United States Patent 8,541,208 (PROCESS FOR THE PRODUCTION OF FINE CHEMICALS) - sequence listing, part 9

SEQ ID NO: 38095 - protein, 39 aa, consensus
  MISC_FEATURE (1)..(39): consensus for the disclosure of xaa see table XV
XXXXXXXXXXXXXXXXXXXXXXXXXXXXXXXXXXXXXXX

SEQ ID NO: 38096 - protein, 46 aa, consensus
  MISC_FEATURE (1)..(46): consensus for the disclosure of xaa see table XV
XXXXXXXXXXXXXXKXXXXXXXXXXXXXXXXXXXXXXXXXXXGXXX

SEQ ID NO: 38097 - DNA, 573 bp, Saccharomyces cerevisiae
  CDS (1)..(573)
atgtccggtaaatggagactagtgctgaccgggataggcaatccagagcctcagtacgctggtacccgtcacaatgtagggctatatatgctggagctgctacgaaagcggcttggtctgcaggggagaacttattcccctgtgcctaatacgggcggcaaagtgcattatatagaagacgaacattgtacgatactaagatcggatggccagtacatgaatctaagtggagaacaggtgtgcaaggtctgggcccggtacgccaagtaccaagcccgacacgtagttattcatgacgagttaagtgtggcgtgtggaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatag

SEQ ID NO: 38098 - protein, 190 aa, Saccharomyces cerevisiae
MSGKWRLVLTGIGNPEPQYAGTRHNVGLYMLELLRKRLGLQGRTYSPVPNTGGKVHYIEDEHCTILRSDGQYMNLSGEQVCKVWARYAKYQARHVVIHDELSVACGKVQLRAPSTSIRGHNGLRSLLKCSGGRVPFAKLAIGIGREPGSRSRDPASVSRWVLGALTPQELQTLLTQSEPAAWRALTQYIS

SEQ ID NO: 38099 - DNA, 579 bp, Aquifex aeolicus
  CDS (1)..(579)
atggacattaaactagtagtaggtttaggaaatccggggaaggagtacgagaaaacccggcataatgtcggttttatggtaatagacgaacttgtaaaggctcttagggcaaaggggccctttgaggaggccctttcccacgtttacaaagcccgtatcggaggaaaagaagtaatactcgcaaagcccatgacttacatgaacaactcgggggctgcagtttacaacctcctcgaagagtacaaactatcacccgagcagatgatagtggtctacgacgaccttgatcttcccttagggcatatgagacttaggttaaaagggagttcaggaggacacagaggcgttgagtccataataaagtacataggaacacagaactttccccgtttgaggataggtataggaagaccgaagaagaaggaagacgttgttaagtacgtcctttcccccttttcacccgaggaagaaaaggtaatttctcaggtcattaaaaaagctgtaaggtgtttaatgagggcgatagaaatttcccccgagcacgcaatggagtactgcaacagacaggatttaatttaa

SEQ ID NO: 38100 - protein, 192 aa, Aquifex aeolicus
MDIKLVVGLGNPGKEYEKTRHNVGFMVIDELVKALRAKGPFEEALSHVYKARIGGKEVILAKPMTYMNNSGAAVYNLLEEYKLSPEQMIVVYDDLDLPLGHMRLRLKGSSGGHRGVESIIKYIGTQNFPRLRIGIGRPKKKEDVVKYVLSPFSPEEEKVISQVIKKAVRCLMRAIEISPEHAMEYCNRQDLI

SEQ ID NO: 38101 - DNA, 576 bp, Mycobacterium tuberculosis
  CDS (1)..(576)
atggccgagccgttgctcgtggtcggcctcggcaaccctggagccaattacgcccgtacccggcacaacctcgggttcgtggtcgccgatctgctcgccgcgcgactaggcgcgaagttcaaggcacacaagcgttccggcgccgaagtcgccactggtagatcagccgggcgctccctggttttggccaagccgcgctgctacatgaacgagtccggccgccagatagggccgctggcgaagttctactcggtggcgccggccaacatcatcgtcatccacgacgaccttgacctcgagttcggccgcatccggctcaagatcggcggcggcgaaggcggccacaacgggttgcgctcggtggtggccgcgctgggtaccaaagactttcagcgggtgcgtatcgggatcggccgcccgcccggccgcaaggacccggcggcgtttgtgttggagaactttaccccggccgagcgcgccgaggtccccacgatctgcgagcaggccgccgatgccaccgagctgcttatcgaacagggcatggagcccgcacaaaaccgcgtccacgcctggtaa

SEQ ID NO: 38102 - protein, 191 aa, Mycobacterium tuberculosis
MAEPLLVVGLGNPGANYARTRHNLGFVVADLLAARLGAKFKAHKRSGAEVATGRSAGRSLVLAKPRCYMNESGRQIGPLAKFYSVAPANIIVIHDDLDLEFGRIRLKIGGGEGGHNGLRSVVAALGTKDFQRVRIGIGRPPGRKDPAAFVLENFTPAERAEVPTICEQAADATELLIEQGMEPAQNRVHAW

SEQ ID NO: 38103 - DNA, 612 bp, Nostoc sp. PCC 7120
  CDS (1)..(612)
atgattccccagctaattgttgggttggggaacccagagcctaaatatgaccaaactcgccacaatatcggctttgcagctgtggatgctcttgctcgtgcttggaatatttccttggctgaaaatcgcaaatttcagggtcaatacggtgaaggtactgcccctggaggtgtaaaaattcgcttgcttaagccactaacttatatgaatcgctcaggacaggcgatacaagcagtaacaagctggtataaattgtcaggtgaatctgtgttagtgatttatgatgatctagacttgcctttgggtaagactcgtctgcgtttgtctgggtcggctgggggacataatggcatgaagagtgcgatcgctcatcttagcacgcaaaatttcccccgcttacgtattggtataggtaagccgaaaaatgcagtgaatggcgataactcagaaacagtttctcatgtgttaggaaaattttccgccaccgagactcaacttatgtcccttgtcttacagttcgtagttgaatgtgtagaattgagcctcaaacaaggcgtagaaaaggcgatgaatcgctgcaatagttgtactgtcgaggctcctaaatcttaa

SEQ ID NO: 38104 - protein, 203 aa, Nostoc sp. PCC 7120
MIPQLIVGLGNPEPKYDQTRHNIGFAAVDALARAWNISLAENRKFQGQYGEGTAPGGVKIRLLKPLTYMNRSGQAIQAVTSWYKLSGESVLVIYDDLDLPLGKTRLRLSGSAGGHNGMKSAIAHLSTQNFPRLRIGIGKPKNAVNGDNSETVSHVLGKFSATETQLMSLVLQFVVECVELSLKQGVEKAMNRCNSCTVEAPKS

SEQ ID NO: 38105 - DNA, 753 bp, Brucella melitensis
  CDS (1)..(753)
atgctgctcatcgcaggtcttggcaatccgggtccccaatatgcgcataaccggcacaatatcggtttcatggcggcggatgaaatattccgccgccatcgcttttccaactggcagaagaaatttcaggcagagatcgccgatggcgtgatcgacggcgagaaagtgttgctggtcaaaccgcagactttcatgaacctttccggccagtctatcggcgaggccatgcgcttctacaagctgacgcctgccgatctcgtcgtgatctatgatgaactggacctcgttccgggcaagctgcgcatcaagaccggcggcggttccggcggccataacggcatcaaatccatcgacgcacatatgcagtccttccccggcggacagaattatcgccgcatgcggcttggcatcggccatcccggcgcgaaggaactcgtgcataattatgttctgggcgatttcgccaaggccgacaatgaatggctggatacgcttatgggcgccgtcgccgacaatgtcgccatgcttgccagacgcgaggataacagcttcatgaaccgcattgcactcgccatgggcgacggcaatcagcggccaggcggcgtcaagacagatcccgcgcaattggagaaggctccgccaaaggcccagagccatattcgtcaggcgcgccagaaccagaaaaagcccaatattcccgaaagcggcccgatggctgaaatgctgaaaaagctgctggggaagaaggattaa

SEQ ID NO: 38106 - protein, 250 aa, Brucella melitensis
MLLIAGLGNPGPQYAHNRHNIGFMAADEIFRRHRFSNWQKKFQAEIADGVIDGEKVLLVKPQTFMNLSGQSIGEAMRFYKLTPADLVVIYDELDLVPGKLRIKTGGGSGGHNGIKSIDAHMQSFPGGQNYRRMRLGIGHPGAKELVHNYVLGDFAKADNEWLDTLMGAVADNVAMLARREDNSFMNRIALAMGDGNQRPGGVKTDPAQLEKAPPKAQSHIRQARQNQKKPNIPESGPMAEMLKKLLGKKD

SEQ ID NO: 38107 - DNA, 591 bp, Yersinia pestis
  CDS (1)..(591)
atgagtagcattaaattaatcgttgggctggcaaatccgggcgcagaatatgcccaaacccgccataatgcgggagcctggtatgtagatttattggctgaacgccacaatcagtccctgaaagaagagagtaaattctttggttataccgcacggttaaatctggcaggccaagatatccgtttattggtacccgccacgtttatgaatctcagtggtaaagccgtcgcggcgatggccagtttttaccgcattctgccggaagagattctagtcgcccacgatgagctggatattttaccggggatggcaaaattaaaactgggaggaggcaacggcggccataatggtctgaaagacattcagaacaaattaggtaataaccctaatttttaccgcttacgcatcggtattggtcatcctggtgataaaagcaaagtcactggctttgttttgggtaaaccccccgctagcgaacaaacgttgatagacgatgccattgacgagtctatccgctgcactgaagtgctactcaatgaaggcatgaccaaagcaatgaaccgcctgcacgcttttaaggccagcgcatag

SEQ ID NO: 38108 - protein, 196 aa, Yersinia pestis
MSSIKLIVGLANPGAEYAQTRHNAGAWYVDLLAERHNQSLKEESKFFGYTARLNLAGQDIRLLVPATFMNLSGKAVAAMASFYRILPEEILVAHDELDILPGMAKLKLGGGNGGHNGLKDIQNKLGNNPNFYRLRIGIGHPGDKSKVTGFVLGKPPASEQTLIDDAIDESIRCTEVLLNEGMTKAMNRLHAFKASA

SEQ ID NO: 38109 - DNA, 609 bp, Salmonella enterica subsp. enterica serovar Typhi
  CDS (1)..(609)
atggatctactcaggacaaaaaacgtggcaattaaattgattgttggtctggcgaatcccggtgcggaatatgccgcgacgcgacacaatgcaggcgcatggtacgtcgatttactggcggagcgcctgcgcgcgccgttgcgtgaagagcctaaattctttggctatacctcacgcatcacgctggaaggggaagatgttcgcctgctggtacccaccacgttcatgaacctcagtggtaaagcagttggcgcaatggccagtttttaccgtattcagccggacgaaattttggtcgctcacgacgagctggatctccctccgggcgtcgcgaaatttaaacttggcggcggccacggcggccacaatggtctgaaagacatcatcagcaagctgggcaataatcccaactttcaccgattacgcgttggaattggtcatccaggcgataaaaataaagttgttggtttcgtgctgggtaaaccccctgtttctgaacaaaaattaattgatgaggccattgacgaagcggcacgctgtacggaattgtggttcaaagagggtctggccaaagcaacaagccgtttgcatacctttaaggcgcaataa

SEQ ID NO: 38110 - protein, 202 aa, Salmonella enterica subsp. enterica serovar Typhi
MDLLRTKNVAIKLIVGLANPGAEYAATRHNAGAWYVDLLAERLRAPLREEPKFFGYTSRITLEGEDVRLLVPTTFMNLSGKAVGAMASFYRIQPDEILVAHDELDLPPGVAKFKLGGGHGGHNGLKDIISKLGNNPNFHRLRVGIGHPGDKNKVVGFVLGKPPVSEQKLIDEAIDEAARCTELWFKEGLAKATSRLHTFKAQ

SEQ ID NO: 38111 - DNA, 561 bp, Thermotoga maritima
  CDS (1)..(561)
atggttgttgttggtctggggaatccaggcccacgttatgccttcacccggcataacgtgggttttctgtttctggactttttgaaaaacaaagactggaaaactgaaaaatatttcgcgtggaacaaaattaacctggctggaaatgaagtggctctggtgaaaccattgacctatatgaacctcagcggtttggcgatgccccacgttttgaaattcttcagcgccagtctggatgatataatagtggtgtacgatgacgtgagtttgaaactcgggaagatccgcatcaggaagaaaggttccgacggtgggcacaacggcatgaaatccattatacaggcgcttggaacacaggagataaaacgtataagggtaggaataggcgataaaccagaaggaatggatcttgtaaatttcgtgctgggagaattctcagacgaggagtggattatacttaacaaagtgtttgaagtaatgaaagaagcccttgaggtgattctcgtcgaaggaatagaaaaagcaatgtctatctacaattccttagaggtgagagcatga

SEQ ID NO: 38112 - protein, 186 aa, Thermotoga maritima
MVVVGLGNPGPRYAFTRHNVGFLFLDFLKNKDWKTEKYFAWNKINLAGNEVALVKPLTYMNLSGLAMPHVLKFFSASLDDIIVVYDDVSLKLGKIRIRKKGSDGGHNGMKSIIQALGTQEIKRIRVGIGDKPEGMDLVNFVLGEFSDEEWIILNKVFEVMKEALEVILVEGIEKAMSIYNSLEVRA

SEQ ID NO: 38113 - DNA, 648 bp, Deinococcus radiodurans
  CDS (1)..(648)
atgaaactgatcgtaggtctgggcaatcccggcgaaaagtacgcgcagacccggcacaacgtgggctggctggtcgtggacgaactcgcgcggcgggccggaggaagctggcgcaaggacggcgaggccgaggtctgcgaagtgcggctgggtacggcgcccggcgagaaggtgctgctcgtcaagccccagacctttatgaacacctcgggcaaggcggtttggccgctgatgtcgttctacaaactggagggcgagcagcttctcgtcgtgcaggacgacctcgacagccccttcggcctgctgcgctttcgcctgggcgggcggcacggcggccaaaacggagtgcgcgacatcatcgcccggctgggctacgaccgctttccccggctcaaaatcggcatttcccgcccccccgctggccgtgaccccgccgactgggtgctgagcaagtggcgcgacgaggaacgcgaaacgctcgccgaactcgtgcgcctcggggttggcgcggcggagctgtgggcggtgcagggactcgccgaagcgcagcagatgtacaacggcaccgacctgcgcccccagccgcctgccccgccagccgccccggcaccggcagcggacggggcaccgggtgacgctcaagactga

SEQ ID NO: 38114 - protein, 215 aa, Deinococcus radiodurans
MKLIVGLGNPGEKYAQTRHNVGWLVVDELARRAGGSWRKDGEAEVCEVRLGTAPGEKVLLVKPQTFMNTSGKAVWPLMSFYKLEGEQLLVVQDDLDSPFGLLRFRLGGRHGGQNGVRDIIARLGYDRFPRLKIGISRPPAGRDPADWVLSKWRDEERETLAELVRLGVGAAELWAVQGLAEAQQMYNGTDLRPQPPAPPAAPAPAADGAPGDAQD

SEQ ID NO: 38115 - DNA, 585 bp, Haemophilus influenzae
  CDS (1)..(585)
atgtcagaaataaaacttattgttggtttaggcaaccctggcgataaatatacagatacacgccacaatgcaggcgaatggcttattgaacgcttggctcgtcgttttaacgtttcactaaatccagaaagtaaattcttcggaaaaactgcccgcactttagtgaatggaaaagaagtacgccttttagtgccaacaacttttatgaatttaagcggtaaagcagttggcgcattggcaagtttttaccgtattaaacctgaagaaattttagtgattcatgatgaattagatttaccaccaggcactgcgaaactcaaacaaggcggtggacatggtgggcataacggcttaaaagatattgtggctcaattaggcaataacaataatttctaccgtttacgtattggcattgggcatcctggccatcgtgatttagtggcaggttatgtcttaaataaaccatctccagcagatcgcgatgcacttgaaaaagtgctagatgaagccactgattgtgtagaaatgattttcagagatggaatggtcaaagcgaccaatcgtttaaacagttttaaaatttaa

SEQ ID NO: 38116 - protein, 194 aa, Haemophilus influenzae
MSEIKLIVGLGNPGDKYTDTRHNAGEWLIERLARRFNVSLNPESKFFGKTARTLVNGKEVRLLVPTTFMNLSGKAVGALASFYRIKPEEILVIHDELDLPPGTAKLKQGGGHGGHNGLKDIVAQLGNNNNFYRLRIGIGHPGHRDLVAGYVLNKPSPADRDALEKVLDEATDCVEMIFRDGMVKATNRLNSFKI

SEQ ID NO: 38117 - DNA, 567 bp, Bacillus subtilis
  CDS (1)..(567)
atgcttgtgattgccggtctcggaaacccggggaagaactatgaaaatacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacgtccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataa

SEQ ID NO: 38118 - protein, 188 aa, Bacillus subtilis
MLVIAGLGNPGKNYENTRHNVGFMVIDQLAKEWNIELNQNKFNGLYGTGFVSGKKVLLVKPLTYMNLSGECLRPLMDYYDVDNEDLTVIYDDLDLPTGKIRLRTKGSAGGHNGIKSLIQHLGTSEFDRIRIGIGRPVNGMKVVDYVLGSFTKEEAPEIEEAVDKSVKACEASLSKPFLEVMNEFNAKV

SEQ ID NO: 38119 - DNA, 591 bp, Vibrio cholerae
  CDS (1)..(591)
atgagtcaaccaatcaaactccttgtcggactggccaatcctgggccggaatacgcgaaaacacgccataatgcaggtgcttgggttgtcgaagagttagcccgtatccataacgtcacgctcaaaaatgagccgaagttttttggtctgaccggacgtttgttgattaacagccaagagttacgcgtgttaatccccaccactttcatgaatctctccggcaaagcgattgctgcactggccaatttctatcagatcaagccagaagagatcatggttgcccacgatgagctagacttaccacccggtgtggcaaaatttaagcaaggtggcggacatggcgggcataatgggctcaaagacaccataagcaaattaggcaacaacaaagaattctatcgtctacggcttggcatcggccatccgggacataaagacaaagtagccggttatgtactaggcaaagctcccgctaaagagcaagaatgccttgatgccgcagtggatgaatccgttcgctgccttgagatcctcatgaaggatggcctcaccaaagcacaaaatcgtttacacactttcaaagctgaataa

SEQ ID NO: 38120 - protein, 196 aa, Vibrio cholerae
MSQPIKLLVGLANPGPEYAKTRHNAGAWVVEELARIHNVTLKNEPKFFGLTGRLLINSQELRVLIPTTFMNLSGKAIAALANFYQIKPEEIMVAHDELDLPPGVAKFKQGGGHGGHNGLKDTISKLGNNKEFYRLRLGIGHPGHKDKVAGYVLGKAPAKEQECLDAAVDESVRCLEILMKDGLTKAQNRLHTFKAE

SEQ ID NO: 38121 - DNA, 579 bp, Xylella fastidiosa
  CDS (1)..(579)
atgttagggttgcgtttgatagttgggctcggcaatccgggtagcgagcacaccaaaacccggcacaatgccgggtttcgctttgttgatggtttagttcagcgtgaggggcagcgctggatgttggagtctaagttgtttgctcacgttgctcgtgtatttatcgctgggcagtgggtatggttattacgcccagtcacttttatgaatttgagcggcaagtcgatttgtgcaggtttgagtttttggaagattaaaccggagcagatgttggttgctcacgatgagttggattttccgccgggggctgtgcgcttgaagtttgatggtggtcatggtggtcagaatgggttgcgtgatattaccaagttgcttggtcacggacgttttcatcggctgcgtgtaggtattggtcatcctggtcataaagatcgtgtggtgaattgggtgctaggttgtccaacgtgcgaagaaaatattgctatcgacgctgctttggaacgagccagtgcagtgttacctttagtggttgctggtgactttgatgaggcgatgaaaaagctacatacggtggtgtga

SEQ ID NO: 38122 - protein, 192 aa, Xylella fastidiosa
MLGLRLIVGLGNPGSEHTKTRHNAGFRFVDGLVQREGQRWMLESKLFAHVARVFIAGQWVWLLRPVTFMNLSGKSICAGLSFWKIKPEQMLVAHDELDFPPGAVRLKFDGGHGGQNGLRDITKLLGHGRFHRLRVGIGHPGHKDRVVNWVLGCPTCEENIAIDAALERASAVLPLVVAGDFDEAMKKLHTVV

SEQ ID NO: 38123 - DNA, 756 bp, Agrobacterium tumefaciens
  CDS (1)..(756)
atgacaacagcatcatcaggcaaaacgcggacatgccccatgaagatcatcgcaggacttggtaatcccggcgcacaatatgcgggaaaccgtcacaatatcggcttcatggccgtggatgcgctgcagcgcctgccctcttttgcgccctggtcgaagaagttcaaggcggagatttccgaaggtgagatcggcggcgagaaggttctgctgatgaaaccgctcacctatatgaacctgtcaggcgaatccgtcggcgaggccatgcgtttcttcaaactgacgccggccgacatcatcgccatccatgacgaactcgatttgctggccggccgcacacgcatcaagatcggcggcggccacggcggtcataacggccttaaatcgctcgacgcccattgcggcaaggaataccgccgtctgcgcctcggcatcggccatcccggtgacaaggagcgggtgcacggccatgtgctcggcgatttcgccaagtcggaccgcgtctggctcgatccgctgctggacgccattgccgacaacgccgccatgctggtgaagggtgacgattcgcagctgatgaacaagctggcgctggcgacgggcagcaaaccggaagcggaaaaaccggtaaaggtcgccaagccggccgcgcagtcccacatccaccaggcgcgcaacagcgcccagccgaaaaagctgccggaaaccggaccaatggccgagatgctgaagcgaatgttcggcaagaaggactaa

SEQ ID NO: 38124 - protein, 251 aa, Agrobacterium tumefaciens
MTTASSGKTRTCPMKIIAGLGNPGAQYAGNRHNIGFMAVDALQRLPSFAPWSKKFKAEISEGEIGGEKVLLMKPLTYMNLSGESVGEAMRFFKLTPADIIAIHDELDLLAGRTRIKIGGGHGGHNGLKSLDAHCGKEYRRLRLGIGHPGDKERVHGHVLGDFAKSDRVWLDPLLDAIADNAAMLVKGDDSQLMNKLALATGSKPEAEKPVKVAKPAAQSHIHQARNSAQPKKLPETGPMAEMLKRMFGKKD

SEQ ID NO: 38125 - DNA, 558 bp, Rickettsia conorii
  CDS (1)..(558)
atgcttcttgttattggtcttggtaatccaggaaaagagtatcaatatacgaggcataatgtcggctttattgctatagagaaaatagtaaaccaatataattcatcatttagtacaaagaaaaaattcaattgtgaaattgctgaaactattagtgatggacaaaagataatttttataaagcctaccacctatatgaacttgtccggtaagtcagtgatatcggtgaaaacatattataatatctaccccgcaaaaatctttgttattcatgatgatattgatttagaaacaggtagaataaaatttaaaactggtggcggtaatggcgggcataatggtttaaagtcgattgatggggttataggtaataattataaccggattaggattggagtcggtagaccgcaaaataatcagggtgtagcagattacgtacttaatcatttctctaaaccggagtatgaaacagtaatgcaagctatagatagaatcactagtaactttggtttaatattagagaataagttagaagaatttaagaataagatagcttga

SEQ ID NO: 38126 - protein, 185 aa, Rickettsia conorii
MLLVIGLGNPGKEYQYTRHNVGFIAIEKIVNQYNSSFSTKKKFNCEIAETISDGQKIIFIKPTTYMNLSGKSVISVKTYYNIYPAKIFVIHDDIDLETGRIKFKTGGGNGGHNGLKSIDGVIGNNYNRIRIGVGRPQNNQGVADYVLNHFSKPEYETVMQAIDRITSNFGLILENKLEEFKNKIA

SEQ ID NO: 38127 - DNA, 558 bp, Bacillus halodurans
  CDS (1)..(558)
atgaagctaatcgtcggtttaggaaaccctggtgctaaatatgatggcacgaggcataatgtcggttttgatgtagtagatgccgtcgctcgccgcttgaatattgagatcaagcagtcgaaagcgaacggactttatggggaaggtcgaatcgatggagaaaagatctttttgttaaagccccagacttttatgaatcgatcaggagaatcggtccgcccattccttgaatactataacatggaggtggaagacctactcgtgatttatgatgatttagatttgccagtaggtaaaatccgccttcgtcaaaaaggaagcgctggtggccacaatgggatgaaatctttgatcgctcacctaggcacgagtgattttaaacgaattcgtgtcggtgtcgacaggccggcaccaggagaaacggtcgttcagcacgtgcttgggcgctatcgcccagaggaaaaggacgccatctcggaggcgattgatctctcggcagaggcagcagaagcttttacaaagaaaccatttcttgaagtgatgaatacatttaattaa

SEQ ID NO: 38128 - protein, 185 aa, Bacillus halodurans
MKLIVGLGNPGAKYDGTRHNVGFDVVDAVARRLNIEIKQSKANGLYGEGRIDGEKIFLLKPQTFMNRSGESVRPFLEYYNMEVEDLLVIYDDLDLPVGKIRLRQKGSAGGHNGMKSLIAHLGTSDFKRIRVGVDRPAPGETVVQHVLGRYRPEEKDAISEAIDLSAEAAEAFTKKPFLEVMNTFN

SEQ ID NO: 38129 - DNA, 567 bp, Lactococcus lactis subsp. lactis
  CDS (1)..(567)
atgacaaaaatgattgttggcttgggaaacccaggcgataaatatgaaaaaacaaaacataatatgggctttatggcacttgatttactggcaaaagaactgaatgttgattttaaagaagaaaaaccttttatgtcgcttgtcgcgtcaacgtttgtgaatggtgaaaaattgtttctcgtgaaacctctgacttttatgaatgaatctgggcggtcggtggcgccacttttgaaatattataatatagacgaagcagatttaacggtcatgcatgatgacttggattcaccagtcgggcgcgtgcgtctaagacaaaaagggtcatcaggtggacaaaatggaataaaatcagtcattacacatgtgggaagtcaaacttttaaccgtgtaaaaattgggattggccgtccaaaacatgggatgacagttgggaatcatgtactctctggttttgacaatgaagataaggaaatcgctcaagatggaattttcaaagctgttgatgcaatgaaattctatcttgaaaatggtgattttcaaaagacaatgaataaatttaactaa

SEQ ID NO: 38130 - protein, 188 aa, Lactococcus lactis subsp. lactis
MTKMIVGLGNPGDKYEKTKHNMGFMALDLLAKELNVDFKEEKPFMSLVASTFVNGEKLFLVKPLTFMNESGRSVAPLLKYYNIDEADLTVMHDDLDSPVGRVRLRQKGSSGGQNGIKSVITHVGSQTFNRVKIGIGRPKHGMTVGNHVLSGFDNEDKEIAQDGIFKAVDAMKFYLENGDFQKTMNKFN

SEQ ID NO: 38131 - DNA, 600 bp, Mycobacterium leprae
  CDS (1)..(600)
atggccgaacccacattggccagcgggtggtacccccggttggtggtcggcctaggcaaccccggcaaaaactatggccgtacccgacacaacgttgggtttatggttgccaacctgctcgctgtgcgactgggctcgaaattcgaggtgcataagcgttctggcgctgacgtcgtcaacggccgtctggcggggtgttcgatgttggtggccaagccacgcaactacatgaacgagtctggccagcaggtggggctactagcgaaattatactcggtaacccccgcggacatcatcatcgtccacgacgacctcgacctcgacttcggtcgtatccggctcaaactcggcggcggcgagggtggccacaacgggctgcgctcggtggcggccgcgttgggtaccaaagactttcagcgggtgcgcatcgggattggtcgtccgactggccgcaaagatccggcgtcgtttgtgttggagaacttcaccactgccgaacgcatgcaggttcccaccatctgcaagcgggccgccgacgccaccgaattgttggtcggattgggcctagagcccgcacagaaccacgtgcacgcctggtag

SEQ ID NO: 38132 - protein, 199 aa, Mycobacterium leprae
MAEPTLASGWYPRLVVGLGNPGKNYGRTRHNVGFMVANLLAVRLGSKFEVHKRSGADVVNGRLAGCSMLVAKPRNYMNESGQQVGLLAKLYSVTPADIIIVHDDLDLDFGRIRLKLGGGEGGHNGLRSVAAALGTKDFQRVRIGIGRPTGRKDPASFVLENFTTAERMQVPTICKRAADATELLVGLGLEPAQNHVHAW

SEQ ID NO: 38133 - DNA, 570 bp, Streptococcus pneumoniae
  CDS (1)..(570)
atgaccaaattacttgtaggcttgggaaatccaggggataaatattttgaaacaaaacacaatgttggttttatgttgattgatcaactagcgaagaaacagaatgtcacttttacacacgataagatatttcaagctgacctagcatcctttttcctaaatggagaaaaaatttatctggttaaaccaacgacctttatgaatgaaagtggaaaagcagttcatgctttattaacttactatggtttggatattgacgatttacttatcatttacgatgatcttgacatggaagttgggaaaattcgtttaagagcaaaaggctcagcaggtggtcataatggtatcaagtctattattcaacatataggaactcaggtctttaaccgtgttaagattggaattggaagacctaaaaatggtatgtcagttgttcatcatgttttgagtaagtttgacagggatgattatatcggtattttacagtctattgacaaagttgacgattctgtaaactactatttacaagagaaaaaatttgagaaaacaatgcagaggtataacggatag

SEQ ID NO: 38134 - protein, 189 aa, Streptococcus pneumoniae
MTKLLVGLGNPGDKYFETKHNVGFMLIDQLAKKQNVTFTHDKIFQADLASFFLNGEKIYLVKPTTFMNESGKAVHALLTYYGLDIDDLLIIYDDLDMEVGKIRLRAKGSAGGHNGIKSIIQHIGTQVFNRVKIGIGRPKNGMSVVHHVLSKFDRDDYIGILQSIDKVDDSVNYYLQEKKFEKTMQRYNG

SEQ ID NO: 38135 - DNA, 564 bp, Clostridium acetobutylicum
  CDS (1)..(564)
atgtttttaatagtgggacttggaaatccaggtttaaaatatgagcatacaaggcataacatgggttttgatgccattgaaaatattgcagctaagcacaatataagtatagataaaaaaggttttaaaggtttatacggaaaaggaattatagatggtgaaaaagtaattttattaaaaccgtatacatacatgaatttaagtggagaaagtgtggtagaggctgcaaattattataaaattaacaaggaaaatatagttgtaatatatgatgatataagtcttgatgttggaaaaataagaataagaaccaaaggaagtgcaggaggacacaatggcataaaaaacatagtgcttcacttatcctctgaagagtttcctagagtaaaggtaggggtaggtgaacctactgaaaaccttgtgaattatgttttgggaaaatttagtcaagatgaaagaaagaagatagaagaagttttaaatatagttacagaagcagttgaatgtatggtagtagatggtgtacaaaatgctatgaataaatttaacggcttaaagttataa

SEQ ID NO: 38136 - protein, 187 aa, Clostridium acetobutylicum
MFLIVGLGNPGLKYEHTRHNMGFDAIENIAAKHNISIDKKGFKGLYGKGIIDGEKVILLKPYTYMNLSGESVVEAANYYKINKENIVVIYDDISLDVGKIRIRTKGSAGGHNGIKNIVLHLSSEEFPRVKVGVGEPTENLVNYVLGKFSQDERKKIEEVLNIVTEAVECMVVDGVQNAMNKFNGLKL

SEQ ID NO: 38137 - DNA, 609 bp, Treponema pallidum subsp. pallidum (syphilis spirochete)
  CDS (1)..(609)
atgggcatacaacttatagtgtttttaggaaatcctggtgcagagtacgaagaaacgcggcacaatgctgcatggttgcttttaacgtaccttttcccatccatcgtgcttccttggcgatgcggatgtcgggggtcgattgcgcgtattgaagggtttgaagggtcaagcgaagaagtttggcttttgaaaccgctgacttatatgaaccgttctgggaaaagcgtaggggcagcatgtgcctttttgcagacggatgcgaagcagctcttagtagtgcacgatgaattagaattaccgttcggtgtggtgagtttaaaacaaggcggagggcttggaggacacaatgggttgcgctctatcaaggaagtgcttggtaccgcagatttttggcggttgcgcataggcatcgggcgtccacccagtgagagtgtgaatatagcgcagtacgtcctctctgccttttacccggcagagatggctgcattcccaaagctggggcgtgccacgcgagatcttctgtgtcagcttgtagtaacagatcaggcagcgacagtcaccttactcagtgcgtggagaaaaaaacggttgctgtctttatgcgaataa

SEQ ID NO: 38138 - protein, 202 aa, Treponema pallidum subsp. pallidum (syphilis spirochete)
MGIQLIVFLGNPGAEYEETRHNAAWLLLTYLFPSIVLPWRCGCRGSIARIEGFEGSSEEVWLLKPLTYMNRSGKSVGAACAFLQTDAKQLLVVHDELELPFGVVSLKQGGGLGGHNGLRSIKEVLGTADFWRLRIGIGRPPSESVNIAQYVLSAFYPAEMAAFPKLGRATRDLLCQLVVTDQAATVTLLSAWRKKRLLSLCE

SEQ ID NO: 38139 - DNA, 585 bp, Pseudomonas aeruginosa
  CDS (1)..(585)
atgactgccgtacaactgatcgttggcctgggaaacccgggtcctgaatacgaccagacccggcataacgcgggggcccttttcgttgagcgcctggcgcatgcccagggcgtcagcctcgtggctgaccgcaagtatttcggcctggtcggcaagttcagccaccagggcaaggacgttcgtctgttgatcccgaccacctacatgaaccgcagcggccagtccgtggcggcgctggcgggattcttccggatcgccccggacgccatcctggtggcccacgacgaactcgacatgccccctggcgtcgccaagctcaagaccggcggcggacacggcgggcacaacgggttgcgcgacatcatcgcccagctcggcaatcagaattctttccatcgcctgcggcttggcatcggccatccggggcacagcagcctggtttccggttacgtgctcggccgcgccccgcgcagcgagcaggaactgctcgacaccagcatcgacttcgccctcggcgtgctgccggaaatgctcgccggggactggacccgggcgatgcagaagctgcacagccagaaggcctga

SEQ ID NO: 38140 - protein, 194 aa, Pseudomonas aeruginosa
MTAVQLIVGLGNPGPEYDQTRHNAGALFVERLAHAQGVSLVADRKYFGLVGKFSHQGKDVRLLIPTTYMNRSGQSVAALAGFFRIAPDAILVAHDELDMPPGVAKLKTGGGHGGHNGLRDIIAQLGNQNSFHRLRLGIGHPGHSSLVSGYVLGRAPRSEQELLDTSIDFALGVLPEMLAGDWTRAMQKLHSQKA

SEQ ID NO: 38141 - DNA, 585 bp, Synechocystis sp
  CDS (1)..(585)
atgattcccaagttaattgtgggtttgggtaaccctgagccgaaatatgatcaaactcgccacaacattggttttgcggtggtggatgcgttggcgatcacctggcagtgttcttggtatgaccataagcgcttccagggctggtttggcgaagggctaatggccggacaaaaaacctgtttgctcaaaccccgtacctatatgaatcgctctggccaagctgtgcgggcggtggtggactggtacaaactcgacccccagtcggtgctggtggtctatgacgatatggatttacccctgggccgattacgcctgagacaaacgggttccgccgggggccataacgggatgaaatccctgattagtcatttgggcacccaggattttccccgcctccggttaggcattggcaaaagtgacggcagtaaagacaccatcgcccatgtgctaggcaaatttagcccgtcggaattacccatcgtcgagaaaagcttagacctggccacggaggcgatcgcccatagtctgcaccatggcattgccaaaaccatgagtttatttaataatcgtgacgtctgcccttag

SEQ ID NO: 38142 - protein, 194 aa, Synechocystis sp
MIPKLIVGLGNPEPKYDQTRHNIGFAVVDALAITWQCSWYDHKRFQGWFGEGLMAGQKTCLLKPRTYMNRSGQAVRAVVDWYKLDPQSVLVVYDDMDLPLGRLRLRQTGSAGGHNGMKSLISHLGTQDFPRLRLGIGKSDGSKDTIAHVLGKFSPSELPIVEKSLDLATEAIAHSLHHGIAKTMSLFNNRDVCP

SEQ ID NO: 38143 - DNA, 657 bp, Schizosaccharomyces pombe
  CDS (1)..(657)
atggcaataaaacatcttcctaagattttaattgccaggaaaaacaaagcagaagttaaccattgcgaccttaaaagaagagtttctataaaaattatctatggtttaggaaatccaggatcagcgttcgtcaaatcgagacactcactggggaaattaatggtgagtatgtacgctgacagcatggcatttccaaaaaattggcctagtaccaaagaaaatctcaccttggttttgtccacctcatacatgaatgattccgggaaacagttgaaaaagatatctaatgattttgtgcgcaaagtttcgccattagacaaaatcgtatatgtagttgtgcatgacgaattggagttagatttaggcaaagtcaagcttcgtttgcccggaggctctcacaggggacacaatgggattcgctcttgtcaagaattcctaggaaaagaagtaaggtacacatttaatttcattactaattcaaagagtttttacaggattggattgggaattggacgttgtgagtcaaggaatagggaggacgtttcagattatgttttgagtaaattcaactctaatgaaatgaaactaattgaaactgatatattccataagttttgcaacattcttcaacaattacaactttcaattgaaacatag

SEQ ID NO: 38144 - protein, 218 aa, Schizosaccharomyces pombe
MAIKHLPKILIARKNKAEVNHCDLKRRVSIKIIYGLGNPGSAFVKSRHSLGKLMVSMYADSMAFPKNWPSTKENLTLVLSTSYMNDSGKQLKKISNDFVRKVSPLDKIVYVVVHDELELDLGKVKLRLPGGSHRGHNGIRSCQEFLGKEVRYTFNFITNSKSFYRIGLGIGRCESRNREDVSDYVLSKFNSNEMKLIETDIFHKFCNILQQLQLSIET

SEQ ID NO: 38145 - DNA, 723 bp, Arabidopsis thaliana (mouse-ear cress)
  CDS (1)..(723)
atgttgtgcccaacgtatacaccaagtgtttaccattttcaaacgcaaaagccagttttccggaaacagaggtttcgggtttgttcatctacttctggtggtgaggatgatagattcaaagtagagtacactccttggcttatcgttgggttgggcaatccaggaaacaagtatcatggaacaagacacaatgttggtttcgagatgatcgatgtgttggctagaaaagaaggggtgttgatgaacactatacagtccaaagctctaatcggaataggtgctattgaagatgtacctatcttattggctaaacctcagacttatatgaacttcagcggcgaatcggttggatctctagcttcacactatcgagtaccattgcgccacattttaatgatttacgatgagatggctttaccaaatggggttttgagacttcaaccgaaaggaggtcaaggctatcacaacggagtgaagagtgtaatggggcatttggatggtcgtcgaaactttcctcgtttaagcataggcattggtaaaccacctggaaacatggatatgaaagcttttcttcttcagaagtttagtccattggaacagaaacagatcgaggaagcactcgagcaaggaagtgaagcagtgaagactcttgtgcttaatggcttcaatcaaggaatttcgagatttaatcttgtgcagaaatataaattccataaagtatag

SEQ ID NO: 38146 - protein, 240 aa, Arabidopsis thaliana (mouse-ear cress)
MLCPTYTPSVYHFQTQKPVFRKQRFRVCSSTSGGEDDRFKVEYTPWLIVGLGNPGNKYHGTRHNVGFEMIDVLARKEGVLMNTIQSKALIGIGAIEDVPILLAKPQTYMNFSGESVGSLASHYRVPLRHILMIYDEMALPNGVLRLQPKGGQGYHNGVKSVMGHLDGRRNFPRLSIGIGKPPGNMDMKAFLLQKFSPLEQKQIEEALEQGSEAVKTLVLNGFNQGISRFNLVQKYKFHKV

SEQ ID NO: 38147 - DNA, 561 bp, Kluyveromyces lactis NRRL Y
  CDS (1)..(561)
atgagcgctcagaagctattatgtcttagcgctttaggaaacccagaaccgttatatcgaagtacaagacataatgccggagtcattatgttaagaatgcttaagaatgaattttgcccggatgccgtgttgaagacatcaaacgtctcacctcatattcaatattgccatgaacctagattaaatctcttgatgcttttcaacaagtcacagtttatgaacctttctggccatgctatgataccagtttggcgaaagcttccgcacgacgcactacatgtggttttgcacgacgagttgaacataccgattggaaacgtccagttgaggaagcctggcacaagtttcagaggtcataatggtctaagagatatgataaaaatgaaaggcgatgataaatttcacaagctcggtattggcattgatagaccaaattccagagatccaagaattgtagcagattacgtgcttgccaattttacgaaaggagaaatggagacattacagtacgattcctttcagaaggcggtagaacatgtacggaagcttttgccacattaa

SEQ ID NO: 38148 - protein, 186 aa, Kluyveromyces lactis NRRL Y
MSAQKLLCLSALGNPEPLYRSTRHNAGVIMLRMLKNEFCPDAVLKTSNVSPHIQYCHEPRLNLLMLFNKSQFMNLSGHAMIPVWRKLPHDALHVVLHDELNIPIGNVQLRKPGTSFRGHNGLRDMIKMKGDDKFHKLGIGIDRPNSRDPRIVADYVLANFTKGEMETLQYDSFQKAVEHVRKLLPH

SEQ ID NO: 38149 - DNA, 588 bp, Erwinia carotovora subsp
  CDS (1)..(588)
atgagcagcattaaattaattgtcggcctggctaatcctggcgcggaatatgccgccactcgtcataatgcgggtgcctggtttgtcgatcgtctggctgagtcttatcgccagtcgctaaaagaagaaagcaaatttttcggttacacctcccgtctgaacctggctgggcaagatgtacgtctgctggttcccaccacgttcatgaacctaagcggaaaagccgtcgcggcaatggccaccttctaccgcatccagcccgatgaaattctggttgcacacgatgaactggatttattaccggggattgccaaacttaaactgggtggcggacacggcggtcataacgggcttaaagacatcatcagtaaattgggtaataaccctaacttccatcgtttgcgcattggtatcggtcatccgggtgataaaagtaaagtgaccggttttgtgttgggtaagccaccgatgagcgagcagactctgatcgacgaggccattgacgaagccgtgcgctgcacagaaattcttatgaaagaagacatgataaaagcgatgaatcgcttacatgctttcaaagcggcataa

SEQ ID NO: 38150 - protein, 195 aa, Erwinia carotovora subsp
MSSIKLIVGLANPGAEYAATRHNAGAWFVDRLAESYRQSLKEESKFFGYTSRLNLAGQDVRLLVPTTFMNLSGKAVAAMATFYRIQPDEILVAHDELDLLPGIAKLKLGGGHGGHNGLKDIISKLGNNPNFHRLRIGIGHPGDKSKVTGFVLGKPPMSEQTLIDEAIDEAVRCTEILMKEDMIKAMNRLHAFKAA

SEQ ID NO: 38151 - DNA, 582 bp, Acinetobacter sp
  CDS (1)..(582)
atgtcaaaaatttcgctaattgttggtctgggtaatcccggtgcggaatatgcccagacccgtcacaatgcaggtttctggtttgtagaacaacttgcagatcgatacaacattacacttaaaaaagatccaaaatttcatggattcagtggccgtgggcaaattgagggacatgatgttcgtcttttgattccaacaaccttcatgaatcgttctggacaaagtgttgttcccttttcaaaattttatcaaatttctccagaagccattctaattgctcatgatgagcttgatatggacccaggtgtaattcgcttgaaaacaggcggaggccatggcggccataatggtctgcgtgatatcgttccccatattggcgcaaactttcatcgtctacgcattggtattggacatcctggctcaaaagatcgtgtttcaggtcatgtattaggtaaagctccccaaaatgagcagacactcatggaggatgccattcatcatgcactatcaaacaccagacttttagtcgatggtcagattgctcaagccatgaatcaaatcaacgcttacaaaccaaaataa

SEQ ID NO: 38152 - protein, 193 aa, Acinetobacter sp
MSKISLIVGLGNPGAEYAQTRHNAGFWFVEQLADRYNITLKKDPKFHGFSGRGQIEGHDVRLLIPTTFMNRSGQSVVPFSKFYQISPEAILIAHDELDMDPGVIRLKTGGGHGGHNGLRDIVPHIGANFHRLRIGIGHPGSKDRVSGHVLGKAPQNEQTLMEDAIHHALSNTRLLVDGQIAQAMNQINAYKPK

SEQ ID NO: 38153 - DNA, 591 bp, Candida glabrata CBS138
  CDS (1)..(591)
atgaaactcgagaaaagtatcaagtacggaagggcaatgaataaagctagacacttgtgcctcactggcattggcaaccctgagccaagttacaagggcacccgccataacgtgggcctcaccgtgttggacctattgatcaagcaattggtaccgagagatcagcatgtattccgcagagagggtaaagttcatgtactcaggacacctacgataacattcataagatcagatatcggtttcatgaacctcagtggtcgcagtgtggtgcctatgtggcagaaattgtacactgatcacaccgattacgctgtgatccacgatgagctcagcttgaggacaggtgccctgcaactaagacaacctcaggccagtctccgaggccacaatggactccgggatatatcagcacactggcgccaccagtactacaagctggccattggcatcgacagacctgagtcgcgagacccgcaggcggtggccgactacgtactcagtaaagtaccccagcgcgatgccacttacatagagaacactacaacgtctaaggcactcgagctgctgcaaagacagttcccatatatataa

SEQ ID NO: 38154 - protein, 196 aa, Candida glabrata CBS138
MKLEKSIKYGRAMNKARHLCLTGIGNPEPSYKGTRHNVGLTVLDLLIKQLVPRDQHVFRREGKVHVLRTPTITFIRSDIGFMNLSGRSVVPMWQKLYTDHTDYAVIHDELSLRTGALQLRQPQASLRGHNGLRDISAHWRHQYYKLAIGIDRPESRDPQAVADYVLSKVPQRDATYIENTTTSKALELLQRQFPYI

SEQ ID NO: 38155 - DNA, 582 bp, Bartonella quintana
  CDS (1)..(582)
atgtggctcattgctggtcttggcaatcctggtttacagtatcaaaataaccgccataatattggtttcatggttattgatgccatttatcagtccttctccttttctccatggtcgaaaaaatttcaagcagaaatctccaatggtctcatagatggtgaaaaaacttttcttataaaacctcaaactttcatgaacctctctggccaagccatcggtgaagttttacgattttataaattagacttgaaaaattttattgtcatttgcgatgagttggacttacctcccgggaaagtgcgtgtaaaaaccgctggcggaaataatggacacaatggtataaaatccattgatgctcattgtggcactgactactgtcgtgtacgcttagggatcggacatcctggttccaaagaacttgttcatcagcatgttctcggaaactttacgaaatctgatcaagagtggttatctcctctcttagacgcaattgcaaaaaacattgctctccttataaaaggtgatagatgtctttttatggacacaatctcacaagcaacgaaaaacaaaaacctgcaataa

SEQ ID NO: 38156 - protein, 193 aa, Bartonella quintana
MWLIAGLGNPGLQYQNNRHNIGFMVIDAIYQSFSFSPWSKKFQAEISNGLIDGEKTFLIKPQTFMNLSGQAIGEVLRFYKLDLKNFIVICDELDLPPGKVRVKTAGGNNGHNGIKSIDAHCGTDYCRVRLGIGHPGSKELVHQHVLGNFTKSDQEWLSPLLDAIAKNIALLIKGDRCLFMDTISQATKNKNLQ

SEQ ID NO: 38157 - DNA, 708 bp, Oryza sativa
  CDS (1)..(708)
atggcggccgcaggacctgcctgctgtgccccagccgccgccgccgccgccgcctcctcgtcggcttctgcttctgctgctgctgcggctggcgatggcggcggaggagcccagaagccgtggctgctcatcgggctcgggaaccccggcaggatgtacaaggggactcgtcacaacgttggatttgagatgatcgatgctattgcagaagctgagggtatttctgttagcagcaagcaattcaagtcaatggttggtaaaggccttattggtgatgtcccagtaatgcttgccaagccacagacttacatgaatgcaagtggtgagtctgttgcacagctggtttcatattttaagataccactcagtcaagttcttgtgatctatgatgatctagacataccctttgcaaaattgcgcttactgcctaaaggaggacatggcgggcataatgggatgagaagcattattaaccatttgaaacagagccgtgatttcccacgccttaggattggtattgggcgccccactgggaagttggatgctatcggctttgttctaaggtcattcaccaaggaagaacaagaagagcttaatttgacgatcaataggagcttgcaagcagtaaggataatgctactcgaaggattcaacaagggtgcaacttttgtgaacactccacagccatcagaaatgctaaataaatga

SEQ ID NO: 38158 - protein, 235 aa, Oryza sativa
MAAAGPACCAPAAAAAAASSSASASAAAAAGDGGGGAQKPWLLIGLGNPGRMYKGTRHNVGFEMIDAIAEAEGISVSSKQFKSMVGKGLIGDVPVMLAKPQTYMNASGESVAQLVSYFKIPLSQVLVIYDDLDIPFAKLRLLPKGGHGGHNGMRSIINHLKQSRDFPRLRIGIGRPTGKLDAIGFVLRSFTKEEQEELNLTINRSLQAVRIMLLEGFNKGATFVNTPQPSEMLNK

SEQ ID NO: 38159 - DNA, 591 bp, Photobacterium profundum
  CDS (1)..(591)
atgagtaataatattcgtctattagttggcctggctaatcccggtgccgagtatgctaaaacccgccataatgcgggggcatgggtagtacaagaactggctcgagtacacaatgttagcctacgagaagaatcaaaatacttcggtgtaactggcagaatcacaacaaatggacaggatcttcgcttgttgatcccaacaacatacatgaatctatcaggtaaatcggtcgctgctttggcgaatttcttccaaatcaaaccggaagaaatccttattgctcatgacgaactcgatttaccaccaggcgtagctaaatttaaaaaaggcggcgggcatggtggtcataacggcttacgcgacacaataagcaaaatgggtaacaacaaagaattctatcgcttgcgtgttggtattgggcatccaggcgataaaaacaaggttgcaaactttgtgttaggcaaagcaccagtcaaagaacaagaatgtattgatgccgctgttgatgaagcagtccgctgcatggatatcttgttaaaagatggactgaataaagcgcaaaacagactacattcattcaaagctgaataa

SEQ ID NO: 38160 - protein, 196 aa, Photobacterium profundum
MSNNIRLLVGLANPGAEYAKTRHNAGAWVVQELARVHNVSLREESKYFGVTGRITTNGQDLRLLIPTTYMNLSGKSVAALANFFQIKPEEILIAHDELDLPPGVAKFKKGGGHGGHNGLRDTISKMGNNKEFYRLRVGIGHPGDKNKVANFVLGKAPVKEQECIDAAVDEAVRCMDILLKDGLNKAQNRLHSFKAE

SEQ ID NO: 38161 - DNA, 564 bp, Bdellovibrio bacteriovorus
  CDS (1)..(564)
atgtggttgattgttggtcttggcaatccgggtggcgagtacaagctgacccgtcataacatcggctttatggccgtggactttctgatggaaggcctgggaaatcccccgatcaaaaatcagttcaaagccgaaatcgctcaggcgaaaatcaaggaccacccggttatcttttgcaaaccccagacgtacatgaatctgtccggcgaatccgtacaacccctgatgggattttataaaatccctctggaacgcctgatcgtcatccacgacgaaattgaccagccgtttgcgcagatgaaaatccagaaaaaccgtgggcacggcggccataacggcattaaaagcatttcagggctgatgggctcgatggactacacccgactgcgtttgggggtgggtcgcccggccaacccgaatatccccgtgcctgattacgtcctgggtaagttcaccaaggaagagttcgcgcagatgccggatttcctgaacaaagccggcgatgctgtggaaagcatcatcctggatggaattcaaaaagcttcgacaaaattcaacacttag

SEQ ID NO: 38162 - protein, 187 aa, Bdellovibrio bacteriovorus
MWLIVGLGNPGGEYKLTRHNIGFMAVDFLMEGLGNPPIKNQFKAEIAQAKIKDHPVIFCKPQTYMNLSGESVQPLMGFYKIPLERLIVIHDEIDQPFAQMKIQKNRGHGGHNGIKSISGLMGSMDYTRLRLGVGRPANPNIPVPDYVLGKFTKEEFAQMPDFLNKAGDAVESIILDGIQKASTKFNT

SEQ ID NO: 38163 - DNA, 621 bp, Rhodopseudomonas palustris
  CDS (1)..(621)
atgcggctgttcgttgggctgggcaatcccggggcgaagtaccagggcaaccggcacaacatcggcttcatggtcatcgacgaaatcgcgcggcgtcatggcttctcgccatggcgccgtcgttttcagggcgagaccgcagacggtgtgctcgacggcgagcgcatcacactactgaagccgctcacctacatgaacgagtccggccgcgccgtgcaggatgcggccagcttctacaagatcgggcagaacgagatcgccgtgtttcacgacgagatcgagctgccgccggcgaaagttcgcgtgaaggtcggcggcggcatcgccgggcacaacggcctgcgctcgatctcggcgcatatcggcaacgattatcttcgcgtgcggctcggcgtcggccatccgggcgcgaaggagctggtgcacaatcacgtgctcggcgatttcgccaagagcgagcggccctgggtcgaggcgctttgcgagatcgccgcggacaatgccggcctgatcgccaagggtaaggacgcctccttcgccaacaaggtgcatctggcgatgcaggcgaagggattctacgacaacgacaaacaggccaaaggcggcgagcgcgacaagtaa

SEQ ID NO: 38164 - protein, 206 aa, Rhodopseudomonas palustris
MRLFVGLGNPGAKYQGNRHNIGFMVIDEIARRHGFSPWRRRFQGETADGVLDGERITLLKPLTYMNESGRAVQDAASFYKIGQNEIAVFHDEIELPPAKVRVKVGGGIAGHNGLRSISAHIGNDYLRVRLGVGHPGAKELVHNHVLGDFAKSERPWVEALCEIAADNAGLIAKGKDASFANKVHLAMQAKGFYDNDKQAKGGERDK

SEQ ID NO: 38165 - DNA, 543 bp, Corynebacterium diphtheriae
  CDS (1)..(543)
atggggttgggtaatcctggggttcggtatgcgtcgacacgccataacgtgggatatatggtggttgatgaattgttggggcctgctgaattgcggcctctgcgtgggttcaaggcgtctggcgctgtcattgaggttgggggttgccgtgtgttggtggtgcggtcgtcgacgtttatgaacacttccggtgaggctgtggggccaattgtccaagagtatggggtgtcgccggatcatgttgttgtggttcatgatgaattggatctgccggcgcataaagttcgggtgaaggttggcggtaatgagaatggccacaatgggttgaagtcggtgtcgcaatggctggggactcgggattatgtgcggattcgggtaggaattggtcgccctccccgtgggggaacggtgccggactatgtgcttggtgcgttggattctggtgaggtattggatgcggcggttcgttgtggggcggatgcgattcgtcttgtgattgagcgtggtgtgagtgtggctcagaatgagattcatcgtcgttga

SEQ ID NO: 38166 - protein, 180 aa, Corynebacterium diphtheriae
MGLGNPGVRYASTRHNVGYMVVDELLGPAELRPLRGFKASGAVIEVGGCRVLVVRSSTFMNTSGEAVGPIVQEYGVSPDHVVVVHDELDLPAHKVRVKVGGNENGHNGLKSVSQWLGTRDYVRIRVGIGRPPRGGTVPDYVLGALDSGEVLDAAVRCGADAIRLVIERGVSVAQNEIHRR

SEQ ID NO: 38167 - DNA, 660 bp, Arabidopsis thaliana
  CDS (1)..(660)
atgctgagtaggttgtcaaggcgttgctactgcacttcttctgttcatcggccatggctgtttctaggactgggcaatccaggtgacaaatacaaaggaactagacacaacattggattcgaaatgattgatgttttcgctgagtcagtggggattcaaatgaacttggtaaatttcaaggctataatgggacaaggtttcgtggcagatcttcccgtcatccttgcaaaaccgcaaacctacatgaacttgagcggtgaatcaagtggacctctcgcagcttattacaagttacctctcaatcgtgtgcttgtggttcatgatgacatgcaattgccatgtggtgttcttcgtcttcaagaaaaaggaggccatggatgtcacaacgggttaaaaagtgtaatgaaccatttccgaggcaacagggaatttgcaaggctacgaatcggaattggaaagcctccgggacaaatggacccaaaggcgttcttgttgcagaagttcagcatgccagctcgtgaacggatggataaagctttagcagaaggggtggatgctctgaagctcgtcttggctaaagactttggagaaagctggagattgttcaatgtggaacagaagtacaaacacttaaaacaacacacaatactatcagcttga

SEQ ID NO: 38168 - protein, 219 aa, Arabidopsis thaliana
MLSRLSRRCYCTSSVHRPWLFLGLGNPGDKYKGTRHNIGFEMIDVFAESVGIQMNLVNFKAIMGQGFVADLPVILAKPQTYMNLSGESSGPLAAYYKLPLNRVLVVHDDMQLPCGVLRLQEKGGHGCHNGLKSVMNHFRGNREFARLRIGIGKPPGQMDPKAFLLQKFSMPARERMDKALAEGVDALKLVLAKDFGESWRLFNVEQKYKHLKQHTILSA

SEQ ID NO: 38169 - DNA, 606 bp, Desulfovibrio vulgaris
  CDS (1)..(606)
atgaacatatccggactcatcatcggcctcggcaatccgggacgcgagtacgaccgtacccgccataatttcggattcatgttcatcgacgccctgctggaagaagcccagcgcaatccttttgcgcgctgtgaacaactcagcggcggcaagaagaaatacgacctctggcgatgcgacatcgtcgaaggacaagccccatggcttcttgccaagccgcagaccttcatgaacctcagcggcgaggccgtgcttgcgatagcctcgttctatcgggtcaagcccgccgccatggtcgtggcgcacgacgaactcgacctgcccctcggaaggatgcgcttcaagatggggggaggcaacgcaggacataacgggctgaaatccatcacacaatgccttgggacgcctgactttcatcgactccgcctcggcattggcaaacctccggcaggtggagaaaccacagggtgggtgctcggtcgcttctcccagtccgacactgccatggtcgacgcggtgcttgaggcggccatacaaggcatcaggacattcgccacagagggggatgtcgcggccacccagtacatcaacgccttcaggccctga

SEQ ID NO: 38170 - protein, 201 aa, Desulfovibrio vulgaris
MNISGLIIGLGNPGREYDRTRHNFGFMFIDALLEEAQRNPFARCEQLSGGKKKYDLWRCDIVEGQAPWLLAKPQTFMNLSGEAVLAIASFYRVKPAAMVVAHDELDLPLGRMRFKMGGGNAGHNGLKSITQCLGTPDFHRLRLGIGKPPAGGETTGWVLGRFSQSDTAMVDAVLEAAIQGIRTFATEGDVAATQYINAFRP

SEQ ID NO: 38171 - DNA, 552 bp, Thermus thermophilus
  CDS (1)..(552)
atgttcctggtggtgggccaggggaacccgggggagcggtacgcccgcacccggcacaacctcggcttcatggtcctggaccgcctgggcctttccttccgcccccggggcgaggcgctcgtggcggaggcggagggcgggcttttcctcaagcccctcacctactacaacctcacggggcgggcggtggcccccctcgcccgcttttacaagatccctcccgagcggatcctggtggtccacgacgagatggacctccctttggggcggatccgcttcaaggccggggggagcgccgccgggaaccggggcgtgctttccatagaggaggccctgggcacccgggccttccaccgcctccgcctcggcatcgggaagcccccggacccctcccggggggcggagtacgtgctctcccccttccgcgaggaggagcttcccgtggtggagcgggtcctcgaggcggccaaggaggcggtttggtgctgggtgcgggagggtctccccccctgcgccgggcgcttcaacggcctggacctctccttggggtag

SEQ ID NO: 38172 - protein, 183 aa, Thermus thermophilus
MFLVVGQGNPGERYARTRHNLGFMVLDRLGLSFRPRGEALVAEAEGGLFLKPLTYYNLTGRAVAPLARFYKIPPERILVVHDEMDLPLGRIRFKAGGSAAGNRGVLSIEEALGTRAFHRLRLGIGKPPDPSRGAEYVLSPFREEELPVVERVLEAAKEAVWCWVREGLPPCAGRFNGLDLSLG

SEQ ID NO: 38173 - DNA, 633 bp, Bacillus cereus
  CDS (1)..(633)
atggatagaatgagacgtaaccaagattggttacgtcttttcgtatcgaaaaaagaaagtagtggtacaagaatgaaattgatagtaggacttgggaacccaggtagagaatatgaattaacaaggcataatattggatttatggcgattgatgaacttgcaaagcgttggaatatttctttgaacgaacaaaagtttaaaggagtatttggtgcaggatttgttaatggagaaaaagtaatcttattaaagccacttacatatatgaatttatctggggaaagtattcgtccgttaatggattactataaaattgatgtagaggacttcgttgttctgtacgatgatttagacatccctgtaggtaaattacgccttcgtatgaaaggcagtgcgggtggacataatggtgtgaaatcaacaatttcacatttaggaacacaagagtttcaacgtatccgcatgggaatcgatcgtccgaaaaatggaatgaaggtagtagattacgtattaggacgttttacatcagaagagattcctggtgtaaatcattctattgaaaaagcagcagatgcatgtgaagaatggttaaataaaccttttcttcaaattatgaatactttcaatagttaa

SEQ ID NO: 38174 - protein, 210 aa, Bacillus cereus
MDRMRRNQDWLRLFVSKKESSGTRMKLIVGLGNPGREYELTRHNIGFMAIDELAKRWNISLNEQKFKGVFGAGFVNGEKVILLKPLTYMNLSGESIRPLMDYYKIDVEDFVVLYDDLDIPVGKLRLRMKGSAGGHNGVKSTISHLGTQEFQRIRMGIDRPKNGMKVVDYVLGRFTSEEIPGVNHSIEKAADACEEWLNKPFLQIMNTFNS

SEQ ID NO: 38175 - DNA, 576 bp, Mycobacterium paratuberculosis
  CDS (1)..(576)
atggccgagccgttgctggtggtcggcctgggcaatcccggagacaactacgcccgcacccggcacaacgtcgggttcatggtcgccgacctgctggcggcgcggatgggttcgaagttcaaggcgcacaagcggtccggcgccgagatcgtcagcggccggctggccgggcgctccgtggtggtggccaagccgcgctgctacatgaacgaatccggccgccaggtcggcccgctggcgaagttctactcggtgccgccgggcgacatcatcgtcatccacgacgatctcgacttggacttcggccgcatccggctcaagatcggcggcggcgagggtggccacaacggcctgcgctcagtggcaaacgccctgggcagcaaggactttcaacgcgtccgcatcgggatcggccgcccgccggggcgcaaggacccggcggccttcgtgctggagaacttcaccagcaccgagcgcgccgacgtcccgaccatctgcgagcaggccgccgacgccaccgagctgctgatcgaactggggctcgagcccgcccagaaccgggtgcacgcctggtag

SEQ ID NO: 38176 - protein, 191 aa, Mycobacterium paratuberculosis
MAEPLLVVGLGNPGDNYARTRHNVGFMVADLLAARMGSKFKAHKRSGAEIVSGRLAGRSVVVAKPRCYMNESGRQVGPLAKFYSVPPGDIIVIHDDLDLDFGRIRLKIGGGEGGHNGLRSVANALGSKDFQRVRIGIGRPPGRKDPAAFVLENFTSTERADVPTICEQAADATELLIELGLEPAQNRVHAW

SEQ ID NO: 38177 - DNA, 582 bp, Geobacter sulfurreducens
  CDS (1)..(582)
atggcaacaaaactgatcgtcgggctggggaatcccggcccgaaatacctatggacccgccacaacgcgggtttcatggttttagaccgtcttgcccacgccatcggtgcgtcggttaccaggaagagcttttccggtgtcttcggtgagggggcttggcacggcgaacggcttctccttctcaagccccagacctacatgaatctttccgggcgctcggtggccgaggcgctccgttttcacaagcttccgctttgcgacaccatcgtgattcatgacgacctcgacattcccttcggccgtgtcaaggtcaaggaggggggcggtcacggcgggcacaatggtctccgctcccttgttcaggagcttggcggagcaggctttgtccgggtgagagtcgggatcggcaggccggtccatggtgacgtggtgaattacgttctgaccaatttcagtcaggacgaaatggcggatcttgcccacctgctcgacggaaccctcgacctcctggagtcactcctgacagccggactccccaagaccatgagtctgtataacaacaaggatcttcttgccccctga

SEQ ID NO: 38178 - protein, 193 aa, Geobacter sulfurreducens
MATKLIVGLGNPGPKYLWTRHNAGFMVLDRLAHAIGASVTRKSFSGVFGEGAWHGERLLLLKPQTYMNLSGRSVAEALRFHKLPLCDTIVIHDDLDIPFGRVKVKEGGGHGGHNGLRSLVQELGGAGFVRVRVGIGRPVHGDVVNYVLTNFSQDEMADLAHLLDGTLDLLESLLTAGLPKTMSLYNNKDLLAP

SEQ ID NO: 38179 - DNA, 558 bp, Lactobacillus johnsonii
  CDS (1)..(558)
atgaagttaattacaggtttaggaaatccaggtagaaaatatgatcagactaagcataatacaggttttatggcattagatcattacttagagaaaaatggtttaactctagataagaataagtttgaaggcttatggacaaaacaaaagatcaacggtgaagatgtaatttttcttgaaccgcagacttttatgaacgattcgggaaaatcaatcgcgcaagtagctaatttcttcaaaattaagcctgaagatattttagttattcatgatgatatggacatgccaattggaaagattagaattcgtgcaaatggtaaatcagggggtcataatggaattaagagcattatggcttgcttaggaacgaacaattttaatcgattaaaaattggaattcgccatcctgaaaacgaaagtgttgtttcttgggtattaagtccctttaataatgaccagcaaaaactgatggatgcagcttttgagacaagtgagaatgtcattaatgattttattaaagggaagaacgcccaatatttaatgaatcagtataattag

SEQ ID NO: 38180 - protein, 185 aa, Lactobacillus johnsonii
MKLITGLGNPGRKYDQTKHNTGFMALDHYLEKNGLTLDKNKFEGLWTKQKINGEDVIFLEPQTFMNDSGKSIAQVANFFKIKPEDILVIHDDMDMPIGKIRIRANGKSGGHNGIKSIMACLGTNNFNRLKIGIRHPENESVVSWVLSPFNNDQQKLMDAAFETSENVINDFIKGKNAQYLMNQYN

SEQ ID NO: 38181 - DNA, 600 bp, Ashbya gossypii
  CDS (1)..(600)
atgcttgctagcaaagcccgctcggcgccccagcggcgtacgctccatctatgcctgactggccttggtaaccccgagccacagtatcgcaacacccggcacaatgcaggtcttatcttgctggacctactgaaggcgcactacgcccctggcaaaccgtggatgccctgcacagtcccccgggtggcggcctcatactgccacgcttcgcggcacgatctgctgctgttgcgctcggacggcgctttcatgaaccgcagcggccagaacgttgtgccgctctggcagcgcatcggcggcgcaacgcgcgtggtggtgcacgacgaattgtcgctgcccctgggcaaggtgcagctcagggcaccagggcgcagcccgcgtggccacaacgggctcaaaagcatcattgctgccggcgcgcaggggacctactacagcctcgccgtcggcatcgaccgcccggagacacggaagccggccgcgattgcagactacgtgctgtcgcgcttctcgcgcgccgagctgtcgcagctcgagcaggatgctctcccggcggccctggggcacctcaacgggctgctgggggtggttgtcacgtga

SEQ ID NO: 38182 - protein, 199 aa, Ashbya gossypii
MLASKARSAPQRRTLHLCLTGLGNPEPQYRNTRHNAGLILLDLLKAHYAPGKPWMPCTVPRVAASYCHASRHDLLLLRSDGAFMNRSGQNVVPLWQRIGGATRVVVHDELSLPLGKVQLRAPGRSPRGHNGLKSIIAAGAQGTYYSLAVGIDRPETRKPAAIADYVLSRFSRAELSQLEQDALPAALGHLNGLLGVVVT

SEQ ID NO: 38183 - DNA, 594 bp, Candidatus Blochmannia floridanus
  CDS (1)..(594)
atgacaataaaattaattgcaggtataggtaatatcggcgctaaatatattaatactagacataattgtggtcataaatatatttatttattatcacaaaaatttaaagttcatttaaaatataataatatattatgtggatatataggaaaatttcaaatacttgaacatacagttaaattattaataccaaattcttatgtcaataatagtggcatatcagtatctaaatgtgttaatttttatggattatctttaagagaaattttggtagcacatgatgaactagatttatatccaggaacgataaaaattcagttaggaaaaaggaggaatgaaagtcatcatggtattcaaaatattattgataaacttggaaatcgatatgatttttatcggttgcgtataggtattggacgaccttgtaataagaatgaaattatcaattttgttttaaatattccttctgtgcatgaaggtattcagattgattttattgtaaacaaagttgttttttttactgaagatattgttctaaataattttgtgaaagttatgaatcaattgcatatatcaaataatataattgattga

SEQ ID NO: 38184 - protein, 197 aa, Candidatus Blochmannia floridanus
MTIKLIAGIGNIGAKYINTRHNCGHKYIYLLSQKFKVHLKYNNILCGYIGKFQILEHTVKLLIPNSYVNNSGISVSKCVNFYGLSLREILVAHDELDLYPGTIKIQLGKRRNESHHGIQNIIDKLGNRYDFYRLRIGIGRPCNKNEIINFVLNIPSVHEGIQIDFIVNKVVFFTEDIVLNNFVKVMNQLHISNNIID

SEQ ID NO: 38185 - DNA, 684 bp, Homo sapiens
  CDS (40)..(684)
atgacgtcagggggcggtgtcggagtgaatgggggcagcatgaggccgggcggctttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtga

SEQ ID NO: 38186 - protein, 214 aa, Homo sapiens
MRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNAMPRLRVGIGRPAHPEAVQAHVLGCFSPAEQELLPLLLDRATDLILDHIRERSQGPSLGP

SEQ ID NO: 38187 - DNA, 867 bp, Arabidopsis thaliana
  CDS (1)..(867)
atgaaagctgtagcttttcccgctaaaatcgcaaatcttagcttcccttctaactgttgctcactattcttccgatcaccggcgacgtttttatcgccggcattgccttgtcggaagctgacgaaaggaataagaggtctcgaaggcttgatgtctcagtgtttatcatcatcgtcacaatcattgtcattttcatcgaattcattctcctctcaaccggaatcagagttacttcaagctttaccttcttcgaagccaaaatctccgccactgcagctgccatggctcattgttggtttgggtaatcccggcaagaagtaccagggcacgcgccacaacgttggttttgagatggtggacgctttggctgatgcagaaggcatctccatgaacactgttaacttcaaggccttgtttgggaaaggcgttattggaaatataccgattatgctggctaaaccacaaactttcatggacctaagtggtgagtctgttggacaaatcgtttcattttacaagatcccgttaaagcaagtacttgtggtttacgatgatttagatttgccctttggtaaactacgtttattgccaaaaggtggtcacggaggccacaatgggatgagaagtattatagaccgcctcaaaggtagccgtgattttcctcgactaagaatagggatcggacgtcctccagggaagatggatacagccaattttgttctccgccagttcaatagacaggaacaggaagagttggatcacacattccaaaccgggttagaggcaataaggattcttttgcttgaggggttcaacaaaagtgcaacatttgtcaacactcgaaaatctatggagcaactcagttag

SEQ ID NO: 38188 - protein, 288 aa, Arabidopsis thaliana
MKAVAFPAKIANLSFPSNCCSLFFRSPATFLSPALPCRKLTKGIRGLEGLMSQCLSSSSQSLSFSSNSFSSQPESELLQALPSSKPKSPPLQLPWLIVGLGNPGKKYQGTRHNVGFEMVDALADAEGISMNTVNFKALFGKGVIGNIPIMLAKPQTFMDLSGESVGQIVSFYKIPLKQVLVVYDDLDLPFGKLRLLPKGGHGGHNGMRSIIDRLKGSRDFPRLRIGIGRPPGKMDTANFVLRQFNRQEQEELDHTFQTGLEAIRILLLEGFNKSATFVNTRKSMEQLS

SEQ ID NO: 38189 - DNA, 741 bp, Arabidopsis thaliana
  CDS (1)..(741)
atgttttgtgcatcatcttctccaattacatctcctctctacccaaaagcttataaattttctcaaacaaaatcgaattcgaagagattttcctctctgcgtgcttcgttgcctgtttctgataacaagcttcttaaatttgaatacacaccatggcttattgttggacttggtaaccctggattaaagtattacggaacaaggcataatattggttttgagatgattgatcatatagctcgagcaacggatatttctatgaacacaattcagtccaaggctttagttgggataggttctgttggagaagttccgattttgttggttaaacctcaaggatacatgaatttcagtggtgaatcggttgggccgttagctgcttactaccaaatacccttacgtcacattcttatgatatatgatgacatgggtttgtctaatggtgtcttgagacttcaaccaaaaggtgggcatagccaacacaatggattgaagaatgtgacagaacatttaaatggttgtcgcggctatccccgcttatcaatcggaattggaaatccaccaggtaacatggacatgaaagcgtttcttctccagaaattcagccccttggagcgcaaacagatggatgagggactggaacaaggtgttgaaggtgtgaagacacttgttgaagaggggtttagtgactcaatatctcgattcaatttgggacagaaatacaagtttcataaagtttga

SEQ ID NO: 38190 - protein, 246 aa, Arabidopsis thaliana
MFCASSSPITSPLYPKAYKFSQTKSNSKRFSSLRASLPVSDNKLLKFEYTPWLIVGLGNPGLKYYGTRHNIGFEMIDHIARATDISMNTIQSKALVGIGSVGEVPILLVKPQGYMNFSGESVGPLAAYYQIPLRHILMIYDDMGLSNGVLRLQPKGGHSQHNGLKNVTEHLNGCRGYPRLSIGIGNPPGNMDMKAFLLQKFSPLERKQMDEGLEQGVEGVKTLVEEGFSDSISRFNLGQKYKFHKV

SEQ ID NO: 38191 - DNA, 771 bp, Zea mays
  CDS (1)..(771)
atgtcgttgctcgccgcggccattcccagcacttcctcccacttctccgcacccttcctcccctccttccgcatgccccgcaagagcctcaccgccccactccaccggatccgccgtccgcggccgttcaccgtcgtctcctccgtcccagaccccgcggcggggccggtggaatacacgccctggctcatcgccggcctcggcaacccaggcaacaagtactacggcacgcggcacaatgtggggtttgagatggtggatcgcatcgcggcggaggaggggattacgatgaacacaatccagtccaagtcgcttctgggaattggttcaattggcgaggtgccagtcttggtggtaaaaccgcaatcatacatgaactacagtggagaggcaattggacctcttgcagcctattatcaagtaccattacggcacatcctcttgatttatgatgatacaagtctgcccaatggtgtactgcggcttcaaaagaaaggtggtcatggtcgccacaacgggctacagaatgtgattgagcatttggatggtcgcagagaatttcctcgtttatctataggcattggtagcccacctggaaaaatggaccctcgggctttccttctgcagaagttcagttcagaggaacgagtccagatcgacactgctctggagcaaggggtggacgctgtgagaacccttgtgcttaagggttttagtgggagtactgaaagattcaaccttgtgcagaagtacaagttccacagggtttga

SEQ ID NO: 38192 - protein, 256 aa, Zea mays
MSLLAAAIPSTSSHFSAPFLPSFRMPRKSLTAPLHRIRRPRPFTVVSSVPDPAAGPVEYTPWLIAGLGNPGNKYYGTRHNVGFEMVDRIAAEEGITMNTIQSKSLLGIGSIGEVPVLVVKPQSYMNYSGEAIGPLAAYYQVPLRHILLIYDDTSLPNGVLRLQKKGGHGRHNGLQNVIEHLDGRREFPRLSIGIGSPPGKMDPRAFLLQKFSSEERVQIDTALEQGVDAVRTLVLKGFSGSTERFNLVQKYKFHRV

SEQ ID NO: 38193 - DNA, 534 bp, Corynebacterium glutamicum
  CDS (1)..(534)
atgaataactctccccttttagttgttggcctgggaaatcccggcccgaaatacgttggcacccgccacaatattggctttgaggttgcagaagaactagtgtcgcgcagctttggatcatttagtgtgcacaagcgctccaacaccgatatcgcgcagcttcctgggctaattgtggccaagccgcgcagctttatgaacctgtcgggaactccgattcgggcgctgtgtgacttctttaagatttccccagccaatgtcatcgtggtgcatgatgaattggagcttgatttcggctcagtgaagctacgtcagggtggcggggatcatgggcacaatggtctgaaatccacgtccaaatctttgggaactaaggactattggaagctcagcatgggtatcggtaggccaccgggtcggatggatccggcaagttttgtgttgaagccttttggcaagcaagaactggcggatattcccatcatggcggctgacgctgcagatctcgtcgaaaagcatttgcagcagggctag

SEQ ID NO: 38194 - protein, 177 aa, Corynebacterium glutamicum
MNNSPLLVVGLGNPGPKYVGTRHNIGFEVAEELVSRSFGSFSVHKRSNTDIAQLPGLIVAKPRSFMNLSGTPIRALCDFFKISPANVIVVHDELELDFGSVKLRQGGGDHGHNGLKSTSKSLGTKDYWKLSMGIGRPPGRMDPASFVLKPFGKQELADIPIMAADAADLVEKHLQQG

SEQ ID NO: 38195 - DNA, 615 bp, Corynebacterium glutamicum
  CDS (1)..(615)
atgacttccgtgagttttttgtctaaaatccaagcactgtttgcccccaagcctgaacttcccgccgccaaatggctggtcgtgggcctgggcaaccccggcgccaagtacgaatccacccgacacaacgtcggttacatgtgccaagacatgcttatcgacgcccaccagcagcagcccctcacccccgccacgggctacaaggccctcacaacgcagctcgcaccaggggtgctcgccgttcgatccaccacttttatgaaccactccggccaaggtgtcgcaccgatcgccgcagcgttgggtatcccagcagagcgcatcatcgtgatccacgacgagctcgatctgcccgctggaaaagtacgcctgaaaaagggcggaaacgaaaacggtcacaacggcctgaaatccctcacggaagagctcggcaccagagactacctgcgcgtccgcatcggcatttcacgaccaccagcaggaatggccgtgcccgactacgttttggaaccagtcgatcacgaccaaccaggcattgaacttgccgccgaggcagtggatttgctgctggcccagggattatctgctgcgcaaaacgctatccacagccgctag

SEQ ID NO: 38196 - protein, 204 aa, Corynebacterium glutamicum
MTSVSFLSKIQALFAPKPELPAAKWLVVGLGNPGAKYESTRHNVGYMCQDMLIDAHQQQPLTPATGYKALTTQLAPGVLAVRSTTFMNHSGQGVAPIAAALGIPAERIIVIHDELDLPAGKVRLKKGGNENGHNGLKSLTEELGTRDYLRVRIGISRPPAGMAVPDYVLEPVDHDQPGIELAAEAVDLLLAQGLSAAQNAIHSR

SEQ ID NO: 38197 - DNA, 561 bp, Bacillus cereus
  CDS (1)..(561)
atgaaattgatagtaggacttgggaacccaggtagagaatatgaattaacaaggcataatattggatttatggccattgatgaacttgcgaagcgttggaacatttctttgaatgaacaaaaatttaaaggtgtatttggtgcagggtttgttaatggagaaaaggtaatcttattaaagccgctaacatacatgaacttatctggggaaagtattcgtccactcatggattattataaaattgatgttgaggacttcgttgttatgtacgacgatttggacattcctgtaggtaaattgcgtcttcgcatgaaaggtagtgctggtggacataatggtgtaaagtcaacgatttcgcacctaggaacacaagaatttcaacgtatccgtatgggaatcgatcgcccgaaaaatggaatgaaggtagtcgattatgtattaggacgctttacatctgaagagattccggatgttaaccattctattgaaaaagcagcggatgcatgtgaagagtggctaaataagccttttctccaaatcatgaatactttcaatagttaa

SEQ ID NO: 38198 - protein, 186 aa, Bacillus cereus
MKLIVGLGNPGREYELTRHNIGFMAIDELAKRWNISLNEQKFKGVFGAGFVNGEKVILLKPLTYMNLSGESIRPLMDYYKIDVEDFVVMYDDLDIPVGKLRLRMKGSAGGHNGVKSTISHLGTQEFQRIRMGIDRPKNGMKVVDYVLGRFTSEEIPDVNHSIEKAADACEEWLNKPFLQIMNTFNS

SEQ ID NO: 38199 - DNA, 600 bp, Bifidobacterium longum
  CDS (1)..(600)
atggcatcggatttctggctgattgcgggactgggcaaccccggcaaaaaatatgaggacacgcggcacaacatgggcttcatgaccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtga

SEQ ID NO: 38200 - protein, 199 aa, Bifidobacterium longum
MASDFWLIAGLGNPGKKYEDTRHNMGFMTADVLAERWTVNFADHKGLAMLGKSVMNLDGRTVKFFLAKPLTYMNDSGNAVASISAYYQIEPDHIVVIHDDMDLEFGRIKVKAGGSAGGHNGIKSIDRSLGTPKYARVRMGVGHSKRGANAHDNTVNWVLGGFGPDQRKQLPEFLADGADAAEDIIFHGLAKTQEKFNGR

SEQ ID NO: 38201 - DNA, 624 bp, Buchnera aphidicola
  CDS (1)..(624)
atgaaagaaattaaattaatagtaggtttagcaaatccgattaaaaaatataatgatactcgtcataatgttggttcttggctagttaacagtttagttacacaacaaaataaaaaattaaaaaaaaataacaaatttttaggttattctacagaaattaatattttgtctaaaaatattcatgtattagttccggatacatttatgaatttaagtggaatatcagttttagctatatcaaatttttataacattaagttacacgaaatattggtagtacatgatgaattagatttaaaaccaggaaatgtcaagtttagattgagatctagtcacaatggacacaatggaattagaaacgttcttgctgtgttaggaactaacataaaatttttgagaattcaaattggaataggacgtccaattaatagcggatacaaaatatctaagtttgtattatctaaacctaatgtttctgagaaattattaattaatagagctattttatgtgcaattcgtgtcatttatgattcgataaatcaacgcaatgttattatgactgaaagttcgttgaattctatgttagatcattacatgaatagttgtgtaattcatcataattaa

SEQ ID NO: 38202 - protein, 207 aa, Buchnera aphidicola
MKEIKLIVGLANPIKKYNDTRHNVGSWLVNSLVTQQNKKLKKNNKFLGYSTEINILSKNIHVLVPDTFMNLSGISVLAISNFYNIKLHEILVVHDELDLKPGNVKFRLRSSHNGHNGIRNVLAVLGTNIKFLRIQIGIGRPINSGYKISKFVLSKPNVSEKLLINRAILCAIRVIYDSINQRNVIMTESSLNSMLDHYMNSCVIHHN

SEQ ID NO: 38203 - DNA, 564 bp, Chlorobium tepidum
  CDS (1)..(564)
atgaaacttatcgtcggccttggcaacccggaacttcggcacgcggcaacgaggcataatatcggattcgacgtcatcgaccatcttgcaggaagctcgacattctcatcgggcaagggaaattaccggttcacaaagatcaccgcaccgggcgggccgctgattctggtcaagccgatgacctacatgaacctttcgggtcatgccgtcgttgcggcgatgaatttctggaagatcgaacgcgagaatttgctcgtgatttgcgacgacgtgaacattccgctggggacgatccggattcgggcgaaaggttcggcgggaggtcagaacgggctgaaacacattatccagagcctcggtagcgaggagttcgcgcggctgcgcgtcggggttgggggggagaacatgcctgcgtcgctctcgtcgttcgtgctgtcgaagtttaccgcagaagagcgcaaatgcatcgacaaggtgattccggtgtgcgccgacgcggtactcgacttcgcctcgctgggcgtcgaacatgcaatgacaaaatataacgggcaggtctgttaa

SEQ ID NO: 38204 - protein, 187 aa, Chlorobium tepidum
MKLIVGLGNPELRHAATRHNIGFDVIDHLAGSSTFSSGKGNYRFTKITAPGGPLILVKPMTYMNLSGHAVVAAMNFWKIERENLLVICDDVNIPLGTIRIRAKGSAGGQNGLKHIIQSLGSEEFARLRVGVGGENMPASLSSFVLSKFTAEERKCIDKVIPVCADAVLDFASLGVEHAMTKYNGQVC

SEQ ID NO: 38205 - DNA, 567 bp, Clostridium perfringens
  CDS (1)..(567)
atgattttaatagttggattaggaaatccgggaaaacaatatgagcaaactagacataacattggatttgatgtaattgattatatggcaaataagtataatattgatgtaaatagggaaaaatttaaaggtatttgtggtgaaggatttatagagaataaaaaggttattttattaaaacctttaacatatatgaatttaagtggagaaagtataagagaacttgctaacttttataagttagaagatgatgaaataatagtagtttatgatgatataagtttagatataggaagattaagaataagagaaaaaggtagtgctggtgggcataatggaatcaagagcataatacaaaatcttggtggagataaattcccaagggttaaagtgggggtaggacaacctaaagataacttagtaaatcacgttttaggaaaattctcaaaggaagatagggaacatatagaaaaggttattccagtagtaagtgatgcaatagttgaaattgtaaaaaatgatgctaaggaatcaatgaataaatttaatggagttaatatagaatag

SEQ ID NO: 38206 - protein, 188 aa, Clostridium perfringens
MILIVGLGNPGKQYEQTRHNIGFDVIDYMANKYNIDVNREKFKGICGEGFIENKKVILLKPLTYMNLSGESIRELANFYKLEDDEIIVVYDDISLDIGRLRIREKGSAGGHNGIKSIIQNLGGDKFPRVKVGVGQPKDNLVNHVLGKFSKEDREHIEKVIPVVSDAIVEIVKNDAKESMNKFNGVNIE

SEQ ID NO: 38207 - DNA, 534 bp, Corynebacterium efficiens
  CDS (1)..(534)
atgaatgactcccctgttcttgttgtcggtctcggtaacccgggcccgaaatatgtcggtacccgccacaacatcggtttcgaggtggtggaggaactggtgggccgcaactacgcgaacttcagcgtgcacaagcggtccaacaccgagatcgcgcagctgcccggtctgatcgtggccaagccccgcagtttcatgaacctgtccggcaccccgatccgcgcgctgtgtgacttcttcaagatctcccccgcgaatgtcctggtggtccacgatgagctggatctggatttcggtcaggtcaaactgcgtcagggcggcggagaccatgggcacaacggcttgaagtccaccagcagatccctgggaaccaaggactactggaaactcagcgtgggcatcggcaggccaccgggccggatggatccggccaccttcgtgctcaagcccttctccaagcaggagcaggacagcgtgccgatcatggccgcggatgccgcggatctcattgaggagcacatcaggacactgtga

SEQ ID NO: 38208 - protein, 177 aa, Corynebacterium efficiens
MNDSPVLVVGLGNPGPKYVGTRHNIGFEVVEELVGRNYANFSVHKRSNTEIAQLPGLIVAKPRSFMNLSGTPIRALCDFFKISPANVLVVHDELDLDFGQVKLRQGGGDHGHNGLKSTSRSLGTKDYWKLSVGIGRPPGRMDPATFVLKPFSKQEQDSVPIMAADAADLIEEHIRTL

SEQ ID NO: 38209 - DNA, 564 bp, Coxiella burnetii
  CDS (1)..(564)
atgtcgggcggggttaaactgattgcaggccttgggaatccgggcgatcagtatgcccgaacacgccacaatgtcggggcgtggttccttgaaacgttggctcagcaacgtaatcaatccttggccaaagaaaataaatttcatggctttgtcgcgaaatgcaatgattactggttacttaagccgaccacattcatgaacgaaagcggccaagctgtcgccgctttagctcatttctataaaataaagccctcagaaattttaatcgcacacgatgaattggattttcccgccggcgacattcgcttaaaagaagggggcggacacggcgggcataacgggcttcggaatattattcaacacctggggagtagcgatttttaccgcttgcgaattgggattaatcaccccggccataaggatcgtgtcactccttacgttttaagcccaccgtctgaaaatgatcggattgctattttggcagccatcgaaaaaggtttgcgcctgattccagaattggtacaaggtgattttcaaaaagtgatgcgggaattgcattcttaa

SEQ ID NO: 38210 - protein, 187 aa, Coxiella burnetii
MSGGVKLIAGLGNPGDQYARTRHNVGAWFLETLAQQRNQSLAKENKFHGFVAKCNDYWLLKPTTFMNESGQAVAALAHFYKIKPSEILIAHDELDFPAGDIRLKEGGGHGGHNGLRNIIQHLGSSDFYRLRIGINHPGHKDRVTPYVLSPPSENDRIAILAAIEKGLRLIPELVQGDFQKVMRELHS

SEQ ID NO: 38211 - DNA, 567 bp, Enterococcus faecalis
  CDS (1)..(567)
atgaaagtaatcgtaggactgggaaatcccggtagtaaatacaaagaaacaaaacacaacattggctttattacgctagatgaaattgcgtatcggcaaaatgtttcgtttaataatagtaattttgaagcagatattgcagagttttttatagggactgagaaagtattgttagtgaaaccattaacatttatgaatgaatcaggtcgctctgttggtccgttgttgacctactttggggtagatgaggaagatttgattgttatttatgatgacttagacttagagatcggtaaaattcgtttacggcaaaaaggtagtgctggcggccacaatgggataaaaagtctgattgcccatttaggaacaaatgtctttcctagaattaaaattggcattggtcggccctcaaaaaatgatacagttatccaccatgtactaagtacttttcccaaagaaacacacgaagagatgttacttgctgtaaaaaaagcagccgatgccgctttatatgcatgcgaaggacatacgtttgttgaaacaatgaatcaatttaatggaaaatga

SEQ ID NO: 38212 - protein, 188 aa, Enterococcus faecalis
MKVIVGLGNPGSKYKETKHNIGFITLDEIAYRQNVSFNNSNFEADIAEFFIGTEKVLLVKPLTFMNESGRSVGPLLTYFGVDEEDLIVIYDDLDLEIGKIRLRQKGSAGGHNGIKSLIAHLGTNVFPRIKIGIGRPSKNDTVIHHVLSTFPKETHEEMLLAVKKAADAALYACEGHTFVETMNQFNGK

SEQ ID NO: 38213 - DNA, 597 bp, Gloeobacter violaceus
  CDS (1)..(597)
atggaactgcgcttgttcgtcgggcttggcaatcctggcctccagtacacccagacccgccacaacgccgggtttcttgctgtggacgccctcgcgaaacgttggcaatgcagttgggtcgaaaagagccgcttcaaaggctatctggccgagggggccggccctgggggccgggccattctgctcaagccgaccacctacatgaaccactccggccaatcggtgcgcgcggtggccgattactttcggctgccgccgcaacagctgctggtgctctacgacgaggtcgccctgcccctgggcaaaatccgcctgcgccccgaagggtccgccgccggtcacaacggcatcaaatcgcttatcgaacatctgggcaccaaccagtttgcccggctgcgcatcggcatcggccgggagccgcctccgccggtgctcaccaactacgtgctgggcaaattcgctcccgaggagcaggagcagttgcctgccatccttgacggctgcgtggaggcagtggaggcggtgctcgccaaggggctggaaaaggcgatgagcatttataatgcgaggagttttggatcccccccagacccttag

SEQ ID NO: 38214 - protein, 198 aa, Gloeobacter violaceus
MELRLFVGLGNPGLQYTQTRHNAGFLAVDALAKRWQCSWVEKSRFKGYLAEGAGPGGRAILLKPTTYMNHSGQSVRAVADYFRLPPQQLLVLYDEVALPLGKIRLRPEGSAAGHNGIKSLIEHLGTNQFARLRIGIGREPPPPVLTNYVLGKFAPEEQEQLPAILDGCVEAVEAVLAKGLEKAMSIYNARSFGSPPDP

SEQ ID NO: 38215 - DNA, 585 bp, Haemophilus ducreyi
  CDS (1)..(585)
atgtcacaaatcaaattgatcgtaggcttagctaatccgggcgcaaaatatgaaggtactcgccataatgcaggtgaatggttagttaatgagctagccagaatgtataatacatcgctcaaagatgaagcgaaatattttggcaaaaccgccaaaattaatacggtaaacggcgatgtttggctactcattcccactacatttatgaatttaagtggtaaagctgtcggagcattagcccattttttccgaatcaaggccgaagaaattttaattgctcacgatgaattagatttaccgccaggtgtggcaaaactaaaacaaggtggtggtcatggtggccataatggtttaaaagatattattagtgcattgggcaataataataatttctatcgaattagactcggtattggtcatcccgggcataaagatcaagtagcaggttatgtattaagcaaaccagctccacaagatcaacaaaaaataaatgcggtgattgatgaagccagccgttgccttgaaatattattcaaagatggggtcacaagtgccaccaaccgcttaaacagttttaaagcataa

SEQ ID NO: 38216 - protein, 194 aa, Haemophilus ducreyi
MSQIKLIVGLANPGAKYEGTRHNAGEWLVNELARMYNTSLKDEAKYFGKTAKINTVNGDVWLLIPTTFMNLSGKAVGALAHFFRIKAEEILIAHDELDLPPGVAKLKQGGGHGGHNGLKDIISALGNNNNFYRIRLGIGHPGHKDQVAGYVLSKPAPQDQQKINAVIDEASRCLEILFKDGVTSATNRLNSFKA

SEQ ID NO: 38217 - DNA, 672 bp, Helicobacter hepaticus
  CDS (1)..(672)
atgccttgcctccttgtcgcaggacttggtaatccgagtgccaaatatcaaaatactcggcacaatattgggtttatggtgcttgattttttatcaaaagaattagactttgatttttcttttgataaaaaatttaatgcggaagttggtgctataaatatcggtcctcacaaagttttttttcttaaaccacaaacttttatgaatctctccggggaggcaattaatccttttgtgcggtattttgatatcacacatacattcgtaattcacgatgatattgatatcggttttggtgatatgcgttttaaatatggtggttcaagtggcggacataatggcttaaaatctattgattcatttatgggagatacatattttagattacgttttggtgtgggacgaagtgcgaataaaaatgtagtagagtatgttttaagtgattttaatgcacaagaaagagagcaacttgaaggattaatagctcacgctaaggaagcagttatgagtttttgtaatatggcacaatatcctaaagagcatattcttactcatctacagcagtattttactctcaaaatacctaagcttacgccatcgcaaactcaaaataatgaatcctttgctacacaattctcacaaatgcagtatacaagatttacgcagggataa

SEQ ID NO: 38218 - protein, 223 aa, Helicobacter hepaticus
MPCLLVAGLGNPSAKYQNTRHNIGFMVLDFLSKELDFDFSFDKKFNAEVGAINIGPHKVFFLKPQTFMNLSGEAINPFVRYFDITHTFVIHDDIDIGFGDMRFKYGGSSGGHNGLKSIDSFMGDTYFRLRFGVGRSANKNVVEYVLSDFNAQEREQLEGLIAHAKEAVMSFCNMAQYPKEHILTHLQQYFTLKIPKLTPSQTQNNESFATQFSQMQYTRFTQG

SEQ ID NO: 38219 - DNA, 558 bp, Lactobacillus plantarum
  CDS (1)..(558)
atgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttaccactaggaaaagtacgcctcaaacaaaagggatcggcgggtggtcataatggcatcaagagcattattagtcatgttggtgatcagcacttcaagcgcgttaaagttggtattgaccatcctcagaagatgagtgttgttgattacgtgttggggaaatttacgccagccgaagtggcgaagtttgacgatgctaagattacggcgctagcggcggtcgaagcttggttagcaaatgatgattttacggcagttatgaatcaatataactag

SEQ ID NO: 38220 - protein, 185 aa, Lactobacillus plantarum
MKMIVGLGNIGRQYAQTRHNVGFMIVDELASKLNVTFQTSKFEAQVATAFQDGEKILLVKPATYMNDSGRAVGPLMSYYNVDPADLLVIHDDLDLPLGKVRLKQKGSAGGHNGIKSIISHVGDQHFKRVKVGIDHPQKMSVVDYVLGKFTPAEVAKFDDAKITALAAVEAWLANDDFTAVMNQYN

SEQ ID NO: 38221 - DNA, 573 bp, Leptospira interrogans
  CDS (1)..(573)
atggcaaatctaaaactattattggtagggattggaaatccaggccaaaaatatgttcacaaccggcataacatcggttttgtgatcttggattctctcttggattcttcttccgtaagttatcaaaccaattctaaatattctttagctagaaccgatgaagatggggttacgattttttatctaaaacccttagaatttatgaatctttctggaaagtctgttgcggaaatcgctaaaaaaaacggaatttctcctgaaaacattttaattattcacgatgaaattgatttcgagttcggtaagttgaaattgaaaggcggaggtggacacgctggtcataacggacttagaaacatagtagaaaaattaggtaccaatacattctttcgacttaggtttggggtcggaaaaccttccattacttcagaagtgccggattatgtgctttccaattttcttccgaacgaaaaagaaaaaattccagaacttgtaaaagtttctttgcaaaaaatctcggattggattcgagaaagaaaaaacggatttcaaaaactctccgataatcaatag

SEQ ID NO: 38222 - protein, 190 aa, Leptospira interrogans
MANLKLLLVGIGNPGQKYVHNRHNIGFVILDSLLDSSSVSYQTNSKYSLARTDEDGVTIFYLKPLEFMNLSGKSVAEIAKKNGISPENILIIHDEIDFEFGKLKLKGGGGHAGHNGLRNIVEKLGTNTFFRLRFGVGKPSITSEVPDYVLSNFLPNEKEKIPELVKVSLQKISDWIRERKNGFQKLSDNQ

SEQ ID NO: 38223 - DNA, 588 bp, Nitrosomonas europaea
  CDS (1)..(588)
atggagttacccgtaaggctggtggtgggtcttggcaacccgggcgagaagtatgcctcgacccgccataacgtcggttttgactggttggaccgtctggccagttcacaacgggttgcattcacgctggaaacccggtttcgcgggttgtgtgcacgcatcatgctggccgataccgacatctggttgctcaaaccccaaacctacatgaatgctagcggtatgtcggttgctgctgtatgccgctattacaaaatagtgcctgaacagatgctggtcgttcacgatgaactggacctgcagcctggcgtcatcaaactgaaatccggtggcgggaccgggggacacaacggccttaaaagtatcgtcgcggatctttccagccaggttttctggcgattgcggatcggcgtgggacatccgggagatcgaaatcaggtggtggattatgtcctgcatcccccgcgcagggaagaagcagcactgattgatgaagcaatagatcacagcatgcaggtatggccgctgatcgcccggggagattttgccgcggcaatgcagcgactgcatacccggcaggaaaactga

SEQ ID NO: 38224 - protein, 195 aa, Nitrosomonas europaea
MELPVRLVVGLGNPGEKYASTRHNVGFDWLDRLASSQRVAFTLETRFRGLCARIMLADTDIWLLKPQTYMNASGMSVAAVCRYYKIVPEQMLVVHDELDLQPGVIKLKSGGGTGGHNGLKSIVADLSSQVFWRLRIGVGHPGDRNQVVDYVLHPPRREEAALIDEAIDHSMQVWPLIARGDFAAAMQRLHTRQEN

SEQ ID NO: 38225 - DNA, 564 bp, Oceanobacillus iheyensis
  CDS (1)..(564)
atgaaactaattgttggtctggggaacccaggaagaaagtttaaaaaaacaagacataatattggtttttttgtcattgatgaattattacaacgtcataagtggaagctaaataattcgaagtttgaaggggattattccatagaacatttcgatggtgagaaagtcatcctattacaacctcaaacatatatgaatctctctggtaaatcgatcagtccgttaatggactattttgatatagatgtcgatgatgtgatagttgtttatgatgatctggatttaccaacgggaaaaattagacttcgccaaaaaggtggtcatggtggacacaatggtgtacgatctacgattgatcatttaggtacaaaggatttcaaaagagttcgtttaggaataggaagaccgacgaacgcaactccagtaattgattatgtattaggtaaatttccaaagcaagagacaactgcagtaacagatagtgtggaaaaggcggctgatgctatcgaagcctggataaaaggtaaaccattcttagaagttatgaatgattttaaccagtaa

SEQ ID NO: 38226 - protein, 187 aa, Oceanobacillus iheyensis
MKLIVGLGNPGRKFKKTRHNIGFFVIDELLQRHKWKLNNSKFEGDYSIEHFDGEKVILLQPQTYMNLSGKSISPLMDYFDIDVDDVIVVYDDLDLPTGKIRLRQKGGHGGHNGVRSTIDHLGTKDFKRVRLGIGRPTNATPVIDYVLGKFPKQETTAVTDSVEKAADAIEAWIKGKPFLEVMNDFNQ

SEQ ID NO: 38227 - DNA, 591 bp, Photorhabdus luminescens
  CDS (1)..(591)
atgagtaacataaaattaatcgtcggtctggctaatcccggtgctgaatatgctcaaaccagacacaatgccggagcctggtatgttgatctactcgctcggagccacaatcaatcactgaaagaagagagtaaatttttcggttataccgcccggattaatatctgcggtcacgatgttcgtctgttagtcccgacgacgtttatgaatctcagtggtaaatctgtcgtagccctcgcctccttctaccgtattcaaccggatgaaattctggtggctcatgatgaactcgatttaccgcccggggtggcaaaaatgaagctgggtggtagtcatggcggtcataatggcttgaaagatattcagaacaaatttggcaataaccctaacttttatcgcttacgtattggtatcggccatcccggcgataaaaataaagtggttggctttgtgctaggcaaaccaccagccagtgaacaacagttgattgatgatgccattgatgaagcacggcgttgtactgatatcctgatgaaacaagatatggataaagcgatcaaccgtttacatagctttaaagccagcgtttga

SEQ ID NO: 38228 - protein, 196 aa, Photorhabdus luminescens
MSNIKLIVGLANPGAEYAQTRHNAGAWYVDLLARSHNQSLKEESKFFGYTARINICGHDVRLLVPTTFMNLSGKSVVALASFYRIQPDEILVAHDELDLPPGVAKMKLGGSHGGHNGLKDIQNKFGNNPNFYRLRIGIGHPGDKNKVVGFVLGKPPASEQQLIDDAIDEARRCTDILMKQDMDKAINRLHSFKASV

SEQ ID NO: 38229 - DNA, 558 bp, Porphyromonas gingivalis
  CDS (1)..(558)
atgaaatacctgatcgtcggccttggcaatatcggcggagagtacaacggcactcgccataatgtgggtttccggatggtgaatgctctggccgaagacggtggagtgcagttcgtggaagctcgttacggagcgatagcgcgtatgcgtgtgaagaatgcggagctgatcctgctgaaaccaaatacatatatgaatctgagtggcaatgccgttcgctactggatgcaacaggagaatatccctcgcgaacaggtgcttgtccttgtggacgatttggctttgcctttcggcactttgcggctgaaacccaagggaagcgatgcggggcataacgggctgaagaacattgccgaggtgatgggatcgatcgattatgcccgtctgcgtttcggcttgggcgacgagttttccaaaggaaggcaggtggacttcgtcctcggccgttttacccccgaagaagaggagaagctgccggagctgaccaagcatgccgtggagatcatcaagagtttttgcctggccggtatccaaaggacgatgaaccggtacaactaa

SEQ ID NO: 38230 - protein, 185 aa, Porphyromonas gingivalis
MKYLIVGLGNIGGEYNGTRHNVGFRMVNALAEDGGVQFVEARYGAIARMRVKNAELILLKPNTYMNLSGNAVRYWMQQENIPREQVLVLVDDLALPFGTLRLKPKGSDAGHNGLKNIAEVMGSIDYARLRFGLGDEFSKGRQVDFVLGRFTPEEEEKLPELTKHAVEIIKSFCLAGIQRTMNRYN

SEQ ID NO: 38231 - DNA, 621 bp, Prochlorococcus marinus
  CDS (1)..(621)
atgaggccgggtcgtttacgtctattggtaggcctaggtaatccaggctcaaagtatgtcggtacccgtcacaacatcggcttcatggccctcgataagttggctgcgcagaagtcagtcagtttcaggccgcaaacaaagttccatggactgatggcggaagtggcggttggctcagagagggttcgattgctgatgcctcaaacttatatgaatgaaagcggtcgggcgattcgtgcagccatcgattggtttggcttggaggttgatcagttgctggtgcttgtagatgacatggatttgtctttgggtcgactgcggcttcgcgcccagggaagtgcaggaggtcacaatggtttgcgcagcgcgattcaacatctggggactcaggatttttgtcgtctgcggatcgggatcggtgctccaggttgtacctctgaggaacgaagagctcgaaccgtctcgcatgtgctcggggtgtttagtcggcaggagagcctcctagtcgatcaagtgcttgatgaggtgctgatgggtttggatctgattcagtgccttgggttggaacgggcaggtaatcgtctcaatgcttttcaaccggagggttgttctgcctgctga

SEQ ID NO: 38232 - protein, 206 aa, Prochlorococcus marinus
MRPGRLRLLVGLGNPGSKYVGTRHNIGFMALDKLAAQKSVSFRPQTKFHGLMAEVAVGSERVRLLMPQTYMNESGRAIRAAIDWFGLEVDQLLVLVDDMDLSLGRLRLRAQGSAGGHNGLRSAIQHLGTQDFCRLRIGIGAPGCTSEERRARTVSHVLGVFSRQESLLVDQVLDEVLMGLDLIQCLGLERAGNRLNAFQPEGCSAC

SEQ ID NO: 38233 - DNA, 585 bp, Pseudomonas syringae
  CDS (1)..(585)
atgaccgccatacaactgatcgtgggcctgggaaatccaggcgctgaatacgaacagacccggcataacgcaggggcttttttcgttgagcgtattgctgcggcgcaacgagtcaatctcgttcccgagcgcaaattctttggcctgaccggacgctttacgcatcagggtcaggatgttcgtctgctgatccccaccacctacatgaaccgcagcggccaggctgtcgcggcgcttgcgggcttctaccgtatcccgatcgagtcgattctggtggcgcacgacgaactggacctgcctccgggcgttgccaaactcaaagtgggcggcggtcatggcggtcacaacggcctgcgcgacatcatcgcgcagctcggcaaccagaacacatttcatcgcttgcggcttggcattggccacccgggcgatgccagcaaggtatccggctttgtcctgggtcgagcgccacgcgccgaacaggaaaaactggacgccagtatcgactttgccctcggcgtgctgccggatatcttcgccggtgaatggaaccgggcgatgaaaaacctgcacagccagaaggcctga

SEQ ID NO: 38234 - protein, 194 aa, Pseudomonas syringae
MTAIQLIVGLGNPGAEYEQTRHNAGAFFVERIAAAQRVNLVPERKFFGLTGRFTHQGQDVRLLIPTTYMNRSGQAVAALAGFYRIPIESILVAHDELDLPPGVAKLKVGGGHGGHNGLRDIIAQLGNQNTFHRLRLGIGHPGDASKVSGFVLGRAPRAEQEKLDASIDFALGVLPDIFAGEWNRAMKNLHSQKA

SEQ ID NO: 38235 - DNA, 720 bp, Rhizobium meliloti
  CDS (1)..(720)
atgctgatcatcgcgggacttggcaatcccggcccgaaatatgccggcaaccgccacaatatcggcttcatggccgtcgacgccattcagcggcgccagggcttttccgcctggtcgaggaaattcaagtcggaggtctccgaaggcgagatcgacggcgaacgcgtcctgctgatgaagccgcagaccttcatgaacctctccggcgaagccctcggcgacgcgatgcgcttctacaagctcgcgccaaaggacatcgtcgtcatctatgacgaactggaccttcccgccggcaaggcccggatcaagaccggcggcggccacggcgggcacaacggcatcaagtccatcgacgcccattgcggcaaggaataccgccgtttgcggctcggtatcggccatccgggggtcaaggatctggtccacgcgcatgtgctcggcgatttcgccaaggccgaccaggcctggctttcgctcctgctcgaggccatcgccgacaatgccgcgatgctggtgaagggcgaggactcgcagctcatgaacaagatcgcgctggcgaccgggggcaagcccgagacggagaagcccgtcgctgtgaagaagcaggcggcgcaatcccatatccatcaggcgcgtgccaccgcccagccgaaaaagctgccggtgacgggccctatggccgacatgctgaagaagatgttcgggccgaaaggggattag

SEQ ID NO: 38236 - protein, 239 aa, Rhizobium meliloti
MLIIAGLGNPGPKYAGNRHNIGFMAVDAIQRRQGFSAWSRKFKSEVSEGEIDGERVLLMKPQTFMNLSGEALGDAMRFYKLAPKDIVVIYDELDLPAGKARIKTGGGHGGHNGIKSIDAHCGKEYRRLRLGIGHPGVKDLVHAHVLGDFAKADQAWLSLLLEAIADNAAMLVKGEDSQLMNKIALATGGKPETEKPVAVKKQAAQSHIHQARATAQPKKLPVTGPMADMLKKMFGPKGD

SEQ ID NO: 38237 - DNA, 573 bp, Rhodopirellula baltica
  CDS (1)..(573)
atgaagttagtcgtcggcttgggtaaccctggtcggaaatacgaccaaacccgccacaacattggattcatggtcgccgacgccctcgtgcgtcggtatgtcggttctcccccgacgaccaaatttgagggagagatcagcgagtgtcgcatcgaaaacgaaaaggttttggtgctttgcccgcaaacatacatgaacgccagtgggcaaagtgtccgcaaggcaatggatttttacaaactttccccggaagacatcctcgtcatttgtgatgacttgaacctcgaaaccggtcgcgttcgattgcgacgatctggttccgctggtggtcaaaaaggcctggtcgacatcattcgtcacctcggcagcgaacaatgggcgagactaaagatcggaatcggacgtccgccagcgaaatggcaggtgtctgattatgttttgggcaagtttgacaaaaccgaattagaagaaatggaacatgccatcgtgcattcctgtgacgccaccgcttgttgggtggccgacggagtgacggaagccatgaaccgttacaatgccgccagcggcacttag

SEQ ID NO: 38238 - protein, 190 aa, Rhodopirellula baltica
MKLVVGLGNPGRKYDQTRHNIGFMVADALVRRYVGSPPTTKFEGEISECRIENEKVLVLCPQTYMNASGQSVRKAMDFYKLSPEDILVICDDLNLETGRVRLRRSGSAGGQKGLVDIIRHLGSEQWARLKIGIGRPPAKWQVSDYVLGKFDKTELEEMEHAIVHSCDATACWVADGVTEAMNRYNAASGT

SEQ ID NO: 38239 - DNA, 585 bp, Shigella flexneri
  CDS (1)..(585)
atgacgattaaattgattgtcggcctggcgaaccccggtgctgaatacgccgcaacgcgacataatgctggtgcctggttcgttgacttactggcagagcgtttgcgcgctccgctgcgcgaagaggctaaattctttggttatacttcgcgagtcacccttggaagcgaagatgtccgcctgttagtcccgactacatttatgaatctcagcggcaaagccgttgcggcgatggccagttttttccgcattaatccggacgaaattctggtggcccacgacgaactggatctgcctcctggcgtcgccaaatttaagttgggcggtggccatggtggtcacaatggactgaaagacatcatcagtaaattgggtaataaccctaactttcaccgtttacgcatcggaatcggtcatccgggcgataaaaataaagttgtcggttttgtgttaggcaaaccgcctgttagtgaacagaagttaattgatgaagccatcgacgaagcggcgcgttgtactgaaatgtggtttacagatggcttgaccaaagcaacgaaccgattgcacgcctttaaagcgcaataa

SEQ ID NO: 38240 - protein, 194 aa, Shigella flexneri
MTIKLIVGLANPGAEYAATRHNAGAWFVDLLAERLRAPLREEAKFFGYTSRVTLGSEDVRLLVPTTFMNLSGKAVAAMASFFRINPDEILVAHDELDLPPGVAKFKLGGGHGGHNGLKDIISKLGNNPNFHRLRIGIGHPGDKNKVVGFVLGKPPVSEQKLIDEAIDEAARCTEMWFTDGLTKATNRLHAFKAQ

SEQ ID NO: 38241 - DNA, 612 bp, Streptomyces avermitilis
  CDS (1)..(612)
atgggagacacggacgtgacgagcgacgccaatgcgccctggttgatcgtagggctcgggaatccggggccggagtacgcgcggaaccggcacaacgtggggttcatggtggccgatctgctggcggagcggatcggggggaagttcaagcgggccggtaaggcgcaggcgcaggtgatcgaggggcgcatcgggccgcccggtccggcgaaccggcgggtgattctggcgaagccgatgtcgtacatgaatctgtccggcggtccggtgaacgcgctgcgggagttctacaaggtgccggtggcgaacatcgtggcggtccacgacgagttggacatcgactacggcgtcctgcggctcaagctcggcggcggcgacaacggccacaacgggctcaagtcgatgacgaaggcgatgggcccggactaccaccgggtgcggttcggcatcggacgccctccgggccgtatgcaggtcgccgatttcgtgctgaaggacttcgcgtcggcggagcgcaaggagctcgactacctcgtcgaccgcgcggcggacgccgcggagtgtctggtgatcgaggggctggagcgggcgcaggggacgtacaactcctga

SEQ ID NO: 38242 - protein, 203 aa, Streptomyces avermitilis
MGDTDVTSDANAPWLIVGLGNPGPEYARNRHNVGFMVADLLAERIGGKFKRAGKAQAQVIEGRIGPPGPANRRVILAKPMSYMNLSGGPVNALREFYKVPVANIVAVHDELDIDYGVLRLKLGGGDNGHNGLKSMTKAMGPDYHRVRFGIGRPPGRMQVADFVLKDFASAERKELDYLVDRAADAAECLVIEGLERAQGTYNS

SEQ ID NO: 38243 - DNA, 603 bp, Streptomyces coelicolor
  CDS (1)..(603)
atggacgtgacgacggacgcgggcgctccgtggctggtggccggcctcggcaatccgggccccgagtacgcctcgaaccggcacaacgtcggtttcatggtggcggacctgctggcggagcggatcggggcgcgtttcaagcggcacggcaaggcgcaggcgcaggtggtcgaggggcggatcggtccgccggggccggcgaaccggcgggtgatcctggcgaagccgatgtcgttcatgaacgtgtcgggcggtccggtgacggcgctgcgggacttctacaaggttccggtcggcaacatcgtggcggtgcacgacgagctggacatcgactacggcgtgctgcggctgaagctgggcggcggggacaacgggcacaacggcctgaagtcgatcacgaagtcgctgggcgcggactaccaccgggtgcggttcgggatcgggcggccgccggggcggatgccggtggcggatttcgtactgcgggacttctcgtcgacggagcgcaaggagctggactacttcgtcgaccgggcggcggacgcggtggaggctctggtgatcgaggggctcgagcgggcgcagagcgcgtacaactcctga

SEQ ID NO: 38244 - protein, 200 aa, Streptomyces coelicolor
MDVTTDAGAPWLVAGLGNPGPEYASNRHNVGFMVADLLAERIGARFKRHGKAQAQVVEGRIGPPGPANRRVILAKPMSFMNVSGGPVTALRDFYKVPVGNIVAVHDELDIDYGVLRLKLGGGDNGHNGLKSITKSLGADYHRVRFGIGRPPGRMPVADFVLRDFSSTERKELDYFVDRAADAVEALVIEGLERAQSAYNS

SEQ ID NO: 38245 - DNA, 570 bp, Streptococcus mutans
  CDS (1)..(570)
atgactaaattaattgttggccttggaaatccaggcagtaaatatcatgaaacgaaacataatgttggctttatggctcttgacagaattgtcaagcctttgaatgttcagtttacagaaaataaaacatttaaagcagaaacagtagcgacttttattaatggtgaaaaaatttattttattaaaccaactacatttatgaatgccagtggtttagctgtcagagcttttctagcttattataatttaactgtggaagatctaattgttatttatgatgatcttgatatggaagtaggaaaaatacgttttcgtcaaaaaggctctgctggtggacataatggtataaaaagcattatcaaggaaattgggactcaggaatttgatcgtatcaagattggtattggccgtccaaaggataagatgacagtcgttaactatgttttaggaaaatttgataaaaaagatgaaataactatttttaacacacttgataaagttgacaaagctgtcaattactatttacaaacgaaaaattttgaacaaacaatgcaaaaatttaatgggtaa

SEQ ID NO: 38246 - protein, 189 aa, Streptococcus mutans
MTKLIVGLGNPGSKYHETKHNVGFMALDRIVKPLNVQFTENKTFKAETVATFINGEKIYFIKPTTFMNASGLAVRAFLAYYNLTVEDLIVIYDDLDMEVGKIRFRQKGSAGGHNGIKSIIKEIGTQEFDRIKIGIGRPKDKMTVVNYVLGKFDKKDEITIFNTLDKVDKAVNYYLQTKNFEQTMQKFNG

SEQ ID NO: 38247 - DNA, 618 bp, Synechococcus elongatus
  CDS (1)..(618)
atggcactccagccctgtgtcattgttggtcttggaaatccgggaatagagtacgccacaactcgccacaatgttggttttcgtgtcctcgacactcttgcgcagcggtatagggtgcagctgactcagcagcggcgcttcttgggagaggtggcagaggtactgattcagggtcaaaaggtgcggctcctcaagcccaccacctacatgaatagctcggggcaatctctccatgccctgttgaatttttataagctgcccctcgagcgaacccttgtggtccatgatgatgccgatttgcccctggggcgactgcgcttgcgcctgagtggctcaacggggggacacaacgggattaaatccattattcagcattgtcattcccaacagtttcctcgccttaaggtgggcattgcctttggcgatcgcctgcagcagcagacgggacctcgcaacgcggtgccctttgttttggggcatttttcagccactgaactggccattttacccgctgtgcttgacctggctgtggatgccattgagttgagtattcagtctggggttgaggtggccatgaatcgctacaacggcaaaagtattcccctaccgcaagcctga

SEQ ID NO: 38248 - protein, 205 aa, Synechococcus elongatus
MALQPCVIVGLGNPGIEYATTRHNVGFRVLDTLAQRYRVQLTQQRRFLGEVAEVLIQGQKVRLLKPTTYMNSSGQSLHALLNFYKLPLERTLVVHDDADLPLGRLRLRLSGSTGGHNGIKSIIQHCHSQQFPRLKVGIAFGDRLQQQTGPRNAVPFVLGHFSATELAILPAVLDLAVDAIELSIQSGVEVAMNRYNGKSIPLPQA

SEQ ID NO: 38249 - DNA, 612 bp, Synechococcus sp
  CDS (1)..(612)
atggccgatgtgctccggctggtggtcggcctgggcaatccaggcacgaagtatgagggaacccgtcacaacatcggcttcatggcattggagcagatggcatcacgcgaggggttcagttttcgtcagcagagcaagttgcatggcttggtggcggagcacggcatcggtgaaagccgactgaggctgctcatgccgcagacctacatgaacgacagcggtcggtccatccgcgcagcgctcgactggtttggcttcacgccggaacaactgctggttctggtggatgacatggacatccccctggggcgtctgcggttgcggggccagggcagtgctggaggccataacggtttgcggagcacaattcagcacctgggcactcaggcctttccgcgcttgcgcatcggcattggtgctcctgctgacaatcccgcggaacggcgggcgcgcaccgtgtcccacgtgctcggttccttcagtcgtgcggagcagcctgaggtggatgtcgtgctggacggtgtgttggaggccatccagcgcattcagcgccagggtctggaccgcgccggcaactggatcaacggcttctgtccggcttcagtggaatga

SEQ ID NO: 38250 - protein, 203 aa, Synechococcus sp
MADVLRLVVGLGNPGTKYEGTRHNIGFMALEQMASREGFSFRQQSKLHGLVAEHGIGESRLRLLMPQTYMNDSGRSIRAALDWFGFTPEQLLVLVDDMDIPLGRLRLRGQGSAGGHNGLRSTIQHLGTQAFPRLRIGIGAPADNPAERRARTVSHVLGSFSRAEQPEVDVVLDGVLEAIQRIQRQGLDRAGNWINGFCPASVE

SEQ ID NO: 38251 - DNA, 558 bp, Thermoanaerobacter tengcongensis
  CDS (1)..(558)
atgtacataatagctggtcttggaaatccgggaaaagaatacgagggcacgaggcacaatgtaggctttatggtgatagatgccctttcaaaaaagcttgggatagaggtttcaaggcttaaattcaagtccctcatgggggaagggcattttaaaggcgaaaaagtgatacttttgaagcctcagacgtttatgaatttgagtggcgaagccctgtacgatgctgtaaatttttataaaattccgcttgaaaatgtaattgtggtatatgatgataaagaccttgaggtgggaaaaataaggataaggagaaaaggaagttcaggcggtcacaatggcatgaactcaataatatatcttttaaacagcgaagactttcctagagtgagaataggtattgggaagccagaagatggcgaccttgtaaggcacgttctggggcgatttagcgatgaagagaaaaaggtgatagatgaggcggtggaaagagcagcagaagccgtgattgacataatggagaatggaatagagcatgccatgagcagatttaatggctag

SEQ ID NO: 38252 - protein, 185 aa, Thermoanaerobacter tengcongensis
MYIIAGLGNPGKEYEGTRHNVGFMVIDALSKKLGIEVSRLKFKSLMGEGHFKGEKVILLKPQTFMNLSGEALYDAVNFYKIPLENVIVVYDDKDLEVGKIRIRRKGSSGGHNGMNSIIYLLNSEDFPRVRIGIGKPEDGDLVRHVLGRFSDEEKKVIDEAVERAAEAVIDIMENGIEHAMSRFNG

SEQ ID NO: 38253 - DNA, 561 bp, Tropheryma whipplei
  CDS (1)..(561)
atgtgtgtgtacatagtggctggccttggtaaccctggcccttcgtatgacaagacgcggcacaatgttggccagatggttcttgatatcttgtcaggaggtgcgcgtttcaggcgtcacaaaacgaataatttttatctttcactcggtgatatcttgctcgtcaaaccggatgcgtatatgaatttatcgggtcccgttattgcgagcctgatgaaatttcattctgtatcagacctacttgttctgcatgacgatattgaccttcctctcggcacgcttcgattcaagcaaggcgggggtactgccggccatagaggtcttagaagtataagtgattgccttggttctgattacgcaagattaagggttggtataggcaggccagaaaataaccaaagcatcgaagactttgtcttgtcaaacttctctcctgttcagacagacattatcagcagaacaatacagctggccgcagaggccgttttgcatctgagagacaatggctttgttggcgtaaaacaattcatagcccaaaccaaattgccctctcggacttaa

SEQ ID NO: 38254 - protein, 186 aa, Tropheryma whipplei
MCVYIVAGLGNPGPSYDKTRHNVGQMVLDILSGGARFRRHKTNNFYLSLGDILLVKPDAYMNLSGPVIASLMKFHSVSDLLVLHDDIDLPLGTLRFKQGGGTAGHRGLRSISDCLGSDYARLRVGIGRPENNQSIEDFVLSNFSPVQTDIISRTIQLAAEAVLHLRDNGFVGVKQFIAQTKLPSRT

SEQ ID NO: 38255 - DNA, 591 bp, Vibrio parahaemolyticus
  CDS (1)..(591)
atgactcaaccaatcaaacttcttgttggtcttgctaatccgggaccagaatatgccaaaactcgccataatgcgggcgcttgggttgtagaagaattagcacgcgtccataacgttaccctgaagaacgaaccaaagttctttggcctaaccggacgcatcatggtcaacggccaggatctccgtttgcttatccctaccactttcatgaacctctctggaaaagcgatcgctgctttggcgaagttttaccaaattaagccagaagagatcatggttgctcacgacgagctagacttaccgccaggtgtcgctaagtttaagaaaggtggtggccacgggggccacaacggactacgtgacacaataagcaaactgggcaataacaaagatttttatcgtcttcgtatcggcattggccatccgggacacaaagataaagtggcaggttttgtattaggtaaagctccagcgaaagagcaagagctactagatgccgcagcagatgaagctgttcgtagtctagacatcctgattaaggatggcctatccaaagcacaaaaccgcctccacacgttcaaagctgaataa

SEQ ID NO: 38256 - protein, 196 aa, Vibrio parahaemolyticus
MTQPIKLLVGLANPGPEYAKTRHNAGAWVVEELARVHNVTLKNEPKFFGLTGRIMVNGQDLRLLIPTTFMNLSGKAIAALAKFYQIKPEEIMVAHDELDLPPGVAKFKKGGGHGGHNGLRDTISKLGNNKDFYRLRIGIGHPGHKDKVAGFVLGKAPAKEQELLDAAADEAVRSLDILIKDGLSKAQNRLHTFKAE

SEQ ID NO: 38257 - DNA, 591 bp, Vibrio vulnificus
  CDS (1)..(591)
atgagtcaacagatcaaacttcttgtcggccttgctaatcctgggcctgaatatgccaaaactcgccacaatgcgggcgcttgggtagtagaagaactggcacgcgttcacaacattacgctaaagaatgaagcaaagttctatggcttaacaggacgtattgtgatgaatggtcaggaactgcgtttactgattcctactacttttatgaacctttctggtaaagccattgctgcattggcaaagttttatcagattcaaccagaagagatcatggtcgcgcatgacgagctggatcttcctcctggtatcgcaaagttcaaaaaaggtggtggccatggtggccacaatggtttgcgagataccattagtaaactgggcaacaataaagaattctaccgtctacggatcggcattggccatcctggacacaaagataaagtagcgggttttgtactgggtaaagcacctgccagtgaacaatccttactcgacgctaccgtcgacgaatctgttcgctgcttggatattttgatcaaagatggtctatccaaagcacaaaaccgcctccacacgttcaaagctgaataa

SEQ ID NO: 38258 - protein, 196 aa, Vibrio vulnificus
MSQQIKLLVGLANPGPEYAKTRHNAGAWVVEELARVHNITLKNEAKFYGLTGRIVMNGQELRLLIPTTFMNLSGKAIAALAKFYQIQPEEIMVAHDELDLPPGIAKFKKGGGHGGHNGLRDTISKLGNNKEFYRLRIGIGHPGHKDKVAGFVLGKAPASEQSLLDATVDESVRCLDILIKDGLSKAQNRLHTFKAE

SEQ ID NO: 38259 - DNA, 579 bp, Wolinella succinogenes
  CDS (1)..(579)
atggtgttagttgtagggcttgggaatccaggcaaaacatacgaaagcacccgccacaatattggatttagggtcatcgatgcacttttagagcgtcggtcggccttgaatgcgaccaagagcacctttaagggtgagcttcacaaagagggcgagaacctctttctcaagcccaccacctacatgaatctctcaggagaatcagccctccccgtctccactttctataagcccgaaaaaatccttgttattcatgatgatcttgatcttccctttggagcgattcgcttgaagcgtggaggggggaatggggggcataatggacttaaatcgcttgataagcttctaggcaatgactattatcgactgaggatagggattggcaagcctcctttggggtgggaggttgctgattatgtgttggcaagatttagccaagaggaggagcaggagctagaagagcgacttttcccccatgccaaagaggcgattgagagcttcttggaagggaagatggagtgggatcgattggtttcgcgctactctcttaagccctcaacccccaaggagaaggtgtga

SEQ ID NO: 38260 - protein, 192 aa, Wolinella succinogenes
MVLVVGLGNPGKTYESTRHNIGFRVIDALLERRSALNATKSTFKGELHKEGENLFLKPTTYMNLSGESALPVSTFYKPEKILVIHDDLDLPFGAIRLKRGGGNGGHNGLKSLDKLLGNDYYRLRIGIGKPPLGWEVADYVLARFSQEEEQELEERLFPHAKEAIESFLEGKMEWDRLVSRYSLKPSTPKEKV

SEQ ID NO: 38261 - DNA, 582 bp, Xanthomonas axonopodis
  CDS (1)..(582)
atgactgcactccgcctgatcgtcgggctcggcaatccgggcccggaacacgcgcaaacccggcataacgccgggtttcgtttcgtcgatgccctcatcgagcgcagtggcgcccgctgggcattggacagcaagttgttcggcgagaccgccaaggtcgaggtcgcgggacaaccggtctggctgctcaagccggctaccttcatgaatctcagcggcaagtcgatcaccgccgcattgcggttctggaagatcgagcccgaacacctgctggtcgcccacgacgaactggatctggcgcccggtaccgcgcggctcaagttcgacggcggtcacggcgggcaaaacggcttgcgcgacaccattcgcctgctcgggcacggcaaatttcaccgtctacgcgttggcatcggtcatcccggtcataaggatcgcgtggtgccctgggtgctggggcgggcagggcgcgaggacgatgcggcgatcggcgctgcggtggacgccgccatcgatgtgctgccgctggcgatggaaggcaatttcaacgaggcgatgaaacgcctgcacaccgaaaaaaaatag

SEQ ID NO: 38262 - protein, 193 aa, Xanthomonas axonopodis
MTALRLIVGLGNPGPEHAQTRHNAGFRFVDALIERSGARWALDSKLFGETAKVEVAGQPVWLLKPATFMNLSGKSITAALRFWKIEPEHLLVAHDELDLAPGTARLKFDGGHGGQNGLRDTIRLLGHGKFHRLRVGIGHPGHKDRVVPWVLGRAGREDDAAIGAAVDAAIDVLPLAMEGNFNEAMKRLHTEKK

SEQ ID NO: 38263 - DNA, 582 bp, Xanthomonas campestris
  CDS (1)..(582)
atgtctgcattacgtctgatcgtcgggctgggcaatcccggtcccgaacacgcgcaaacccggcacaacgccgggtttcgtttcgtcgatgcgctcgccgagcgcaccggcgcacggtggggcctggacagcaagctgttcggcgaaaccgccaaggccgagatcgccggccacacggtgtggttgctcaaacccgccactttcatgaacctaagtggcaagtcgatcactgctgcgctgcggttctggaagatcgagcctgagcagctgctggttgcgcatgacgagctggacctggcgccgggcacggcgcggctcaagttcgacggcggccatggcggccagaatggcctgcgtgacaccatccgtctgctcggacatggcaagttccaccggctgcgggtcggcatcggtcaccctggtcacaaggaccgcgtggtgccctgggtgctgggtcgtgccgggcgcgacgacgacatggcgatcggcgaggcagtggatgcggccatcgatgcgctgccgctggcactggacggtaatttcaacgaggcgatgaagcggttgcacaccccaaaaaaatag

SEQ ID NO: 38264 - protein, 193 aa, Xanthomonas campestris
MSALRLIVGLGNPGPEHAQTRHNAGFRFVDALAERTGARWGLDSKLFGETAKAEIAGHTVWLLKPATFMNLSGKSITAALRFWKIEPEQLLVAHDELDLAPGTARLKFDGGHGGQNGLRDTIRLLGHGKFHRLRVGIGHPGHKDRVVPWVLGRAGRDDDMAIGEAVDAAIDALPLALDGNFNEAMKRLHTPKK

SEQ ID NO: 38265 - DNA, 579 bp, Xylella fastidiosa
  CDS (1)..(579)
atgttagggctgcgtttgatagttgggctcggcaatccgggtagtgagtacatcaaaaccaggcacaatgctgggtttcgctttgtcgatggtttagttcagcgtgaggggcagtgctgggcgttggagtctaagttgtttgcttacgttgctcgtgtgtttatcgctgggcaatgggtatggttactacgcccagtcacttttatgaatttgagcggcaagtcgatttgtgccggtttgaatttttggaaaattaaaccggagcaaatgttggttgctcacgatgagttggattttccaccaggggctgtgcgcttgaagtttgatggtggtcatggtggtcagaatgggttgcgtgatattaccaagttgcttggtcacggacgttttcatcgtctgcgtgtaggtattggtcatcctggccataaagaccgtgtggtgagttgggtgctaggttgtccaacgtgcgatgaaaatattgctattgatgctgctttggaacgagccagtgtagtgttgcctttagcggttgctggtgactttgatggggcgatgaaaaagctacatacggtagtgtga

SEQ ID NO: 38266 - protein, 192 aa, Xylella fastidiosa
MLGLRLIVGLGNPGSEYIKTRHNAGFRFVDGLVQREGQCWALESKLFAYVARVFIAGQWVWLLRPVTFMNLSGKSICAGLNFWKIKPEQMLVAHDELDFPPGAVRLKFDGGHGGQNGLRDITKLLGHGRFHRLRVGIGHPGHKDRVVSWVLGCPTCDENIAIDAALERASVVLPLAVAGDFDGAMKKLHTVV

SEQ ID NO: 38267 - DNA, 24 bp, Primer
atgtccggtaaatggagactagtg

SEQ ID NO: 38268 - DNA, 25 bp, Primer
ctatgaaatgtactgagtcagagca

SEQ ID NO: 38269 - protein, 165 aa, consensus
  MISC_FEATURE (1)..(165): consensus for the disclosure of xaa see table XV
LXXGLGNPGXXYXXTRHNXGXXXXXXLXXXXXXXXXXXXXXXXXXXXXXXXXXXXXXXXXXXXXXXXPXTXMNXSGXXXXXXXXXXXXXXXXXXVXXDXXXXXXGXXXXXXXGXXXXGHNGXXXXXXXXXXXXXXXXXXRXXXGIGXPXXXXXXXXXXXXXXXVL

SEQ ID NO: 38270 - protein, 26 aa, consensus
  MISC_FEATURE (1)..(26): consensus for the disclosure of xaa see table XV
XXGXXNXXXXXXXXXHNXGXXXXXXX

SEQ ID NO: 38271 - protein, 12 aa, consensus
  MISC_FEATURE (1)..(12): consensus for the disclosure of xaa see table XV
XXXXMNXSGXXX

SEQ ID NO: 38272 - protein, 51 aa, consensus
  MISC_FEATURE (1)..(51): consensus for the disclosure of xaa see table XV
XXXDXXXXXXXXXXXXXXXXXXXGXXGXXXXXXXXXXXXXXXXXXXXXXGX

SEQ ID NO: 38273 - DNA, 648 bp, Escherichia coli
  CDS (1)..(648)
atggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataa

SEQ ID NO: 38274 - protein, 215 aa, Escherichia coli
MARKTKQEAQETRQHILDVALRLFSQQGVSSTSLGEIAKAAGVTRGAIYWHFKDKSDLFSEIWELSESNIGELELEYQAKFPGDPLSVLREILIHVLESTVTEERRRLLMEIIFHKCEFVGEMAVVQQAQRNLCLESYDRIEQTLKHCIEAKMLPADLMTRRAAIIMRGYISGLMENWLFAPQSFDLKKEARDYVAILLEMYLLCPTLRNPATNE

SEQ ID NO: 38275 - DNA, 621 bp, Agrobacterium rhizogenes
  CDS (1)..(621)
atgagaaggacgtcggatgaggctgcagctacccggaggcggattttacgctctgccgaggctgtgtttatcgaaaaaggatacgatgaagcctccttgcaggaaattgccgccgaagcggccgtaacaaccggcgccatccagtggcatttcggacaaaaaatgcacattctattggccttgcgcgatgagttatgctggcaggcaagaaagctcggcaggcttcacgacgcagggatggttgagaagccattaaaggcagtcgccgagtttgccacatcagccattaactactttgccgacaatgaaaactgcaggcggattttccagatctatgataggaaagtctccgatacagtggccttccataatgaagaccgcaagtttcagcaggaggtgcgggctacgttagggaacgtttttggatccgcagagacgaggaaggaattactagctccttggacctccgacactgcggcatataccttttggtttgcaatgcgaggaacgtttcagacctggctggaggacgattcgacgtttgacttgaagtccgatggcatgcgtatcgttcaaacgatgctttcctcgtaccagcgcgccgatttggtcactggataa

SEQ ID NO: 38276 - protein, 206 aa, Agrobacterium rhizogenes
MRRTSDEAAATRRRILRSAEAVFIEKGYDEASLQEIAAEAAVTTGAIQWHFGQKMHILLALRDELCWQARKLGRLHDAGMVEKPLKAVAEFATSAINYFADNENCRRIFQIYDRKVSDTVAFHNEDRKFQQEVRATLGNVFGSAETRKELLAPWTSDTAAYTFWFAMRGTFQTWLEDDSTFDLKSDGMRIVQTMLSSYQRADLVTG

SEQ ID NO: 38277 - DNA, 618 bp, Mesorhizobium loti MAFF303099
  CDS (1)..(618)
gtggagaaaaaattggccgaagccgtcatcgctgaagacaccgccgcggaacccaagccgctgcgcgccgatgcccagcgcaaccgcgaccggctggtcgaggtggcggcttcggtatttgccgagcgcggcatcgatgcctcgctggaggagatcgcgcgccgtgccggcgtcggcatcggcacgctctaccggcatttcccgacgcgcgagcatctggtcgaggtggtctaccgccgcgaggtcgaggcgctgtgcgccgccgccgccgagcttgcccaaaaacatccctccgatgtcgcgctcgaggtgtggatgcggcgcttcgtcgactacatcgccaccaagcgcggcctggcgaccagcctgcgcatcctgctgacaaccaattccaccctgttctccgacacgtcggggcgggtctcgcaagccttgcgacaattggtcgaggcggcggtggccgacggtaccatccgtgacgatgtcgatgcctcggatgtgctgcacgcacttggtggcatctattccgcgcccgacacgccggagtggcgcgaccgttcgcgccggctggtcaagctcttgatggacgggctgcggttcggggcgggaaaggggtga

SEQ ID NO: 38278 - protein, 205 aa, Mesorhizobium loti MAFF303099
MEKKLAEAVIAEDTAAEPKPLRADAQRNRDRLVEVAASVFAERGIDASLEEIARRAGVGIGTLYRHFPTREHLVEVVYRREVEALCAAAAELAQKHPSDVALEVWMRRFVDYIATKRGLATSLRILLTTNSTLFSDTSGRVSQALRQLVEAAVADGTIRDDVDASDVLHALGGIYSAPDTPEWRDRSRRLVKLLMDGLRFGAGKG

SEQ ID NO: 38279 - DNA, 735 bp, Mesorhizobium loti MAFF303099
  CDS (1)..(735)
atggccgacacaacgcctgacgtcgaaaccgataaatgcgacgacctgctggaaagcctgcgtcgtggcaggccggcggccggacaggatccggtcaagcgcagccagatcatcgatggcgcccgccgtgtcttcattgagaaaggcttcgaagccgcttcgatgaacgacatcacgcgcgaggccggtgtgtcgaagggcacgatctatgtctacttcgccaacaaggaagagctgttcgaggcgctgatcgaggaagagcgcggcaccatcttcaagaatatgtacgacatgctcgaccgcgccgacgatctgcgccagactctggtgaagttcggcaaggtgctgtcgatgaagatcacctcggccagggtcatccaggcgcagcgcacggtgatcggcgcctccgacaggatccccgacatgggcgcgcggttttacgaacgcggccccaaacgcggccatgacaaggtggtgaagtttctcaatgccgccatcgaacgcggcctgctcaagatcgacgatgtcgatcttgccgcctaccagttcaccgaactgtgcctggccggcctcttccggcagtgcatcttcgcctaccgcaccaaggctccgagccaggaagaaatcgaccacatcgtcaggtcgggcgtcgacatgttcctgaagaactacggcaccgaacagctcgccgaggaagaaagccaccagatgatcgcgctggaggcaaaggcctag

SEQ ID NO: 38280 - protein, 244 aa, Mesorhizobium loti MAFF303099
MADTTPDVETDKCDDLLESLRRGRPAAGQDPVKRSQIIDGARRVFIEKGFEAASMNDITREAGVSKGTIYVYFANKEELFEALIEEERGTIFKNMYDMLDRADDLRQTLVKFGKVLSMKITSARVIQAQRTVIGASDRIPDMGARFYERGPKRGHDKVVKFLNAAIERGLLKIDDVDLAAYQFTELCLAGLFRQCIFAYRTKAPSQEEIDHIVRSGVDMFLKNYGTEQLAEEESHQMIALEAKA

SEQ ID NO: 38281 - DNA, 588 bp, Bacillus halodurans C-125
  CDS (1)..(588)
gtgggaaagaaaaaaggaccaaaatatgaccaaataatcgatgcggcagtacaagtcattgccgagcatggctaccatcaagcgcaagtatcaaaaatcgcaaaagcagccggagtagctgatggcacgatttacctttattttaacaataaagaagatgttctcatttcattgtttcaagaaaaaatgggaaggttcgttgataaaattcgttcgcaaatgaacgaagccactgatgtagaagaaaagttaaaaatccttgtaaacatgcactttaaacagcttgccgctgatcataaattagccattgtcacccaattggagctccgtcaatcaaatacagagcttcgtttaaaaataaatgaagttctaaagggttacttaaaccttctcgatgagctattaatggaaggaaaagagaagggctactttttccaagagttagacactcgtcttgcccgccaaatgatctttggcacacttgacgaagtcgtcacaaactgggtgatgaaagattgcaaatatgatttaaccgcattagtgaaacctgttcatcaacttttgctaggtgggttgcgccatcgttga

SEQ ID NO: 38282 - protein, 195 aa, Bacillus halodurans C-125
MGKKKGPKYDQIIDAAVQVIAEHGYHQAQVSKIAKAAGVADGTIYLYFNNKEDVLISLFQEKMGRFVDKIRSQMNEATDVEEKLKILVNMHFKQLAADHKLAIVTQLELRQSNTELRLKINEVLKGYLNLLDELLMEGKEKGYFFQELDTRLARQMIFGTLDEVVTNWVMKDCKYDLTALVKPVHQLLLGGLRHR

SEQ ID NO: 38283 - DNA, 633 bp, Pseudomonas aeruginosa PAO1
  CDS (1)..(633)
gtggccaggaaaaccaaagaggaatcccagaaaacccgcgacggcatactcgatgccgccgagcgggttttcctggaaaagggcgtgggcaccactgccatggccgacctggcggacgccgccggggtttctcgcggtgcggtctacggccactacaagaacaagatcgaggtctgcctggcgatgtgcgaccgcgccttcggccagatcgaggtacccgacgaaaacgccagggtgccggcgctggatatcctcctgcgcgccggcatgggctttctccgccagtgctgcgagcccggttcggtgcagcgggtgctggagatcctctacctcaagtgcgaacgcagcgacgagaacgagccgctgttgcgccgccgcgagctgctcgagaagcaggggcaacgcttcggcctccggcagatccgccgggcggtggaacgcggcgaactgccggcgcggctggacgtcgagctggccagcatctatctgcaatcgctctgggacggcatctgcggcaccctggcctggaccgagcgcctgcgcgacgatccctggaaccgcgccgaacgcatgttccgcgccggcctcgacagcctgcgcagttctccctacctgttgctggcggacgcctga

SEQ ID NO: 38284 - protein, 210 aa, Pseudomonas aeruginosa PAO1
MARKTKEESQKTRDGILDAAERVFLEKGVGTTAMADLADAAGVSRGAVYGHYKNKIEVCLAMCDRAFGQIEVPDENARVPALDILLRAGMGFLRQCCEPGSVQRVLEILYLKCERSDENEPLLRRRELLEKQGQRFGLRQIRRAVERGELPARLDVELASIYLQSLWDGICGTLAWTERLRDDPWNRAERMFRAGLDSLRSSPYLLLADA

SEQ ID NO: 38285 - DNA, 639 bp, Pseudomonas aeruginosa PAO1
  CDS (1)..(639)
atgcgacgcacaaaggaagattctgaaaaaacccgtacggccatcctcctggccgccgaggaactgttcctggaaaagggcgtgtcccataccagcctggaacagatcgccagggccgccggggtgacccgtggcgccgtctactggcacttccagaacaaggcccacctgttcaacgagatgctcaaccaggtacgcctgccgccggagcaactcaccgagcgcctgtccggctgcgatggcagcgacccgctgcgctcgctctacgacctctgcctggaggccgtgcaatcgttgctgacgcaggagaagaagcgccgcatcctgaccatcctgatgcaacgttgcgaattcaccgaggaactgcgcgaggcgcaggaacgcaacaacgccttcgtgcagatgttcatcgaactctgcgagcagttgttcgcccgcgacgaatgccgtgtgcggctgcatccgggcatgaccccgaggatcgcctcgcgcgccttgcacgcgctgatcctgggcctgttcaacgactggttgcgcgacccgcgcctgttcgatccggatacggacgcggaacacctgctggagccgatgttccgtggcctggtgcgcgactggggtcaggccagctcggcgccgtag

SEQ ID NO: 38286 - protein, 212 aa, Pseudomonas aeruginosa PAO1
MRRTKEDSEKTRTAILLAAEELFLEKGVSHTSLEQIARAAGVTRGAVYWHFQNKAHLFNEMLNQVRLPPEQLTERLSGCDGSDPLRSLYDLCLEAVQSLLTQEKKRRILTILMQRCEFTEELREAQERNNAFVQMFIELCEQLFARDECRVRLHPGMTPRIASRALHALILGLFNDWLRDPRLFDPDTDAEHLLEPMFRGLVRDWGQASSAP

SEQ ID NO: 38287 - DNA, 633 bp, Neisseria meningitidis Z2491
  CDS (1)..(633)
atgagaaaaaccaaaaccgaagccttgaaaaccaaagaacacctgatgcttgccgccttggaaaccttttaccgcaaagggattgcgcgcacctcgctcaacgaaatcgcccaagccgccggcgtaacgcgcggcgcgctctattggcatttcaaaaataaggaagacttgttcgacgcgctgttccaacgtatctgcgacgacatcgaaaactgcatcgcgcaagataccgaagatgccgaaggagggtcttgggcggtattccgccacacgctgctgcactttttcgagcggctgcaaagcaacgacatctactacaaattccacaacatcctgtttttaaaatgcgaacacacggagcaaaacgccgccgttatcgccattgcccgcaagcatcaggcaatctggcgcgagaaaattaccaccgttttgaccgaagcggtggaaaatcaggatttggctgacgatttggacaaggaaacggcagttatcttcatcaaatcaaccttggacgggctgatttggcggtggttctcttcctgcgaacgtttcgatttgggcaaaaccgccccgcgcatcatcgggataatgatggacaacttggaaaaccatcccgacctgcgccggaaataa

SEQ ID NO: 38288 - protein, 210 aa, Neisseria meningitidis Z2491
MRKTKTEALKTKEHLMLAALETFYRKGIARTSLNEIAQAAGVTRGALYWHFKNKEDLFDALFQRICDDIENCIAQDTEDAEGGSWAVFRHTLLHFFERLQSNDIYYKFHNILFLKCEHTEQNAAVIAIARKHQAIWREKITTVLTEAVENQDLADDLDKETAVIFIKSTLDGLIWRWFSSCERFDLGKTAPRIIGIMMDNLENHPDLRRK

SEQ ID NO: 38289 - DNA, 606 bp, Mycobacterium tuberculosis CDC1551
  CDS (1)..(606)
atggaaatcaagagacgcacccaggaggaacgctccgcggcgacccgcgaggcgctgatcaccggggcccgcaagctgtgggggttacggggttatgcggaggtggggacgccggaaatcgcgaccgaggcgggggtcacgcggggggcgatgtaccaccaattcgccgataaagcagcactattccgcgatgtggtggaggtcgtggagcaagacgtgatggcccggatggccaccttggtcgccgcctcgggggcggcgacgccggccgatgcaatccgggcagcggtcgatgcctggctcgaggtatctggtgatccggaggtgcgtcagctgatcctgctggatgcgcccgtcgtgctgggctgggcgggtttccgcgacgtcgcccagcgatacagcctgggcatgaccgaacagttgatcaccgaggcgatccgggccggccagttggctcgtcaaccggtgcggccgctggcccaggtgctcattggcgcgctcgacgaggcggcgatgttcatcgccaccgccgacgaccccaagcgcgcccgtcgggagaccagacaggtgctgcgccggctcatcgacgggatgcttaacggctag

SEQ ID NO: 38290 - protein, 201 aa, Mycobacterium tuberculosis CDC1551
MEIKRRTQEERSAATREALITGARKLWGLRGYAEVGTPEIATEAGVTRGAMYHQFADKAALFRDVVEVVEQDVMARMATLVAASGAATPADAIRAAVDAWLEVSGDPEVRQLILLDAPVVLGWAGFRDVAQRYSLGMTEQLITEAIRAGQLARQPVRPLAQVLIGALDEAAMFIATADDPKRARRETRQVLRRLIDGMLNG

SEQ ID NO: 38291 - DNA, 618 bp, Clostridium acetobutylicum ATCC 824
  CDS (1)..(618)
atggcgagaaaatcacctgaagatagagaaaaagaaataattgaggcggcaattaaagttttttctgaaaaaggctataatgcttccacaacaagtgaaatttcaaaaaaggcaggtatagcagaaggaactatatttagatattttaaaaataagaaagctcttttagctagaataataatgttttcatcaaaattaataggtaaaagtattataacaaccagattagaaaaaataataagggacaataaagataaaagtctaaaagaagtgcttaagctaataatgattgatagaatagagcttttggaaaaaaataaagagatttttaaaattgtttttacagaaatacagtatcaagaagatttaaaggaacaattcatggagaacataatcttaactgtaaaggaaatgatagagggccatattttacataatgattttaaagagaaatttaaagacttagatttaatggttatggtcagaacttttataggatgtgtagttatgtatgttgtgcaaaaatcaattttccctgaactaataaagcttgatagagaaaggcaggttgatcaaatggtggaaatgatgttgtatggagttattaacactaaatag

SEQ ID NO: 38292 - protein, 205 aa, Clostridium acetobutylicum ATCC 824
MARKSPEDREKEIIEAAIKVFSEKGYNASTTSEISKKAGIAEGTIFRYFKNKKALLARIIMFSSKLIGKSIITTRLEKIIRDNKDKSLKEVLKLIMIDRIELLEKNKEIFKIVFTEIQYQEDLKEQFMENIILTVKEMIEGHILHNDFKEKFKDLDLMVMVRTFIGCVVMYVVQKSIFPELIKLDRERQVDQMVEMMLYGVINTK

SEQ ID NO: 38293 - DNA, 642 bp, Agrobacterium tumefaciens str. C58
  CDS (1)..(642)
ttggaaggagacatcagcatgcgccgaaccaaggccgaggcagaagagacgcgtcaggcgatccttgccgccgccgagcgggtgttcttcaaaaagggtgtggccaatagttcactggacgaggtggcggccgcggccggtgtcacgcgtggcgccatatactggcatttttccagcaaggccgaccttttcattggcctttacgaatccgtagcgctgccggaatcggatctgctggattttggcgatccggacctcaaggggacagcactgctggccaagatcgaggaggcgacgtgcaagtggcttgcgcttctggcagaagacgaacaacgccagcgcatcatgacgatcagcctgcgtaccaattattccgacgagtttgccccggtcctgcatgcgcaggaagaactggaccgtcaccacaaggatgtgctggaggccgcttttcagcgtgtacagtcagagggtgtcttcaacgataattggacggcagagtcggcgctcggtgcgctttactggctgctgaaaggcatagtctatgactggctgctgttcggtaaacgtttcgatctggtcaaggaaggggccgaggcgatgcatcgtctcatgaagggatttcaacgtcctccagtaccttga

SEQ ID NO: 38294 - protein, 213 aa, Agrobacterium tumefaciens str. C58
MEGDISMRRTKAEAEETRQAILAAAERVFFKKGVANSSLDEVAAAAGVTRGAIYWHFSSKADLFIGLYESVALPESDLLDFGDPDLKGTALLAKIEEATCKWLALLAEDEQRQRIMTISLRTNYSDEFAPVLHAQEELDRHHKDVLEAAFQRVQSEGVFNDNWTAESALGALYWLLKGIVYDWLLFGKRFDLVKEGAEAMHRLMKGFQRPPVP

SEQ ID NO: 38295 - DNA, 651 bp, Sinorhizobium meliloti 1021
  CDS (1)..(651)
atgcgccgaaccaaggccgacgccgaggctacaagacagaagatcctgtgcgccgccgagcggatgttctacaagaagggcgttcccaacacgacgctcgaggaagtggcgaaggaggctggcgtcacccgcggcgccatctactggcatttcgccaacaagacggatcttttcctcgccctttacgaggccgtgccgctgccccacgaagacatgatcgcacgcgagatcgaaacggaagccttcgacacgctcgccatcgtcgagagcgcgaccagcgactggctgacgaccctggccgcggacgagcagcggcagcgcattctcgcgatcatgctgcgctgcgactacgacaatgacatgtccgccgttctcgtgcgccagcgcgaaatcgaggagcgccacgatgcccttctcgagcttgccttcgcccgcgcactggaaaggggtcagttgcaggagcactgggcgccgccgactgcggcgcgggccctgcgctggatgatgatggggctctgtaccgaatggctgctcttcggccgccgcttcgacctcgtggcccaggggagcgaagcactccagtctctctttgcgggcttccggcgggtgccggctcgcggcgatacctcctcccgcctcggccctaactga

SEQ ID NO: 38296 - protein, 216 aa, Sinorhizobium meliloti 1021
MRRTKADAEATRQKILCAAERMFYKKGVPNTTLEEVAKEAGVTRGAIYWHFANKTDLFLALYEAVPLPHEDMIAREIETEAFDTLAIVESATSDWLTTLAADEQRQRILAIMLRCDYDNDMSAVLVRQREIEERHDALLELAFARALERGQLQEHWAPPTAARALRWMMMGLCTEWLLFGRRFDLVAQGSEALQSLFAGFRRVPARGDTSSRLGPN

SEQ ID NO: 38297 - DNA, 654 bp, Salmonella typhimurium LT2
  CDS (1)..(654)
atggcacgaaaaaccaaacaacaagcgctggagacacgacaacacatcctggatgtggccctgcgtttgttctcgcagcaaggcgtatcggcaacctcgctggcggagattgcgaacgctgctggcgtgacgcgcggcgcaatctattggcatttcaaaaataagtcggatttattcagtgagatctgggagctatcagaatccaatattggtgagcttgagattgagtatcaggcaaaattccccgacgatccactatctgtattaagagaaattttagttcatattcttgaagctactgtaacagaagaacgacgccgcttattgatggagattatattccataaatgtgagtttgtcggagaaatggttgtggttcaacaggcgcaacgtagcctttgtctggaaagttacgatcggattgaacaaacgttaaaacattgtattaatgctaaaatgctgcctgaaaatctgctgacccgtcgtgcggcgatactgatgcgcagctttatttcagggctcatggaaaactggttatttgctccgcaatcgtttgatttaaaaaaagaagctcgcgcctacgtcacgatcctgctggagatgtatcaattgtgtccgacgctgcgcgcgtcgacggtcaacggctccccctga

SEQ ID NO: 38298 - protein, 217 aa, Salmonella typhimurium LT2
MARKTKQQALETRQHILDVALRLFSQQGVSATSLAEIANAAGVTRGAIYWHFKNKSDLFSEIWELSESNIGELEIEYQAKFPDDPLSVLREILVHILEATVTEERRRLLMEIIFHKCEFVGEMVVVQQAQRSLCLESYDRIEQTLKHCINAKMLPENLLTRRAAILMRSFISGLMENWLFAPQSFDLKKEARAYVTILLEMYQLCPTLRASTVNGSP

SEQ ID NO: 38299 - DNA, 663 bp, Salmonella typhimurium LT2
  CDS (1)..(663)
atggcgaagaaaacgaaggcggatgcgcttaaaacgcggcaacatttgattgaaaccgctattgcgcagttcgctttgcgcggcgttgccaacacgacgttgaatgatatcgctgatgccgctgatgtcacgcggggcgccatctactggcactttgagaataaaacgcagttgtttaatgaggtttggttacagcaaccacctttacgcgaacttattcaggataggcttacgggatgctggaatgataatcctttacaggatctacgagagaaatttattgcagccttacaatatattgcggcagtgcctcgtcagcaggcattaatgcagattttatatcataaatgtgaattccataatggtatgatatcggaacaggccattcgggagaagatgggtttccatcatcagtcgctgcttgaagtattacagcgatgtatggataaaaaactgatctcaggcagtcttgatctggatgtcatattaattattctgcatggtagttttagcggaatagtaaaaaactggttaatgaatcccacaagttatgatctttataagcaggcgcctgcattagtcgataatgtattaaaaatgctaagcccggatggcagtgtgaggcaattaatgccaaatgaacaacaggcggaagaagcctga

SEQ ID NO: 38300 - protein, 220 aa, Salmonella typhimurium LT2
MAKKTKADALKTRQHLIETAIAQFALRGVANTTLNDIADAADVTRGAIYWHFENKTQLFNEVWLQQPPLRELIQDRLTGCWNDNPLQDLREKFIAALQYIAAVPRQQALMQILYHKCEFHNGMISEQAIREKMGFHHQSLLEVLQRCMDKKLISGSLDLDVILIILHGSFSGIVKNWLMNPTSYDLYKQAPALVDNVLKMLSPDGSVRQLMPNEQQAEEA

SEQ ID NO: 38301 - DNA, 555 bp, Listeria innocua Clip11262
  CDS (1)..(555)
atgacgaaaaaacttatcaaagaagtagcattaaccctttttgcagaaaaaggatatgatggaacggctctttctgaaattgcaaaagctgtagggattaaaacgccatcgttgtatgcccactttccatctaaagaagcgctttttatggaagtgtatcaagatagcatccacacagaactaagcgaattaagtaaagtagctgatgaagaagcgctaggaggagaagaaaaactgcggacaatcttttttgttgcgactgatttttcaagaagtcctgatgagaaaaagtttttccaacgagcagtattttatccaccaaagtctctttttgaagagttaaaagaagagacgagaacttatgagcagttaacgaatgatattttacgaaaaacgcttgagccggcgctccctgaagatgctttaacaagatggatgcatgtgttctatgcgttactcgatgggcttagcgtcgagcacgggatctatgatgaaacggaatttgagttgcgtaggaaatccgcttgggaagttctcgcaagtttactcggataa

SEQ ID NO: 38302 - protein, 184 aa, Listeria innocua Clip11262
MTKKLIKEVALTLFAEKGYDGTALSEIAKAVGIKTPSLYAHFPSKEALFMEVYQDSIHTELSELSKVADEEALGGEEKLRTIFFVATDFSRSPDEKKFFQRAVFYPPKSLFEELKEETRTYEQLTNDILRKTLEPALPEDALTRWMHVFYALLDGLSVEHGIYDETEFELRRKSAWEVLASLLG

SEQ ID NO: 38303 - DNA, 615 bp, Agrobacterium tumefaciens str. C58
  CDS (1)..(615)
atggcgaaagcaaaactgacacgcgctgaacagaagatacaacgtccgctacaaattctcgacgctgcattcgaggaattcaccaaaagaggtttcacggcgacgcgggtggaggacattgccgaacgggtgggagttacgaagggcacggtctacgtctatttcgagaccaaggaggcgctgttcgaggcgatggtcagacatgcctcggtgccgtttcaggaggccttcaaggcctatacgcataaatccgacgaccccgtcgaggagcttcgctcgctgctagaattcctgttcgacgccttggtcgacaaccgaaaaatgcgcgaactgttccgcctgatcgtcgcggaaggcgcaaaatttcctgaactcatcgaccagcaccacgacacgttgatggtcccggttttcgcgcgcatcgatgcgatcctgaatgagggcgtggcgaagaaaagattcagggccaaccccccggaactcgccaaggtggtgatgtcgcccatggtcggaacattggtgttccggctgatcttcgacgacaggcgcagcctggacaagcgcgccgtcctgacgatccatctggagctgatcatgcgcggtctactggcctga

SEQ ID NO: 38304 - protein, 204 aa, Agrobacterium tumefaciens str. C58
MAKAKLTRAEQKIQRPLQILDAAFEEFTKRGFTATRVEDIAERVGVTKGTVYVYFETKEALFEAMVRHASVPFQEAFKAYTHKSDDPVEELRSLLEFLFDALVDNRKMRELFRLIVAEGAKFPELIDQHHDTLMVPVFARIDAILNEGVAKKRFRANPPELAKVVMSPMVGTLVFRLIFDDRRSLDKRAVLTIHLELIMRGLLA

SEQ ID NO: 38305 - DNA, 597 bp, Bacillus anthracis str. A2012
  CDS (1)..(597)
atggtcatttttggaggtgaygatgtggcgatagatcgaaaacgttctattattgaggctgcaacaaagtatttttcagcattcggttataaagcaacaacaatggatcaagtagcgaagttagcgaatgtaggaaaaggaacgatttatacttttttcaaaaataaagaagagctatttggcgagattatttctaatttaattacagaaatgaagcaagttgcagaaaatgcaattcgttcagatgtttcattttttgaaaatgtacatagagcattatatagcatattagaattcagaaaagaacatcagctcatgattaagttaattcaagaagagcgcgatatgggaacgaaagaagtacaagaagtgatgcaacaagtagatgtggaaatcgtttctgtcattcaatcgtatttaaagattgcgattgataaaggtgaaattagcaaatgtgatccagaaattacagcatttattatgcttcgcttatatgtatcgcttatttttgattgggaaaaaaatcatgaaccgctagaaaaagaaaaaattgcagaattatttgaactttatttattaaaaggattgtcaaactaa

SEQ ID NO: 38306 - protein, 198 aa, Bacillus anthracis str. A2012
MVIFGGDDVAIDRKRSIIEAATKYFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSVIQSYLKIAIDKGEISKCDPEITAFIMLRLYVSLIFDWEKNHEPLEKEKIAELFELYLLKGLSN

SEQ ID NO: 38307 - DNA, 657 bp, Yersinia pestis KIM
  CDS (1)..(657)
atggcacgaaaaaccaaacagaaagccgaagagacccggcaacaaattctagatgccgcagtgcgggagttttctgcgcatggcgtttccaggacttctcttaccgatattgctatcgctgcgggtgtaacccgaggcgctatttactggcacttcaagaataaggtagacctatttaacgaagtttgggagctatccgagtctaaaattgatcagctcgagatagagtatcaggcaaaatatcctgataatccactacgtatcctccgcgaactcctaatctatattttggtttctactcgtgaggaccgccgacgtcgtgcactgatggaaattgttttccataaatgtgaattcgtcggtgaaatgacctccgttcatgacgcacgtaaagtccttgatttagctagctatgagcgaattgagtcggttttacaaggttgcatcgatgctaatcaattaccggtcaatctcaatactcatcgtgcggcaattattatgagagcctatattacaggtttgatggagaattggctttttatgccagaaagctttgatataaaacaagaggcacctgtattaattgatgcctatctggagatgctaggccagagtttttcattacgaaacgagatgaatagcagagtatcggattaa

SEQ ID NO: 38308 - protein, 218 aa, Yersinia pestis KIM
MARKTKQKAEETRQQILDAAVREFSAHGVSRTSLTDIAIAAGVTRGAIYWHFKNKVDLFNEVWELSESKIDQLEIEYQAKYPDNPLRILRELLIYILVSTREDRRRRALMEIVFHKCEFVGEMTSVHDARKVLDLASYERIESVLQGCIDANQLPVNLNTHRAAIIMRAYITGLMENWLFMPESFDIKQEAPVLIDAYLEMLGQSFSLRNEMNSRVSD

SEQ ID NO: 38309 - DNA, 630 bp, Brucella suis 1330
  CDS (1)..(630)
atgcgcagaacaaaagccgaggccgcggaaacccgtgaagccattcttctggcagccgaacaggtgttcctcgaacgcggcgtgaaccagtccacactgacggaaatcgcatgttacgcaggcgtgacgcgcggcgcgatctattttcattttgaagacaagctcgatattttccagtccatcattggccgggcgcgctttccgcaggaagagatcatgcttcaggcggcgcgcttcgaccatcccaatccgctccatattctcgaacaatccatcgtcgccgcgctggagcttttcgccaccgatgaaagacagcaggtcgtcttcaccatcatcaaccagcgttgcgaatatgtgggcgagatggctcccgtcatcgaccggctgaaggaaatgcgcagtgatgtgctggcgcttttcatcggccttttgaaagtggccgagcggcgcggcgagcttgcaagcgaatggagcgccgaaacggcggcgcaaattctgctcgccatggtgggtggttttctcaatgaatggttacacggtgaaaaaggtttcgatctcatcatccatggcagccgtgtgatttccacagtgatccagtcgctgcgcgcacccgcaaatatcccgcagtag

SEQ ID NO: 38310 - protein, 209 aa, Brucella suis 1330
MRRTKAEAAETREAILLAAEQVFLERGVNQSTLTEIACYAGVTRGAIYFHFEDKLDIFQSIIGRARFPQEEIMLQAARFDHPNPLHILEQSIVAALELFATDERQQVVFTIINQRCEYVGEMAPVIDRLKEMRSDVLALFIGLLKVAERRGELASEWSAETAAQILLAMVGGFLNEWLHGEKGFDLIIHGSRVISTVIQSLRAPANIPQ

SEQ ID NO: 38311 - DNA, 633 bp, Pseudomonas putida KT2440
  CDS (1)..(633)
atggtccgtcgaaccaaagaagaagcccaggaaacccgtgcccagatcatcgaggcggcggaaagggccttctacaagcgcggggttgcgcgaaccaccctggccgacatcgccgaactggcgggtgtgacgcggggggcgatctactggcacttcaacaacaaggccgagctggtgcaggcgttgctcgacagcctgcacgagacccatgaccatttggcgcgcgcgagcgaaagcgaggatgaactcgacccgcttggctgcatgcgcaagctgctgttgcaagtgtttaacgagctggtgctcgatgcccgaacccgtcgtatcaatgaaatcctgcatcacaagtgcgagttcaccgatgacatgtgtgaaattcgccagcagcgccagagtgcggtgctggattgccacaagggcatcaccctggcgctggccaatgccgtacgccggggccagttgcctggcgagctggatgtcgagcgcgcggcggtggccatgtttgcctatgtcgatggcctgatcgggcgctggctattgctgcctgacagtgtcgatctgttgggtgatgtcgaaaaatgggtcgacaccgggctggatatgctgcgcttgagcccggctctgcgcaaatga

SEQ ID NO: 38312 - protein, 210 aa, Pseudomonas putida KT2440
MVRRTKEEAQETRAQIIEAAERAFYKRGVARTTLADIAELAGVTRGAIYWHFNNKAELVQALLDSLHETHDHLARASESEDELDPLGCMRKLLLQVFNELVLDARTRRINEILHHKCEFTDDMCEIRQQRQSAVLDCHKGITLALANAVRRGQLPGELDVERAAVAMFAYVDGLIGRWLLLPDSVDLLGDVEKWVDTGLDMLRLSPALRK

SEQ ID NO: 38313 - DNA, 582 bp, Pseudomonas syringae pv. tomato str. DC3000
  CDS (1)..(582)
atgaagaaaccagtccacgacatgcgccagcacatcatcgatgttgccaggtcactgatgacgaacaaaggctataccgctgtcggtctcgcagaagtattgatcacggcgggcgtacccaaaggctcgttttactactatttcaaatcgaaggaagaattcggtcaggcgctgctggaagagtatttttccgagtacctgggccgggtcgacgcccttatggcacgccccggcacaggcgctgaacggttgctggcctattttatgtactggtcagaaacccaaggcaccgacctgcccgaaggcaaatgcctggtggtcaaactcggcgctgaagtgtgcgatctgtccgaggacatgcgttgcgtgctggaagtcggcactgcaaaaatcatccagcgcatcagcgcctgtgtcgaaatgggtgtatccgacggcagcattcaccccgaaggcgatcatcagggtttcgcagaatcgctttatcaactctggcttggcgcttccctgctggtgaaggtcaacaagtccaccgagtctttcgataaagcgttgaacatgaccaagcgcctgctcaagtag

SEQ ID NO: 38314 - protein, 193 aa, Pseudomonas syringae pv. tomato str. DC3000
MKKPVHDMRQHIIDVARSLMTNKGYTAVGLAEVLITAGVPKGSFYYYFKSKEEFGQALLEEYFSEYLGRVDALMARPGTGAERLLAYFMYWSETQGTDLPEGKCLVVKLGAEVCDLSEDMRCVLEVGTAKIIQRISACVEMGVSDGSIHPEGDHQGFAESLYQLWLGASLLVKVNKSTESFDKALNMTKRLLK

SEQ ID NO: 38315 - DNA, 651 bp, Pseudomonas syringae pv. tomato str. DC3000
  CDS (1)..(651)
atggtcatcgaagaatcagggaatgaatccgaagcatcggtagcgcccaagcgacgccgggcgcccaagggcgacatgcgcagaaaggccttgctggacgctgccacggtggtgttcgccagagacggctactcgagtgcatccatgcgcgaggttgcgctgctggccggcatcacgacggttggcttgttgcatcactttcccaacaaggaagcgctgctcagcgcgttgctggagcgaagggatcagcgggtcacgtccaggtttcaggacatggtcaccgaactgacgcttgacgggtttctgaagtttctcaagctgagcatgagcttcagcgtcgaaaatgccgatgagtgccaggctgcgctgttgatgaacaccgaaagcctctcaccttcacacccggcctgttcatggcaccgtgagcgatttcagatgacccacgagcatgcccgcggtcatctgaacgcgttgatagaagcaggggaggttcgtgcggacatcaacgtgaaagccctggcccaggaaatcttctcggtcatggacggtttgcagattcagtggctgagaagcccggacgacgtggatgtcatggcggtgttcgaggtttacgtgcagcgtctgggaagggatatcaaggctcatccctga

SEQ ID NO: 38316 - protein, 216 aa, Pseudomonas syringae pv. tomato str. DC3000
MVIEESGNESEASVAPKRRRAPKGDMRRKALLDAATVVFARDGYSSASMREVALLAGITTVGLLHHFPNKEALLSALLERRDQRVTSRFQDMVTELTLDGFLKFLKLSMSFSVENADECQAALLMNTESLSPSHPACSWHRERFQMTHEHARGHLNALIEAGEVRADINVKALAQEIFSVMDGLQIQWLRSPDDVDVMAVFEVYVQRLGRDIKAHP

SEQ ID NO: 38317 - DNA, 672 bp, Pseudomonas syringae pv. tomato str. DC3000
  CDS (1)..(672)
atggttcgtcgcaccaaagaggaagctcagatcacccgcagccagattctggaggccgccgagcaggctttttatgagcgaggcgtcgcccgcaccacgctggctgacattgcgacccttgccggtgtgacccgtggcgccatctattggcacttcaacaacaaggctgatctggtccaggcgatgctcgacagccttcaggaaccgctcgacgaaatggcgcaggccagtcagagcgaagacgaagaagacccgctgggctgcatgaggaacctgttgattcatttgtttcatgagctcgcactggacccgaaaacccgtcgcatcaacgaaatcctgtttcacaagtgcgagtttactgacgagatgtgtgattttcgtcgtcagcgccaggacaacgccattcagtgccacgaccgtatcacccttggcctgagcaatgccgtgcgccaaggccagttgccacaagaactggacacgggccgggctgcggttgcacttttttcctacgtcaacggcatcatttatcaatggctgttggtccctgacagcttttcgttgccggccgaggccgagcaactggtcgatgtgtgcctggacatgctgcgcttcagccctaccttgcgggtaaaaaacagcccggaactgaacgttgaacgtgaaaggttatag

SEQ ID NO: 38318 - protein, 223 aa, Pseudomonas syringae pv. tomato str. DC3000
MVRRTKEEAQITRSQILEAAEQAFYERGVARTTLADIATLAGVTRGAIYWHFNNKADLVQAMLDSLQEPLDEMAQASQSEDEEDPLGCMRNLLIHLFHELALDPKTRRINEILFHKCEFTDEMCDFRRQRQDNAIQCHDRITLGLSNAVRQGQLPQELDTGRAAVALFSYVNGIIYQWLLVPDSFSLPAEAEQLVDVCLDMLRFSPTLRVKNSPELNVERERL

SEQ ID NO: 38319 - DNA, 600 bp, Vibrio parahaemolyticus RIMD 2210633
  CDS (1)..(600)
atgaacgcaaaaacaaatgacacacgccaacacattctcgacgtcgggtacgaattgattgttacccgagggtttacgagtgttggactttcagagctattaaaaacggccgaagtgccaaaaggctcgttttatcattacttcaaatctaaagaacagtttggtgaggcaatgattcaagattacttcaacaagtattttgaacaattgactgcccgcttcactaataccgagctcaatggctaccaacgcttaatgagctactttgaagaaatggtaaaagtagaagatgatgtctgtaatgcaaacaaatgcttgttagtgaagctaagcgccgaagtgtcagatttatcggagcctatgcgtatcgcactgcgtcgaggcgctgataagaccattcaagctatggctgagtgtattgatgtcggtattcaagatggctctatcccaagcggtgatagcgcattgttggccagacagatttattatctttggaatggcgcaagcttactgaacaaactgtatcaagatcaggaagcgctcacgcaaagcctgacctatactcaacatctactgcaaaacacgcgtacttgcccataa

SEQ ID NO: 38320 - protein, 199 aa, Vibrio parahaemolyticus RIMD 2210633
MNAKTNDTRQHILDVGYELIVTRGFTSVGLSELLKTAEVPKGSFYHYFKSKEQFGEAMIQDYFNKYFEQLTARFTNTELNGYQRLMSYFEEMVKVEDDVCNANKCLLVKLSAEVSDLSEPMRIALRRGADKTIQAMAECIDVGIQDGSIPSGDSALLARQIYYLWNGASLLNKLYQDQEALTQSLTYTQHLLQNTRTCP

SEQ ID NO: 38321 - DNA, 615 bp, Streptomyces avermitilis MA-4680
  CDS (1)..(615)
atgaccgccgcaccggagcgccgccgcgaactcctcgacaccgcagccgaggtcttcgccgagcagggctacaacgccaccaccgtacgcaagatcgcggaccatgccggcatgctcgcgggcagcctctactaccacttcgactccaaggaatcgatgctggaggagatcctgcggaccttcctcgacgagctctgggacggctacgacaccgtcctggacgccgaactcgggccgcgcgaaaccctggaggcgctggtcaccgagtccttccgggagatcgaccggcaccgtgcggccgtcgcgatctaccagaaggagtcgaggcaactcgtggcgcaggagcggttcgcgttcctcgccgagtcgcagcgcaggttcgagaaggcgtggctggccacgctggagcgcggggtcgccgccgaggtgttccgggccgacctcgacatccggctcacctaccggttcgtacgcgacacggtgtgggtcgccgcgtcctggtaccggcccggtggacagcaccgcccggaggagatcgcccggcagtacctgtcgatggtcctcgacgggatcgccgtccgtacgtcgcccctcacgttgcccgtccgtacataa

SEQ ID NO: 38322 - protein, 204 aa, Streptomyces avermitilis MA-4680
MTAAPERRRELLDTAAEVFAEQGYNATTVRKIADHAGMLAGSLYYHFDSKESMLEEILRTFLDELWDGYDTVLDAELGPRETLEALVTESFREIDRHRAAVAIYQKESRQLVAQERFAFLAESQRRFEKAWLATLERGVAAEVFRADLDIRLTYRFVRDTVWVAASWYRPGGQHRPEEIARQYLSMVLDGIAVRTSPLTLPVRT

SEQ ID NO: 38323 - DNA, 582 bp, Bacillus cereus ATCC 14579
  CDS (1)..(582)
atgagaagaagcgcagaagagataaagaaagaaattgcatacaaagcagaaagtctattttcacagaagggctacgcagctacatctatggaagagatttgtgaaattacagagcgaagtaaaggaagtatttattatcactttaaaagtaaagaagaattatttttatttgtagtgaaacagcatacgtatgattggcttgaaaaatggaatgaaaaagagaagttgtatagcactagtactgaaaaactatatggtctcgcggaatatcatgtagaggacatacagcaaccaatttcaaatgccatagaggaattctctatgagtcaagttgtaagtaaagagattttggaggaactattagctttaactagagaatcatatgttatgtttgagaaattaattgaagcaggtatacagtctggagagttccgtgaagataatactcgtgatcttatgtatattgtgaatggattattatcagggcttggagtactttactacgagctagattataaagagttgaagcgtatttataaaaaggcaatagatgtattgttaaaaggaatggcagctgaataa

SEQ ID NO: 38324 - protein, 193 aa, Bacillus cereus ATCC 14579
MRRSAEEIKKEIAYKAESLFSQKGYAATSMEEICEITERSKGSIYYHFKSKEELFLFVVKQHTYDWLEKWNEKEKLYSTSTEKLYGLAEYHVEDIQQPISNAIEEFSMSQVVSKEILEELLALTRESYVMFEKLIEAGIQSGEFREDNTRDLMYIVNGLLSGLGVLYYELDYKELKRIYKKAIDVLLKGMAAE

SEQ ID NO: 38325 - DNA, 573 bp, Bacillus cereus ATCC 14579
  CDS (1)..(573)
gtggcgatagatcgaaaacgttctattattgaagctgcaacaaagtctttttcagcgttcggttataaagcaacaacgatggatcaagtagcgaagttagcgaatgtaggaaaaggaacgatttatacttttttcaaaaataaagaagagctatttggtgaaattatttctaatttaattacagaaatgaagcaagttgcagaaagtgcaattcgttcagatgtttcattttttgaaaatgtacatagagcattatatagcatcttggaatttagaaaagaacatcagctcatgattaaattaattcaagaagagcgcgatatgggaacgaaagaagtacaagaagttatgcaacaagttgatgtggaaatcgtttctgttattcaatcgtatttaaagattgcgattgaaaaaggtgaaattagcaaatgtgatccagaaattacagcatttattatgctgcgtctatatgtatcgcttatttttgattgggaaaaaaatcacgaaccgctagaaaaagaaaaaattgcagagttatttgaactttatttattaaaaggattgtcaaactaa

SEQ ID NO: 38326 - protein, 190 aa, Bacillus cereus ATCC 14579
MAIDRKRSIIEAATKSFSAFGYKATTMDQVAKLANVGKGTIYTFFKNKEELFGEIISNLITEMKQVAESAIRSDVSFFENVHRALYSILEFRKEHQLMIKLIQEERDMGTKEVQEVMQQVDVEIVSVIQSYLKIAIEKGEISKCDPEITAFIMLRLYVSLIFDWEKNHEPLEKEKIAELFELYLLKGLSN

SEQ ID NO: 38327 - DNA, 588 bp, Bacillus cereus ATCC 14579
  CDS (1)..(588)
gtgaagaaaaatagaccgaaatacaatcaaattattgatgcggcagtcattgtgattgcggagaatgggtaccaccaagcgcaagtttctaaaatcgcaaagcaagctggggtagctgatggcacgatttatttatattttaaaaataaagaagatatattaatatccttattccaagagaagatgggagaatttgtcgaaacaattcgtcaaaaaacagcaggaattgaaagcgctgtatcgaagttattcatgttggtagaaacgcacttcttgctgttgtcgcaaaatgatccgcttgctatcgttacgcaattagagctaaggcagtccaatcaagacttgcgccttaaaataaatgaagtattaaaaggctacttacaagttatggatgagattttagagactggtataaaacaaggtgaatttcaagcagatttaaatgttcgcgtggcaagacaaatgatctttggaacagtagatgaagttgtgaccaattgggtaatgagcgatcataagtatgatctggtcgcactttcaaaaacggtacacgggctacttattgcagcttgtggttatcgtcaataa

SEQ ID NO: 38328 - protein, 195 aa, Bacillus cereus ATCC 14579
MKKNRPKYNQIIDAAVIVIAENGYHQAQVSKIAKQAGVADGTIYLYFKNKEDILISLFQEKMGEFVETIRQKTAGIESAVSKLFMLVETHFLLLSQNDPLAIVTQLELRQSNQDLRLKINEVLKGYLQVMDEILETGIKQGEFQADLNVRVARQMIFGTVDEVVTNWVMSDHKYDLVALSKTVHGLLIAACGYRQ

SEQ ID NO: 38329 - DNA, 573 bp, Bacillus anthracis str. Ames
  CDS (1)..(573)
gtggcgatagatcgaaaacgttctattattgaggctgcaacaaagtatttttcagcattcggttataaagcaacaacaatggatcaagtagcgaagttagcgaatgtaggaaaaggaacgatttatacttttttcaaaaataaagaagagctatttggcgagattatttctaatttaattacagaaatgaagcaagttgcagaaaatgcaattcgttcagatgtttcattttttgaaaatgtacatagagcattatatagcatattagaattcagaaaagaacatcagctcatgattaagttaattcaagaagagcgcgatatgggaacgaaagaagtacaagaagtgatgcaacaagtagatgtggaaatcgtttctgtcattcaatcgtatttaaagattgcgattgataaaggtgaaattagcaaatgtgatccagaaattacagcatttattatgcttcgcttatatgtatcgcttatttttgattgggaaaaaaatcatgaaccgctagaaaaagaaaaaattgcagaattatttgaactttatttattaaaaggattgtcaaactaa

SEQ ID NO: 38330 - protein, 190 aa, Bacillus anthracis str. Ames
MAIDRKRSIIEAATKYFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSVIQSYLKIAIDKGEISKCDPEITAFIMLRLYVSLIFDWEKNHEPLEKEKIAELFELYLLKGLSN

SEQ ID NO: 38331 - DNA, 606 bp, Mycobacterium bovis AF2122/97
  CDS (1)..(606)
atggaaatcaagagacgcacccaggaggaacgctccgcggcgacccgcgaggcgctgatcaccggggcccgcaagctgtgggggttacggggttatgcggaggtggggacgccggaaatcgcgaccgaggcgggggtcacgcggggggcgatgtaccaccaattcgccgataaagcagcactattccgcgatgtggtggaggtcgtggagcaagacgtgatggcccggatggccaccttggtcgccgcctcgggggcggcgacgccggccgatgcaatccgggcagcggtcgatgcctggctcgaggtatctggtgatccggaggtgcgtcagctggtcctgctggatgcgcccgtcgtgctgggctgggcgggtttccgcgacgtcgcccagcgatacagcctgggcatgaccgaacagttgatcaccgaggcgatccgggccggccagttggctcgtcaaccggtgcggccgctggcccaggtgctcattggcgcgctcgacgaggcggcgatgttcatcgccaccgccgacgaccccaagcgcgcccgtcgggagaccagacaggtgctgcgccggctcatcgacgggatgcttaacggctag

SEQ ID NO: 38332 - protein, 201 aa, Mycobacterium bovis AF2122/97
MEIKRRTQEERSAATREALITGARKLWGLRGYAEVGTPEIATEAGVTRGAMYHQFADKAALFRDVVEVVEQDVMARMATLVAASGAATPADAIRAAVDAWLEVSGDPEVRQLVLLDAPVVLGWAGFRDVAQRYSLGMTEQLITEAIRAGQLARQPVRPLAQVLIGALDEAAMFIATADDPKRARRETRQVLRRLIDGMLNG

SEQ ID NO: 38333 - DNA, 615 bp, Bordetella parapertussis 12822
  CDS (1)..(615)
atgccgctgcgccaggtggagctgctggacgcggccgcccgggcgttcaccgagatggggttcagcgccgcgacgatcgattcggtggcggacctgatcggggtgaccaagggcagcgtgtattactactaccgcagcaagacggacctgttcttcgcggtgcaccggcgcgccatgcagctgaacctggacgcggtcgagcccctggcggcggacctgtcggtgacgccggcgcggcgcttgtggaacatggcgcacgcgcatacgcacctgatgatggcgtacctgccctaccagcgcgtgacggtgcagggcatcgagctgcggctggccgggcgcaccacggcgggccagcgcgccgagctggaagagctggtgcaactgcgcgaccgctacgagtcgctgtttcgcgcggtggtggaagcgggcgtggcggccgggcagtttcgcgcggcgccgccggcgctggcggtcaagccgctgctgggcgcgctgaactggacgacattgtggtaccgcccgcgcgagggcgagaccgaggccgagcgcgaatcgatcgcgcacgggattgccgacgcgatcgtgggcagcgtgatgccgctgccggcgatctga

SEQ ID NO: 38334 - protein, 204 aa, Bordetella parapertussis 12822
MPLRQVELLDAAARAFTEMGFSAATIDSVADLIGVTKGSVYYYYRSKTDLFFAVHRRAMQLNLDAVEPLAADLSVTPARRLWNMAHAHTHLMMAYLPYQRVTVQGIELRLAGRTTAGQRAELEELVQLRDRYESLFRAVVEAGVAAGQFRAAPPALAVKPLLGALNWTTLWYRPREGETEAERESIAHGIADAIVGSVMPLPAI

SEQ ID NO: 38335 - DNA, 663 bp, Bordetella bronchiseptica RB50
  CDS (1)..(663)
atgcaggcaggggcgcgccttgcccgccaggataacgccatggccgatgctcctgcccctgctccgaagcgcgcgcgcgccggccgcccgcccacgctggccgcgccgcgcgagcgcattctcgaggaggccgcgcgcctgttcgcccgcagcggctacgaaaacagctcggtcgccgacctggccgcggccatcggggtgtccaaggccgccctctatcactatttcccgaccaagcaggacatctacgacgccatcatcctggagacgctggccggcctgttgcaggccgtgacccgcgaggtggagcgccagcgcgaggcctgcgaacggctgcgcgccttcatggtggggcatgcccgctatttcgcgcgccatcacgagcaattcgtgaccatgctgatcggctattccggcatggcgctgcccgagcgcgccgacgccgcgcaattgcgcgaccgctacgaacaactgctgcgcgacctgctggagcagggcatggccacgggaacgctgcgccggctggacgtggcagccaccggccgcgcggtgctgtcgatgctgaactggatggtgcgctggtacaagcctggccagggcgacagcgccgagcagatcgccgacggctactacgacttgcttttcaacggcctgcgcatctga

SEQ ID NO: 38336 - protein, 220 aa, Bordetella bronchiseptica RB50
MQAGARLARQDNAMADAPAPAPKRARAGRPPTLAAPRERILEEAARLFARSGYENSSVADLAAAIGVSKAALYHYFPTKQDIYDAIILETLAGLLQAVTREVERQREACERLRAFMVGHARYFARHHEQFVTMLIGYSGMALPERADAAQLRDRYEQLLRDLLEQGMATGTLRRLDVAATGRAVLSMLNWMVRWYKPGQGDSAEQIADGYYDLLFNGLRI

SEQ ID NO: 38337 - DNA, 648 bp, Chromobacterium violaceum ATCC 12472
  CDS (1)..(648)
atggcacggaaaacacgtgaggaagcggaacagacccgccagcagttgctggacgccgccgagcagttgttcagcgagcagggcgtgtcgcgcaccacgctggcggaaatcgccaccgccgccgggctgacccgcggcgcggtgtactggcacttccagaacaagctggatctgtaccgcgcgatgctggaccgggtgtcgccgtcgttcgacgacatgcgcgagcaactgttgctcgtcgccaacacggatccggcccaggcgctgtggcagcacagccaccggctgctggcgctgatcgagcacgatccgcaggtgcggcgcatcctgctgatcctgttcatgcgcagcgaatacgtcggcgagctggcgccgatacacgaggagtgcattgcccacatgcacgaggcgcgcggcctgctgagccaggtggtgggcgccgccaaggcgcgcgggcagacttacgactgcgtcgatccggacgaagtggcggtggcgctgcagtcgctgcacgacggcctgatgacccggctgctggtggaccggccgtgcccggacgccaccctggccgccagccggctgttgcagtatttgtaccgcggcattttcctgccgccggtgatggaacaacttaccacttgcggctga

SEQ ID NO: 38338 - protein, 215 aa, Chromobacterium violaceum ATCC 12472
MARKTREEAEQTRQQLLDAAEQLFSEQGVSRTTLAEIATAAGLTRGAVYWHFQNKLDLYRAMLDRVSPSFDDMREQLLLVANTDPAQALWQHSHRLLALIEHDPQVRRILLILFMRSEYVGELAPIHEECIAHMHEARGLLSQVVGAAKARGQTYDCVDPDEVAVALQSLHDGLMTRLLVDRPCPDATLAASRLLQYLYRGIFLPPVMEQLTTCG

SEQ ID NO: 38339 - DNA, 612 bp, Chromobacterium violaceum ATCC 12472
  CDS (1)..(612)
atggctcgcaaaaccaaggaagactcgcaaaaaacccgggacgcgatactggatggcgcggaacgggtgtttttggacaagggcatcgccaacgccaccatggccgagatcgccgacgcggcgcaggtatcgcgcggcgcggtgtacggtcattacgacaacaagctggaagtgtgccaggcgatgatagaccgcgccttcgcgctggacgcgctgcgcttccccgccccctgcgcatccgcttgcgacacgctgctggcggccggaacttactacctggcgcaattcctggagcccggctcgccgcaacgggtgtaccagatcctgtaccagaagtgcgagcagacagaggaaaaccgcagcgtgctgcggcgccgcgagctggcggaccgcctgaccatgcattacgcgcggcgacaactgcggcgggccatcgcccagcaggaactgcccgaccggctggacgtgggcctggccgccgactacctggtctgtctgttcctgggcctgtacgagctgctggaggccagcccggacgcgctgccgcgctgcgagcgcattctgcgcggtgcgctgcaaggcttgccgcacgcggccagcatcatgcgttga

SEQ ID NO: 38340 - protein, 203 aa, Chromobacterium violaceum ATCC 12472
MARKTKEDSQKTRDAILDGAERVFLDKGIANATMAEIADAAQVSRGAVYGHYDNKLEVCQAMIDRAFALDALRFPAPCASACDTLLAAGTYYLAQFLEPGSPQRVYQILYQKCEQTEENRSVLRRRELADRLTMHYARRQLRRAIAQQELPDRLDVGLAADYLVCLFLGLYELLEASPDALPRCERILRGALQGLPHAASIMR

SEQ ID NO: 38341 - DNA, 642 bp, Photorhabdus luminescens subsp. laumondii TTO1
  CDS (1)..(642)
atggcacgaaaaactaaacaacaggctgaggagacccggcaacagattatagacgcagctataaaagagttttctgagcgcggtgtctcggctacttcactgacagatattgccacaacggctggggtaacccgtggggcaatttactggcattttaaaaataaagtagacctgttttccgaagcctgtagaataacagattctaagattgacgaattagaaaaagagtatcaagcaaaatatcctaataatccactcctgattttaagaactttaatcatccatatcctgacgtcggtcgttgatgatccgaaaaaccggctattaatggagatttttttccacaaatgtgagtttgttggtgaaatgtctgccttggtggaagtgcgtcaggaactgtgtgttgcagactatgttcgtattgaagagtctctttctggttgtattgcatcaggccagcttccttataatcttcatctgcggcgagcggctatcatgttaagaggattgataacgggcttgttggaaaattggttatttgcaccagatagttttgatattcagaaagaagcggagtcgttagtggatagttttatcgatatgcttaaatatagtgagcatatgaaaattgctgaaaaatga

SEQ ID NO: 38342 - protein, 213 aa, Photorhabdus luminescens subsp. laumondii TTO1
MARKTKQQAEETRQQIIDAAIKEFSERGVSATSLTDIATTAGVTRGAIYWHFKNKVDLFSEACRITDSKIDELEKEYQAKYPNNPLLILRTLIIHILTSVVDDPKNRLLMEIFFHKCEFVGEMSALVEVRQELCVADYVRIEESLSGCIASGQLPYNLHLRRAAIMLRGLITGLLENWLFAPDSFDIQKEAESLVDSFIDMLKYSEHMKIAEK

SEQ ID NO: 38343 - DNA, 627 bp, Rhodopseudomonas palustris CGA009
  CDS (1)..(627)
atgcggcggacgaaactggaagcagaaacaacgcgcgagaccatactcgcggtggccgagcggctgttcctcgaaagcggcgtcaccgaggtgtcgctggagcagatcgccgtggcggccgggttcacccggggggcggtgcattggcatttccagaacaagcaggggctgctgctagcgttgctggaccggatgggccttccgctcgaacaactcgccggtcagctcgagatcgacgataccctcgacccgatggacgaactggtccgcgacatgaccgggcggctctgcgagctggagatggatccgaaacgcaagcggctctccacctacctggtcaatttcgccgcggtcgaagcgcccgagcgccagcgcaacttcgaccgcaaattcagatcctcggtcaccatcatttttcgtttggccgagaaacgcggccggctggcgccgcactggcggccggagatcgccgcgctagccttctgcggcatggtgatgggcctgatcaatcaatggctgaacggcgagaccgagttcgacatgcgcaatgacgtcaccgcggctgtgcgggctttttcgtcctcgctgcgggcgcagcccgacgatccaaaaagaccaggagcttag

SEQ ID NO: 38344 - protein, 208 aa, Rhodopseudomonas palustris CGA009
MRRTKLEAETTRETILAVAERLFLESGVTEVSLEQIAVAAGFTRGAVHWHFQNKQGLLLALLDRMGLPLEQLAGQLEIDDTLDPMDELVRDMTGRLCELEMDPKRKRLSTYLVNFAAVEAPERQRNFDRKFRSSVTIIFRLAEKRGRLAPHWRPEIAALAFCGMVMGLINQWLNGETEFDMRNDVTAAVRAFSSSLRAQPDDPKRPGA

SEQ ID NO: 38345 - DNA, 642 bp, Mycobacterium avium subsp. paratuberculosis str. k10
  CDS (1)..(642)
gtggacatggcagcatcgccccgccgcgtaggagcagagacttcacagacgcgcgacgccttgctcgaggccgttgcgcagatgatgctggaggagggatatgcgagcgtcacgtatcgcgcattggccgcgaaggccggcgtgacgccaagcctcgtccagtactacttcccctcgctggatgacatcttcgtcgccgccattcgccgctactccgagcgcaacctgcaatggttgaccgaggaacttcagcggcgagccgacgacccacttcatgcgctgtgggagagcggctggcacgagtcgacgagtgcgctgatgacggagttcatggcacttggcaaccaccgcaaatcgattcgttccgagatcgccgccgtgacggatagcatgcgcagagtccaggtcgaggcgctggtggcgaaattcgggaacgacgcccggctcctcgctgatctttcgttcgatgccgtggtgctgttgatcaacggcgttccgaagctccttgggttggaggaaagcgtgggcgtcgataccgcccacgccgagttgatcgccgcgtgcgagcgctttctggacgccgtcgaacctcgagccaagcctcgccgtcgcagtaagaaggctccgactcgccgacgctga

SEQ ID NO: 38346 - protein, 213 aa, Mycobacterium avium subsp. paratuberculosis str. k10
MDMAASPRRVGAETSQTRDALLEAVAQMMLEEGYASVTYRALAAKAGVTPSLVQYYFPSLDDIFVAAIRRYSERNLQWLTEELQRRADDPLHALWESGWHESTSALMTEFMALGNHRKSIRSEIAAVTDSMRRVQVEALVAKFGNDARLLADLSFDAVVLLINGVPKLLGLEESVGVDTAHAELIAACERFLDAVEPRAKPRRRSKKAPTRRR

SEQ ID NO: 38347 - DNA, 648 bp, Treponema denticola ATCC 35405
  CDS (1)..(648)
gtgtcatattgttcggacataactaaaaacagaattttggaatgcgctaaagaagagtttttacggaatggttttgaaaaagcacaggtgggggagattgcgaaaacggcgaatgtaaccacaggtgcaatataccgtcactttaagaataaggaagaactgttttttacacttattgaagatgtatatgagtacacattagatatcgtaacggatgttgaaattagaagtactgataaagcgtctatgccgctatcggaagaaactgacaatgttgttattgaagcattattttctgaaaccatgaggtttgtagattatatgtatgagcattttgatgagtttaagctgcttcttgcctgcagtaaaggttcacgggtagaaaattttgcggaagaaattgcagatagatatacgcataaaaatatgaagctcattcaagccacagccggcaaaaaatcttctgcaaccaaaattaaagaacttgaggtacatatcattacgaaaggttatataacgtcattatgtgaatgtatcattcacgctattccatacaatgatgtgagcaggtacatcaaaagcattgttacttttcaatattatggttggggcggcttattaaatgaattgaggatatatcatgaataa

SEQ ID NO: 38348 - protein, 215 aa, Treponema denticola ATCC 35405
MSYCSDITKNRILECAKEEFLRNGFEKAQVGEIAKTANVTTGAIYRHFKNKEELFFTLIEDVYEYTLDIVTDVEIRSTDKASMPLSEETDNVVIEALFSETMRFVDYMYEHFDEFKLLLACSKGSRVENFAEEIADRYTHKNMKLIQATAGKKSSATKIKELEVHIITKGYITSLCECIIHAIPYNDVSRYIKSIVTFQYYGWGGLLNELRIYHE

SEQ ID NO: 38349 - DNA, 582 bp, Bacillus cereus ATCC 10987
  CDS (1)..(582)
atgagaagaagtgcagaagagataaagaaagaaattgcatataaagcagaaagtctgttttcacagaagggctatgcagctacatctatggaagagatttgtgaaattacagagcgaagtaaaggaagtatttattatcactttaaaagtaaagaagaattatttttatttgtagtaaaacagcatacgtatgattggcttgaaaaatggaatgaaaaagagaagtcgtatagtacgaatactgaaaaattatatggtctcgcggaatatcatgtagaggacatacagcaaccaatttcaaatgcaatagaggaattctctatgagccaagttgtaagtaaagagattttggatgaactattagctttaactagagaatcatatgttatgtttgagaaactaattgaagcaggcatacagtctggagagtttcgtgaagataatacgcgcgatcttatgtatattgtgaatggattattatcagggcttggagtactttactacgagttagattataaagagttgaaacgtatttataaaaaggcaatagatgtattgttaaaaggaatggcagctgaataa

SEQ ID NO: 38350 - protein, 193 aa, Bacillus cereus ATCC 10987
MRRSAEEIKKEIAYKAESLFSQKGYAATSMEEICEITERSKGSIYYHFKSKEELFLFVVKQHTYDWLEKWNEKEKSYSTNTEKLYGLAEYHVEDIQQPISNAIEEFSMSQVVSKEILDELLALTRESYVMFEKLIEAGIQSGEFREDNTRDLMYIVNGLLSGLGVLYYELDYKELKRIYKKAIDVLLKGMAAE

SEQ ID NO: 38351 - DNA, 657 bp, Bacillus cereus ATCC 10987
  CDS (1)..(657)
ttgtcaaatccaatttttgataaaatacttgctcaaggtctcataaaaggtaagacagaaaagcagcaaaggattattgagacaacgattaaattgtttgctgagaaaggttatgcgaatacatcgacagcagagatagcaaaagttgcaggcgtatccgaaggaacaatttttaagcattacggaaagaaagaccaattattactttctgttattttaccgtttgtaaatgactttttcccgaacatggctaaggaattgatagaggaaactatgttagaacagacaacatcttttgaggagtttttacgtaatttattgaaaaatagggttgcttttattacggaaaataaagaaatatttcgagtcattgttaaggagattatttataaagaagaattgaaaaaagagctaaaaccatactttataaaacatgttcctgtattatttgaaaatattgtagaacaattcaaagagcaaggagagctgattgatcttccagctgatcgaatcttaaagatgttatttaccttactggcaggattttttgtttctcgttttgtactcatggaaaatcacattattagtgaagaggaaattgaggatgtcgttcaatttgttatgaacggtataaaaaataagcagtctgctgaataa

SEQ ID NO: 38352 - protein, 218 aa, Bacillus cereus ATCC 10987
MSNPIFDKILAQGLIKGKTEKQQRIIETTIKLFAEKGYANTSTAEIAKVAGVSEGTIFKHYGKKDQLLLSVILPFVNDFFPNMAKELIEETMLEQTTSFEEFLRNLLKNRVAFITENKEIFRVIVKEIIYKEELKKELKPYFIKHVPVLFENIVEQFKEQGELIDLPADRILKMLFTLLAGFFVSRFVLMENHIISEEEIEDVVQFVMNGIKNKQSAE

SEQ ID NO: 38353 - DNA, 588 bp, Bacillus cereus ATCC 10987
  CDS (1)..(588)
gtgaagaaaaatagaccgaaatacaatcaaattattgatgcggcagtcattgtgattgcggagaatgggtaccatcaagcgcaagtttctaaaatagcaaagcaagctggggtagcggatggcacgatttatttatattttaaaaataaagaagatatattaatatccttattccaagagaagatgggagaatttgtcgaaacaattcgtcaaaaaacagcaggaattgaaagcgctgtatcgaagttattcatgttggtagaaacgcacttcttgctgttgtcacaaaatgatcctcttgctatcgttacgcaattagagctaagacagtccaatcaagaattacgcctaaaaataaatgaagtattaaaaggctacttacaagttatggatgagattttagagacaggtataaagcaaggtgaatttcgagcggatttaaatgttcgcgtggcaagacaaatgatctttggaacagtagatgaagttgtgaccaattgggtaatgagcgatcataagtatgatctggtcgcactttcaaaaacggtacatgggctacttattgcagcttgtggttatcgtcaataa

SEQ ID NO: 38354 - protein, 195 aa, Bacillus cereus ATCC 10987
MKKNRPKYNQIIDAAVIVIAENGYHQAQVSKIAKQAGVADGTIYLYFKNKEDILISLFQEKMGEFVETIRQKTAGIESAVSKLFMLVETHFLLLSQNDPLAIVTQLELRQSNQELRLKINEVLKGYLQVMDEILETGIKQGEFRADLNVRVARQMIFGTVDEVVTNWVMSDHKYDLVALSKTVHGLLIAACGYRQ

SEQ ID NO: 38355 - DNA, 588 bp, Desulfovibrio vulgaris subsp. vulgaris str. Hildenborough
  CDS (1)..(588)
atgaagcgcgatactatcctttccacagcagcccgcctgttcgccgagcgcggcttcaacaacacccccacaagcctgctggcacgcgaggcgggtgtcgccgaaggtaccatcttccgccatttcaagaccaaggatgatatctttctcacgctcatccgcaatgtgaaagaccagctcatcagcgacatcgagaagtacctcgaagtccgcgcccctgagaccagcatcgaaaaggtcgtgtccatcatcaagtcgttctatgtcttcgtgaagaagaaccgtatggagttcagcctcatcttccgtgatgcgccgacccgctacggcgaacgcaacgacaacgtctttctcgccatcaaggacatctacacctatctgggcgactatgtgctgcaagcccttcaggaaggacagcgcgacggttccatccgggcggacatcaacacccgcgataccgcgcacatgctggtgagcaccatggctggtctcgtgcgtgccatccacttccagttcatcgaacccagcgacgacctgctgcgcaatgtcgtcgacaactgcacgaacttcctcaagccgcgcgcctaa

SEQ ID NO: 38356 - protein, 195 aa, Desulfovibrio vulgaris subsp. vulgaris str. Hildenborough
MKRDTILSTAARLFAERGFNNTPTSLLAREAGVAEGTIFRHFKTKDDIFLTLIRNVKDQLISDIEKYLEVRAPETSIEKVVSIIKSFYVFVKKNRMEFSLIFRDAPTRYGERNDNVFLAIKDIYTYLGDYVLQALQEGQRDGSIRADINTRDTAHMLVSTMAGLVRAIHFQFIEPSDDLLRNVVDNCTNFLKPRA

SEQ ID NO: 38357 - DNA, 573 bp, Bacillus thuringiensis serovar konkukian str. 97-27
  CDS (1)..(573)
gtggcgatagatcgaaaacgttctattattgaggctgcaacaaagtctttttcagcattcggttataaagcaacaacgatggatcaagtagcgaagttagcgaatgtaggaaaaggaacaatttatacttttttcaaaaataaagaagagctatttggcgagattatttctaatttaattacagaaatgaagcaagttgcagaaaatgcaattcgttcagatgtttcattttttgaaaatgtacatagagcattatatagcatattagaattcagaaaagaacatcagctcatgattaagttaattcaagaagagcgcgatatgggaacgaaagaagtacaagaagtgatgcaacaagtagatgtggaaatcgtttctgtcattcaatcgtatttaaagattgcgattgataaaggtgaaattagcaaatgtgatccagaaattacagcatttattatgcttcgcttatatgtatcgcttatttttgattgggaaaaaaatcatgaaccgctagaaaaagaaaaaattgcagaattatttgaactttatttattaaaaggattgtcaaactaa

SEQ ID NO: 38358 - protein, 190 aa, Bacillus thuringiensis serovar konkukian str. 97-27
MAIDRKRSIIEAATKSFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSVIQSYLKIAIDKGEISKCDPEITAFIMLRLYVSLIFDWEKNHEPLEKEKIAELFELYLLKGLSN

SEQ ID NO: 38359 - DNA, 642 bp, Erwinia carotovora subsp. atroseptica SCRI1043
  CDS (1)..(642)
atggcacgaaaaaccaaaaaacaggctcaggaaactcggcaacagatactggatactgcgttaagagtgttctctgagcatggtgtgtctgcgacttcattgtctgatattgcgactgctgctggtgtgacccgcggtgctatttattggcattttaagaacaaagccgaaatttttgatgaaatctgggctctggcagagtcaaaaatcagtgagtttgaaatagagtatcagacaaaattccctgataatccactccgtgtgatgcgtgaattattgatttatatgctgcgtttaaccgttagcgacactcactggcgttccattatggagatcgtttttcacaaatgtgagtttgtcggtgaaatgctgcaatcgtataatgcacgaaaagagctttatctttcctgctatgtggatatcgaagaaaacctgattgagtgcattcgtatggggatgttgccgacggacattcatccccgtcgggcagcgattgcgctgcgtgcctatttctccggtgtgatggagaactggttatttatgccggaaagtttcgatctcgatcaggaagccccggcgctggtagatgcctttatcgacatgttgcattttagccctgcgctgcgtaaacctgctgagtaa

SEQ ID NO: 38360 - protein, 213 aa, Erwinia carotovora subsp. atroseptica SCRI1043
MARKTKKQAQETRQQILDTALRVFSEHGVSATSLSDIATAAGVTRGAIYWHFKNKAEIFDEIWALAESKISEFEIEYQTKFPDNPLRVMRELLIYMLRLTVSDTHWRSIMEIVFHKCEFVGEMLQSYNARKELYLSCYVDIEENLIECIRMGMLPTDIHPRRAAIALRAYFSGVMENWLFMPESFDLDQEAPALVDAFIDMLHFSPALRKPAE

SEQ ID NO: 38361 - DNA, 582 bp, Bacillus licheniformis ATCC 14580
  CDS (1)..(582)
gtgagaaaccgtgagcaaagatcgaaagcactgattttagaagcggcgacaaaatcgtttacacaattcggctacaaagcgacgacgatggatctggtggcgaagcttgccaatgtcggcaagggtacgatctatacctttttcaagaataaagaggaactgttcgatgacattttttcttcgcttctgattgaaatgaagcaaacggctgatcaagcgattgaccctgatctgccttttcacgaaaatgcccatcgcgcgatgatggcgatattggagtacagaaagaggcaccagctgaccattaagatctttcaggaaggcgcggagctcggcacaccggcggcccgcgaggtgattgaaaagctggaacgcatggtcatcggctatattaagagaaaaattaaagaagcaattaaaaatgacgatattagaccgtgtgacccagagctgaacgcgtttgtcatcttcaagctttacatcgcgctcatctttgactgggaaaaaaaccatgaaccgctgaaagatgaagagttggcagagatgctgaaaatgtatattttaaaaggattatctcgttag

SEQ ID NO: 38362 - protein, 193 aa, Bacillus licheniformis ATCC 14580
MRNREQRSKALILEAATKSFTQFGYKATTMDLVAKLANVGKGTIYTFFKNKEELFDDIFSSLLIEMKQTADQAIDPDLPFHENAHRAMMAILEYRKRHQLTIKIFQEGAELGTPAAREVIEKLERMVIGYIKRKIKEAIKNDDIRPCDPELNAFVIFKLYIALIFDWEKNHEPLKDEELAEMLKMYILKGLSR

SEQ ID NO: 38363 - DNA, 585 bp, Bacillus cereus ZK
  CDS (1)..(585)
ttgcaaaaaaaaactctgccaaatagaaaacaacaagctctactaacacagaacaatatatttcatgtgtttttaaatttaatgaaagaaaaaaaatttgaaaatataactattgaagatatttgtaaaaaagcaaatgtatcagtaggaactttttatcattatttctcttccaaagaggatatttataaaaaattatttcaacaaattgaagaaaacctacatgttgaattagaaaagatcgatcaacatacaacaatgcaaacaactattttaactttcttccaatgcatagctgcatatacaactaaattagagttacatataaatcttcttaacgatttcaacaaaaggtcattcatatatgagccttcactaatttacgaagctctaaatggctttgtttacaaaggacaacttgaaaaagaattaacaaatgatatgagtgtagaagaaataacaacgtatctttttacaattgctagaggacttatattagattggtgtcttttagatggaaaatactcactagaacagagaatgaatacttatatgaatttagcattgaaatctttaaagccttaa

SEQ ID NO: 38364 - protein, 194 aa, Bacillus cereus ZK
MQKKTLPNRKQQALLTQNNIFHVFLNLMKEKKFENITIEDICKKANVSVGTFYHYFSSKEDIYKKLFQQIEENLHVELEKIDQHTTMQTTILTFFQCIAAYTTKLELHINLLNDFNKRSFIYEPSLIYEALNGFVYKGQLEKELTNDMSVEEITTYLFTIARGLILDWCLLDGKYSLEQRMNTYMNLALKSLKP

SEQ ID NO: 38365 - DNA, 573 bp, Bacillus cereus ZK
  CDS (1)..(573)
gtggcgatagatcgaaaacgttctattattgaggctgcaacaaagtctttttcagcattcggttataaagcaacaacgatggatcaagtagcgaagttagcgaatgtaggaaaaggaacgatttatacttttttcaaaaataaagaagagctatttggcgagattatttctaatttaattacagaaatgaagcaagttgcagaaaatgcaattcgttcagatgtttcattttttgaaaatgtacatagagcattatatagcatattagaattcagaaaagaacatcagctcatgattaagttaattcaagaagagcgcgatatgggaacgaaagaagtacaagaagtgatgcaacaagtagatgtggaaattgtttcttttattcaatcgtatttaaagattgcgattgataaaggtgaaattagcaaatgtgatccggaaattacagcatttattatgcttcgcttatacgtatcacttattttcgattgggaaaaaaatcatgaaccgctagaaaaagaaaaaatcgcagaattatttgaactttatttattaaaaggattgtcaaactaa

SEQ ID NO: 38366 - protein, 190 aa, Bacillus cereus ZK
MAIDRKRSIIEAATKSFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSFIQSYLKIAIDKGEISKCDPEITAFIMLRLYVSLIFDWEKNHEPLEKEKIAELFELYLLKGLSN

SEQ ID NO: 38367 - DNA, 873 bp, Bacillus cereus ZK
  CDS (1)..(873)
atgaaagaaaaagagcgcttaattatagagatggctatgaagttatttgcgactaagggtgtaaatgcgacatcagtgcaggaaattgtgacagcttgtggcatatctaagggagccttttatttatactttaaatcgaaagaggaacttttattagcaacacttcgatattactatgacaagattcaaaacaaaatgatggatattgaaaaagagtcgttattgccacgtgaaaaatttgcaaaacaactgcattgccaatttaatgatatacaaaagcataaagaattcattattatgcatgccagagaaaatgctattccgtttaataaagaagtagaagaatttatgatgcggatgaagttagagtctcacgcattttatcgaaatagtttattgtctatttatggtgataaggttatgccatatttattagatttagtcattatggtagaaggcatatgccgtggatatttagaactaattattttacaagcgccagaaatcgacttatcttacgtctctacgtttattttgaaaagagtagacgatttagtagatggattgttaaaatcttcggaagaacctgtgttacatgaagaaaagcttggagaatttctttgtaaatcagagcttattaaggagcaggttaaggaacattttttaaaagaaattattgtgtttaaacgtacattagcggatcaattagaagatgaggaattgcttgttacgttagatgttttagaggcagaaatgagattaccaaatccaaggattccggttatacaaggaatgctgtctaatttagaagtatatccaaatttaaaagaatttcgtttgagacttatgggctattacaatataaaaaggtaa

SEQ ID NO: 38368 - protein, 290 aa, Bacillus cereus ZK
MKEKERLIIEMAMKLFATKGVNATSVQEIVTACGISKGAFYLYFKSKEELLLATLRYYYDKIQNKMMDIEKESLLPREKFAKQLHCQFNDIQKHKEFIIMHARENAIPFNKEVEEFMMRMKLESHAFYRNSLLSIYGDKVMPYLLDLVIMVEGICRGYLELIILQAPEIDLSYVSTFILKRVDDLVDGLLKSSEEPVLHEEKLGEFLCKSELIKEQVKEHFLKEIIVFKRTLADQLEDEELLVTLDVLEAEMRLPNPRIPVIQGMLSNLEVYPNLKEFRLRLMGYYNIKR

SEQ ID NO: 38369 - DNA, 672 bp, Burkholderia pseudomallei K96243
  CDS (1)..(672)
atggcccgcaagacgcgcgaagaatcgctgaacacgaagaaccggatcctcgacgccgccgagctcgtgctgctggaaaagggcgtcggccagaccgcgatggccgacatcgcggaggcggccggcatgtcgcgcggcgcggtgtacgggcacttcaacggcaagatcgaggtgtgcgtcgcggtgtgcgaccgcgcgttctcgcgcgcggtggaaggcttcgacctgtccgacgagcggccggcgctcgcgacgctgcgccttgccgcgtcgcactatctgcaccagtgcggcgagcccggctcgatgcagcgcgtgctcgagatcctctacatgaaatgcgagcagagcgaagagaacgcgccgctgatgcgccggcgcgcgctctacgaactgcagacgctgcgcatcgcgaaggcgctgctgcgccgcgcggtcgccgcgggcgagctcgacgcgtcgctcgacgtgcacctcgcgggcgtctatctgctgtcgctgctcgaaggcatcttcggctcgatgatctggaccacccggctgcgcggcgatcgctggcgtgacgccgaggcaatgctcgacgcgggcgtcgacacgctgcgcgcgtcgcccgcgctgcgcgtggccgaggcttgcgcggcgcgcggattgccgcgcgcaaacgtgcactga

SEQ ID NO: 38370 - protein, 223 aa, Burkholderia pseudomallei K96243
MARKTREESLNTKNRILDAAELVLLEKGVGQTAMADIAEAAGMSRGAVYGHFNGKIEVCVAVCDRAFSRAVEGFDLSDERPALATLRLAASHYLHQCGEPGSMQRVLEILYMKCEQSEENAPLMRRRALYELQTLRIAKALLRRAVAAGELDASLDVHLAGVYLLSLLEGIFGSMIWTTRLRGDRWRDAEAMLDAGVDTLRASPALRVAEACAARGLPRANVH

SEQ ID NO: 38371 - DNA, 648 bp, Nocardia farcinica IFM 10152
  CDS (1)..(648)
gtgacgacctcggtgggcaggcagtacggcgggcgggccgtggcggagcgcaaggccgagcgccggctgcgcttcctcgacgccgccacccggctgttcgccgagcgcggctacaccgactgctcgctggccgacgtgtgcgccgccgccggactgtccaaacgacagttctacgaggagttcgagaccagggaagacgtgctcgcggccgcctacgaccggatccaggacgaggcggccgacgcggtcgtgggcgcactggccggggtcggccggggtcgtgatccgaacaccgcagacccgcataccgcgctcaccgcggtgctcacggcctacctcgagtcgatcggcgcggacccgttccgggcgaagctggccttcatcgaggtggtcggcgtcagcgagcggatggagcgccaccgcaggcagcgcaggcacgcctgggcccggctgctggaatcggcggtggtgccgaggatcgtgccgggcggccgggtccggggccggtccgggctggcggcggccgcgctgatcggcgccatcaacggactcacccacgaatggctgctgtcggacccgcgcccaccggtggacgatctggtggccctgctggtgccggtggcggtctcgctgatcgagacgtcctga

SEQ ID NO: 38372 - protein, 215 aa, Nocardia farcinica IFM 10152
MTTSVGRQYGGRAVAERKAERRLRFLDAATRLFAERGYTDCSLADVCAAAGLSKRQFYEEFETREDVLAAAYDRIQDEAADAVVGALAGVGRGRDPNTADPHTALTAVLTAYLESIGADPFRAKLAFIEVVGVSERMERHRRQRRHAWARLLESAVVPRIVPGGRVRGRSGLAAAALIGAINGLTHEWLLSDPRPPVDDLVALLVPVAVSLIETS

SEQ ID NO: 38373 - DNA, 585 bp, Geobacillus kaustophilus HTA426
  CDS (1)..(585)
atgaaggagaaaattatggctgccagcattgagctgtttgaacaaaatgggttcagcgaaacatcgatccaagacatcgttgacgccctcggggtgacaaaagggacgttttattactattttacaagcaaagaagaactgttgatggatattcaccttcgctacattgaagggctgcttgacgaagaggagcgcattataagcgataaacggcgcccgttgcgggagaagctgtatgacattatcttcatgctcattcataatgtcgagcggcaaggaagggaagctcgcattttttttcgtgaaatgaagcatttgagtgaggagcatttacaaaaagtaaaagaaaagcgcgatttgttccgctatcggctgcagtcgttgattgaggaaggaatgaaaagcggtgaactgcgctgcgatttgtcaccatcgatcgccacgcttaccgttcttggggcggccaattggagctaccaatggtttcgtccggacggcgagctgaccgatgccgaggtggcgaagcagatggtggagatcctgcttgatggcatgagcgcgccgtctgtctcgaaagccgagtga

SEQ ID NO: 38374 - protein, 194 aa, Geobacillus kaustophilus HTA426
MKEKIMAASIELFEQNGFSETSIQDIVDALGVTKGTFYYYFTSKEELLMDIHLRYIEGLLDEEERIISDKRRPLREKLYDIIFMLIHNVERQGREARIFFREMKHLSEEHLQKVKEKRDLFRYRLQSLIEEGMKSGELRCDLSPSIATLTVLGAANWSYQWFRPDGELTDAEVAKQMVEILLDGMSAPSVSKAE

SEQ ID NO: 38375 - DNA, 615 bp, Idiomarina loihiensis L2TR
  CDS (1)..(615)
atggttcgacgcacaaaagaagacgcaatggagacccgcgccaagttattagacgctgctgaggctttattcagcgagaatggtgtgactcaaacgtcgatgatgcaagtggctgaaaaagcgggtgtcactcgcggtgctatctatcaccattttgaaaataaaatggatctcattgaatcgttaatgggaagaatttctcttccgatcgatgaaatgcgggaacaaatagccgagagtttagaattcgatgccttagaagaagtaaaagcccgctctaaagaatttttagctcgcgttcaaaatgagccccaggtacgttctattgccagcatccttcttcacaagtgcgagtacattgacgaagtaaatcctataaaattacggcatgttagcggtcgtaacgaatgcatttgtgaagtcgaaaagttgtttgaatcagctatccaaaaaggtcagttgtcctcaaaagctagccccagggttgcggttattggcttgttttcattagtggacggccttatttataactggctgcttgctccggattactttcctttagtggagtacggcaaccaggctatcgatagctatattaacgggttagcacgctaa

SEQ ID NO: 38376 - protein, 204 aa, Idiomarina loihiensis L2TR
MVRRTKEDAMETRAKLLDAAEALFSENGVTQTSMMQVAEKAGVTRGAIYHHFENKMDLIESLMGRISLPIDEMREQIAESLEFDALEEVKARSKEFLARVQNEPQVRSIASILLHKCEYIDEVNPIKLRHVSGRNECICEVEKLFESAIQKGQLSSKASPRVAVIGLFSLVDGLIYNWLLAPDYFPLVEYGNQAIDSYINGLAR

SEQ ID NO: 38377 - DNA, 618 bp, Azoarcus sp. EbN1
  CDS (1)..(618)
atggctcgcggcaaggcacccacattcgaactgcagcgcgcggcgatcctcgacgcggcggctgcgctgttcgcgcagaaaggcttccacaacgcgtcgatgtcggcgctcgcggaagcctgtggcgtgtcgaagccgctgctgtaccactactaccgcgacaaggaacacatcctcttcgacatcgcggacagctacatcgaccgcctgctggcgatcatcgacggcgtcgtcgcacgcggcctcgacgacgacgcacatctctccgagctcgtcacacgcttcatggaggaatacgagcacgcgcacgaccagcacatcgtgatcgtccaggacgtgaaattcctgcagcaggagcaggcggcgaagatcgccgcgaagcagcgcagggtggtttcggcgttcgccgacgcgatcgtgcggatcgagccgggcctgaaggggcgcaagctcgaacgcccggtcgcgatgatcctgttcggcatgatcaactggactttcacctggatgcggaccgacgggcggctcacgttccgcgacatggctccggtcgtgaccgggattttcctcaacggcgtcaaaggcttcgtcgaacagagcggcagggtcacggcatga

SEQ ID NO: 38378 - protein, 205 aa, Azoarcus sp. EbN1
MARGKAPTFELQRAAILDAAAALFAQKGFHNASMSALAEACGVSKPLLYHYYRDKEHILFDIADSYIDRLLAIIDGVVARGLDDDAHLSELVTRFMEEYEHAHDQHIVIVQDVKFLQQEQAAKIAAKQRRVVSAFADAIVRIEPGLKGRKLERPVAMILFGMINWTFTWMRTDGRLTFRDMAPVVTGIFLNGVKGFVEQSGRVTA

SEQ ID NO: 38379 - DNA, 612 bp, Bacillus clausii KSM-K16
  CDS (1)..(612)
atgagcacacttgataacaggcgccatttaatggaggctgccttggcgcttttcgcccaagaaggctaccacaaaacgaaagtatccgacattgtcaaacaagtcggcgttgcccaaggcactttctattggcactttaaaaacaaagaggagattgttttatgcattttgcaagaaggcgaacaagcactcttgaatgtcattcgctctggataccgccaaacagaaggaaatgtcgatgatatggttgaatcttcgcggcgattaatgaccgacctcttctcttttgcgcaagcaaatccagattatatgcggttgttattcaaaacagggcaagatgcagaagaaaaaatttgccggcatatctcccatacgctcatcgctattgaagaagcgttcgaacgtaacattaaacgggcccaagaactagagatgttgccaaaagatagttccagcaaaagacttgctgctatgctcgttagtttagtgctcggaacacttgagcgttggctgttttcggaatcaccccatttagacaatattgcagctgaatcgttggcagttgaaatcgtttcttttgaattttttgggctactcggcaaaacaaagtga

SEQ ID NO: 38380 - protein, 203 aa, Bacillus clausii KSM-K16
MSTLDNRRHLMEAALALFAQEGYHKTKVSDIVKQVGVAQGTFYWHFKNKEEIVLCILQEGEQALLNVIRSGYRQTEGNVDDMVESSRRLMTDLFSFAQANPDYMRLLFKTGQDAEEKICRHISHTLIAIEEAFERNIKRAQELEMLPKDSSSKRLAAMLVSLVLGTLERWLFSESPHLDNIAAESLAVEIVSFEFFGLLGKTK

SEQ ID NO: 38381 - DNA, 588 bp, Bacillus clausii KSM-K16
  CDS (1)..(588)
ttgagtaaaaagagaggtcaaaagtatgaccaaatcattgatgcagcggtcatagtgatcgccaagcacggtttccatcaagcgcaagtatcaaaaatagcaaaagaagcgggcgttgccgatggaacaatttatttgtattttaaaaacaaggaagacttgctcgtatcgctatttgacaagaagctaggcgcttttgtcgaaaaaagcaggagaagattggccaaggaacactcaatagaagcgaaattccaccttttagttgaatctcatttctcacagctagaagacaattacgatcttgcagtggtgacacagcttgaattgcgccaatctaaatcggaattacgccaacgaatcaatcaagttttaaaaggatatttgacacttttagatgaattaatagcagaagggaaagcagaaggttgctttcaccctgaactggacccgcttttagcaagacaaatggtatttggcgttatggatgaagttgtctccaattgggtcatggcagaaggcaagtttccgttgaagaaacaagctgaaaatgtctatcatttgctcctccacgggttgcgagggaagtaa

SEQ ID NO: 38382 - protein, 195 aa, Bacillus clausii KSM-K16
MSKKRGQKYDQIIDAAVIVIAKHGFHQAQVSKIAKEAGVADGTIYLYFKNKEDLLVSLFDKKLGAFVEKSRRRLAKEHSIEAKFHLLVESHFSQLEDNYDLAVVTQLELRQSKSELRQRINQVLKGYLTLLDELIAEGKAEGCFHPELDPLLARQMVFGVMDEVVSNWVMAEGKFPLKKQAENVYHLLLHGLRGK

SEQ ID NO: 38383 - DNA, 654 bp, Azotobacter vinelandii
  CDS (1)..(654)
atgcgccgaaccaaggctgatgccgaaaagacccgcgaaaacatcctcgctaccgccgagcggttgtttctacgcaacggcgtggcccataccagcctggaacagatcgcccgcgccagcggcgtgacccgtggtgcggtctactggcatttccagaacaagagccatctgctcaacgaaatactcgaccaggtccgcccgcggccggaacagatcgccgagcggctgaacgccccggcgcaagcctaccccctgcagaacctgcgcgacctgctcgtggaaatcatggccgacctggccgccaacgagcaggagcgcaacatcctgacgatcctgctgatgcgctgcgaattcaccgacgaattgagcgacgcccaggaacgccacaccaacttcatcaaccagttcatcgccctcagcgaggaacagttcgaacgcgagcggcaacgcctgcgtcccggcatcagcccgcccctggcggcgcgcctgctgcacgccaccctggtcggcatgctcagcgaccgcctgcgcgatcccgggctgttcgacgtccagaccgaggcgccggtgatgatcgacgccctgttcagcggcctgctctgcgactggcggatcgccggccagcgccccgttcaggccggcgccacctcgtag

SEQ ID NO: 38384 - protein, 217 aa, Azotobacter vinelandii
MRRTKADAEKTRENILATAERLFLRNGVAHTSLEQIARASGVTRGAVYWHFQNKSHLLNEILDQVRPRPEQIAERLNAPAQAYPLQNLRDLLVEIMADLAANEQERNILTILLMRCEFTDELSDAQERHTNFINQFIALSEEQFERERQRLRPGISPPLAARLLHATLVGMLSDRLRDPGLFDVQTEAPVMIDALFSGLLCDWRIAGQRPVQAGATS

SEQ ID NO: 38385 - DNA, 606 bp, Desulfitobacterium hafniense DCB-2
  CDS (1)..(606)
atggatagcaatcttatacacagaaaagagagcctggtcattacagctatctccctgatcaatgaaaagggcttgcaaggcctttccacaagagaagtggccaaacgggaaggggtttccgaagccactatcttcaagcattttaaatcgaaaaacgaactcgtatcagccgttcttgagcactcttcccaatatgatcatgctttgttggaagcagccctgacgaaggacttaactcccaaagagaaggttcttcatcttatcgacagctatataacctactgtgagaactatccggaaattacggcgatccttctggcctacaatggcttgttgtacgaagaagagcttaaggacaaggttatggagattatttgccgacggtcaaaagacatccaatctttaatttatagctccatcgcaatgggtgaactgaatccatccgttcatagtgaaagtttaaccaatatcattctggggatgatccatgagatcattctcaagtggcgaatggcggagttcagcttttccttgcgggagcagactcttgcttcggcaaccatgcttttagaggctttcaccatgagacacgaagccaaactatag

SEQ ID NO: 38386 - protein, 201 aa, Desulfitobacterium hafniense DCB-2
MDSNLIHRKESLVITAISLINEKGLQGLSTREVAKREGVSEATIFKHFKSKNELVSAVLEHSSQYDHALLEAALTKDLTPKEKVLHLIDSYITYCENYPEITAILLAYNGLLYEEELKDKVMEIICRRSKDIQSLIYSSIAMGELNPSVHSESLTNIILGMIHEIILKWRMAEFSFSLREQTLASATMLLEAFTMRHEAKL

SEQ ID NO: 38387 - DNA, 579 bp, Desulfitobacterium hafniense DCB-2
  CDS (1)..(579)
ttgacggacaagaaagaagcggcagaacaacccatcgacatgcgccggcatattctcactgtggccggtggattaatgattgaaaaaggagtcaaggaaaccagcttaaaagacattgcccaggaagcggggattagcaaggggacattatattactactattcagctaaagaagacattatttatgacattgccaaccataacttaaaacaaattacggacggtttgctggcctggattgaagatgccaatacagaagttgcccctgaggaggtcctgaaaacagtatttgaacaaatattgggggctgaaaccaggggaaagcttcatctttatcttctcagcgatgcaggaacaagcaatactcttctcaaagaaaaattcaaagaacagtatcaagagtggagaaaaaccttgcaatatggtttggataagatcttaccctcccagaaccaaaagaacgtaatgctttcctacttaatcctggctgcccttgacgggctgattatccaaaggttgttcggaaccgaagagattcctgtgcaagaaatcgtcaagctcttggtaaatgccgaatag

SEQ ID NO: 38388 - protein, 192 aa, Desulfitobacterium hafniense DCB-2
MTDKKEAAEQPIDMRRHILTVAGGLMIEKGVKETSLKDIAQEAGISKGTLYYYYSAKEDIIYDIANHNLKQITDGLLAWIEDANTEVAPEEVLKTVFEQILGAETRGKLHLYLLSDAGTSNTLLKEKFKEQYQEWRKTLQYGLDKILPSQNQKNVMLSYLILAALDGLIIQRLFGTEEIPVQEIVKLLVNAE

SEQ ID NO: 38389 - DNA, 774 bp, Desulfitobacterium hafniense DCB-2
  CDS (1)..(774)
ttgccatccaccggcagcgcctatggagacctggcgaccaccgccgtccgggtaaagagggaaatggtcagacgtaccaaggaagaagcgctagagacgcgcaaccgcattctggatgcggcagaggccgtgttccacgcccgtggcgtggcacgtccttcgctggcggacattgccgaggcggcaggcgtcacgcgcggcgcgatctattggcatttcaagaacaagagcgacgtgttcgccgcgatgtgcgatcgcgtcaacttgcctgtcgaggcgctctgctcgcccgagcgcattgcctcgcaggaagacccgctcggcagcatccgcgacatctgcgcattcgtgttccgccagaccgtcaacaatccccaatggcgccgcgtgttcgaaatcatcttccacaagtgcgagatggtcgaggacaacggcgccatcttcgtgcgccagcgccagtcgcaccaggaaggcacggtgaagatgcgcgagcatctgcggctagcgatggagcgcggccagttgcccgccgacctcgacctgccactggccgtcaatgcctttcacgccgcgatcggtggcgtgctggcgcactggctgttctcccccgaggatttcgaactggcccgcgaggccgaacgcctggcggacgcatcatcgacacattgcgcctctcgccggctctgcgcgtgggtacgtgccacgcccatggcgccgtcgatgggaatggcggcctgtgcaacggagcccagagcccagcagcctgggcgatga

SEQ ID NO: 38390 - protein, 257 aa, Desulfitobacterium hafniense DCB-2
MPSTGSAYGDLATTAVRVKREMVRRTKEEALETRNRILDAAEAVFHARGVARPSLADIAEAAGVTRGAIYWHFKNKSDVFAAMCDRVNLPVEALCSPERIASQEDPLGSIRDICAFVFRQTVNNPQWRRVFEIIFHKCEMVEDNGAIFVRQRQSHQEGTVKMREHLRLAMERGQLPADLDLPLAVNAFHAAIGGVLAHWLFSPEDFELAREAERLADASSTHCASRRLCAWVRATPMAPSMGMAACATEPRAQQPGR

SEQ ID NO: 38391 - DNA, 618 bp, Desulfitobacterium hafniense DCB-2
  CDS (1)..(618)
atgaaccgccccgcccccgcccgcctgaccgaccgcaagcgcgcggccatcctcgacgccgccgaggccgaattccgtcaggccggctacgaagccaccagcatggatcgcatcgcggccagcgccggcgtctccaagcgcaccgtctacaaccacttcccgagcaaggaagtgctgttcgcgcagatcctgcagcagttgttcgagcgcagccgcgaatcgccggaactggcctatcgcgccgaccggccgctgcgccagcaattgctcgacctggtccagcagaagctgcaactgctgcacgacgaagccttcatcgacttggtccgggtcgccgtcgccgcggtcatcccctcgcccgagcgcgcgcagcagatcttcaagcgcgtcggcgacaaggaggaaggcctgaccgtgtggatccgcgccgccgccgccgacggccggctcaagaccgacgacccgcagttcgcctcgatgctgctgcaaggcatgatcaaaggcttcgcgttctggccacagatcaccctcggccatccgatcctgagcgcggacgagcgcgagcgcgtggcgcatacggcgacggatatgttcctggcgcatttcgccgcgcgctga

SEQ ID NO: 38392 - protein, 205 aa, Desulfitobacterium hafniense DCB-2
MNRPAPARLTDRKRAAILDAAEAEFRQAGYEATSMDRIAASAGVSKRTVYNHFPSKEVLFAQILQQLFERSRESPELAYRADRPLRQQLLDLVQQKLQLLHDEAFIDLVRVAVAAVIPSPERAQQIFKRVGDKEEGLTVWIRAAAADGRLKTDDPQFASMLLQGMIKGFAFWPQITLGHPILSADERERVAHTATDMFLAHFAAR

SEQ ID NO: 38393 - DNA, 621 bp, Desulfitobacterium hafniense DCB-2
  CDS (1)..(621)
atggttgacaaggaacagactactcagcagcggattctgcaggccgcccaagaggaatttctgcgcctgggctttcagaactcttccctgcgctccatcgccaaggcctgcggcgtaaccaccggcgccttatatggatattacgccgataaagacgctttgtttgaggcgctggtccgggaagaggcggaaaccctctatactatctacctgcgcgctcatcaggagttcgaagcgctgccgccggagcagcagcttgcggagatgactcagcagatcgagccgaggatatggaagtgctttaattacgtttatgagcattatgatgcctttaaactgcttatctgccatgctgaagggacatcttatgaaaattatgtccatcgtctggctgaagtggaggtggagagctccactatctttctttcctgcatggagaacatggggcggcgggttacccatatcccggatgatctcaatcatatgctggccagcgcttatctgaccggtttttttgaagttgtcgcccatgatatgcctaaagaagaggcccgggaatatatcgaacgtcttactgattttttcagcgccggttggaaaaaccttttggggcttgtctag

SEQ ID NO: 38394 - protein, 206 aa, Desulfitobacterium hafniense DCB-2
MVDKEQTTQQRILQAAQEEFLRLGFQNSSLRSIAKACGVTTGALYGYYADKDALFEALVREEAETLYTIYLRAHQEFEALPPEQQLAEMTQQIEPRIWKCFNYVYEHYDAFKLLICHAEGTSYENYVHRLAEVEVESSTIFLSCMENMGRRVTHIPDDLNHMLASAYLTGFFEVVAHDMPKEEAREYIERLTDFFSAGWKNLLGLV

SEQ ID NO: 38395 - DNA, 1230 bp, Nostoc punctiforme PCC 73102
  CDS (1)..(1230)
atgtcgtctcacctcgtttctactcgtcaacgcttgattcaagctgcacttgagttgttttctgctcagggagttagcgctaccacaacccgccaaattgctgaaaaagccgaagtcaacgaagtgactctatttcggaattttggcaataagcatggactgcttttagctgtgctggaagagtcggcagcctttaaggatttaggtgaatcgctggtgcggcgggcaacgcctcccggcaatgtgtaccaagctctgaaagattatgcaagtgatagcttgcacgcattagaacgagtgccagagtttgtcaggtctgtggtaggtgaagccgaccaattcccggcagaaaatcgccgcgcactaggcaggggagtcacagaggcaaaccattatgtagctcagtatttagctactgtaatccagcaagggcacctaaatacttatttaccagcagaaaaattagccagtttgctaaatgggatgatcttgggatatgccgtaattgagttcaccagcgaatttcacgaactttgggaggatcggaatgattttctcgaaaatttggtggagttgtttttacatggagctatgtcatcctcagcagaatcagcaataaactgcttacaaggaggattcaccaccacagaagtagctgatttaccagctagtttagttcacgaaattttacaacaagccaggaaatcgggaacccgagatcacgcgttggcttatgtgttattcggagctgggttatccgccacagaaataattagcttggagcgatcgcaccaaatctacgatactcaagggcacttcctgcaaatcacaatccccggatttgtccgtcaagtgcctgtgaatcagtggattttgggcaaacgctacggttcttttactaataatcctttaattaaatggctgaaaagtcgtaaagatgctcaaacagccatgtttttgaatgaaacaggtaaacccatgacagaatcagagcttgagacacgttggcaagtatggagtgagggattactaactccccaaggacaaacgccagcgatcgctcaggctcaacaaacttggcgcgtagaaatgttgatgcggggaatcaccttggaaaacctgattatattaacaggttgcgatcgcattcaattacaaccttatgtccgccgagccaaagaaaaagctgccctagagcaagccactcgtttggatcacaagccaggatag

SEQ ID NO: 38396 - protein, 409 aa, Nostoc punctiforme PCC 73102
MSSHLVSTRQRLIQAALELFSAQGVSATTTRQIAEKAEVNEVTLFRNFGNKHGLLLAVLEESAAFKDLGESLVRRATPPGNVYQALKDYASDSLHALERVPEFVRSVVGEADQFPAENRRALGRGVTEANHYVAQYLATVIQQGHLNTYLPAEKLASLLNGMILGYAVIEFTSEFHELWEDRNDFLENLVELFLHGAMSSSAESAINCLQGGFTTTEVADLPASLVHEILQQARKSGTRDHALAYVLFGAGLSATEIISLERSHQIYDTQGHFLQITIPGFVRQVPVNQWILGKRYGSFTNNPLIKWLKSRKDAQTAMFLNETGKPMTESELETRWQVWSEGLLTPQGQTPAIAQAQQTWRVEMLMRGITLENLIILTGCDRIQLQPYVRRAKEKAALEQATRLDHKPG

SEQ ID NO: 38397 - DNA, 1212 bp, Anabaena variabilis ATCC 29413
  CDS (1)..(1212)
atggtttctccaccgctttcaactcgccaacgcttgatacaagctgcactagagttatttacggctcagggagttagtggcactaccacccgccaaattgctgaaaaagccgcagttaatgaagtgactttgttccgaaattttggtaacaaacatggattgcttttggctgtgctagaagaatcggcagcttttacaaatttgggtgaatctttggtacaacgggcaacgcctccagggaatgtttatcaggcattaaaagactatgcaagtgacagcttgcaggctttggaaagggtgcctgaactagttaggtctgtggtaggagaagctgaccaatttccggcagagaaccgccgtgctttaggacggggattaacagaggctaaccgttatgtggctcaatatttagccactgtaattcaacagggagacttaaacacttatctacccgcagaaaaattggcaagtttactcaatggaatgatcttaggctatgctgtgattgaatttaccagcgaatttcatcaattatgggagagtcgggatgattttctggaaaatttggtggaattattcttacacggcgcaatgtcagccacagccaatacaaataaaaaagttattactagagaagttgctgatttacctgctacgttagttcacgaaattctccgacaagcgagaaagacaggcatacaagattatgcgatcgcctacgttttatttgcggctggcttatctgtcacagaaatagttaacttacaacgtaatcatcaaatatatgactctcacgggcattttctgcaaatcaccatccccggatttgtccgtcaagttcctgtcaatcagtggattttaggtaaacgctatggttcctacacagataatcccttaactaaatggctgaaaagtcgtaaagataattatgcagccatgtttattaatacagcaggtgagccaataactgaatctgaggttttggaatattggcaagcatggactcaagcattattaaccccccaaggacaagcaccagaaatcgaccaagcacagcatacctggcgtgtagaaatgttaatgaggggcataagtttggaaaatttaagcattattacagcttgcgatcgcattcaattacaaccatatgcccacagagctaaggagaaagctgcacttgagcaagcaactcgtttggatcaaaaaccatga

SEQ ID NO: 38398 - protein, 403 aa, Anabaena variabilis ATCC 29413
MVSPPLSTRQRLIQAALELFTAQGVSGTTTRQIAEKAAVNEVTLFRNFGNKHGLLLAVLEESAAFTNLGESLVQRATPPGNVYQALKDYASDSLQALERVPELVRSVVGEADQFPAENRRALGRGLTEANRYVAQYLATVIQQGDLNTYLPAEKLASLLNGMILGYAVIEFTSEFHQLWESRDDFLENLVELFLHGAMSATANTNKKVITREVADLPATLVHEILRQARKTGIQDYAIAYVLFAAGLSVTEIVNLQRNHQIYDSHGHFLQITIPGFVRQVPVNQWILGKRYGSYTDNPLTKWLKSRKDNYAAMFINTAGEPITESEVLEYWQAWTQALLTPQGQAPEIDQAQHTWRVEMLMRGISLENLSIITACDRIQLQPYAHRAKEKAALEQATRLDQKP

SEQ ID NO: 38399 - DNA, 771 bp, Ralstonia eutropha JMP134
  CDS (1)..(771)
atgaggcacgattcaaacaattcatccgccgccgggccccgcgccgacgcctccccgctcgtcctgccacgcaagcgcgggcgcaagaaagtcgacggcctggtcgaggcgcggcggcagcagatcctcacggccgcgctcgagctgttcggcaccaagggattccaccgcacgacgacgcaggacctggccgacagcgccgacgtgagcgtcggcctcatctaccagtacttcaaggacaaggaagacctgctcgcggcggccatcggccagatcttcgatgcctacctgagcgagatcccgctcgccgtcgaggccgccgccgatccgctgtcgcgctttcgggccgcggtgcatgcctactgccgcgtcatcgacgaacaccgcgaggccgccctgctcggctatcgcgagacacgttcgctgtccaaggcggcaaccaagggcctgatggcgaaggaaacgcagtcgacggcgctgatcgccgagcgcgtgaccgaatgcatcgaggcgcgcgtcttccgctcggtcgacgtcgcgatgctgacctaccacatcgtcgtcttcgtccattcctgggcgctcaattcgtggcgcctgaagggccagttcaagcgcgaggactacgtggacgtgggcgtcgacatgctgctgggcccgatcgtgcagaccccggcgcctgcgcgcaaacccgccaaggccgccaagacaaccaagaccgcgaaacccgcaccccgaaggaatccccatgccggccgccgcactgtctga

SEQ ID NO: 38400 - protein, 256 aa, Ralstonia eutropha JMP134
MRHDSNNSSAAGPRADASPLVLPRKRGRKKVDGLVEARRQQILTAALELFGTKGFHRTTTQDLADSADVSVGLIYQYFKDKEDLLAAAIGQIFDAYLSEIPLAVEAAADPLSRFRAAVHAYCRVIDEHREAALLGYRETRSLSKAATKGLMAKETQSTALIAERVTECIEARVFRSVDVAMLTYHIVVFVHSWALNSWRLKGQFKREDYVDVGVDMLLGPIVQTPAPARKPAKAAKTTKTAKPAPRRNPHAGRRTV

SEQ ID NO: 38401 - DNA, 720 bp, Ralstonia eutropha JMP134
  CDS (1)..(720)
atggtcagacgcaccaaggaagaggcgctcgaaacgcgccaccggattctcgacgcagccgaaaccgtgtttcacgcgcgcggcgtggcgcgcccgtcgctggcagacattgccgaggcggccggcgttacccgcggcgccatctactggcacttcaagaacaagagcgacgtgttcgccgccatgtgcgaccgcgtgaacctgcccgtggaagcgctatgcgacccggagcgcatcgcgcgccaggaagacccgctgggaggcatacgcgacatctgcgccttcgtcatgcgccagaccgtggtcaatccgcgctggcggcgggtgttcgagatcatcttccacaagtgcgagatggtgcaggacaacggggccatcttcgaacgccagcgccagtcgcaccaggaaggcatggtgaagatccgcgagcacctgcgctttgcggtggagcgcggccagcttccggccgatctggacctggacctggccgtgaacgcgttccatgcggcgattggcggcgtgctcgcgcactggctgttctcgccacaggacttcgacctcgacgccaatgccgagcgcctgtcggacgccttcatcgatacgctcaggttttccccggcgctgcgccatggctatgtgccgcgcccgatggcggaactcgatcgcgagctgagtacgctttgcgagaaagcctgccaggaagccaacggcgcgccgtaa

SEQ ID NO: 38402 - protein, 239 aa, Ralstonia eutropha JMP134
MVRRTKEEALETRHRILDAAETVFHARGVARPSLADIAEAAGVTRGAIYWHFKNKSDVFAAMCDRVNLPVEALCDPERIARQEDPLGGIRDICAFVMRQTVVNPRWRRVFEIIFHKCEMVQDNGAIFERQRQSHQEGMVKIREHLRFAVERGQLPADLDLDLAVNAFHAAIGGVLAHWLFSPQDFDLDANAERLSDAFIDTLRFSPALRHGYVPRPMAELDRELSTLCEKACQEANGAP

SEQ ID NO: 38403 - DNA, 636 bp, Methylobacillus flagellatus KT
  CDS (1)..(636)
atggccagaaaaacgaaagaggattccctgcggacgcgctccagcattctggatgctgcagaacgcgtcattatccagcggggcatcagctatgccacgatggcggatatcgcccaggctgcaggcgtgtcgcgtggcgcggtgtacgggcatttcgagaacaagatggaggtggccatcgccatgtgcgaacgggcattggcactggcggtcgcgccggagcgaaagcccggcacatcggcgctggaaacgctttatgagcaaggcatgtattttctcaagctctgcagtgaacctggtccggtgcagcgtgtattgcagatcctttatatgcagtgcgataccaacgagcacaatttgccgctgctggaaatccgtgaccgttgggaaatggaatgccgtgaagatgcagaaacattgatccgcgaggcggtggccagtgaagagctgcctggagatattgacgtcggccttgccaatctctacctcttttccctattcgatggcatctacagtacgttattcttggccaatcgcatcaagcaggaccgctggcaagtggccgaggcgctataccgtgctggttttgcagccttcaggacggcgcccgagctgcgcaagaaggctgcaggttag

SEQ ID NO: 38404 - protein, 211 aa, Methylobacillus flagellatus KT
MARKTKEDSLRTRSSILDAAERVIIQRGISYATMADIAQAAGVSRGAVYGHFENKMEVAIAMCERALALAVAPERKPGTSALETLYEQGMYFLKLCSEPGPVQRVLQILYMQCDTNEHNLPLLEIRDRWEMECREDAETLIREAVASEELPGDIDVGLANLYLFSLFDGIYSTLFLANRIKQDRWQVAEALYRAGFAAFRTAPELRKKAAG

SEQ ID NO: 38405 - DNA, 597 bp, Dechloromonas aromatica RCB
  CDS (1)..(597)
atgaaaaccacatcggtcaaacctcgcaagcgggcggcagcaacacgcacccagctcgatccggatcgctgggtggaagtggcgatcgaccttcttgccaaggaaggcgtcagcggcttgcgcgtcgaagtgctggccaagcgttgcggcgtcaccaagggcagtttctactggcacttcaaggaccggcaggcactgctcgacgccgtgctggaacagtggaaacttggccgcatccgcgacattgaaaagacgacggcagtgacccccggcaatgaacgcgaccagttgcactatgccatcgaagtatacggcgccagccgcaaccgcaaaggaatgtcgatcgaactggctgttcgtgactgggctcggcacgacccacaagctgctgccattgtcgaagcggtggatctttatcggctggaatgcacccgcaagctgtttgttgcggcaggaatgtccgatgccgaggccaagagccgcagcctgctgctctacgcctgtgtttttggcctgtcgctgatgcattacacgcatttcgacgacaatcttgccgatctcaagcaacgcatcgccgagcgcatcgtttccaactaa

SEQ ID NO: 38406 - protein, 198 aa, Dechloromonas aromatica RCB
MKTTSVKPRKRAAATRTQLDPDRWVEVAIDLLAKEGVSGLRVEVLAKRCGVTKGSFYWHFKDRQALLDAVLEQWKLGRIRDIEKTTAVTPGNERDQLHYAIEVYGASRNRKGMSIELAVRDWARHDPQAAAIVEAVDLYRLECTRKLFVAAGMSDAEAKSRSLLLYACVFGLSLMHYTHFDDNLADLKQRIAERIVSN

SEQ ID NO: 38407 - DNA, 606 bp, Burkholderia cepacia R18194
  CDS (1)..(606)
atggtgaaacgaacccgtgaacaggcacaggcgacacgggccatcatcgtcgagtcggcacagggcgtgttcttcgatcatggcttcgcgcatgcgtcgcttgaggaaatcgcccgccgggccggcgtcacgcgcggggccgtgtactggcacttcgagagcaagctcgaggtgctcgatgccatcttcgccgatgcggcgatcccgctggaccctttcctgattgcgtcgcgacacgatgccgagcatgagctcgacgcgctgatcgatgcactcggtgcgtgctggcggatcgcgacacgctcgaaattgtcccgccggctgtacacgctgtcgtacacacgatgtgaaaacgcgaaggaaacggcggctttctgcgaacgggtttgccaggctgcgtacgcggcggaacagcgcatcgatgcctggttgcgtcgtgcgatatcggccgggcagctggcgagcgagcatgaaccggcggtgatcgccagcgtggttcacgcgacgctgagcggattgctgcaccgggaattgacgcggccaggatgccgcaatccggacagggttgaagtgaccgaagtggtccgcaccctgattcaaggatga

SEQ ID NO: 38408 - protein, 201 aa, Burkholderia cepacia R18194
MVKRTREQAQATRAIIVESAQGVFFDHGFAHASLEEIARRAGVTRGAVYWHFESKLEVLDAIFADAAIPLDPFLIASRHDAEHELDALIDALGACWRIATRSKLSRRLYTLSYTRCENAKETAAFCERVCQAAYAAEQRIDAWLRRAISAGQLASEHEPAVIASVVHATLSGLLHRELTRPGCRNPDRVEVTEVVRTLIQG

SEQ ID NO: 38409 - DNA, 642 bp, Burkholderia cepacia R1808
  CDS (1)..(642)
atggtcagacgcaccaaggaggaggcactcgagacgcgcaaccgcattctcgacgccgccgaacacgtattcttcgagaaaggcgtgtcgcacacgtcgctcgcggacatcgcccagcacgccggcgtcacgcgcggcgcgatctactggcatttcgccaacaagagcgagttgttcgacgcgatgttcgaccgcgtgttcctgccgatcgacgagttgaagcggatgccgcccgatgcgccgggcgccgatccgctggaaaagatccgcaagatcctgatctggtgcctgctgggcgtgcagcgcgacccgcagttgcggcgcgtgttcagcatcctgttcatgaagtgcgaatacgtggccgacctggagccgctgctgcagcgcaatcgcgcgggcatgagcgaggcgctgcacgcgctcgacgccgatctcgcgctcgccgtgcagctcaagctgctgcccgagcggctcgacacgtggcgcgcgacgctgatgctgcatacgctcgtcagcggctttgtgcgcgacatgctgatgctccccgacgagatcgacgccgaacagcacgcggagcagctggtcgacggctgcttcgacatgatgcgttatagcccggcgatgctgaagacggggggatga

SEQ ID NO: 38410 - protein, 213 aa, Burkholderia cepacia R1808
MVRRTKEEALETRNRILDAAEHVFFEKGVSHTSLADIAQHAGVTRGAIYWHFANKSELFDAMFDRVFLPIDELKRMPPDAPGADPLEKIRKILIWCLLGVQRDPQLRRVFSILFMKCEYVADLEPLLQRNRAGMSEALHALDADLALAVQLKLLPERLDTWRATLMLHTLVSGFVRDMLMLPDEIDAEQHAEQLVDGCFDMMRYSPAMLKTGG

SEQ ID NO: 38411 - DNA, 573 bp, Bacillus cereus G9241
  CDS (1)..(573)
gtggcaatagatcgaaaacgttctattattgaagctgcaacaaagtctttttcagcgttcggttataaagcaacaacgatggatcaagtagcgaagttagcgaatgtaggaaaaggaacgatttatacttttttcaaaaataaagaagagctatttggtgaaattatttctaatttaattacagaaatgaagcaagttgcagaaaatgcaattcgttcagatgtttcattttttgaaaatgtacatagagcattatatagcatattagaattcagaaaagaacatcagctcatgattaagttaattcaagaagagcgcgatatgggaacgaaagaagtacaagaagtgatgcaacaagtagatgtggaaatcgtttctgttattcaagcgtatttaaagattgcgattgataaaggtgaaattagcaaatgtgatccagaaattacagcatttattatgcttcgcttatacgtatcgcttatttttgattgggaaaaaaatcatgaaccgctagaaaaagagaaaattgcagaattatttgaactttatttattaaaaggattgtcaaactaa

SEQ ID NO: 38412 - protein, 190 aa, Bacillus cereus G9241
MAIDRKRSIIEAATKSFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSVIQAYLKIAIDKGEISKCDPEITAFIMLRLYVSLIFDWEKNHEPLEKEKIAELFELYLLKGLSN

SEQ ID NO: 38413 - DNA, 609 bp, Pseudomonas fluorescens PfO-1
  CDS (1)..(609)
atgacagctccccagcgcctcaccgaccgaaaacgcgaagccatcatccaggccgcgatcaccgaatttcgtaccaacggtttcgaggtcaccagcatggacaagattgcggccactgccggggtgtcgaagcgtacggtgtacaaccattttccgagcaaggaagagctgttcgccgaaattctcaaccagttgtgggcacggatcagcaccgagcaaaccgtctcgtatcagcccgatcagccattgcgcgatcaattgcgaaccatgctgctggccaaactgcagatgatggcggacgacaatttcatgaatctggcccgcgttgccatcgcggcggcgatccattcgccggagcgcgcgcagaacatggtggcgcgcatgggcgaacgtgaggaaagcgtgactgtgtggattcgcgccgcccaggcggatggtcgattgaaaccggtcgatccggcgttcgccgcccatcaagtgcaagggctgctgaaaacctttgccttctggccacaaatctccctgggccaaccctcgctcgacagcacagcgcaaaatgccgtggtcgactctgcactcgacatgttcctgacctgctatcagctctag

SEQ ID NO: 38414 - protein, 202 aa, Pseudomonas fluorescens PfO-1
MTAPQRLTDRKREAIIQAAITEFRTNGFEVTSMDKIAATAGVSKRTVYNHFPSKEELFAEILNQLWARISTEQTVSYQPDQPLRDQLRTMLLAKLQMMADDNFMNLARVAIAAAIHSPERAQNMVARMGEREESVTVWIRAAQADGRLKPVDPAFAAHQVQGLLKTFAFWPQISLGQPSLDSTAQNAVVDSALDMFLTCYQL

SEQ ID NO: 38415 - DNA, 633 bp, Pseudomonas fluorescens PfO-1
  CDS (1)..(633)
atggttcgtcgtaccaaagaggaagctcaggaaacgcgcagccagattctcgaagcggccgagaaagccttctatgagcggggcgtggcccgcacgaccctgtcggacatcgctaccttggccggggtgacgcgcggtgcgatctactggcacttcagcaacaaggccgatctgctgcaggccatgctcgataccctgcatgagccgctggacgaactggccaaggccagcgaaagcgaggacgaacccgatccgctgggttgcatgcgcaaattgctgattcatttgtttcatcaagttgcgctggatccgaagacccggcgtatcaacgaaattctgtttcataagtgcgagttcaccgatgaaatgtgcgacctgcgccagcagcgccggaccgccagcctcgattgcaatgtgcggatcgcgctgacactgagtaatgcgatcaatcgtgggcagttgccggcagacctcgacactgcccgggcagccatcagcattcacgcctatatcgacggcctcctttatggatggctattggcgccggacagcttcgagctgtacgccgaggccgaacgctgggtcgataccgggctggacatgctgcgcctgagccccagcctgcgcaaatga

SEQ ID NO: 38416 - protein, 210 aa, Pseudomonas fluorescens PfO-1
MVRRTKEEAQETRSQILEAAEKAFYERGVARTTLSDIATLAGVTRGAIYWHFSNKADLLQAMLDTLHEPLDELAKASESEDEPDPLGCMRKLLIHLFHQVALDPKTRRINEILFHKCEFTDEMCDLRQQRRTASLDCNVRIALTLSNAINRGQLPADLDTARAAISIHAYIDGLLYGWLLAPDSFELYAEAERWVDTGLDMLRLSPSLRK

SEQ ID NO: 38417 - DNA, 654 bp, Rhodospirillum rubrum
  CDS (1)..(654)
atggcagtaagcgaaagtgcggcgcggcgcatcggccgacccgatgcccaggcgtcggaaacgcttgaccgtttgatcctggccaccgccacccaatcgttcatcgaccatggttatgccgccacgtcgatcgaaaaagtcgcggcccaggccgaggttggcaagcaaacgatctaccgccgctatcgctccaaagaagaactgttcaaggcgagcgtcggtgccctgatcgggtccttgctgacgcgggccgacgcggcggcgaagttttcggccgatccgctggcggccctgcgcgaggcctgcgccacctttcttgaaaccgtcgcccgacccgactcgatcgccatgtaccggatcctcatcgccgaatcacggcgctttcccactttggccgatcacgcccttgagtccacctccgagccctttcacgccatcatcaggcgcctgctcgacgccgcggcgcgggccggccggttgcgcgccgaccacgatcttgatctcctcagccgcatcctgattggcatggtcagcggatgggccctcaatcaatggcttcttggcggtcaggccctgtcaaccgaagccgagagggccgctttcctcgataccgccctctccattttcctgaacggcgttgtgatcgacagatga

SEQ ID NO: 38418 - protein, 217 aa, Rhodospirillum rubrum
MAVSESAARRIGRPDAQASETLDRLILATATQSFIDHGYAATSIEKVAAQAEVGKQTIYRRYRSKEELFKASVGALIGSLLTRADAAAKFSADPLAALREACATFLETVARPDSIAMYRILIAESRRFPTLADHALESTSEPFHAIIRRLLDAAARAGRLRADHDLDLLSRILIGMVSGWALNQWLLGGQALSTEAERAAFLDTALSIFLNGVVIDR

SEQ ID NO: 38419 - DNA, 729 bp, Ralstonia metallidurans CH34
  CDS (1)..(729)
atggtcagacgtaccaaggaagaagcgctagagacgcgcaaccgcattctggatgcggcagaggccgtgttccacgcccgtggcgtggcacgtccttcgctggcggacattgccgaggcggcaggcgtcacgcgcggcgcgatctattggcatttcaagaacaagagcgacgtgttcgccgcgatgtgcgatcgcgtcaacttgcctgtcgaggcgctctgctcgcccgagcgcattgcctcgcaggaagacccgctcggcagcatccgcgacatctgcgcattcgtgttccgccagaccgtcaacaatccccaatggcgccgcgtgttcgaaatcatcttccacaagtgcgagatggtcgaggacaacggcgccatcttcgtgcgccagcgccagtcgcaccaggaaggcacggtgaagatgcgcgagcatctgcggctagcgatggagcgcggccagttgcccgccgacctcgacctgccactggccgtcaatgcctttcacgccgcgatcggtggcgtgctggcgcactggctgttctcccccgaggatttcgaactggcccgcgaggccgaacgcctggcggacgcattcatcgacacattgcgcctctcgccggctctgcgcgtgggctacgtgccacgccccatggcgccgctcgatgcggaaatggcggccctgtgcgaacggcagccccagcagccccagcaggccctggcgccgacctga

SEQ ID NO: 38420 - protein, 242 aa, Ralstonia metallidurans CH34
MVRRTKEEALETRNRILDAAEAVFHARGVARPSLADIAEAAGVTRGAIYWHFKNKSDVFAAMCDRVNLPVEALCSPERIASQEDPLGSIRDICAFVFRQTVNNPQWRRVFEIIFHKCEMVEDNGAIFVRQRQSHQEGTVKMREHLRLAMERGQLPADLDLPLAVNAFHAAIGGVLAHWLFSPEDFELAREAERLADAFIDTLRLSPALRVGYVPRPMAPLDAEMAALCERQPQQPQQALAPT

SEQ ID NO: 38421 - DNA, 615 bp, Burkholderia fungorum LB400
  CDS (1)..(615)
atgaatcgcaagttacagggcctcgccacgcgggaaaagatactcgacgcagccgagctggctttttccgcgtacggaacggagcacacgtcactcgaagacgtcgcgcgcgcggcgctggtgacgcgcggcgcgatctatggccacttcgacgacaaggcggcgctgctggatgcactgttgaagcgtgccgcattgccgttagacccattcatggtgccggtgctcgagaattgcgacagccccctcgaacgattacggcaagacctgcaaacgaggctgcacacagtattatgcgaaggcacaacgcggcggctttatcgcatcctgctggcgaggccaatgaacaataccatcgcatccgcggaaaccctcgacgaagcgggtcagatcgcgcaagcgcgcattgcaaccgcgttgcgagccgcacaggatatgggggaaatcagcgaagacatcgattcgcggcacgaagcgagcatgatccatgcgttgctgaccggttatttccgccgcagtctgctccgcgcggcggaatcgaggccccgcgaacaggcagcagaagtcgtgcatcatgcgcttgtgccacttcattctcattcggtggttcgatag

SEQ ID NO: 38422 - protein, 204 aa, Burkholderia fungorum LB400
MNRKLQGLATREKILDAAELAFSAYGTEHTSLEDVARAALVTRGAIYGHFDDKAALLDALLKRAALPLDPFMVPVLENCDSPLERLRQDLQTRLHTVLCEGTTRRLYRILLARPMNNTIASAETLDEAGQIAQARIATALRAAQDMGEISEDIDSRHEASMIHALLTGYFRRSLLRAAESRPREQAAEVVHHALVPLHSHSVVR

SEQ ID NO: 38423 - DNA, 660 bp, Burkholderia fungorum LB400
  CDS (1)..(660)
atggtccgtagaaccaaagaagaggcgctggagacgcgcaatagcattctcgacgcggccgagcgcgttttcttcgagaagggcgtttcgcgcacgtcgcttgccgacatcgcgcaggccgccggcgtcacgcgcggcgcgatctactggcacttcgcgcataaaagcgacctgttcactgaaatgttcgaccgcgtgctgctgccgctggacgaactcaaagccgcctcgcaagaccccaacgagcccgatccgctcggccggctaatggaaatctgcacggtctgcctgcgcgacaccgcgaacgatccacgccgccggcgcgtgttcgacatcctgtttctgaaatgcgaactggtcgaggaaatgggcccggtgatggtccgctatcagaccaacatgcgcgaaggactcgcgaaaatcgaaggcggcctgcgcaacgccatctccaaagggcaaatgcccgcggatctggacacgaagctggccgcggctatggtgcacgcgtttgtcagcggttcgctgcgcgacatgctgttcctgcccgacgccacggatttcggcgctcacgccgtgcagatggtggaaggcatgttcgacgcgctgaagctgagcccggcgctgcgcaacgggcatgcacggcgaacagccggtggctag

SEQ ID NO: 38424 - protein, 219 aa, Burkholderia fungorum LB400
MVRRTKEEALETRNSILDAAERVFFEKGVSRTSLADIAQAAGVTRGAIYWHFAHKSDLFTEMFDRVLLPLDELKAASQDPNEPDPLGRLMEICTVCLRDTANDPRRRRVFDILFLKCELVEEMGPVMVRYQTNMREGLAKIEGGLRNAISKGQMPADLDTKLAAAMVHAFVSGSLRDMLFLPDATDFGAHAVQMVEGMFDALKLSPALRNGHARRTAGG

SEQ ID NO: 38425 - DNA, 702 bp, Thermobifida fusca
  CDS (1)..(702)
atggcggggcgtacggagggccgcggggttgttgccgcggcgctgcgactattcgacgagaaaggcttcgaagcgaccacgatggacgacgtcgcggtcgccgccggagtgagccgcagcaccctgtttcggcgcttcgggtctaaagacgacctgctcttcgctgaccaagaagagctggtggaggcggtgcgcacccatctcgcctcctcgcccgaagacccagtgagcgccgtgtgctcggcggcgcgcatggtgctccgctcctacaccagccagcccgacctggccgtgcgccgctatcgcctggtgcggacccgtcctgcgctacgggaccgcgaaatcgcaatgacggcgcgctaccagtcgctcttcacccagcacctgaccggcgggcacagtgacgagtcgcgggtgctcgccgcggaagtagtggctgcggcagtaattgccgcgcacaaccatgtgctacggatgtggctgcgcgctccggaagtcacgtcgccttcgccgctggagcggctcgaccaggccttggcgttcgtcgtggacatgatggcgcccgcactacgccgcagcggtgagcagcggtcggatgagcggggggaccgtgcggtgcttgtggcggtctacccagcgggggcgtcccacgaagaagtgctggcacgggtccgcgcggccttggaatcaccgcggaactaa

SEQ ID NO: 38426 - protein, 233 aa, Thermobifida fusca
MAGRTEGRGVVAAALRLFDEKGFEATTMDDVAVAAGVSRSTLFRRFGSKDDLLFADQEELVEAVRTHLASSPEDPVSAVCSAARMVLRSYTSQPDLAVRRYRLVRTRPALRDREIAMTARYQSLFTQHLTGGHSDESRVLAAEVVAAAVIAAHNHVLRMWLRAPEVTSPSPLERLDQALAFVVDMMAPALRRSGEQRSDERGDRAVLVAVYPAGASHEEVLARVRAALESPRN

SEQ ID NO: 38427 - DNA, 648 bp, Geobacter metallireducens GS-15
  CDS (1)..(648)
atgacattgcgcgaacgcagacaaaaacacaaggcgcagttccgccaggagattctcgacgcatccagggagcttttctcccagatcgggtacgagcggttctccatgcgtaagcttgcggccaaaatcgagcactctcccacaaccatctacctctatttccgcgacaaggatgatctcctctattctctctgcgaagagcttttcgccaagctgttccagagctaccaggacatctcgcggggagagaacgacccgcggcaggtgttgcgtctttgcctcctgaggtatatcgagttcgggctggcgaatcccggccactacaaggtcgcctttttcacgagtcccgtcgtctatgggtcgcccacggaattcctgcaaaaggacagcatgggacggcgcacctactttcatatcctccggaccgtagaagagaccatggcggccggcatgcttcgccccatggacgcggacctcctcgcgcagacagtatgggtcgcggcccacggagtcgtgacatcgcgaatttactccgccgatttccccatggtggacgccgtcctccaggcagagacgctggtggacgggctgctcgccggtttcagcgtgaaaaatttttttggcacaaatatttacactgttaactaa

SEQ ID NO: 38428 - protein, 215 aa, Geobacter metallireducens GS-15
MTLRERRQKHKAQFRQEILDASRELFSQIGYERFSMRKLAAKIEHSPTTIYLYFRDKDDLLYSLCEELFAKLFQSYQDISRGENDPRQVLRLCLLRYIEFGLANPGHYKVAFFTSPVVYGSPTEFLQKDSMGRRTYFHILRTVEETMAAGMLRPMDADLLAQTVWVAAHGVVTSRIYSADFPMVDAVLQAETLVDGLLAGFSVKNFFGTNIYTVN

SEQ ID NO: 38429 - DNA, 633 bp, Microbulbifer degradans 2-40
  CDS (1)..(633)
atggccacaaaaacaagctcgcagcccccacatatgaaagtaaccgaccaaaaacgtgcggcaatcttagacgcagctattaaggtgtttggggcacaaggctttgagccatctagcatggatcaaatagcaaaagttgcagatgtatctaaacgcactgtttacaaccactttgaaaacaaagaagcgttatttgcggaaattttgaaccagctatgggaaagaagccctttcaaactagacatcgagtatcaaccctctaagccattaaaggaccagttgaccgacctactttggcaaacaatcgagatgctttctgagccaatgtttctaaagctcgctagagtagccattgcagaaacaatacactccccagaaagagctcaatgtatgctagaccgcttagcggtgcgagaagaaagcattagcgcgtgggtccgcgctgcaagcaatgataaaaaactcaacgtggcagacgtatcgtttgcggccaatcagcttcatgcccttataaaaggctttgccttttggccacaaattacgctgaacagccctcctctaaaccaagaggaacaaaagcgtgttgttgaatctgcagttgatatatttattgatacctacgctataaaatag

SEQ ID NO: 38430 - protein, 210 aa, Microbulbifer degradans 2-40
MATKTSSQPPHMKVTDQKRAAILDAAIKVFGAQGFEPSSMDQIAKVADVSKRTVYNHFENKEALFAEILNQLWERSPFKLDIEYQPSKPLKDQLTDLLWQTIEMLSEPMFLKLARVAIAETIHSPERAQCMLDRLAVREESISAWVRAASNDKKLNVADVSFAANQLHALIKGFAFWPQITLNSPPLNQEEQKRVVESAVDIFIDTYAIK

SEQ ID NO: 38431 - DNA, 567 bp, Pediococcus pentosaceus ATCC 25745
  CDS (1)..(567)
atgaaatatgatttgacgaaaaaatcaaccaaaggagcgcaaagaactttaagagcattttcggatgcgatgtataagctactagcggaaaaatcgtatgacgatattagcattaatgaaatttgtaagattagtaatttcccgcgggcaactttctataactattttgaagataaaaaagatttattgaattattgttggttattattcaaagaagaaagcaatattgagcagtatcatgacgttgctgacgaagatcttcaagaatatgtattgggtcaaatctttgaggccatggatcagcatcgggaactattaactcaattagcaaagcataatgctaataatagttcgatcgtgagcagcatttatgagtactttaaaaacgaggctattacgattttaaagcaacatctaaaaaatcaaacttcgaaagtaccactagaattagtagcaaagcattatagtaatacgattttgttggtacttaagtggattttcatcgagaatcatccattgtctaagagagaagcgatggaatatgttgatgagttactagggaaataa

SEQ ID NO: 38432 - protein, 188 aa, Pediococcus pentosaceus ATCC 25745
MKYDLTKKSTKGAQRTLRAFSDAMYKLLAEKSYDDISINEICKISNFPRATFYNYFEDKKDLLNYCWLLFKEESNIEQYHDVADEDLQEYVLGQIFEAMDQHRELLTQLAKHNANNSSIVSSIYEYFKNEAITILKQHLKNQTSKVPLELVAKHYSNTILLVLKWIFIENHPLSKREAMEYVDELLGK

SEQ ID NO: 38433 - DNA, 594 bp, Moorella thermoacetica ATCC 39073
  CDS (1)..(594)
atgagccgcgaagccggggataaacgccggcagatcctggcggcggccgtgtcggtttttgccgaccggggcttccaccaggccaggatcgccgatattgccgctgccgccggggtagggaaggggaccatctatgagtatttctccagcaaaaaggaactcttccagcaattgctagttcatatcttccacacttacctggagcacctgcgccgggtatgccgggaagaagcaagcctggaaggcttcctgcggcggctgatcggcgaaagcctggaacacttccaggctcaccgggaaattaccagaattcttttgagcgaacacccgccggtggatgccgccacccagcagatattcttcaggatggagcatgaaaaactgcaacacctgcaaaatcacctgcaagcggcccttgagcggggggaaatgcgcccggtgccggcggacctggcggctattatgatcactggtttcataaccgccctggggtaccagttattcttctataggaatcaggaaatgaacctggcggctttgtcaacgggggttacagatctcatcttacggggtatccgggatagcggcgggtga

SEQ ID NO: 38434 - protein, 197 aa, Moorella thermoacetica ATCC 39073
MSREAGDKRRQILAAAVSVFADRGFHQARIADIAAAAGVGKGTIYEYFSSKKELFQQLLVHIFHTYLEHLRRVCREEASLEGFLRRLIGESLEHFQAHREITRILLSEHPPVDAATQQIFFRMEHEKLQHLQNHLQAALERGEMRPVPADLAAIMITGFITALGYQLFFYRNQEMNLAALSTGVTDLILRGIRDSGG

SEQ ID NO: 38435 - DNA, 687 bp, Polaromonas sp. JS666
  CDS (1)..(687)
atggcccgtcgaaccaaagaagaggcactggcgacccgcaacaagctgcttgatgctgccgaacacctgtttcaggcacagggagtctcacgcaccagcctgcaggacattgcccggcgcgccggtgccacgcgtggagccatttattggcatttcagggacaaggccgacctgttcaacgccatgatggagcgggtgacgctgcccatggaaaagtcgttcggcctcgaggggaacggagggcaggaatccgcggataactcaggtgccagcggcctcggccggatccgctcggccactgttaacgcgctcaagcagatcgtgaacgacgcccagacccggcgcgttttcgaagtggcgacacaaaaagtggagtatgtggaagaactgcaggccgttcgtctccggcatctggcagtgcgcaacgggtttttacaattttttgaagagagtattgacctcgccgcgcgccgatgcggcttgaaactggcggtgcctgcctcagtggctgcacagggattccacgccctgatagacggcctgatacaaaactggctattggatccgcaagcgtttgaccttctcgaggtgggtcaaggcgtgatgaacgtctacctgggaggccttggcttcaccgaagggccgcccccgggcaccccgggagagactgcgccaacgccttcctaa

SEQ ID NO: 38436 - protein, 228 aa, Polaromonas sp. JS666
MARRTKEEALATRNKLLDAAEHLFQAQGVSRTSLQDIARRAGATRGAIYWHFRDKADLFNAMMERVTLPMEKSFGLEGNGGQESADNSGASGLGRIRSATVNALKQIVNDAQTRRVFEVATQKVEYVEELQAVRLRHLAVRNGFLQFFEESIDLAARRCGLKLAVPASVAAQGFHALIDGLIQNWLLDPQAFDLLEVGQGVMNVYLGGLGFTEGPPPGTPGETAPTPS

SEQ ID NO: 38437 - DNA, 624 bp, Agrobacterium tumefaciens
  CDS (1)..(624)
gtgaggagaaccaaggagcaggcggcggaaaccggtcgccagatcttgcaggcggcggagaccctgtttctggacaagggctacgacaatgtgagcctggaagaaatcgctgctctttccggcgtgacccgcggggcgatccactggcacttcaagaacaagcacgggcttctgctcgcgctcagaaacgaggcacaggaacctttccggcaatttgccgacgaactctccgaaggccgcggttccgcctccatcgaaaagctcggcgacatcataaccgacaccttcaagctgctggaacaggatccccgtcagcgcggtctgctacgtgtcatgatgaggcttgatatcggccttgcggagaaagaagagggcggggaaaataccttccccgaagagatgcacgcattgttcgtgcgcatattcagggcagtcgagcgaagcccgggaatgatgaagccatggacaccggaaaaggctgcctccatggtttatgcggccatgggcgggctcatcaccgaatgggcgttgcgaaagaccgaattcacgctttcaaatgacggcgggctgttcatccgaaccttgctggccgggcttcagcgaagacccacggacgagaactga

SEQ ID NO: 38438 - protein, 207 aa, Agrobacterium tumefaciens
MRRTKEQAAETGRQILQAAETLFLDKGYDNVSLEEIAALSGVTRGAIHWHFKNKHGLLLALRNEAQEPFRQFADELSEGRGSASIEKLGDIITDTFKLLEQDPRQRGLLRVMMRLDIGLAEKEEGGENTFPEEMHALFVRIFRAVERSPGMMKPWTPEKAASMVYAAMGGLITEWALRKTEFTLSNDGGLFIRTLLAGLQRRPTDEN

SEQ ID NO: 38439 - DNA, 660 bp, Xanthomonas maltophilia
  CDS (1)..(660)
atggcccgcaagaccaaagaggacacccaggcaacccgggaaggcatccttgacgccgccgaagcctgcttccatgaacacggcgtggcccgtaccacgctggagatgatcggtgcccgcgccggctacacccgtggcgcggtctactggcacttcaagaacaagagcgaggtgctggccgcgatcgtcgagcgcgtgcacctgcccttcatgcaggaactggagcgcacctccaccgaccagcgcgacaccccggtgcacgacctgcgcgcggtgatgatccactcgttcatcgagctgtccgaggacgagcgactgcgcaagaccatggagatcatgctgcgcagcgatgcctcggccgacaccaaggtgctgaccgaactgcagcaggccggtttccgcgatggactggagcggatggaacgtgccctgcgccgggcaaaggacctgggccagctgcgcgagggtgcagacccgaagatcgccgcacgcatgctgcacgccaccgtgctgggcgtactgcacggtgcgatggtcgaaccggaactgatggacctcaagcgcgatggcatgctcgcactggacatgaccctggccgcctacgtaaaggacggcgtgttcgttcccggcaccgtgccggagccgctgcccgaggcatga

SEQ ID NO: 38440 - protein, 219 aa, Xanthomonas maltophilia
MARKTKEDTQATREGILDAAEACFHEHGVARTTLEMIGARAGYTRGAVYWHFKNKSEVLAAIVERVHLPFMQELERTSTDQRDTPVHDLRAVMIHSFIELSEDERLRKTMEIMLRSDASADTKVLTELQQAGFRDGLERMERALRRAKDLGQLREGADPKIAARMLHATVLGVLHGAMVEPELMDLKRDGMLALDMTLAAYVKDGVFVPGTVPEPLPEA

SEQ ID NO: 38441 - DNA, 660 bp, Xanthomonas maltophilia
  CDS (1)..(660)
atggcccgcaagaccaaagaggacacccaggcaacccgggaaggcatccttgacgccgccgaagcctgcttccatgaacacggcgtggcccgtaccacgctggagatgatcggcgcccgcgccggctatacccgtggcgcggtgtactggcacttcaagaacaagagcgaggtgctggccgcgatcgtcgagcgcgtgcacctgcccttcatgcaggaactggagcgtacctccaccgaccagcgcgacaccccggtgcacgacctgcgcgcggtgatgatccactcgttcatcgagctgtccgaggacgagcgcctgcgcaagaccatggagatcatgctccgcagcgacgcctcggccgataccaaggtgctgaccgagatgcagcaaaccggcttccgcgatgcgctggaccggatggagcgcgccctgcgccgcgcccgcgatctgggccagctgcgcgaaggcgccgaccccaagatcgccgcgcgcatgctgcacgccaccgtgctgggcgtgctgcacggcgcgatggtcgaaccggaactgatggacctcaagcgcgatggcatgctcgcgctggacatgaccctggccgcctacgtgaaagaaggcgtgttcgtgcccggaacggtgcccgagccgctgccggaagcatga

SEQ ID NO: 38442 - protein, 219 aa, Xanthomonas maltophilia
MARKTKEDTQATREGILDAAEACFHEHGVARTTLEMIGARAGYTRGAVYWHFKNKSEVLAAIVERVHLPFMQELERTSTDQRDTPVHDLRAVMIHSFIELSEDERLRKTMEIMLRSDASADTKVLTEMQQTGFRDALDRMERALRRARDLGQLREGADPKIAARMLHATVLGVLHGAMVEPELMDLKRDGMLALDMTLAAYVKEGVFVPGTVPEPLPEA

SEQ ID NO: 38443 - DNA, 633 bp, Pseudomonas fluorescens
  CDS (1)..(633)
atggtccgtcgtaccaaagaggaagctcaggaaacccgtagccagatactcgaagcggcagaaaaggccttttacgaacggggcgtagcacgcaccacgctggcggacatcgcgacgctggcgggcgtgacgcgcggggccatctactggcatttcagtaacaaggcggatctggtgcaggccatgctcgatacattgcatgagccgctggatgaaatggccaaggcgagtgaaagcgaagatgaactcgacccactgggttgcatgcgcaagctgctgattcatttgtttcatcaagttgccctggacccgaaaacccgacgcatcaatgagattttgtttcacaagtgcgaattcaccgatgaaatgtgcgatctgcgccagcagcgccgggaggtcagcctcgattgcaatgtgcgtatcggcctggccctgagtaatgcggtgaatcgggggcagttgccggacaacctcgacacggcccgcgcggccatcagtctgcatgcctacatcgatggcattttgtatcagtggctattggcgcccgacagctttcaactgcataccgaagccgagcgttgggtcgatgcagcgttggacatgctgcgcctgagccccagcctgcgcaaatga

SEQ ID NO: 38444 - protein, 210 aa, Pseudomonas fluorescens
MVRRTKEEAQETRSQILEAAEKAFYERGVARTTLADIATLAGVTRGAIYWHFSNKADLVQAMLDTLHEPLDEMAKASESEDELDPLGCMRKLLIHLFHQVALDPKTRRINEILFHKCEFTDEMCDLRQQRREVSLDCNVRIGLALSNAVNRGQLPDNLDTARAAISLHAYIDGILYQWLLAPDSFQLHTEAERWVDAALDMLRLSPSLRK

SEQ ID NO: 38445 - DNA, 639 bp, Erwinia amylovora
  CDS (1)..(639)
atggcacgaaataccaaacaacaagcgcaggaaacgcgcaatcacattatagatgcggctatcaagcgtttttctgaacatggcgttgctaatacgtcactggcggacattgccgcaggcgcaggcgtgacgcgaggtgcaatctactggcattttaaaaataaaaccgatttgctcaatgaaatctggactcagtccgaatctggtttgactgcactggaacttgagtatcaatcaaaatacccggaggatccactttccgtgatgcgtgcgatgcttctgtatgtgtttgaagcgactgccaccgacccaagaagacgtgcgcttatggaaatcatttaccataaatgtgagttcgtgggtgaaatgaccaccctgcaactgatgcagcaaaacctctatcttgaatgttatgaaaagatagaagaggtgctgaaagagtgtattgcagcaaagcaacttccggaaaacctggatacccgacgcgccgcggtggtgatgcgcggctatgtgagcggcatcatggaaaactggctatttatgccggaaagctttgatctggccgaagatgctgcgcaactggtggctaccttaattgatatgttgaactacagcgtaaccttgcgcaaaccggcctga

SEQ ID NO: 38446 - protein, 212 aa, Erwinia amylovora
MARNTKQQAQETRNHIIDAAIKRFSEHGVANTSLADIAAGAGVTRGAIYWHFKNKTDLLNEIWTQSESGLTALELEYQSKYPEDPLSVMRAMLLYVFEATATDPRRRALMEIIYHKCEFVGEMTTLQLMQQNLYLECYEKIEEVLKECIAAKQLPENLDTRRAAVVMRGYVSGIMENWLFMPESFDLAEDAAQLVATLIDMLNYSVTLRKPA

SEQ ID NO: 38447 - DNA, 660 bp, Xanthomonas maltophilia
  CDS (1)..(660)
atggcccgcaagaccaaagaggacacccaggcaacccgggaaggcatccttgacgccgccgaagcctgcttccatgaacacggcgtggcccgtaccacgctggagatgatcggtgcccgcgccggctacacccgtggcgcggtctactggcacttcaagaacaagagcgaggtgctggccgccatcgtcgagcgcgtgcacctgcccttcatgcaggaactggagcgcacctccaccgaccagcgcgacaccccggtgcacgacctgcgcgcggtgatgatccactcgttcatcgagctgtccgaggacgagcgcctgcgcaagaccatggagatcatgctgcgcagcgatgcgtcggcgaacaccagggtgctgaccgaaatgcagcaggccggattccgcgatgcgctggaccggatggagcgtgccctgcgccgcgcccgcgatctgggccagctgcgcgaaggcgccgacccgaaaatcgccgcgcgcatgcagcacgccaccgtgctgggcgtgctgcacggcgcgatggtcgaaccggaactgatggacctcaagcgcgatggcatgctcgcgctggacatgaccctggccgcctacgtgaaggatggtgtgttcgttcccggcaccgtccccgagccgctgcccgaggcgtga

SEQ ID NO: 38448 - protein, 219 aa, Xanthomonas maltophilia
MARKTKEDTQATREGILDAAEACFHEHGVARTTLEMIGARAGYTRGAVYWHFKNKSEVLAAIVERVHLPFMQELERTSTDQRDTPVHDLRAVMIHSFIELSEDERLRKTMEIMLRSDASANTRVLTEMQQAGFRDALDRMERALRRARDLGQLREGADPKIAARMQHATVLGVLHGAMVEPELMDLKRDGMLALDMTLAAYVKDGVFVPGTVPEPLPEA

SEQ ID NO: 38449 - DNA, 645 bp, Proteus mirabilis
  CDS (1)..(645)
atggcacgaaaaactaaacgccaagcacaagagacaagacagcagattattgatgctgcacttaggctatttactgtgcaaggtgtttctgccacatcactttcagatattgcaaccgaggccggagtaactcgaggtgcaatatattggcactttaagaataaagtggatttatttactgaagcgtgtgaactcaccgacttaaaaatagaatcattagaattagagtatcaatcaaaatatccagatgatccactatttgtattaagagaattgcttatttacatattgacatcaattgtcgaagatccgaaacataatgcacttctagaaatatatttccataagtgcgaatttgttggtgaaatgacaccaattgttgaaatccgccgagaattatgtgcagccgattactctagaatagagcaatctttatctcgctgtatcgaaaaaaaacaacttcctgccaaccttgatttaagaagagccgcgattatgttaagagctatgatgacagggcttgctgaaaattggttattttcaccagaaagtttttctattaaagaggaaagtcaatatttggttgatagttttattgatatgattaagcatagcgtcaatatgagaatatcggcgctatcttaa

SEQ ID NO: 38450 - protein, 214 aa, Proteus mirabilis
MARKTKRQAQETRQQIIDAALRLFTVQGVSATSLSDIATEAGVTRGAIYWHFKNKVDLFTEACELTDLKIESLELEYQSKYPDDPLFVLRELLIYILTSIVEDPKHNALLEIYFHKCEFVGEMTPIVEIRRELCAADYSRIEQSLSRCIEKKQLPANLDLRRAAIMLRAMMTGLAENWLFSPESFSIKEESQYLVDSFIDMIKHSVNMRISALS

SEQ ID NO: 38451 - DNA, 651 bp, Klebsiella pneumoniae
  CDS (1)..(651)
atggcacgaaaaaccaaacaacaggcacgtgaaacccggcaactgattctggatgttgctctgcgtctgttttcgcagcaaggcgtatcatctacctcgttggcaacaattgcaaaagctgcgggtgtaacgaggggggctatctactggcatttcaagaataaatcagatttattcaacgaaatttgggagctgtcagacgccagtattagcgatctcgaaattgagtatcgggcaaaattccccaacgatccactctcagttatcagggagattctagtctatgttcttgaagcgacagtgacagaagaacgtcgacgattaatgatggagattatctatcataagtgtgagttcgtcggtgaaatgaccgtggtgcagcaggcccagcggcagctctccctggcgagttatgagcgtatcgagcagaccttgaaagagtgcatcgcggcgaagctgctgcccgccaatttactcaccccgcgggcgggcgtgttaatgcgcagctaccttttccgactgatggaaaactggctgtttgcccccgattcgttcgaccttcatgcggaagcgcgggactacctcgcttttctgctggagaagtatcaattctgcccgacgctacgcggcccggagagcttgtcagcttaa

SEQ ID NO: 38452 - protein, 216 aa, Klebsiella pneumoniae
MARKTKQQARETRQLILDVALRLFSQQGVSSTSLATIAKAAGVTRGAIYWHFKNKSDLFNEIWELSDASISDLEIEYRAKFPNDPLSVIREILVYVLEATVTEERRRLMMEIIYHKCEFVGEMTVVQQAQRQLSLASYERIEQTLKECIAAKLLPANLLTPRAGVLMRSYLFRLMENWLFAPDSFDLHAEARDYLAFLLEKYQFCPTLRGPESLSA

SEQ ID NO: 38453 - DNA, 651 bp, Enterobacter aerogenes
  CDS (1)..(651)
atggcacgaaaaaccaaacaacaggcacttgaaacccggcaactgattcttgacgtcgccctgcgattgttttcgcagcaaggggtatcatctacctcgttggccgcgattgcaaaagctgctggagtgaccaggggcgctatatactggcatttcaaaaacaaatccgatctgtttaatgaaatatggagtctttctgacgccagcattagcgatctcgaagttgagtatcgggcaaaattccctaacgatccactgtcagttgttcgcgaaatactggtttatatcctcgaagcgacggtagtagaggagcgtaggcgcctgatgatggaaatcatcttccataaatgcgaatttgtcggagaaatggccgttgtccaacaagcgcagcgcagtttatggcttgaaagctacgatcgtattgagcaaacattaaaagattgtatcactgctcaacaattacctgcgaatttactcactcgccgtgcggcaattctgatgcgcagttatctttccggattaatggaaaactggctctttgcaccagagagttttaaccttcatgcggaagcccgtgcttatgtcgatgcgctgattgagatgtatcagacctgcccgtcgctacgaagttcgtctgaggtcatggcctga

SEQ ID NO: 38454 - protein, 216 aa, Enterobacter aerogenes
MARKTKQQALETRQLILDVALRLFSQQGVSSTSLAAIAKAAGVTRGAIYWHFKNKSDLFNEIWSLSDASISDLEVEYRAKFPNDPLSVVREILVYILEATVVEERRRLMMEIIFHKCEFVGEMAVVQQAQRSLWLESYDRIEQTLKDCITAQQLPANLLTRRAAILMRSYLSGLMENWLFAPESFNLHAEARAYVDALIEMYQTCPSLRSSSEVMA

SEQ ID NO: 38455 - DNA, 633 bp, Pseudomonas putida
  CDS (1)..(633)
atggtccgtcgaaccaaagaagaagcccaggaaacccgtgcccagatcatcgaggcggcggaaagggccttctacaagcgcggggttgcgcgaaccaccctggccgacatcgccgaactggcgggtgtgacgcggggggcgatctactggcacttcaacaacaaggccgagctggtgcaggcgttgctcgacagcctgcacgagacccatgaccatttggcgcgggcgagcgaaagcgaggatgaagtcgacccgcttggctgcatgcgcaagctgctgttgcaagtgttcaacgagctggtgctcgatgcccgaacccgtcgtatcaatgaaatcctgcatcacaagtgcgagttcaccgatgacatgtgtgaaattcgccagcagcgccagagtgcggtgctggattgccacaagggcatcaccctggcgctggccaatgccgtacgccggggccagttgcctggcgagctggatgccgagcgcgcggcggtggccatgtttgcctatgtcgatggcctgatcaggcgctggctattgctgcctgacagtgtcgatctgttgggtgatgtcgaaaaatgggtcgacaccgggctggatatgctgcgcttgagcccggctctgcgcaaatga

SEQ ID NO: 38456 - protein, 210 aa, Pseudomonas putida
MVRRTKEEAQETRAQIIEAAERAFYKRGVARTTLADIAELAGVTRGAIYWHFNNKAELVQALLDSLHETHDHLARASESEDEVDPLGCMRKLLLQVFNELVLDARTRRINEILHHKCEFTDDMCEIRQQRQSAVLDCHKGITLALANAVRRGQLPGELDAERAAVAMFAYVDGLIRRWLLLPDSVDLLGDVEKWVDTGLDMLRLSPALRK

SEQ ID NO: 38457 - DNA, 642 bp, Pseudomonas putida
  CDS (1)..(642)
atggccagaaagacggcagccgaggcggaggagacaagacagcgcattattgatgcggcgcttgaggtgtttgttgcccagggtgtttccgacgcgaccctagatcagatagctcggaaggcaggcgtcactcgtggtgctgtctactggcattttaacgggaagctggaagtgctccaggcggtgctggcatctcggcagcatcccctcgaattggactttactcctgacttagggattgagcgctcttgggaggcggtggttgtcgccatgctggacgccgtgcatagtccccagtcgaagcagttctcggagatcttgatttaccaagggcttgatgagtcgggcctgatccataatcgaatggttcaagcgagtgatcggttcctgcagtacattcaccaggtgcttcggcacgcggttacccaaggggaattgcccataaatctggatcttcaaacctcaatcggcgtcttcaaaggactgatcaccggactgctctatgagggattacgaagcaaggaccagcaggctcagataatcaaagttgcgctgggatcgttttgggctctgctcagggagcctcctcgcttcttgttgtgcgaggaggctcagattaagcaagtcaaatccttcgagtga

SEQ ID NO: 38458 - protein, 213 aa, Pseudomonas putida
MARKTAAEAEETRQRIIDAALEVFVAQGVSDATLDQIARKAGVTRGAVYWHFNGKLEVLQAVLASRQHPLELDFTPDLGIERSWEAVVVAMLDAVHSPQSKQFSEILIYQGLDESGLIHNRMVQASDRFLQYIHQVLRHAVTQGELPINLDLQTSIGVFKGLITGLLYEGLRSKDQQAQIIKVALGSFWALLREPPRFLLCEEAQIKQVKSFE

SEQ ID NO: 38459 - DNA, 663 bp, Escherichia coli
  CDS (1)..(663)
atggcaaaaagaaccaaagccgaagctctgaagacccggcaagaactgattgaaactgccatcgcccagtttgcgcagcatggcgtaagcaagacgacgctcaacgacattgccgacgccgctaacgttacgcgtggcgctatctactggcacttcgaaaacaagactcaactgtttaatgagatgtggttgcaacagccttcattgcgggagttaatccaggaacacttgacggctggattagagcatgacccgtttcaacaattgcgtgaaaaattgattgtcggcttgcaatatattgccaaaattccccgccagcaggcgttgctgaaaatcttatatcacaaatgtgaatttaatgatgagatgctggccgagggagtgatacgcgaaaagatgggctttaatccgcagactctccgcgaagtattgcaggcgtgtcagcaacaaggttgtgtagcaaataacctcgatttagatgttgtgatgattattattgatggtgccttcagcggaattgttcaaaactggttaatgaatatggcgggttatgatctttataaacaagcccccgctctggtcgataacgtattaagaatgttcatgccagatgaaaacataacgaaattaattcatcaaacgaatgaattaagtgtcatgtaa

SEQ ID NO: 38460 - protein, 220 aa, Escherichia coli
MAKRTKAEALKTRQELIETAIAQFAQHGVSKTTLNDIADAANVTRGAIYWHFENKTQLFNEMWLQQPSLRELIQEHLTAGLEHDPFQQLREKLIVGLQYIAKIPRQQALLKILYHKCEFNDEMLAEGVIREKMGFNPQTLREVLQACQQQGCVANNLDLDVVMIIIDGAFSGIVQNWLMNMAGYDLYKQAPALVDNVLRMFMPDENITKLIHQTNELSVM

SEQ ID NO: 38461 - DNA, 633 bp, Neisseria gonorrhoeae
  CDS (1)..(633)
atgagaaaaaccaaaaccgaagccttgaaaaccaaagaacacctgatgcttgccgccttggaaaccttttaccgcaaagggattgcccgcacctcgctcaacgaaatcgcccaagccgccggcgtaacgcgcggcgcgctctattggcatttcaaaaataaggaagacttgtttgacgcgttgttccaacgtatctgcgacgacatcgaaaactgcatcgcgcaagatgccgcagatgccgaaggaggttcttggacggtattccgccacacgctgctgcactttttcgagcggctgcaaagcaacgacatccactacaaattccacaacatcctgtttttaaagtgcgaacatacggaacaaaacgccgccgttatcgccattgcccgcaagcatcaggcaatctggcgcgagaaaattaccgccgttttgaccgaagcggtggaaaatcaggatttggctgacgatttggacaaggaaacggcggtcatcttcatcaaatcgacgttggacgggctgatttggcgttggttctcttccggcgaaagtttcgatttgggcaaaaccgccccgcgcatcatcgggataatgatggacaacttggaaaaccatccctgcctgcgccggaaataa

SEQ ID NO: 38462 - protein, 210 aa, Neisseria gonorrhoeae
MRKTKTEALKTKEHLMLAALETFYRKGIARTSLNEIAQAAGVTRGALYWHFKNKEDLFDALFQRICDDIENCIAQDAADAEGGSWTVFRHTLLHFFERLQSNDIHYKFHNILFLKCEHTEQNAAVIAIARKHQAIWREKITAVLTEAVENQDLADDLDKETAVIFIKSTLDGLIWRWFSSGESFDLGKTAPRIIGIMMDNLENHPCLRRK

SEQ ID NO: 38463 - DNA, 576 bp, Bacillus subtilis
  CDS (1)..(576)
atgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgagccttccgttccatgaaaatgtgcacagagcgctgtttgccattctggagttcaggaaaacacatcagctgacgattaaaattttccaagagaatgccgagattggtacaatggcagttcaggaagtgatccagaaaatggagcgatccatcctgtcttatatcaaaagcaagattgaagacgggatcaaaagcggcgcaatcaagccgtgcgaccctgagctgacagcctttgtgatgctgaagctttatatcgcgctcatttttgactgggaaaaacaacaccccccgcttgataaagagacaattgcgggactgcttgaattgtatgttgtcaaaggattgtcagcgaactag

SEQ ID NO: 38464 - protein, 191 aa, Bacillus subtilis
MSIDRKKLILEAATKSFTQFGYKATTMDLVAKLANVGKGTIYTFFKNKEELFDEIFTTLLKEMKQKADEAMEPSLPFHENVHRALFAILEFRKTHQLTIKIFQENAEIGTMAVQEVIQKMERSILSYIKSKIEDGIKSGAIKPCDPELTAFVMLKLYIALIFDWEKQHPPLDKETIAGLLELYVVKGLSAN

SEQ ID NO: 38465 - DNA, 25 bp, Primer
atggcacgaaaaaccaaacaagaag

SEQ ID NO: 38466 - DNA, 23 bp, Primer
ttattcgttagtggcaggattac

SEQ ID NO: 38467 - protein, 36 aa, consensus
  MISC_FEATURE (1)..(36): consensus for the disclosure of xaa see table XV
AXXXFXXXGXXXXXXXXXAXXAXVXXGXXYXXFXXK

SEQ ID NO: 38468 - protein, 47 aa, consensus
  MISC_FEATURE (1)..(47): consensus for the disclosure of xaa see table XV
XXXXXXXXXXXXGXXXXXXXXXXXXXXXXXXXXXXXXXXXXXXXXXX

SEQ ID NO: 38469 - DNA, 1614 bp, Escherichia coli
  CDS (130)..(1503)
gatccctcgcccgcaacccatgcctgacccaccacccgatgaagaaccgattaaattgtcgcatcgtgagcgtagatctgcgaggatacgcgcctgctaactttgcgtcgatgaccacgagaatagattatgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgc

SEQ ID NO: 38470 - protein, 457 aa, Escherichia coli
MTAFSTLNVLPPAQLTNLNELGYLTMTPVQAAALPAILAGKDVRVQAKTGSGKTAAFGLGLLQQIDASLFQTQALVLCPTRELADQVAGELRRLARFLPNTKILTLCGGQPFGMQRDSLQHAPHIIVATPGRLLDHLQKGTVSLDALNTLVMDEADRMLDMGFSDAIDDVIRFAPASRQTLLFSATWPEAIAAISGRVQRDPLAIEIDSTDALPPIEQQFYETSSKGKIPLLQRLLSLHQPSSCVVFCNTKKDCQAVCDALNEVGQSALSLHGDLEQRDRDQTLVRFANGSARVLVATDVAARGLDIKSLELVVNFELAWDPEVHVHRIGRTARAGNSGLAISFCAPEEAQRANIISDMLQIKLNWQTPPANSSIATLEAEMATLCIDGGKKAKMRPGDVLGALTGDIGLDGADIGKIAVHPAHVYVAVRQAVAHKAWKQLQGGKIKGKTCRVRLLK

SEQ ID NO: 38471 - DNA, 1221 bp, Thermococcus kodakaraensis
  CDS (1)..(1221)
atgagttttagagaacttggactatccagtgcttcagttgaagcagttgaaagaaagggtttttcaatcccaacagacattcagagggaggtcatcccccttctgctgtccgctgagagcgatattgtgggtcaatcaaaaacgggaagcggaaaaacagcagcttttggacttccgattctggattcgatagatgaatccataagggaagttcaagcgttgattctaacccccacaagggagcttgccatacaggtcactgatgagctcaggtcgctcaggggcaaaaggaggatttacgtttactccgtttacggcggacagccgatcggacctcaaataagggcccttgaggggggcgtccacatagtagttggaactcctggacgggttctcgaccacataaacagaggtactctgaacctcgatggggtcaggttcttcgtcctcgatgaggccgacaggatgctggacatgggcttccaggaggacatcgaagcaatcttcagggcaacccccaaggagaagagggtcctgatgttctcagccacgatgccgatggatgtcctcctgctggcaaagaagtacatgagaaaccccgaggtagtcatcgtcagcagggacgagcttgtcccaggagaggttgagcaggagtacatcgaagctgttccccacagaaggttcgaccttctcaccaagatactctcagatgagtctaatgagttttacggcatagtgttctgtcagactaaagccgagacgagggaactctctatgaggcttagggcggctggattcagggcagaggccctcaacggcgatatgagccagccggctagagagaagacgttcaatcgctttaaggccaggaaaactaagatactcgttgcgaccgatgtagcagcgaggggacttgacgttccagagataacccacgttatcaactattcaatcccaatgaaccccgaacagtacatccacaggattggaaggacagggagaatgggtaagaaaggaaaggccataactttcatcgccccaggagaactgaggcgctttaggtacatcacaaagcaggccggcgttgaggtcaagaagtccgaactcagcgagggtattcccaaagaataccgggagaggttgaggcaggaggagcttgaaggtgagtaccgcggcaggtgggggtcaatgaagccccgccagagaaggaggagatattga

SEQ ID NO: 38472 - protein, 406 aa, Thermococcus kodakaraensis
MSFRELGLSSASVEAVERKGFSIPTDIQREVIPLLLSAESDIVGQSKTGSGKTAAFGLPILDSIDESIREVQALILTPTRELAIQVTDELRSLRGKRRIYVYSVYGGQPIGPQIRALEGGVHIVVGTPGRVLDHINRGTLNLDGVRFFVLDEADRMLDMGFQEDIEAIFRATPKEKRVLMFSATMPMDVLLLAKKYMRNPEVVIVSRDELVPGEVEQEYIEAVPHRRFDLLTKILSDESNEFYGIVFCQTKAETRELSMRLRAAGFRAEALNGDMSQPAREKTFNRFKARKTKILVATDVAARGLDVPEITHVINYSIPMNPEQYIHRIGRTGRMGKKGKAITFIAPGELRRFRYITKQAGVEVKKSELSEGIPKEYRERLRQEELEGEYRGRWGSMKPRQRRRRY

SEQ ID NO: 38473 - DNA, 1530 bp, Staphylococcus epidermidis RP62A
  CDS (1)..(1530)
atgcaaaattttaaagaactagggatttcggataaaacggttcaaacactagaagcaatgggatttaaagaaccgacacctatccaaaaagatagcatcccttatgcgttagaaggagatgacatccttggacaagcccaaactggtactgggaaaacaggggcgtttggtatacctttaattgagaaagttgtaggccaacagggtgttcaatcattaattcttgcgccaacgagagagcttgctatgcaagtagctgagcaattaagagagttcagtaaaggtcaaaaagtacaagttgttacagtctttggtggtatgcctattgaaagacagattaaagcattaaaaagaggccctcaaattgtagtaggtacgccgggaagagttattgatcatcttaatcgtcgtacacttaaaactcaaggaattcacacgcttattttagatgaagcagacgaaatgatgaatatgggattcatcgatgatatgagatttattatggataaaattccagctgaacaacgtcaaactatgctattttcagctacgatgccaaaagcaatccaagaattggtacagcagtttatgaaagctcctaaaataattaagacaatgaataatgaaatgtcagatcctcaaattgatgaatattatacaatagttaaagaattagagaaatttgatacatttacaaactttttagatgttcatcagcctgaattggcgattgtctttggtcgtactaagcgtcgcgtagatgaattaacaagcgcgctattatctaaaggatacaaagcagaaggtttacatggtgatattacccaagcaaaacgtttagaagtattgaagaaatttaagaacgatcaaatagatattttagttgctacagatgtggctgcacgtggtcttgatatttctggtgtgagtcatgtttataattttgatatccctcaagatacagaaagttatactcaccgtattggacgtactggtcgagcaggaaaagaaggtattgcagttacttttgtaaatccaattgagatggattatattcgacaaattgaagatgtcaataatcgtcgaatgaaagcattaagacctccacatcgtaaagaggtgcttaaagcgcgtgaagatgatattaaagatagagttcaaaactggatgtcaagagaaaatgagccgcgtttacaaagaatatcaagtgaattacttaaagaatatgatagtacagaattagtagcctctttacttcaagaacttgtagaagctaatgatgaagtggaagtacaattaacttttgaaaaaccattagcacgtaaaaatcgcagtagtaaaggcggttctagaagaagtaatcataaacgtggtaatggtaagtttgataataaaaatagacgatcaaaagggtctaaaggtcaatcaagcaaaaagaaaaaccaaaagaaatttgaccgtagagataagcaacaaaaaagtggtaatcaatcactaaaaggtcgcacatttgcagatcatcaaaaatag

SEQ ID NO: 38474 - protein, 509 aa, Staphylococcus epidermidis RP62A
MQNFKELGISDKTVQTLEAMGFKEPTPIQKDSIPYALEGDDILGQAQTGTGKTGAFGIPLIEKVVGQQGVQSLILAPTRELAMQVAEQLREFSKGQKVQVVTVFGGMPIERQIKALKRGPQIVVGTPGRVIDHLNRRTLKTQGIHTLILDEADEMMNMGFIDDMRFIMDKIPAEQRQTMLFSATMPKAIQELVQQFMKAPKIIKTMNNEMSDPQIDEYYTIVKELEKFDTFTNFLDVHQPELAIVFGRTKRRVDELTSALLSKGYKAEGLHGDITQAKRLEVLKKFKNDQIDILVATDVAARGLDISGVSHVYNFDIPQDTESYTHRIGRTGRAGKEGIAVTFVNPIEMDYIRQIEDVNNRRMKALRPPHRKEVLKAREDDIKDRVQNWMSRENEPRLQRISSELLKEYDSTELVASLLQELVEANDEVEVQLTFEKPLARKNRSSKGGSRRSNHKRGNGKFDNKNRRSKGSKGQSSKKKNQKKFDRRDKQQKSGNQSLKGRTFADHQK

SEQ ID NO: 38475 - DNA, 1452 bp, Homo sapiens
  CDS (1)..(1452)
atggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctga

SEQ ID NO: 38476 - protein, 483 aa, Homo sapiens
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 38477 - DNA, 1107 bp, Archaeoglobus fulgidus DSM 4304
  CDS (1)..(1107)
ttgaaagaggtgaataaagtggaatttgaagatttgggaatctcagaaaacggtttgaatgcagttagaagaaagggttttgagaagcctacggaaattcagagggaaatcataccgaggtttttcgaaggtgaaaaggatatggtcggccaggcacagacgggctcggggaaaacagctgcctttgccctgccaattctcgaccttgtggatgaaagaagcaaggatgtgcaggccatagtaataacgcccacaagggagctggctttgcaggtaaaggacgagattgagtcgctcagagggggcaaaaaggttcacgtcctcgctgtttacggcgggcagcccatattccctcaaattgagaggctgaggaagggcgtgcagatagtcgtgggcacaccgggaagagttatcgaccaccttgagaggagaacgctttcgctcgaaaaagttcggttcttcgtgcttgacgaggcggacaggatgctcgacatgggcttcattgacgacattgagaggatcctcagacacgcaggcgcggaaaggcgtgttctgatgttctccgcaaccatgccccctgaagttttgaggctggcgaggcgttacatgagagattacgaggttgtgagagttcacagcaaaatcactcccgaaaacgtcgagcacagatgtctgaaggttaacccggaaaagaggttcgagcatctctgcagaattctcgacgagaacaacttttacggcatcgttttctgccagacgaaaaaagagacaagagaacttggaagaaggcttagagcgaggggatataaggcagatgcgctgaacggagacattccacagcataaaagagagagcatccttagaaatttcagaaaaggatacaccagagttcttgtcgcaacagatgttgccgcaaggggaattgacgtgaaagacctcacccacgtcgtcaactactctatcccgcaggatccagaagcatatatccacagaaccggaagaaccggcagagagggaaagaggggtaaggccataaccttcgttgctccctgggagtcgaggaagctgaaaataatagagaggactgcgaaggtccggtttaggtaa

SEQ ID NO: 38478 - protein, 368 aa, Archaeoglobus fulgidus DSM 4304
MKEVNKVEFEDLGISENGLNAVRRKGFEKPTEIQREIIPRFFEGEKDMVGQAQTGSGKTAAFALPILDLVDERSKDVQAIVITPTRELALQVKDEIESLRGGKKVHVLAVYGGQPIFPQIERLRKGVQIVVGTPGRVIDHLERRTLSLEKVRFFVLDEADRMLDMGFIDDIERILRHAGAERRVLMFSATMPPEVLRLARRYMRDYEVVRVHSKITPENVEHRCLKVNPEKRFEHLCRILDENNFYGIVFCQTKKETRELGRRLRARGYKADALNGDIPQHKRESILRNFRKGYTRVLVATDVAARGIDVKDLTHVVNYSIPQDPEAYIHRTGRTGREGKRGKAITFVAPWESRKLKIIERTAKVRFR

SEQ ID NO: 38479 - DNA, 1131 bp, Thermoplasma volcanium GSS1
  CDS (1)..(1131)
gtgttggaaatgaaagggttcgaagaatttaatttaaggaatgaattgattgaaagtataaggggcacgggttatagtgagccgactgaggttcagtctatggcaataccgattgctcttgcaggctctgacttagttgttaggtcaaagacaggctctggaaagacggctgcttatttgatacctataataaacaacacagcaaaggaaaagggaataagagctcttattcttctaccaacaagggagctggcggttcaagttgcaaaggtttctgaggctttaggcaaaagatctggaataaggactgttgttgtatacggtggagtatcaatcaataaacaaattgaactgatattgcgcggcgctaatataatagtcggtacacctggtagaactcttgatcttatagatagggggatcttaaattttgataaggtctcctattttgttcttgacgaagctgatgaaatgcttgacatgggatttatagaggatattaagaagataataaatgtactcccagttgaaaggcagtcatttcttttctctgcaacgataccatcagaaataatcgaactggcaaagggctttatgcataatgaagaaatattatttttatcaaaggatgaggtaacggtaaatggcatagatcataattacgcagtaagcaggagggaaagaaagctccgtacactattctcctacatcgataaatacaagcctgaaaagtcaataatattctctagaactaaggcaggcgccaacatgatatatgaagcgctgattaatcacgggcaagatgccgtaataatgcacggagacttgactcaagcccagagagaaaaagcgctttacaggttcaaaaactttggcaggtttctcgttgccactaacgttgccgcaagaggcttagatattggtggaatttcagatattataaattatgatgtcccagacgaccctagggtttacgtacatcgcgttggcaggactgctagaatgggtgcagcaggtagagcgtttactatagtcgaagacagggagattggcagtatagacatgattagacatgaagctagggtaaaaatgaaggaaatacatcttgaaacaactagaaaaaatttttag

SEQ ID NO: 38480 - protein, 376 aa, Thermoplasma volcanium GSS1
MLEMKGFEEFNLRNELIESIRGTGYSEPTEVQSMAIPIALAGSDLVVRSKTGSGKTAAYLIPIINNTAKEKGIRALILLPTRELAVQVAKVSEALGKRSGIRTVVVYGGVSINKQIELILRGANIIVGTPGRTLDLIDRGILNFDKVSYFVLDEADEMLDMGFIEDIKKIINVLPVERQSFLFSATIPSEIIELAKGFMHNEEILFLSKDEVTVNGIDHNYAVSRRERKLRTLFSYIDKYKPEKSIIFSRTKAGANMIYEALINHGQDAVIMHGDLTQAQREKALYRFKNFGRFLVATNVAARGLDIGGISDIINYDVPDDPRVYVHRVGRTARMGAAGRAFTIVEDREIGSIDMIRHEARVKMKEIHLETTRKNF

SEQ ID NO: 38481 - DNA, 1506 bp, Arabidopsis thaliana
  CDS (1)..(1506)
atgagtcgctacgatagccggaccggcgattccacctcgtaccgtgaccgtcgaagtgactcagggtttggtgggacttcatcatatggaagctcaggtagtcatacatctagcaaaaaggataacgatggcaatgaatctccaaggaagctagatttagatggtttgactccttttgagaagaatttttatgtcgagtctcccgctgtggcggctatgacagacacagaagtagaggaatatcgaaagctaagggaaattactgttgaaggcaaagatattccaaaacctgtcaagagttttcgtgatgttggctttcctgattatgttttggaagaggttaagaaggctggttttactgaacctacgcctatacaatctcaggggtggccaatggctatgaagggacgtgatcttatcggcattgctgaaactggttctggaaagactctttcttacttactacctgctattgtccatgttaatgcccaaccaatgttagctcatggtgacggcccaatcgtcttggttcttgctcccactcgtgaactggctgtgcagatacagcaagaggcatctaaatttggttcatcctcaaaaattaagaccacttgcatttatggtggggttccaaaagggcctcaagtgcgtgatctccagaaaggtgtggagatcgttatagctactcctgggaggttaatagacatgatggagtcgaacaacacaaacctacgaagggttacttatcttgttttggatgaggctgatcgaatgcttgatatggggtttgaccctcagatccggaaaattgtttcacatattcggccagaccgtcaaactttgtactggagtgccacttggcctaaggaggtggaacaactatcgaagaagtttctttataacccatacaaagtgataataggatcttctgatttgaaagctaaccgtgcaattcgtcaaattgttgatgtcatttccgaaagccaaaagtataacaagttggtgaaactgcttgaggacataatggatggaagcagaattcttgtcttcctcgatacaaaaaagggctgtgaccaaatcactcgtcagcttcgcatggatggttggcctgctttgtcaatacatggagataaaagtcaagcggaaagagattgggttctctcggagtttagatcaggcaaaagccctataatgactgctacagacgttgcagctcgtggattagacgtgaaagatgtgaagtatgtgataaactatgacttccctggatcactggaggattatgttcacaggattggacgaacaggtagagccggggctaaaggaacagcttacactttcttcacagttgcaaatgcgagattcgccaaggaacttaccaacatactacaagaagctggacagaaagtgagtcccgaattggcttcaatgggtcgcagtaccgctcctcctcctccagggcttggaggattcagagaccgtgggagcagaagagggtggagctga

SEQ ID NO: 38482 - protein, 501 aa, Arabidopsis thaliana
MSRYDSRTGDSTSYRDRRSDSGFGGTSSYGSSGSHTSSKKDNDGNESPRKLDLDGLTPFEKNFYVESPAVAAMTDTEVEEYRKLREITVEGKDIPKPVKSFRDVGFPDYVLEEVKKAGFTEPTPIQSQGWPMAMKGRDLIGIAETGSGKTLSYLLPAIVHVNAQPMLAHGDGPIVLVLAPTRELAVQIQQEASKFGSSSKIKTTCIYGGVPKGPQVRDLQKGVEIVIATPGRLIDMMESNNTNLRRVTYLVLDEADRMLDMGFDPQIRKIVSHIRPDRQTLYWSATWPKEVEQLSKKFLYNPYKVIIGSSDLKANRAIRQIVDVISESQKYNKLVKLLEDIMDGSRILVFLDTKKGCDQITRQLRMDGWPALSIHGDKSQAERDWVLSEFRSGKSPIMTATDVAARGLDVKDVKYVINYDFPGSLEDYVHRIGRTGRAGAKGTAYTFFTVANARFAKELTNILQEAGQKVSPELASMGRSTAPPPPGLGGFRDRGSRRGWS

SEQ ID NO: 38483 - DNA, 1833 bp, Arabidopsis thaliana
  CDS (1)..(1833)
atgattagcacagtacttcgccgatctatccttggtacgtcaaggcgtactctcgccgcttcggtgacctccattaacgcagctctatttcataaccttgctccagccgccgccacagtctccgatctagcaaatggagctactaatgtcaagtctctcccttcgaattcgagcccttttggtgttaaagtgagagactttcatgttaaatctgtaccgtcggagtttagatcgtcgattgtttcttctgcgggattcgcggctcaagagtatgctccttcttatgagaacgatggagggattggagattcggagagtgttggtagcagcggtggtggtgatgggcttgcgatagctgatcttggtatatctccggagattgttaaagctttgaagggtaggggtattgagaaactctttcctattcagaaagctgtgttggagccagcgatggagggtcgtgatatgattggccgtgcaaggactggaacgggaaagacacttgcttttgggattcctattattgacaaaatcatcaaattcaacgctaaacatggtcgtgggaagaatcctcagtgcttggttttggcaccgacgagggagcttgctcgtcaggttgagaaagagttcagggaatctgctccaagtttggatactatttgtctctatggaggtacaccaatcgggcaacaaatgagggagctgaactatggtattgatgtggcggttggaactcctggtcgtatcattgatctgatgaaaaggggagctttgaatctatcagaggttcagtttgtggttcttgatgaagctgatcagatgcttcaagttggatttgcggaagatgttgaaataatattgcagaagttgccagcgaagcgtcagagtatgatgttttctgcaacaatgccaagttggatcagatctctcaccaagaagtacctgaacaatcctttgacaattgatcttgttggagattcagatcagaaacttgcagatgggattactatgtattctatcgctgcagattcttatggaagagcatccatcattggtcctcttgtaaaggaacatggcaaaggaggaaaatgcattgtctttacccaaacaaaacgtgatgcagatcgccttgcatttggattggcaaaaagctataaatgtgaagctttacacggtgacatatctcaagctcagagagaaagaacacttgctggtttcagggatgggaatttcagtattcttgttgcaactgatgttgctgcccgtggacttgatgtacctaatgtcgatttagtaattcattatgagcttcctaataacacggagacgtttgttcaccgaacggggcgaactggtcgtgctggaaagaaaggaagcgcgattctcatccacggtcaagatcaaaccagggctgttaaaatgattgagaaagaagtcggaagcagattcaatgagctgcctagcattgctgtggaaagaggaagcgcaagcatgtttgaaggagtaggtgctagatctggtgggtcgttcggaggaggtcgatcaggcggtggtgggtatggtagttacggtagcagcagtggccgttcaggtggtggtagttatggaggttatggtggcagcagtggccgttcaggtggtggtggtggtagttatggaggttcagggggatcaagcagccgttactctggtggttcagaccgctcatctggtttcggaagctttggttcaggcggttcttcaggaggatttggttcagaccgttcttctcagtcaagtggaaggagcagctttggtgggtttggatcaaacgatggtaaaagatcttactga

SEQ ID NO: 38484 - protein, 610 aa, Arabidopsis thaliana
MISTVLRRSILGTSRRTLAASVTSINAALFHNLAPAAATVSDLANGATNVKSLPSNSSPFGVKVRDFHVKSVPSEFRSSIVSSAGFAAQEYAPSYENDGGIGDSESVGSSGGGDGLAIADLGISPEIVKALKGRGIEKLFPIQKAVLEPAMEGRDMIGRARTGTGKTLAFGIPIIDKIIKFNAKHGRGKNPQCLVLAPTRELARQVEKEFRESAPSLDTICLYGGTPIGQQMRELNYGIDVAVGTPGRIIDLMKRGALNLSEVQFVVLDEADQMLQVGFAEDVEIILQKLPAKRQSMMFSATMPSWIRSLTKKYLNNPLTIDLVGDSDQKLADGITMYSIAADSYGRASIIGPLVKEHGKGGKCIVFTQTKRDADRLAFGLAKSYKCEALHGDISQAQRERTLAGFRDGNFSILVATDVAARGLDVPNVDLVIHYELPNNTETFVHRTGRTGRAGKKGSAILIHGQDQTRAVKMIEKEVGSRFNELPSIAVERGSASMFEGVGARSGGSFGGGRSGGGGYGSYGSSSGRSGGGSYGGYGGSSGRSGGGGGSYGGSGGSSSRYSGGSDRSSGFGSFGSGGSSGGFGSDRSSQSSGRSSFGGFGSNDGKRSY

SEQ ID NO: 38485 - DNA, 1851 bp, Arabidopsis thaliana
  CDS (1)..(1851)
atgatcactacagtgctacgacgatctctccttgatgcgtcgaagaggaatctctccgcttcgttgacctcaatcaatactgttctgtttcacaacctggccccagccgccactagagtctccgacctagccttaattggatcttccgatgtcaaagctgggtttccgtttggtgttgaagcgaaaggaattcattttcaatctgggccgttggattttagagcttcgatggtttctcaagctggatttgcgatctctgagagtagcgagagaagggttggtgattcggagagtgttggtggtgatgggcttgcgatatctgagcttgggatatctccggagattgttaaagctttgagtagtaagggtattgagaaactctttcctattcagaaagctgtgctggagccagcgatggagggtcgagatatgattggtcgtgctaggactggaacgggaaagacacttgcttttgggattcctatcattgacaaaatcatcaaatacaacgctaaacatggacgagggaggaatccgctttgtttggttttggcaccgacaagagagcttgctcgccaggttgagaaggagtttagggagtctgctccgagcttggatactatttgtctttatggaggtacaccgattggacagcaaatgaggcagcttgactatggtgttgatgtggcggttggaactccaggtcgtgtcattgatctgatgaagagaggagctttgaatctatcggaagttcagtttgtggttctggatgaagctgatcagatgcttcaagttggatttgctgaggatgttgaaataatattggaaaagttgcctgagaaacgtcagagtatgatgttttctgcaacaatgccgagttggatcagatctctcactaagaagtacctgaataatcctttgacagttgatcttgttggagattctgatcagaaactagcagatggaattacgacatattctatcatagcagattcttatggaagagcatccattattggtcctcttgtaacggagcatgccaaaggaggaaaatgcattgtttttacacaaacaaaacgagatgctgatcgcctttcatatgcattggctagaagcttcaaatgtgaagctttacacggtgatatatcccagagtcagagggaaagaacgcttgctggtttccgagatgggcatttcaatattcttgttgcgactgatgttgctgcccgtggacttgatgtacctaatgtcgatttgatcattcactatgagcttcctaataacacggagacatttgtccatcgaaccgggcgaacgggtcgggctggaaagaaaggaagtgctattctgatctacagtcaagatcaatccagggctgtaaaaataattgagagagaagttgggagccgattcactgagctccctagcattgctgtggaacgtggaagcgcaagcatgtttgaaggaataggttctcgatccggtggttcctttggaggaggcatgagggatcgtggttcaagctttggtggtcgttcaggcggtggtggttatggtggcagcagtggtggttatggtggtgggcgttcaggcggatcaagcaaccgttattctggtgattctgaccgttctggttttgggagcttcggtatgcgttctcctgagggatatggttcggatcgttcatctcagtcaggtggaaggagcagctttggtggtggtcgttcaggcggatcatcaaacaatcgttcctctggtttcggggactttggctctgaccgttcttctcagtcaggcggaaggagcagctttggtgggtttggatcaaatgatgggaaaagatcttactga

SEQ ID NO: 38486 - protein, 616 aa, Arabidopsis thaliana [sequence omitted]

SEQ ID NO: 38487 - DNA, 1497 bp, Arabidopsis thaliana
  CDS (1)..(1497)
atgaatactaacagaggaagatatccaccgggtgttggaacgggtcgtggtgcgcctccgaatccagattatcatcagtcgtatcggcagcaacaaccacctcaagatcagcagtatgttcaacgcggttattctcagaaccctcagcagatgcaactccagcaacaacatcaacaacaacagcagcagcaacagtggtcaagacgccctcagcttcctggaaacgctagtaacgctaatgaggtggttcagcagacgacccagcccgaagctagcagcgatgctaatggtcaagactggaaggctacgttaaggctaccacctcctgatactcgttatcagacagcggatgtgacagctacaaagggaaatgaattcgaagattactttctgaaaagagatctgttaaagggaatatatgagaagggttttgagaagccatctccaattcaagaagagagcattccaattgctttaactggtagtgatattcttgctagagctaaaaacggtacaggaaagactggtgccttctgcattccagtcctcgagaaaattgacccaaataacaatgttattcaagccatgattctagttccaacgcgagagctggcccttcagacatcacaagtttgcaaggagctttccaaatatttgaatatccaggttatggtcaccactggcggtaccagtctgagagatgatattatgcgattacatcaacctgtgcatctgctggttggaactcctggaagaatattggatcttacaaaaaagggtgtctgtgttttgaaagactgtgcgatgcttgtaatggatgaggccgacaagcttttgtctgcagaattccaaccttctctagaggaattgatacagtttctaccccaaaatcgtcagtttttgatgttttccgccacattccctgtcactgttaaggcttttaaggatcgacatctccggaagccctatgttatcaatctcatggatcaactcacgcttatgggtgtcacgcaatattatgcttttgtcgaagaaagacagaaggttcactgcctcaacacacttttctctaagctgcaaataaatcaatcgataatcttttgcaactctgtcaatcgcgtggagctgttggctaagaaaatcacagaacttggttattcatgcttctacattcatgcaaagatggttcaagaccacaggaacagagtattccacgagttccgcaatggtgcttgcaggaatctcgtttgcactgatctgtttactcgaggaattgacattcaagctgtgaatgtcgtgatcaactttgattttcctaggacttctgagtcatatctacacagggtgggtcgatcaggacggtttggacaccttggattggctgtgaatttggtaacttatgaggaccgtttcaaaatgtatcagactgagcaagaacttgggaccgaaatcaaaccaattccttctaatatcgatcaagcaatctactgtcagtaa

SEQ ID NO: 38488 - protein, 498 aa, Arabidopsis thaliana
MNTNRGRYPPGVGTGRGAPPNPDYHQSYRQQQPPQDQQYVQRGYSQNPQQMQLQQQHQQQQQQQQWSRRPQLPGNASNANEVVQQTTQPEASSDANGQDWKATLRLPPPDTRYQTADVTATKGNEFEDYFLKRDLLKGIYEKGFEKPSPIQEESIPIALTGSDILARAKNGTGKTGAFCIPVLEKIDPNNNVIQAMILVPTRELALQTSQVCKELSKYLNIQVMVTTGGTSLRDDIMRLHQPVHLLVGTPGRILDLTKKGVCVLKDCAMLVMDEADKLLSAEFQPSLEELIQFLPQNRQFLMFSATFPVTVKAFKDRHLRKPYVINLMDQLTLMGVTQYYAFVEERQKVHCLNTLFSKLQINQSIIFCNSVNRVELLAKKITELGYSCFYIHAKMVQDHRNRVFHEFRNGACRNLVCTDLFTRGIDIQAVNVVINFDFPRTSESYLHRVGRSGRFGHLGLAVNLVTYEDRFKMYQTEQELGTEIKPIPSNIDQAIYCQ

SEQ ID NO: 38489 - DNA, 2370 bp, Arabidopsis thaliana
  CDS (1)..(2370)
atgccgtcgagtttcttctttgaggatgctagtgacgacgagctcgaattaatacgcaatcaagaggacagtagtgaggaagacgtaaaggaaggcgaagcagaagagcatgaagctggagaagacgaagatggagaagaggaatatgaagaagaagatgacgacgaagaagaagaagatgagaagcggaaacgagatgctgatgctcaatctccttgggattttgcatcttactcaagctccgttggtgaagaacacgcccgccgtcacacaacgtctattgatgaaaagatctctaaagctattcagcatcgtccagttcccatttcaataaatgaagaagaagaagaggaagaagaagaagaagatgcctccgatgctgaaactgacaaacaagaggagtatctttcggaagacgatgaggcagctgagtacaaaccagaagatgctactcccaagccgttcttctctacagtggatggagtttcatttcatgctgatactttcatggagcttaatctctctcgtccattgcttcgagcttgtgaaactctcggatacaagaaacctactccgattcaggcagcttgtatacctttagcacttacagggcgtgatctttgtgccagtgccatcactgggtcagggaagactgctgcattcgctttacctactcttgagaggttgctgttccgtcccaagcgggtctttgctactagagttcttattctcactccgactagggagttggccgtccagattcacagtatgattcagaatcttgcacagtttactgatatcaagtgtggattgattgtaggagggctttctgtaagggagcaagaggtggttctgaggtctatgccagatattgttgtggcgactcctggacgtatgatagatcatttgcgtaattctatgtctgttgatttggatgatctagcggttttaatccttgatgaggcagaccgccttctacagactgggtttgccactgaaatcacagagctggttcgcttatgtcccaagagaaggcaaacaatgctcttctcagccacaatgactgaagaagttaaagagctagtcaaactttccttgaacaaaccgttgcggctctcagctgatccatcagctagaaggccaccaggcttgactgaggaggtggtaagaatacgcaggactcgtgaggcaaatcaggaagctgttcttctatcattgtgcacaaggacttttaaatcaaaagtcattatctttagtggaacaaaacaagctgcacatagactgaaaattttattcggattagctggcctcaaagcagctgagcttcatggaaacctaactcaagcacaacgtcttgattctctggagcttttcagaaagcaggaggtcgattttctcattgctaccgatgtagccgctcgaggacttgacatcattggtgttcaaacagttataaattatgcttgtcctcgggaaatagacagttatgttcacagagttggtagaacagctagggctggaagggaaggttatgctgtaacgtttgtgactgatagtgaccgatcccttttgaaagtcattgcaaagaaggtgggttcaaagttgaagagccgagtcatcccagagcagtcaatcgtcaagtggtctcagataatcgatgaaatggaagatcaatattccgctgttatttcagcagagagggatgagcgagctctaaggaaagctgaaatggaatttgcaaaggcggagaacatgcttgagcacagagatgaaatatatgcacgcccaaaaaggacttggttcatgacagagaaggagaagaagctcgtggcacaggctgaaaaggattctgcagggaaccctgctggaggcgaactagttagtgctgatagagcagaggacctcaagatgaaggagaagagaaaacgtgaacgcgagaagaatcttcctaggaaaaaacgtagaaagctagaagctgccagagagatgctagaagataacgaaggagaagaagaggaagaagacgaagaaggagacgaaaagagaggaagatcaagagggaaagacaagaaaaaacaggagacagataagaagggattgacactaaaggatcttggttacatgagagcaaaagcggtgaaagcaaaacagagagcaattgattccggtaagatggagagaccaaagccggacaagaaacaaagccggagtaaaccaagaaaccagcctcgtggtgaagagatgaaagatctgttcaagagtgatatgggcgagaagaaacagggcagaggcggtgccgcggctgcagcaaaacctcggacgaagtcgaagaactcattcaagagcaaagccagatataagcgtaggtaa

SEQ ID NO: 38490 - protein, 789 aa, Arabidopsis thaliana
MPSSFFFEDASDDELELIRNQEDSSEEDVKEGEAEEHEAGEDEDGEEEYEEEDDDEEEEDEKRKRDADAQSPWDFASYSSSVGEEHARRHTTSIDEKISKAIQHRPVPISINEEEEEEEEEEDASDAETDKQEEYLSEDDEAAEYKPEDATPKPFFSTVDGVSFHADTFMELNLSRPLLRACETLGYKKPTPIQAACIPLALTGRDLCASAITGSGKTAAFALPTLERLLFRPKRVFATRVLILTPTRELAVQIHSMIQNLAQFTDIKCGLIVGGLSVREQEVVLRSMPDIVVATPGRMIDHLRNSMSVDLDDLAVLILDEADRLLQTGFATEITELVRLCPKRRQTMLFSATMTEEVKELVKLSLNKPLRLSADPSARRPPGLTEEVVRIRRTREANQEAVLLSLCTRTFKSKVIIFSGTKQAAHRLKILFGLAGLKAAELHGNLTQAQRLDSLELFRKQEVDFLIATDVAARGLDIIGVQTVINYACPREIDSYVHRVGRTARAGREGYAVTFVTDSDRSLLKVIAKKVGSKLKSRVIPEQSIVKWSQIIDEMEDQYSAVISAERDERALRKAEMEFAKAENMLEHRDEIYARPKRTWFMTEKEKKLVAQAEKDSAGNPAGGELVSADRAEDLKMKEKRKREREKNLPRKKRRKLEAAREMLEDNEGEEEEEDEEGDEKRGRSRGKDKKKQETDKKGLTLKDLGYMRAKAVKAKQRAIDSGKMERPKPDKKQSRSKPRNQPRGEEMKDLFKSDMGEKKQGRGGAAAAAKPRTKSKNSFKSKARYKRR

SEQ ID NO: 38491 - DNA, 2142 bp, Arabidopsis thaliana
  CDS (1)..(2142)
atggctgctactgcttctgcaattcgttacgctcctgaggatccgaatctccctaagccatggaaaggtcttgtggatagtagaactgggtacctctacttttggaatccagaaaccaatgttactcagtacgagagaccggcttcttccgctcctcccaagcttgctgctattcccgtaagctcttcggttcagactaatcagcaatcttcttctggatttaactctggcaaggaagatgataagtatggtaggggcagtgatgggcctaagtctgactctggatcaaggtttaatgaggctggaagaactggacctatatcttctaatgatgctgctagtggactagggaatgcttcatctggtggctcatctgccagagggcctccttcttcagccgcaggaaatgaattgtccccagaggcctattgccgcaaacatgaaattactgtcagtggaggccaagtaccaccacctctaatgtcttttgaagccactggtcttcccaatgagcttctgcgggagtgtcccaattttatgccatatgcgctctcttttgtcccaggtgcgatatttgctcttggaggagctaatgtcgtacgctgtgccacttctttggggttcttgcaaattatttggagtgccctttttggtggaccaaattttttgaggtgtcctcctgctgcaggtttcaacagctatcttgtgttgcctgcaaacgggaggatggtatacagtgcaggattctcagctccatctccaattcaagctcagtcatggccaattgcgatgcaaaacagagacatagtagccattgctaaaacaggctcgggaaaaactttgggttacttgattcctggtttcatgcatctccaacggatccacaatgattcacgaatgggcccaacgatcttggtcttgtcccctactagggagttggccacacaaatccaagttgaagctctgaaatttggcaagtcatctaaaatttcgtgtgcgtgtttgtatggtggagcacccaagggtcctcagctgaaggaaatagaaagaggtgtagatattgttgttgcaactcccgggcgactgaatgatatccttgaaatgaagagaatcagtctgcatcaagtatcttaccttgtgctggacgaggcagatagaatgctggacatggggttcgaacctcagatcagaaaaattgtgaatgaggttcccactaagcgtcaaaccctcatgtacactgcaacatggccaaaggaggtgaggaaaatcgcagctgatcttcttgttaaccctgcccaggtcaatattggtaatgttgatgagcttgtggcgaacaagtccattactcagactattgaagtcttagcaccgatggagaaacatagtaggttagagcagatattgcgctctcaggaaccgggttccaagattataattttctgttcaaccaaaaggatgtgtgatcaactggcaaggaacctgacccgtacgtttggagctgctgctatacatggagacaagtcgcaggctgagagagacgacgtactgaatcaatttagaagtggtaggactcctgttcttgttgcaactgatgtagctgctcgtggacttgacgttaaggacataagggtggtggtcaactatgattttccaaatggagtagaggattatgtccatagaattggaagaactggaagagctggagcaaccggtctagcttacaccttctttggagaccaagatgcaaaacatgcttcagatctgatcaagatcttggaaggagcaaaccagaaagttcctccacaggtccgcgaaatggctacacgtggtggtggtggaatgaacaaatttcgtcgctggggtacaccttccagtggtggtggtggcggccgtggtggctatggtgattctggttatggtggtcgtggtgagtctggctatggtagtcgtggtgattctggttatggtggtcgtggtgattctggtggtagaggaagctgggctccttcacgtgacagcagtggcagctcaggatggggaagagagagaagccgtagtcctgagagattcagaggaggtccaccgtccacttcatctccgcctcgcagctttcatgaggcgatgatgatgaaaaatagataa

SEQ ID NO: 38492 - protein, 713 aa, Arabidopsis thaliana
MAATASAIRYAPEDPNLPKPWKGLVDSRTGYLYFWNPETNVTQYERPASSAPPKLAAIPVSSSVQTNQQSSSGFNSGKEDDKYGRGSDGPKSDSGSRFNEAGRTGPISSNDAASGLGNASSGGSSARGPPSSAAGNELSPEAYCRKHEITVSGGQVPPPLMSFEATGLPNELLRECPNFMPYALSFVPGAIFALGGANVVRCATSLGFLQIIWSALFGGPNFLRCPPAAGFNSYLVLPANGRMVYSAGFSAPSPIQAQSWPIAMQNRDIVAIAKTGSGKTLGYLIPGFMHLQRIHNDSRMGPTILVLSPTRELATQIQVEALKFGKSSKISCACLYGGAPKGPQLKEIERGVDIVVATPGRLNDILEMKRISLHQVSYLVLDEADRMLDMGFEPQIRKIVNEVPTKRQTLMYTATWPKEVRKIAADLLVNPAQVNIGNVDELVANKSITQTIEVLAPMEKHSRLEQILRSQEPGSKIIIFCSTKRMCDQLARNLTRTFGAAAIHGDKSQAERDDVLNQFRSGRTPVLVATDVAARGLDVKDIRVVVNYDFPNGVEDYVHRIGRTGRAGATGLAYTFFGDQDAKHASDLIKILEGANQKVPPQVREMATRGGGGMNKFRRWGTPSSGGGGGRGGYGDSGYGGRGESGYGSRGDSGYGGRGDSGGRGSWAPSRDSSGSSGWGRERSRSPERFRGGPPSTSSPPRSFHEAMMMKNR

SEQ ID NO: 38493 - DNA, 1479 bp, Helicobacter pylori 26695
  CDS (1)..(1479)
atggaattgaatcaaccaccactccctacagaaattgatggtgacgcttatcataagccgagttttaatgatttgggcttaaaagaatcggttttaaaatccgtttatgaagccggcttcacttccccaagccccattcaagaaaaggccattccggctgttttgcaaggccgagatgtcatcgcacaagcccaaacaggcacaggaaaaaccgccgctttcgctctgcccattatcaacaaccttaaaaacaaccacaccatagaagccctagtgatcacgcccaccagagaattagccatgcaaattagcgatgagattttcaaattgggcaaacacaccaggactaaaaccgtgtgcgtgtatggaggccagagcgttaaaaagcaatgcgaattcattaagaaaaatccccaagtgatgatcgctacaccaggaaggctgctcgatcacttaaaaaacgaacgcatccataaatttgtgcctaaagtggtcgttttagatgaaagcgatgaaatgctggatatggggtttttagacgatattgaagagatttttgactacctccctagcgaagcgcagattttgcttttttcagccacgatgccagagccgattaaaagactagcggataagattttagaaaaccctattaaaatccatatcgctccttctaatatcactaacaccgacatcacccaacgcttttatgtgatcaatgagcatgagagggccgaagcgatcatgcgccttttagacacccaagcacccaaaaagagcattgttttcacgcgcactaaaaaagaagccgatgaattgcaccaattccttgcttctaaaaattacaaaagcaccgccttgcatggggatatggatcaaagggatcggcgctcttctatcatggcgtttaaaaaaaatgacgctgatgtgttggtggctacagatgtggcgagtcgtgggctagatattagcggtgtaagccatgtgtttaattaccacttgcccctaaacactgagagctatatccatcgcatcgggagaaccgggcgagcgggcaaaaaaggcatggcgatcactttagtaacccctttagaatacaaagagcttttacgcatgcaaaaagaaattgattcagagattgaactttttgaaatccccaccattaacgaaaatcagatcatcaaaaccttgcatgacgctaaagtgtctgaagggatcatcagcctttatgaacagcttaccgaaatttttgagccgtctcaattggttttaaaacttttgagtttgcagtttgaaaccagcaaaattggcttaaaccagcaagaaattgacgcgattcaaaaccctaaagaaaaaacgccaaaaccctctaacaaaaaaacgccccaacatgagcgagcgcgttctttcaaaaagggtcagcacagagacagacaccctaaaacaaaccattattctaaaaaacccaaacgccgttaa

SEQ ID NO: 38494 - protein, 492 aa, Helicobacter pylori 26695
MELNQPPLPTEIDGDAYHKPSFNDLGLKESVLKSVYEAGFTSPSPIQEKAIPAVLQGRDVIAQAQTGTGKTAAFALPIINNLKNNHTIEALVITPTRELAMQISDEIFKLGKHTRTKTVCVYGGQSVKKQCEFIKKNPQVMIATPGRLLDHLKNERIHKFVPKVVVLDESDEMLDMGFLDDIEEIFDYLPSEAQILLFSATMPEPIKRLADKILENPIKIHIAPSNITNTDITQRFYVINEHERAEAIMRLLDTQAPKKSIVFTRTKKEADELHQFLASKNYKSTALHGDMDQRDRRSSIMAFKKNDADVLVATDVASRGLDISGVSHVFNYHLPLNTESYIHRIGRTGRAGKKGMAITLVTPLEYKELLRMQKEIDSEIELFEIPTINENQIIKTLHDAKVSEGIISLYEQLTEIFEPSQLVLKLLSLQFETSKIGLNQQEIDAIQNPKEKTPKPSNKKTPQHERARSFKKGQHRDRHPKTNHYSKKPKRR

SEQ ID NO: 38495 - DNA, 1950 bp, Treponema pallidum subsp. pallidum str. Nichols
  CDS (1)..(1950)
gtgcaaggggcgtggttgggagcccatagagaaagagctcccagagcgctggaacgctacggtgtccagcgctctttgtgtgtttttgtctctacaagaaagttccactttttgctacacttcccttctatggacgtgtcctttgaagagcttggtttgaatgaacaatcgcttgcagcggtgcgactcaaggggtttcggtgcccaactcccatccaggctgctgccattccccgactgttggcaggggatgcgaatatcatcgcaaaagcccgaaccgggactggaaaaacggccgccttcggcctcccccttatccaagaactgggaagcccgtgcgaacacccaggggccttagtgcttgttcctacaagggagctcgctgcgcaggtcgcaagcgaactgagctccctgaggatacaaaaaatacctcggattcacaccgtgtacggtggggtctccatcgcggagcagctgcgtaatctcgaacagggtggagagataatagtaggaacgaccgggcgcgtcatcgatcatattgagcgcggttctctcgagctgtcttatctgcgctacttcatattagacgaagcggatgagatgctaaacatgggtttcgttgaggatatagagtctatcttctctcatgcaaataaagacgcacgcgtccttatgttttctgccactatgcccaggcagatcctttctattgcctctaccttcatgggaagctacgaggttgttgaagaagtcactccagaagaggcgcgcccgctcattgaacaatttatgtgggttgtaagggacgctgacaaaatcgaggcgcttgtgcgccttattgatgtgagcgacaacttttacggtctggtgttctgtcaaaccaaggcggacgccgacactgttgcgaaatctctagacgaacgccattaccatgttgctgcacttcacggagatattccgcaaagccagcgagaaaaaattctcgagcgctttcgtacaaaacgagcgcgtatcctcgtcgccactgatgttgccgctcgcggcattgacatcgaaggaattacgcacgtggtgaactactccattcctcatgatagcgctacttacacgcaccgcgtcggcagaactggacgcgcaggatcacagggtatcgctatcagttttgtacgcccacacgagacacgacggatggagtatctgagtaaacactgtaatggcgaattgaaagctagtacggtacctttggtggagcacatccttactcaaaaggaggggcgtattttctcgtccctcaagactcatctttgccaattactctctgaaggggtgcacggaacctttacccgttttgcgcagcggctgctccaagaagaccttaaagctcgcgtggcagaagccctgggtacttccgccgacgttcctcaggaaccgaacgtgtcgcttgtcgccgcgctcctgcaaatccactacggtactgcgctggaccccaggcagtaccgggatattaaaacgattacgccagagacggcccgcgcacgtccccatgacgcggaaaaggcgtatgtgcgcattgagtacggaaaaaaaagctacctcactcggaaacgtgttgtgcagttcatctgtgccctggtaaaaatccccggtcatcttgtagatcgcgttgacataaccgaacgttgcgcgtttgcgcgcataccccgacgcgcagcggaggaagcagttcgcttatccaagaagcgcaaggacctgccgcgcgtttccttcgttgggcacgccagtcgcctaagaaataccgctacccctgcagaaaagtctacctatccaaggcgcctcccttccggagaaggcctaagggagcagatctcaaggagaacctcttcctctaagaaggcttctgggaaaccggaggattctcttccccctccccaagaacatcgccttgattga

SEQ ID NO: 38496 - protein, 649 aa, Treponema pallidum subsp. pallidum str. Nichols
MQGAWLGAHRERAPRALERYGVQRSLCVFVSTRKFHFLLHFPSMDVSFEELGLNEQSLAAVRLKGFRCPTPIQAAAIPRLLAGDANIIAKARTGTGKTAAFGLPLIQELGSPCEHPGALVLVPTRELAAQVASELSSLRIQKIPRIHTVYGGVSIAEQLRNLEQGGEIIVGTTGRVIDHIERGSLELSYLRYFILDEADEMLNMGFVEDIESIFSHANKDARVLMFSATMPRQILSIASTFMGSYEVVEEVTPEEARPLIEQFMWVVRDADKIEALVRLIDVSDNFYGLVFCQTKADADTVAKSLDERHYHVAALHGDIPQSQREKILERFRTKRARILVATDVAARGIDIEGITHVVNYSIPHDSATYTHRVGRTGRAGSQGIAISFVRPHETRRMEYLSKHCNGELKASTVPLVEHILTQKEGRIFSSLKTHLCQLLSEGVHGTFTRFAQRLLQEDLKARVAEALGTSADVPQEPNVSLVAALLQIHYGTALDPRQYRDIKTITPETARARPHDAEKAYVRIEYGKKSYLTRKRVVQFICALVKIPGHLVDRVDITERCAFARIPRRAAEEAVRLSKKRKDLPRVSFVGHASRLRNTATPAEKSTYPRRLPSGEGLREQISRRTSSSKKASGKPEDSLPPPQEHRLD

SEQ ID NO: 38497 - DNA, 1476 bp, Helicobacter pylori J99
  CDS (1)..(1476)
atggaattgaatcaaccaccactccctacagaaattgatgatgacgcttatcataagccgagttttaatgatttgggcttaaaagaatcggttttaaaatccgtctatgaagccggtttcacttccccaagccccattcaagaaaaggccattccggctgttttgcaaggtcgagatgtcatcgcgcaagcccaaacaggcacaggaaaaaccgccgctttcgctctgcccattatcaataaccttaaaaacaaccacaccataaaggccttagtgatcacgcccactagagaattagccatgcaaattagcgatgagatttttaaattgggcaaacacaccaggactaaaaccgtgtgcgtgtatggaggccagagcgttaaaaaacaatgcgaatttattaagaaaaacccccaagtgatgatcgccacgccaggaaggctgttggatcatttaaagaacgagcgcatccataaatttgtgcctaaagtggtcgtgttagatgaaagcgatgaaatgctggatatggggtttttagacgatattgaagagatttttgactacctccctagcgaagcgcagattttgcttttttcagccacgatgccagagccgattaaaagattagcggataagattttagaaaaccctattaaaatccatatcgccccttctaatatcactaacactgacatcacccaacgcttttatgtgatcaatgagcatgagagggctgaagcgatcatgcgccttttagacacccaagcgcctgaaaagagcattgttttcacgcgcaccaaaaaagaggccgatgaattgcaccaattccttgcttctaaaaattacaaaagtaccgccttgcatggggatatggatcaaagggatcgccgctcttctatcatggcgtttaaaaaaaatgacgctgacgtgttggtggctacagatgtggcgagccgagggcttgatattagcggtgtaagccatgtgtttagttaccacttgcccctaaacactgagagctatatccatcgcattgggagaaccgggcgagcgggcaaaaaaggcatggcgatcactttagtaacccctttagaatacaaagagcttttacgcatgcaaaaagaaattgattcagagattgagctttttgaaatccccaccattaatgaaaatcagatcatcaaaaccctacatgacgctaaagtgtctgaagggatcatcagcctttatgaacagcttaccgaaatttttgagccgtctcaattggttttaaaacttttgagtttgcagtttgaaaccagtaaaattggcttgaatcagcaagaaattgatgcgattcaaaaccctaaagaaaaaacgccaaaacccccaaacaaaaaaacgcagcacgagccagcgcactcttttaaaaagagccaccacagagacagacaccctaaaacgaatcgttattctaaaaaacacaaacgccgttaa

SEQ ID NO: 38498 - protein, 491 aa, Helicobacter pylori J99
MELNQPPLPTEIDDDAYHKPSFNDLGLKESVLKSVYEAGFTSPSPIQEKAIPAVLQGRDVIAQAQTGTGKTAAFALPIINNLKNNHTIKALVITPTRELAMQISDEIFKLGKHTRTKTVCVYGGQSVKKQCEFIKKNPQVMIATPGRLLDHLKNERIHKFVPKVVVLDESDEMLDMGFLDDIEEIFDYLPSEAQILLFSATMPEPIKRLADKILENPIKIHIAPSNITNTDITQRFYVINEHERAEAIMRLLDTQAPEKSIVFTRTKKEADELHQFLASKNYKSTALHGDMDQRDRRSSIMAFKKNDADVLVATDVASRGLDISGVSHVFSYHLPLNTESYIHRIGRTGRAGKKGMAITLVTPLEYKELLRMQKEIDSEIELFEIPTINENQIIKTLHDAKVSEGIISLYEQLTEIFEPSQLVLKLLSLQFETSKIGLNQQEIDAIQNPKEKTPKPPNKKTQHEPAHSFKKSHHRDRHPKTNRYSKKHKRR

SEQ ID NO: 38499 - DNA, 1833 bp, Pasteurella multocida subsp. multocida str. Pm70
  CDS (1)..(1833)
atgactgaaacaacaatgactttcaatgatttaggcttgcctgaatttcttcttaacgccgtctctgacttaggctttgaaaccccttctccaattcaacaaagttgtatcccaaacctgttaaatgggcatgatgtgctaggtatggcacaaactggaagtggtaaaaccgccgccttttcactccctttattagcacaaattgatttagataaaaaatatccacaaatgttagtgatggcaccgacacgtgagttagccatccaagtagcagatgcctgtgagcacttttgcaaatatgcgaaaaataccaatattgttaccctttatggtggtcaacgctatgacattcaattgcgtgctttacgccaaggtgctcaggttgtagtggggacacctggtcgtattttagatcacattcgtcgtggcactttagatttgtctaatttacgttttatggtgttagatgaagcggacgaaatgttacgtatgggctttattgatgatgttgaaacggtgatggcagaattaccagaacaacatcagactgcacttttctcagccaccatgccagatccaattcgtcgtattactaagcgttttatgaaagatccgaaagagattaaaattaaatcgacgcaaacgacgaatccagatattacacagagttgttggtatgtgcatggtttccgtaaaaatgatgccttattacgtttcttagaagtagaaaaatttgatgccgcgattatctttactcgtactaaaacggggacattagatgtaacggaattgttggaaaaacatggtttccgtgccgcagcattaaatggcgatatgacacaacaattacgtgaacaaacgcttgatcgtttaagaaatggtagtttagatatccttgtggcaaccgatgtggcggcgcgtggtttagatgtggagcgcattagcctcgtagtgaactatgatattccattagatgctgagtcttatgttcaccgtattggtcgtacagggcgtgcaggacgtacagggcgtgcattgttatttgttgaaccaagagaacgtcgtttattacgtaatattgaacaattaactaaaaaaccgattacggaagtcgaagtgccaaatcatgaggtactacaagcttgtcgccgtgagaaatttaaagccaaaattacagtccaattagagcatcatgatttaggactttatcgtagcttactagaagatatgttcaccgcggatcaagatcaggaagatattgcggcggcgatgttgatgttgttgcaaggtaaacaaaagcttattttaccagccgatccaattattgatcgtaaaacttcacgtggtgatcgtggcgagcgtcgtgaacgtggtggacgtgaaaatccacgttcagcagagcgtcgtggttacggtacaccgcaggcgatggatttatatcgtattgaagtaggacgtttagatggcgcggaagtccgtcatattgttggggcgattgccaatgaaggtgatatcaatagtcgttatattggtcatattaaattatatgatgattacaccacgattgaattaccacaaggtatgccgaaagaattattaggtgtatttgcgaaaacacgcgtgatgaacaaacaaatgcagatgtcatttgtgggagcgtctaatgcaggttcaagccgtgatcgcgatgatttcgctgaccgccgtggtggaaaacgtaaaggacgcggcgatgaaccacgttttgggcgtgaagatcgtaaatttaaagaaaaaagtcagcgcacttttaatgatcgcccacgcagagaaagacgtgaacgccaaaagtaa

SEQ ID NO: 38500 - protein, 610 aa, Pasteurella multocida subsp. multocida str. Pm70
MTETTMTFNDLGLPEFLLNAVSDLGFETPSPIQQSCIPNLLNGHDVLGMAQTGSGKTAAFSLPLLAQIDLDKKYPQMLVMAPTRELAIQVADACEHFCKYAKNTNIVTLYGGQRYDIQLRALRQGAQVVVGTPGRILDHIRRGTLDLSNLRFMVLDEADEMLRMGFIDDVETVMAELPEQHQTALFSATMPDPIRRITKRFMKDPKEIKIKSTQTTNPDITQSCWYVHGFRKNDALLRFLEVEKFDAAIIFTRTKTGTLDVTELLEKHGFRAAALNGDMTQQLREQTLDRLRNGSLDILVATDVAARGLDVERISLVVNYDIPLDAESYVHRIGRTGRAGRTGRALLFVEPRERRLLRNIEQLTKKPITEVEVPNHEVLQACRREKFKAKITVQLEHHDLGLYRSLLEDMFTADQDQEDIAAAMLMLLQGKQKLILPADPIIDRKTSRGDRGERRERGGRENPRSAERRGYGTPQAMDLYRIEVGRLDGAEVRHIVGAIANEGDINSRYIGHIKLYDDYTTIELPQGMPKELLGVFAKTRVMNKQMQMSFVGASNAGSSRDRDDFADRRGGKRKGRGDEPRFGREDRKFKEKSQRTFNDRPRRERRERQK

SEQ ID NO: 38501 - DNA, 1389 bp, Neisseria meningitidis MC58
  CDS (1)..(1389)
atgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaa

SEQ ID NO: 38502 - protein, 462 aa, Neisseria meningitidis MC58
MSIKFADLNLDKNILSAVSSEGYESPTPIQAQAIPFALEGRDIMASAQTGSGKTAAFLLPTLQKLTKRSEKPGKGPRALVLTPTRELAAQVEKNALAYAKNMRWFRTVSIVGGASFGYQTRALSKPVDLIVATPGRLMDLMQSGKVDFERLEVLILDEADRMLDMGFIDDIETIVEATPSDRQTLLFSATWDGAVGKLARKLTKDPEIIEVERVDDQGKIEEQLLYCDDMRHKNRLLDHILRDANIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGWRGDHKPSKEGFGGKTRGEGFKKEGFKRDGFKKTGEGFKGKRKAGDSFAGKGERRYKDR

SEQ ID NO: 38503 - DNA, 1278 bp, Methanothermobacter thermautotrophicus str. Delta H
  CDS (1)..(1278)
atgaaaggattagaatttagtgagtttgatatctcaggggatataaacagggcccttgatgatatgggatttgagagcacaactccaatccaggcacttacactacctgttacacttgacggtatggacgttgttggtgaggcccagacagggaccggaaaaacagctgcattcgccatacccgtacttgagaaccttgaagccgagagggtgccccaggccctcataatctgtccgacacgcgagctctgtctccaggtctcagaggagatcaagaggataggtaaatacatgaaggtgaaggtcctcgcggtctatggtggtcagagtatcggtaaccagatagcacagctaaggaggggggttcatgtcatcgttgcaacccctggtagactgatagaccacatcgagagggggaccgttgatctgggaggtatatccaccgttgtccttgatgaggcagatgaaatgctgaacatgggattcattgatgacatagagcgtatactatcccatgtacctgagagaaggcagaccatgctcttctctgcaacggtttcaaagcccatactcaggattgcaaggaagtacatgaggaacccccaggttatgcgtgtggagaagaagcacagccccaagatagatgagttctacttcaaaaccagggaggaggataaggttgagctcctcgactggatactctcatcaaacaatatcaggatgggactcatattctgtaacaccaagagaagggtccagaggttgagaaggcagctgaaccgtatgggttactctgcagatgagatccacggtgatctttcacagtcaaagcgtgagcgtgtcatggagagattcagaaggggagatttcagtctccttgttgcaacggatgttgctgcccgtggtattcacgtacccgatgtcgaggccgttgtgaactatgacctgccctttgagaacgagtactacgttcaccgtataggccgtacagggcgagccggttcaagcgggaagtccttcaccctcgtcgttggaagtgaggttcaccgcctgagaaggatccagtcattcacaggtaagaggataaagcagagcaacatgccctcccctgaggagataaggaggggatatgagatggacctcagggagatcctcaggaggaacctggaatcaaagacttacagtgactctgaaatccttgagagccttgctggtgagggttacagtttcagggacatctcacacgcccttctggatgtactggaatcatccaaataa

SEQ ID NO: 38504 - protein, 425 aa, Methanothermobacter thermautotrophicus str. Delta H
MKGLEFSEFDISGDINRALDDMGFESTTPIQALTLPVTLDGMDVVGEAQTGTGKTAAFAIPVLENLEAERVPQALIICPTRELCLQVSEEIKRIGKYMKVKVLAVYGGQSIGNQIAQLRRGVHVIVATPGRLIDHIERGTVDLGGISTVVLDEADEMLNMGFIDDIERILSHVPERRQTMLFSATVSKPILRIARKYMRNPQVMRVEKKHSPKIDEFYFKTREEDKVELLDWILSSNNIRMGLIFCNTKRRVQRLRRQLNRMGYSADEIHGDLSQSKRERVMERFRRGDFSLLVATDVAARGIHVPDVEAVVNYDLPFENEYYVHRIGRTGRAGSSGKSFTLVVGSEVHRLRRIQSFTGKRIKQSNMPSPEEIRRGYEMDLREILRRNLESKTYSDSEILESLAGEGYSFRDISHALLDVLESSK

SEQ ID NO: 38505 - DNA, 1446 bp, Clostridium acetobutylicum ATCC 824
  CDS (1)..(1446)
atgagtgaattaagttttagagatttaggattaagtgaagaaattttaaagtcaatagaaaagcttgggtataaaaaaccatcaagtattcaagaaaaggttattcctgtaattcttaatggtaaggatataattgcaaaggccaaaacaggaagtggaaagacagcggcttttgcaattcctgtttgtgaaaaaatagaactcgaagaaagagagcctcaggttctggttttagctccaacaagagaactagcctatcaaataaaagaggactttttaaatataggaagatttaaaagattaaggtgcataagtattttcggaaaagagccaatttcaaatcaaattagagagcttaagcaaagagtacatattgtagttggtacacctggaagagttctagatcatattgaaagaggaaccttgaatctagaaaaagtgaaatactttattatagatgaagcagatgaaatgctcaatatgggctttatagagcaggttgaaagcatacttataaaaatgcctaaaaataaaaatacttttcttttctcagcaacactgccggaggaaatagtaatgctttctaaaaagtatatgaagaactttgagaacatagaggttcaaaatgaaggaaagaccaaaggaggaattcatcaggtttactacgaggttgaaagtcgtgaaaagtttgatttgctaaagaaagtaatatataaagaggtacctggaagctctataatattttgcaggactaaaaacaacgtagaggatgttttggttaagatgaaaaatatgaagttttcctgtatggcaatacatggaggaatgcttcaagagaatagaatagcagttatgaatgcttttaaaagaggagaatttacatttttaatagcaacagatgtggcggctagaggcatcgatgttgaaaatgtgacacatgttataaattatgatatacctatggagaaggaaagctacattcatagaattggaagaacgggacgtatgggaaataagggtatcgcaataacctttgtgacatcaaaggaagaaagatttcttaaggaaattgaagaacagttctctttagaaataataaaagaagagcctccaacaagggaagaggttaaaaaagggcaagaagtatttaaaaccgcttctaaacagttaaataaaacaaaggcaaataaatctgaaaaactaaataaggatattacaaaaatttatttaagtgcaggaaagaaaaagaagataagaccaggagatatagcaggaactatatcaagtatagatggggtaagcccagaagatataggaattattgatatacatgataacttttcatatgttgaaatattatcaggaaaaggtgatatagtacttaatgcaattgaggataagacaataaagggaaaaaaagtaagagcggagaaagcacagaaataa

SEQ ID NO: 38506 - protein, 481 aa, Clostridium acetobutylicum ATCC 824
MSELSFRDLGLSEEILKSIEKLGYKKPSSIQEKVIPVILNGKDIIAKAKTGSGKTAAFAIPVCEKIELEEREPQVLVLAPTRELAYQIKEDFLNIGRFKRLRCISIFGKEPISNQIRELKQRVHIVVGTPGRVLDHIERGTLNLEKVKYFIIDEADEMLNMGFIEQVESILIKMPKNKNTFLFSATLPEEIVMLSKKYMKNFENIEVQNEGKTKGGIHQVYYEVESREKFDLLKKVIYKEVPGSSIIFCRTKNNVEDVLVKMKNMKFSCMAIHGGMLQENRIAVMNAFKRGEFTFLIATDVAARGIDVENVTHVINYDIPMEKESYIHRIGRTGRMGNKGIAITFVTSKEERFLKEIEEQFSLEIIKEEPPTREEVKKGQEVFKTASKQLNKTKANKSEKLNKDITKIYLSAGKKKKIRPGDIAGTISSIDGVSPEDIGIIDIHDNFSYVEILSGKGDIVLNAIEDKTIKGKKVRAEKAQK

SEQ ID NO: 38507 - DNA, 1167 bp, Thermoplasma acidophilum DSM 1728
  CDS (1)..(1167)
ttggtgttgctttttatgaatttatcattcgcgggctttagtcgaatggttggaataagtatgtcgaaattcgaagaatgcaatataaaggaagatctgaaatcggatctcaagaggatgggttttgttgatatgacggctgtgcaggaaagaacaattgaacctgcactcgcaggcagggatcttataataagatccaagacgggatctggaaaaacggcagcctatcttgtgcctataataaataatatatccctgggaaggaaacccagtgcactgatcgtgcttccaacgagggagctggcattgcaggtccatggagttgcagaaaagcttggacatagctctagaataagatccactgtcatatacggtggcgcctcaatgtcaaggcagattgaactgctggatcgtgggacagatataatagttggcaccccaggcaggatactggatctgcatgaaagaggctttttgaatctttctgcggtaaagtacttcgttctggatgaagccgatgtcatgcttgacatgggttttatcgatgatataaagagaatgatgtccctgctgagagaggacaagcagacgttcatcctctcggcaaccatgccggaggagatcatagatatggcaaacgacttcatgcgagatccggagactataatagtgggatcggatgaggtcacggtcaaggaaatataccactactatgcaatatcaaagagaaacaggaaacttcatgtgctgcagacgtaccttaaaacctacggcccgcagaagaccatcatattctccaggacaaaggtcggcacgaagatggtctgtgattttctcctgaacatgggatacaacgccgtcatgataaacggagatatgagccagagccagagggaaagggcaatgtaccttttcaggaacagagcggactatctggttgccacgaacgttgcggcccgtggcatagatataagggatgttacggacataatcaacttcgatctgcctgacgatccaaaggtgtatgtgcacagggtcggaaggacagcacgtctcggatctgagggaagggccttcagcatagtggaggagggccagagagacgcagtgtaccagattgaacatatggcccgcgttagcctgaagcagataaagctccaggaataa

SEQ ID NO: 38508 - protein, 388 aa, Thermoplasma acidophilum DSM 1728
MVLLFMNLSFAGFSRMVGISMSKFEECNIKEDLKSDLKRMGFVDMTAVQERTIEPALAGRDLIIRSKTGSGKTAAYLVPIINNISLGRKPSALIVLPTRELALQVHGVAEKLGHSSRIRSTVIYGGASMSRQIELLDRGTDIIVGTPGRILDLHERGFLNLSAVKYFVLDEADVMLDMGFIDDIKRMMSLLREDKQTFILSATMPEEIIDMANDFMRDPETIIVGSDEVTVKEIYHYYAISKRNRKLHVLQTYLKTYGPQKTIIFSRTKVGTKMVCDFLLNMGYNAVMINGDMSQSQRERAMYLFRNRADYLVATNVAARGIDIRDVTDIINFDLPDDPKVYVHRVGRTARLGSEGRAFSIVEEGQRDAVYQIEHMARVSLKQIKLQE

SEQ ID NO: 38509 - DNA, 1941 bp, Escherichia coli K12
  CDS (1)..(1941)
atgatgagttatgtagactggccgccattaattttgaggcacacgtactacatggctgaattcgaaaccacttttgcagatctgggcctgaaggctcctatccttgaagcccttaacgatctgggttacgaaaaaccatctccaattcaggcagagtgtattccacatctgctgaatggccgcgacgttctgggtatggcccagacggggagcggaaaaactgcagcattctctttacctctgttgcagaatcttgatcctgagctgaaagcaccacagattctggtgctggcaccgacccgcgaactggcggtacaggttgctgaagcaatgacggatttctctaaacacatgcgcggcgtaaatgtggttgctctgtacggcggccagcgttatgacgtgcaattacgcgccctgcgtcaggggccgcagatcgttgtcggtactccgggccgtctgctggaccacctgaaacgtggcactctggacctctctaaactgagcggtctggttctggatgaagctgacgaaatgctgcgcatgggcttcatcgaagacgttgaaaccattatggcgcagatcccggaaggtcatcagaccgctctgttctctgcaaccatgccggaagcgattcgtcgcattacccgccgctttatgaaagagccgcaggaagtgcgcattcagtccagcgtgactacccgtcctgacatcagccagagctactggactgtctggggtatgcgcaaaaacgaagcactggtacgtttcctggaagcggaagattttgatgcggcgattatcttcgttcgtaccaaaaacgcgactctggaagtggctgaagctcttgagcgtaacggctacaacagcgccgcgctgaacggtgacatgaaccaggcgctgcgtgaacagacactggaacgcctgaaagatggtcgtctggacatcctgattgcgaccgacgttgcagcccgtggcctggacgttgagcgtatcagcctggtagttaactacgatatcccgatggattctgagtcttacgttcaccgtatcggtcgtaccggtcgtgcgggtcgtgctggccgcgcgctgctgttcgttgagaaccgcgagcgtcgtctgctgcgcaacattgaacgtactatgaagctgactattccggaagtagaactgccgaacgcagaactgctaggcaaacgccgtctggaaaaattcgccgctaaagtacagcagcagctggaaagcagcgatctggatcaataccgcgcactgctgagcaaaattcagccgactgctgaaggtgaagagctggatctcgaaactctggctgcggcactgctgaaaatggcacagggtgaacgtactctgatcgtaccgccagatgcgccgatgcgtccgaaacgtgaattccgtgaccgtgatgaccgtggtccgcgcgatcgtaacgaccgtggcccgcgtggtgaccgtgaagatcgtccgcgtcgtgaacgtcgtgatgttggcgatatgcagctgtaccgcattgaagtgggccgcgatgatggtgttgaagttcgtcatatcgttggtgcgattgctaacgaaggcgacatcagcagccgttacattggtaacatcaagctgtttgcttctcactccaccatcgaactgccgaaaggtatgccgggtgaagtgctgcaacactttacgcgcactcgcattctcaacaagccgatgaacatgcagttactgggcgatgcacagccgcatactggcggtgagcgtcgtggcggtggtcgtggtttcggtggcgaacgtcgtgaaggcggtcgtaacttcagcggtgaacgccgtgaaggtggccgtggtgatggtcgtcgttttagcggcgaacgtcgtgaaggccgcgctccgcgtcgtgatgattctaccggtcgtcgtcgtttcggtggtgatgcgtaa

SEQ ID NO: 38510 - protein, 646 aa, Escherichia coli K12
MMSYVDWPPLILRHTYYMAEFETTFADLGLKAPILEALNDLGYEKPSPIQAECIPHLLNGRDVLGMAQTGSGKTAAFSLPLLQNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLSKIQPTAEGEELDLETLAAALLKMAQGERTLIVPPDAPMRPKREFRDRDDRGPRDRNDRGPRGDREDRPRRERRDVGDMQLYRIEVGRDDGVEVRHIVGAIANEGDISSRYIGNIKLFASHSTIELPKGMPGEVLQHFTRTRILNKPMNMQLLGDAQPHTGGERRGGGRGFGGERREGGRNFSGERREGGRGDGRRFSGERREGRAPRRDDSTGRRRFGGDA

SEQ ID NO: 38511 - DNA, 1554 bp, Caulobacter crescentus CB15
  CDS (1)..(1554)
atgactgaattcaccgacctagggctatcgcccacgaccctgcaggcggtcgccgacaccggctataccactgcgacccccatccaggcccaggccattcccgtcgccctcgcgggccaggacgtcctcggcatcgcccagacgggcaccggcaagaccgccgccttcaccctcccgctgatcgaccgcttgcagtcgggtcgcgccaaggcccgcatgccgcgcgccctggtcatcgccccgacccgcgaactggccgaccaggtggccgccagcttcgagaagtacgccaagggcaccaagctctcctgggccctgctgatcggcggcgtgtcgttcggcgaccaggaaaagaagctcgatcgcggcgtcgacgtgctgatcgccacgccgggccgcctgctcgaccacttcgagcgcggcaagctcctgatgaccggcgtgcagttcctcgtcgtcgacgaggccgaccgcatgctggacatgggcttcatcccggacatcgagcgcatcttcaagatgacgccgcccaagaagcagaccctgttcttctcggcgacgatgccgccggaaatcacccgcctgaccaagcagtttctgcgcgatccggtgcggatcgaggtggcgcgtcctgcgaccaccaacgccaacatcacccagctgttggtcaaggttccctcttctgatccgaaggccaagcgcttggcgctgcgggccctgatcgaaaaggccggcatcgagacgggcatcgtgttctgcaaccgcaagaccgaggtcgacatcgtcgccaagtcgctgaaggtgcacggctatgacgccgcccccatccacggcgacctcgaccagacccagcggatgaagaccctggcggacttccgctcgggcgcgctgaagatcctggtggcctcggacgtcgccgcgcgtggcctcgacatcccggccgtcagccacgtcttcaactatgacgtgccgcaccatgccgacgactatgtccaccgcatcggccgcaccggccgcgcgggccggacgggtatcacctacatgctggtcacgccggccgacgacaagggcttcgacaaggtcatcaagctgatcggttcgacgccggacgaagaaaagctggacctcgactactccaacgccgtcaccgtcaagcgcgagggcgaccgcaagcgcgggggccgcgaccgtgatcgtggcgagcgtggtgaacgcagcgagcgccccgcgcgcggacgcggtcgtggccgcgagcgcgccgaagaaacggtcgaagcgccggcggaggctgtcgccgaaatcgtcgacacccccgctatggccgaggagcgccctgcgcgcgaacgccggccgcgccgtgagcgcgagcccaaggcggccgcgcctgcgccgaccgcggtcgaagccgagcgcccggcccgcgccgagcgtcctgaacgcccggtgcgcggggttcagccggtccgtgaccgcgacgacgatgatcgtcgcgtggtcggcttcggctcggacgtgcccgccttcctcgcgcgcccgccgcgcggcgcgaagtag

SEQ ID NO: 38512 - protein, 517 aa, Caulobacter crescentus CB15
MTEFTDLGLSPTTLQAVADTGYTTATPIQAQAIPVALAGQDVLGIAQTGTGKTAAFTLPLIDRLQSGRAKARMPRALVIAPTRELADQVAASFEKYAKGTKLSWALLIGGVSFGDQEKKLDRGVDVLIATPGRLLDHFERGKLLMTGVQFLVVDEADRMLDMGFIPDIERIFKMTPPKKQTLFFSATMPPEITRLTKQFLRDPVRIEVARPATTNANITQLLVKVPSSDPKAKRLALRALIEKAGIETGIVFCNRKTEVDIVAKSLKVHGYDAAPIHGDLDQTQRMKTLADFRSGALKILVASDVAARGLDIPAVSHVFNYDVPHHADDYVHRIGRTGRAGRTGITYMLVTPADDKGFDKVIKLIGSTPDEEKLDLDYSNAVTVKREGDRKRGGRDRDRGERGERSERPARGRGRGRERAEETVEAPAEAVAEIVDTPAMAEERPARERRPRREREPKAAAPAPTAVEAERPARAERPERPVRGVQPVRDRDDDDRRVVGFGSDVPAFLARPPRGAK

SEQ ID NO: 38513 - DNA, 1512 bp, Sinorhizobium meliloti 1021
  CDS (1)..(1512)
ttgtccactttcaaagagcttggcctctccgagcacatcgtggcgacactctccgccaatggtttcgaaaagccgacgcccatccaggctcaagccattccgctggtcctgaaagaccatgacctcatcggtcttgcgcagacgggtaccggcaagaccgctgcgttcggcctgccgatgatcgaaaagctcgtagccgatggcagacgtcccgatccgcgcaacattcgcgctctcgtgctcgcacctacccgtgaactggtgaaccagatcgcggccaacctgaagcttttcgtaaagaagagcccgctcaagatcggcctcgtcgtcggtggcgtttcgatcaacaagcagaccgaacagctcgcccgtggcgtcgacattctcgtcgcgacccccggccgcctgctcgaccttgtttctcgcaaggcggtgacgctgacacaggctcgctacctcgttctcgacgaggctgaccagatgctcgatctcggcttcatccacgacctgcgcaagatttccaagctggtgccgaagaatcgtcagacgctgctcttctccgcaaccatgccgaagctgattgccgagcttgccggcgaatacctgaccgatccggtcaaggtcgaagtctcgcctccgggtaaggccgccgacaaggtcgaacaatatgtgcatttcgtccccggcaaggacctgaagacgacgatcctgaagcagacgctgactgccaatcccgatgggctgtcgctgattttcagccgcaccaagcatggcgccgagaagctgatgaagcatctcgaccatgtcggcttcaaggccgcctcgatccatggcaacaagagccagggccagcgggagcgcgcgctgaaggcattccgcgacggtgagatccgcgtgctcgtggcgacggatgtggccgctcgcgggatcgacattccaggcgtcacccacgtctacaactacgacctgccggaagtgcccgacgcctatgtgcaccgtatcggccgcacggcccgtaacggccgcgacggcatcgcgatcgcattctgtgcgccggacgaaatccgcctgctgcgtgacatcgaaaagctgatgggcatccagatcgccgtcgccagcggcgaagcgcccgccgaccaggcgcgcccctcgaagggacgtggcggtcgcggcaacggtcagcctcgtggtaacggccagcctcgcggcaatggcgcagggcagcgccagggcggaccccgccgcgatcggccgcagcgccaggcggcagctggcggattcgccggcgatgaactgctgcgcgacgagcgctcgcacgagcgccgcgaccagcgtgctgccgggcatggaccggcggacggacggccggaaggccaccgcaatcacaaggcgcagaagcaccatgggcggcccggaccgcagcaggcccgccgtgggagcgaacagtcaggcgaacgcaacggcggcggcaatcgaccgcagcgtgccgacggtcgcggccatcagcgctag

SEQ ID NO: 38514 - protein, 503 aa, Sinorhizobium meliloti 1021
MSTFKELGLSEHIVATLSANGFEKPTPIQAQAIPLVLKDHDLIGLAQTGTGKTAAFGLPMIEKLVADGRRPDPRNIRALVLAPTRELVNQIAANLKLFVKKSPLKIGLVVGGVSINKQTEQLARGVDILVATPGRLLDLVSRKAVTLTQARYLVLDEADQMLDLGFIHDLRKISKLVPKNRQTLLFSATMPKLIAELAGEYLTDPVKVEVSPPGKAADKVEQYVHFVPGKDLKTTILKQTLTANPDGLSLIFSRTKHGAEKLMKHLDHVGFKAASIHGNKSQGQRERALKAFRDGEIRVLVATDVAARGIDIPGVTHVYNYDLPEVPDAYVHRIGRTARNGRDGIAIAFCAPDEIRLLRDIEKLMGIQIAVASGEAPADQARPSKGRGGRGNGQPRGNGQPRGNGAGQRQGGPRRDRPQRQAAAGGFAGDELLRDERSHERRDQRAAGHGPADGRPEGHRNHKAQKHHGRPGPQQARRGSEQSGERNGGGNRPQRADGRGHQR

SEQ ID NO: 38515 - DNA, 1479 bp, Synechocystis sp. PCC 6803
  CDS (1)..(1479)
atgactaatactttgactagtaccttcgctgaccttggtctttctgaaaaacgttgtcaactcttggccgacattggctttgaggctcccacccaaattcaaactgaagccattcccctgcttttgagcggccgggacatgctggcccaatcccaaaccggcacggggaaaaccgccgcctttgccctacctttgatggaccgcattgacccagagggggacttgcaagccttaattttgacccccacccgggaattggcccagcaggtggcggaagcaatgaaggacttttcccacgagcgccgtctatttattttgaatgtgtacggtggtcaatccatcgagcggcaaattcgcagcctagaacggggtgtgcaaattgtggtgggcacccctggacgggtgattgacctaattgaccgcaaaaaacttaaattagaaaccatccaatgggtggtgctggatgaagcggacgaaatgctgagcatgggcttcattgacgatgtgaaaaccattctgcgtaaaactccccccaccaggcagaccgcttgtttttctgccaccatgccccgggaaatcaaagaattggtcaaccaatttttaaatgatcccgccctggtgaccgttaaacagacccaatccacccccacccgcattgagcagcagctttatcacgtgccccgcggttggtctaaggctaaagcgctacaaccgattctggaaatggaagatcccgaatccgccattatttttgttcgtactaaacaaaccgccgcagacctcaccagtcgtttgcaagaagcgggccatagcgtggatgagtaccacggcaacctgagccaatcccaacgggagcgtttggtgcaccgtttccgggatggcaaaattaagctggtggtggccacggacatcgccgcccggggtttagatgtgaataacctcagccatgtggtcaactttgatttacccgataacgctgaaacctacattcaccgcattggccgcaccggtcgggctggtaagactggtaaggcgatcgccttggtggaacccattgaccgtcgtttactgcgatccatcgaaaaccgtctgaaacaacaaattgaagtttgtaccattcctaaccgttcgcaggtggaagccaagcggattgaaaaactgcaggaacaactcaaggaagccctgaccggtgagcggatggcctccttccttcctttagtgcgggaattgagcgatgagtacgatgcccaggcgatcgccgctgctgctttacagatgatctatgaccagagctgtccccattggatgaaatccgattgggaagtgccggaagttgatttcaacaagcccgttctccgtcgtggccgcaatgctggcggtggccagaacaaaagtgggggtggttaccaaggtaaaccgggcaaaccccgtcgctccagcggtggccgtcgtcctgcctatagtgatcgccaacagtaa

SEQ ID NO: 38516 - protein, 492 aa, Synechocystis sp. PCC 6803
MTNTLTSTFADLGLSEKRCQLLADIGFEAPTQIQTEAIPLLLSGRDMLAQSQTGTGKTAAFALPLMDRIDPEGDLQALILTPTRELAQQVAEAMKDFSHERRLFILNVYGGQSIERQIRSLERGVQIVVGTPGRVIDLIDRKKLKLETIQWVVLDEADEMLSMGFIDDVKTILRKTPPTRQTACFSATMPREIKELVNQFLNDPALVTVKQTQSTPTRIEQQLYHVPRGWSKAKALQPILEMEDPESAIIFVRTKQTAADLTSRLQEAGHSVDEYHGNLSQSQRERLVHRFRDGKIKLVVATDIAARGLDVNNLSHVVNFDLPDNAETYIHRIGRTGRAGKTGKAIALVEPIDRRLLRSIENRLKQQIEVCTIPNRSQVEAKRIEKLQEQLKEALTGERMASFLPLVRELSDEYDAQAIAAAALQMIYDQSCPHWMKSDWEVPEVDFNKPVLRRGRNAGGGQNKSGGGYQGKPGKPRRSSGGRRPAYSDRQQ

SEQ ID NO: 38517 - DNA, 1374 bp, Salmonella typhimurium LT2
  CDS (1)..(1374)
gtgaccactttttcaaccctgaatgttttgcccgccgcccagctcaataaccttactgagctgggctatcttgagatgacgcctgttcaggccgcagcattacccgtcattctggcgggtaatgatgtgcgtgtgcaggccaggaccggtagcggcaaaacggcggcgtttggtcttgggctcttgcatcgaattgacgtcactctgttccagacacaggcattagtgctgtgcccgacgcgggagctggcggatcaggttgccggagagttacgtcgcctggcccgttttctgccaaataccaaaattctgaccttgtgtggcgggcaaccctttggcgcacagcgcgactcgcttcagcacgctccgcatatcattgtcgcgacgccggggcgcctgctggatcatttacaaaaagaaaccgtatcgctggatgcgctgcatattctggtaatggatgaagcagaccgaatgctggacatgggattcagtgacgccattgatgaggtgatccgctttgcgcctgcgacgcgccagacgttattgttttcagcaacctggcctgaggccatcgcggcgattagcggtcgtgtacagcagcagccaatacgtattgaaatcgatacggtagatgcgctaccggctatcgaacaacagttcttcgaaacgtctgcgcatgaaaaaatttcgctgctacaaacgttgcttagccagcatcagccagcgtcctgcgtggtattttgcaataccaaaaaagattgtcaggccgtttgtgatgcgcttaatgcggtaggacaaagcgcgttggcgctccacggcgatctggaacaacgcgaccgcgaccagacgttggtgcgttttgcaaatggcagcgcgcgcattctggttgccaccgacgttgccgcgcgagggttagacattaaatcgctcgaactggtggttaactatgaactggcctgggacccggaggtgcatgtccatcgtattggccgtacggcgcgcgcgggaagcagcggcctggcgatcagtttctgcgcgccggaagaggcgcagcgggcgaatattctttcagaaatgctgcaactcaagctgaactggctgaatgcgcccgcccggcagccgttactccctctggccgcagagatggctaccctatgcattgacggcggcaaaaaagcgaaaatgcgtccgggagatattttgggcgcgctgaccggcgatattggattagacggggcggatattggcaaaattaacgtgcatccaatgcacgtttacgtcgccgtacgtcaagcagtagcgcaaaaagcctggaagcagttgcaaaacgggaagatcaaaggcaagtcatgccgggtacggctattaaaatga

SEQ ID NO: 38518 - protein, 457 aa, Salmonella typhimurium LT2
MTTFSTLNVLPAAQLNNLTELGYLEMTPVQAAALPVILAGNDVRVQARTGSGKTAAFGLGLLHRIDVTLFQTQALVLCPTRELADQVAGELRRLARFLPNTKILTLCGGQPFGAQRDSLQHAPHIIVATPGRLLDHLQKETVSLDALHILVMDEADRMLDMGFSDAIDEVIRFAPATRQTLLFSATWPEAIAAISGRVQQQPIRIEIDTVDALPAIEQQFFETSAHEKISLLQTLLSQHQPASCVVFCNTKKDCQAVCDALNAVGQSALALHGDLEQRDRDQTLVRFANGSARILVATDVAARGLDIKSLELVVNYELAWDPEVHVHRIGRTARAGSSGLAISFCAPEEAQRANILSEMLQLKLNWLNAPARQPLLPLAAEMATLCIDGGKKAKMRPGDILGALTGDIGLDGADIGKINVHPMHVYVAVRQAVAQKAWKQLQNGKIKGKSCRVRLLK

SEQ ID NO: 38519 - DNA, 1890 bp, Salmonella typhimurium LT2
  CDS (1)..(1890)
atggctgaattcgaaaccacttttgcagatctggggctgaaggctcctatccttgaagcccttaccgatctgggttacgaaaaaccatctccaatccaggcagagtgcattccgcatctgctgggcggtcgcgacgtgctgggcatggcccagaccggtagcggcaaaaccgcagcgttctctttaccgctgctcaacaatcttgatcctgagctgaaggcacctcagattctggtgctggcgccaacccgcgaactggcggtacaggttgccgaagccatgacggatttctctaaacacatgcgcggcgtaaacgtggttgccttgtacggcggtcagcgttatgacgtgcagttacgcgccctgcgtcaggggccgcagatcgttgtcggtacgccgggacgtctgcttgatcacttaaaacgcggcaccctcgacctctctaaactgagtggtctggtgctggatgaagccgacgaaatgctgcgtatgggcttcatcgaagacgttgaaactattatggcgcagatcccggaaggtcatcagaccgctctgttctccgccaccatgccggaagcgattcgtcgcattacccgccgctttatgaaagagccgcaggaagtgcgcattcagtccagcgtgactacccgtcctgacatcagccagagctactggactgtctggggcatgcgtaaaaacgaagcgctggtgcgtttcctggaagcggaagactttgatgcggcgattatcttcgtgcgtaccaaaaacgcgaccctggaagtagcagaagcgctggaacgtagcggctacaacagcgccgcgttgaatggcgatatgaaccaggcgctgcgtgagcagactctggaacgcctgaaagatggtcgtctggacatcctgatcgctaccgacgttgcggcacgtggtctggacgttgaacgtatcagcctggtggtgaactacgatattccgatggactccgagtcctacgttcaccgtatcggtcgtaccggccgtgcgggtcgcgccggtcgcgcgctgctgttcgttgagaaccgcgagcgtcgtctgctgcgcaacatcgaacgcaccatgaagctgaccattccggaagtggaactgccgaacgcagaactgctgggtaaacgccgtctggaaaaattcgccgcgaaagttcagcagcaactggaaagcagcgatctggatcagtaccgtgcgctgctggcgaaaatccagccgtctgccgaaggtgaagagctggatctcgaaacgctggccgccgcactgctgaaaatggcgcagggcgagcgtccgctgatcctgccgccggatgcgccgatgcgtcctaagcgtgaattccgtgaccgtgacgaccgtggtccgcgcgatcgtaatgaccgtggcccgcgtggcgatcgtgaagaacgtccgcgtcgtgaacgtcgtgacgttggcgatatgcagttataccgcattgaagtgggccgtgatgacggcgttgaagttcgtcatatcgtgggcgctatcgctaacgaaggcgacatcagcagccgttacattggcaacattaagctgttcgcgtctcactccaccatcgagctgccgaaaggtatgccgggcgaagtgctccagcacttcacgcgtacccgcattctgaacaagccgatgaatatgcagctgttgggtgatgcggttccgcacgcgggcggcgaacgtcgcggcggtggtcgtagcttcagtggcgaacgtcgtgaaggcggtcgtaatttcagcggcgaacgtcgtgaaggtggtcgtggtgatggtcgtcgcttcagcggcgaacgtcgtgaaagccgtggtccgcgtcgtgatgactctaccggtcgccgtcgtttcggcggtgatgcgtaa

SEQ ID NO: 38520 - protein, 629 aa, Salmonella typhimurium LT2
MAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 38521 - DNA, 1563 bp, Listeria monocytogenes EGD-e
  CDS (1)..(1563)
ttgacaaaattttcggagttcggactggacgaaaaaattgtaaaatcagtaaatcggatggggtttgaagaagcaacaccaatccaagaaaagacaattccactaggattagaaggtaaagacttaatcgggcaagcacaaacaggtactggtaaaacagccgcttttggtcttccaatgattcacaaaattgaccaaaagagtaacaacgtacaagctttaattattgctccaacacgtgaacttgcaatccaagtttcagaagagctttataaacttagctatgataaacatgtacgtgtgctagcggtttacggtggtagtgatatcagccgtcaaatccgttcacttaagaaaaacccacaaatcgtagttggtacgccaggacgtattttggatcatattaaccgtcgcacactgaaactagatcacgtggaaacacttgtactagatgaagcagacgaaatgctaaacatgggcttcattgatgatatcgaaactattctaaaagaagtaccagcagaacgtcaaactttactattttctgcaacaatgcctgatccaattcgccgtatcggtgaacgtttcatgcatagcccagaacttattcgtattaaagcaaaagaaatgactgcactattaatcgaacaattcttcgtaaaagtgcatgaaaaagaaaaatttgacgtattatctcgtttattagatgttcaagcaccagaattagcaattgtttttggtcgtacaaaacgtcgtgtagacgaactatctcgcgcgcttgatatgcgtggttacgtggctgaaggtatccacggtgacttaacgcaagcaaaacgtatgagcgtactacgcaaatttaaagaaggaaaaattgatgttctagttgcaacagacgtagcagcacgtggacttgatatttccggtgtaacacatgtatataactatgatattccacaagatccagaaagctatgttcaccgtattggtcgtactggtcgtgctggtaaagaaggtatggcgattacattcgtacaacctcgtgaaatgggttatttacgtattgtggaagaaactacgaaaaaacgtatgcaaccacttcaagctcctacatgggacgaagcatttgcaggccaattacgcgtagcaactgaaaaaattcaagaagcaattacagaagaaaacttagctgactacaaaacgtttgctaacgaacttcttgaaaaatacgatgcaactgacatcgcagcagcaatgcttaaaatgttagcgaaagaaccagataaaactcctgtccatattactgaagagcgtccattaccatcccgtggtggcggtggctacaaaggtaaaaatggtaaaggcggcaaaggtggcggctatcgcggcggaagcggcaaaggcggaagctaccgtgatcgtaacaacagcggtaaaggtcgtcgtagcggcggcggttccggtggtggaagcggctctggcggtggcggcaatcgtgatcgtcgtggcggcggagaacaacgcagcggcggcaacaaaggcaactactcacaaaaatctaaataa

SEQ ID NO: 38522 - protein, 520 aa, Listeria monocytogenes EGD-e
MTKFSEFGLDEKIVKSVNRMGFEEATPIQEKTIPLGLEGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGGGSGSGGGGNRDRRGGGEQRSGGNKGNYSQKSK

SEQ ID NO: 38523 - DNA, 1542 bp, Nostoc sp. PCC 7120
  CDS (1)..(1542)
atgaacttatcgtttcccgaactaggaatttcccaagaacgcgtagaacacttagaaaaacttggttttactgcaccaacaaacattcaagcccaagctatcccccaactgttgtcaggacgggatgtagttggtcaatcacaaacaggtacaggtaaaacagcagcattttcactgccaattttagagcgattagatcctcaacaaaaagcagtacaagccatagttttaaccccaacccgcgaattagcaatccaagtccacgatgcaatggcgcaattcgttggtaacagtggattacggactttagcaatttacggtggtcaatcaattgaccgtcaaatgctacaactcaaacgcggcgtgcatatcgtcgtcggtacaccagggcgagtaattgacctactagaacggggtaacctgaagctagatcaagtcaagtggtttgttttggatgaagccgatgaaatgttaagcatgggctttatcgacgatgtggagaaaattctttctcaagcaccccaagaccgtcagacagctttattctcagctaccatgccaccatcaattcggatgttggtcaacaagtttttgcgatcgcccgtcacagtcaccgtcgagcagccaaaagccacccccaataaaatcaatcaggtagcttatctcatcccccgtcactggacaaaagccagagccttacagccaattctggaaatggaagatccagaaacagctttaatctttgtccgcaccagacgtacagccgccgaactcaccagccaactgcaagcagccggtcacagtgtagacgaatatcatggtgacctgtcccaacaagcacgggaacggttattaactcggttccgcagccgtcaagttcgctgggtagtagcaactgacattgctgcacggggtttagatgtcgatcaactatctcatgtgatcaactacgacctacccgatagcgtcgaaacctacgtccaccggatcggtcgtactggtcgtgctggtaaagaaggtacagcaattaccttagtacaaccctttgagcgtcgcaaacagcaaattttcgagcgtcatgtccgccaaaattggcaattgctttccattcccacacgggcgcaaatcgaagcacgccacatcctgaaattgcaagagcaagtcagagaagccttagctggtgagcgtttagcttccttcttacccattgtcagcgaattgatcgaaaaatatgatgctcaagcgatcgccgcagcagcgctacaaatcgcttacgatcaaactcgtcctgcttggttaagtacagatgccgagattcccgaagaagtcgcatctactcctaaacccaaactaggcggtaagcgtcgtgagttttccggtgacagaggtcgttccaattggaacaaatctgacaataacaacagcgacgacgaaagacgcggtactcccaaaccaaaattacggactggccgtcgtgaaacttccgctacacctagcaatcctaagttgggttcacctgctgctagagaatcagcttcttag

SEQ ID NO: 38524 - protein, 513 aa, Nostoc sp. PCC 7120
MNLSFPELGISQERVEHLEKLGFTAPTNIQAQAIPQLLSGRDVVGQSQTGTGKTAAFSLPILERLDPQQKAVQAIVLTPTRELAIQVHDAMAQFVGNSGLRTLAIYGGQSIDRQMLQLKRGVHIVVGTPGRVIDLLERGNLKLDQVKWFVLDEADEMLSMGFIDDVEKILSQAPQDRQTALFSATMPPSIRMLVNKFLRSPVTVTVEQPKATPNKINQVAYLIPRHWTKARALQPILEMEDPETALIFVRTRRTAAELTSQLQAAGHSVDEYHGDLSQQARERLLTRFRSRQVRWVVATDIAARGLDVDQLSHVINYDLPDSVETYVHRIGRTGRAGKEGTAITLVQPFERRKQQIFERHVRQNWQLLSIPTRAQIEARHILKLQEQVREALAGERLASFLPIVSELIEKYDAQAIAAAALQIAYDQTRPAWLSTDAEIPEEVASTPKPKLGGKRREFSGDRGRSNWNKSDNNNSDDERRGTPKPKLRTGRRETSATPSNPKLGSPAARESAS

SEQ ID NO: 38525 - DNA, 1281 bp, Nostoc sp. PCC 7120
  CDS (1)..(1281)
atgtctttttctcatctcggcttgtccaatgaaattatcaatgctgttactgagttggggtacaccaaacccacacccatccagatgcagtctattcctgctgtcttatcaggacgagatttgctagctggcgctcaaactggaactgggaaaactgccagctttactctccccctcctacatttattatcccaagatagtcttaaaagcgcctccaatgcttcctcacccattcgggcgctaattcttaccccgactcgtgaactcgccgcacaggtggagtcaagcgtgcgtgactacggcaagtacttgaagctgaactcaatggtgatgtttggtggagtcagcattaatccccaaaaacagcgtttaaagggtcgtgtagatattctggttgctaccccagggcgactgctagaccatgtgcagcagggaacggtaaacctttcacagattgagattctggtgctggatgaagccgaccggatgttggatatgggctttattcgtgatatccgtcgtatcctctccctgttgcccaaacagcgacaaaacttgctattcttcgctacattctcagacaaaatcaaggaactcgccgccggtctactgaatcgcccgcagatgatcgaagtagcacgccgtaacgttacagccgatactgtgacacaaaaagtctacaaaatagagcgcgatagaaaacgagatttactggctcacctgattcggaaagataattggtatcaagtactagtatttactcgtaccaagtatggtgctgaccgtctagttaaacaattaggccatgagcgcattcaagctctagctatccacggtaataagagccagtcggcgcgtacccacgctctggcaaagttcaaaaatggtagtttacaagttttagtagcaactgacattgctgcacgaggactggacatcagcgaattgccttatgtggtcaatttcgatttgccctatgtaccagaagattatgttcatcgtattggtcgcactggtcgcgctggtgcatcaggtgaggctgtatcgctggtgagcgccgatgaatatcatttgttggcagatattgaaaaactgattgaaaagcgattgccttttgaattggtagcgggtattggagctaattcccaagctaaacccgaaccaactcaggatgaacgcaagcaaaaacccaaagatagtcagcatcagcctcgctctgctgctcaaggtgtgccaaagaaatcagggaaaaaacgtttaactaattctggaaaaaggtaa

SEQ ID NO: 38526 - protein, 426 aa, Nostoc sp. PCC 7120
MSFSHLGLSNEIINAVTELGYTKPTPIQMQSIPAVLSGRDLLAGAQTGTGKTASFTLPLLHLLSQDSLKSASNASSPIRALILTPTRELAAQVESSVRDYGKYLKLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQAKPEPTQDERKQKPKDSQHQPRSAAQGVPKKSGKKRLTNSGKR

SEQ ID NO: 38527 - DNA, 1200 bp, Caenorhabditis elegans
  CDS (1)..(1200)
atggctggtaaaaaagcagaaaaagatgatatggcaacagtggaattcgaatcttctgaagaagtaaatgttattccaacatttgacaaaatgggtttgcgagaagaccttcttcgtggaatttatgcctatggattcgaaaaaccatcggctattcaacaaagagcagttccagcaattcttaaagcacgtgacgtcattgctcaagctcaatctggaaccggaaagactgcgactttttcaatttccgttcttcaatcattggatacacaagttcgagagacacaagcacttattctttctccaaccagagaattggctgtccagattcaaaaagtagttcttgctctcggagactatatgaatgttcaatgtcatgcctgtatcggaggaacaaatctcggagaagacattcgcaaattggattacggtcaacacgtggtttctggtactccaggacgagtatttgatatgattcgccgtcgtaatcttcgtacccgagcgatcaagcttctggttcttgacgaagccgatgaaatgctgaataaaggtttcaaggagcagttgtacgatatctaccgatatcttccacctggagcacaagtcgtacttctgtcagccacactgcctcatgaaattctagagatgaccagtaaattcatgacagatcctatcagaattcttgtgaaacgtgatgaactgacacttgaaggaatcaagcaattcttcgttgcagttgacagagaagaatggaagttcgacactcttattgatctttatgatactcttaccatcacacaggctgtactattctgtaatacccgtagaaaggttgattggttgacggataaaatgaaggaagccaacttcacagtgtcatcaatgcacggagatatggaacagaaggatcgtgatgaagttatgaaagagttcagagcaggaacaacgagagtgctcatttcaactgatgtttgggcgagaggattagatgttccacaagtctcgttggttatcaactatgatcttccaaacaatcgtgaattatacattcatcgtattggtcgttctggacgtttcggacgcaagggagtcgccatcaactttgtgaagcaagatgatgtcagaattctgcgagacattgagcaatactattcgacacaaatcgacgaaatgcccatgaatattgcggatatcatttga

SEQ ID NO: 38528 - protein, 399 aa, Caenorhabditis elegans
MAGKKAEKDDMATVEFESSEEVNVIPTFDKMGLREDLLRGIYAYGFEKPSAIQQRAVPAILKARDVIAQAQSGTGKTATFSISVLQSLDTQVRETQALILSPTRELAVQIQKVVLALGDYMNVQCHACIGGTNLGEDIRKLDYGQHVVSGTPGRVFDMIRRRNLRTRAIKLLVLDEADEMLNKGFKEQLYDIYRYLPPGAQVVLLSATLPHEILEMTSKFMTDPIRILVKRDELTLEGIKQFFVAVDREEWKFDTLIDLYDTLTITQAVLFCNTRRKVDWLTDKMKEANFTVSSMHGDMEQKDRDEVMKEFRAGTTRVLISTDVWARGLDVPQVSLVINYDLPNNRELYIHRIGRSGRFGRKGVAINFVKQDDVRILRDIEQYYSTQIDEMPMNIADII

SEQ ID NO: 38529 - DNA, 1398 bp, Ralstonia solanacearum GMI1000
  CDS (1)..(1398)
atgaccatcgaaccgactgccccacccttcagtacccttgcgctcgcccccgccgtactcgcgaatctcgcgcagcttggttacaccgacatgacgccgatccaagccgcgagcctgccgatcgcgctcgcgggtcacgacctgatcgcgcaggcgaagaccggcagcggcaaaaccgcagcgttctcgctcgcgctgctcgcgcggctcgacacgcgccgcttcgacgtgcaggcgatggtgctctgcccgacgcgcgagcttgccgatcaggtcgcgcaggaaatccgccgcctcgcgcgcgccgaggaaaacgtgaaagtgctgacgctctgcggcggcacgccaatgcgtccgcaggcggcaagcctcgagcacggcgcgcatgtcgtcgtcggtacgccggggcgcatcatggaccatctcgaacgcggcaatctcgcgctcggcgcgctgaagacgctcgtgctcgacgaagcggaccggatgctcgacatggggttcttcgacgacatcgcgacggtcgtgcgccagtgtccgcctgaacggcagacgctgctgttctcggcgacctacccagacgggatcgcaaagctgagccggcagatcctgcggaatccgaaggaggtgaaactcgaagagcgccacgacgacagcaagattcgccagcgcttctacgaggtgaccgatgacgagcgactgcatgcggtcgggctgctgctgaagcactatcggccggtcagcacactcgcgttctgcaacacgaagcagcaatgccgcaacctgctcgacgtgctgcgtgcgcaaggcttccatgcgctcgcgctgcatggcgagctcgagcagcgcgagcgcgatcaggtattgatccagtttgcgaaccggagctgctcggtgctcgtcgcaaccgacgttgccgcacgcgggctcgacatcgcgcagctcgaagcagtgatcaacgttgatgtgacgcccgatcccgaagtgcacgtgcatcggatcggccgcacgggccgtgccgatcaggacggttgggcgctgagcctcgcgagcatggacgagatggggcgtgtcggcggcatcgagcaggcgctcgggcgcgaggtcgaatggcatcggctcgccgaactcgacgccagcagcgacgcaccgctgctaccgccgatggagacgctacagattctcggcggacgcaaggacaagatccgccccggcgatgtgctcggcgcgctgaccggcgacgcgggctttcgcggcgaccagatcggcaagatcaacgcgaccgaattctcgacctacgtcgcggtcgagcgcggcatcgcgcgcgacgcgctgcgcaagctcaacgcaggcaaggtgaagggcaagaaggtcagggttcggttgatggacgaatga

SEQ ID NO: 38530 - protein, 465 aa, Ralstonia solanacearum GMI1000
MTIEPTAPPFSTLALAPAVLANLAQLGYTDMTPIQAASLPIALAGHDLIAQAKTGSGKTAAFSLALLARLDTRRFDVQAMVLCPTRELADQVAQEIRRLARAEENVKVLTLCGGTPMRPQAASLEHGAHVVVGTPGRIMDHLERGNLALGALKTLVLDEADRMLDMGFFDDIATVVRQCPPERQTLLFSATYPDGIAKLSRQILRNPKEVKLEERHDDSKIRQRFYEVTDDERLHAVGLLLKHYRPVSTLAFCNTKQQCRNLLDVLRAQGFHALALHGELEQRERDQVLIQFANRSCSVLVATDVAARGLDIAQLEAVINVDVTPDPEVHVHRIGRTGRADQDGWALSLASMDEMGRVGGIEQALGREVEWHRLAELDASSDAPLLPPMETLQILGGRKDKIRPGDVLGALTGDAGFRGDQIGKINATEFSTYVAVERGIARDALRKLNAGKVKGKKVRVRLMDE

SEQ ID NO: 38531 - DNA, 1509 bp, Agrobacterium tumefaciens str. C58
  CDS (1)..(1509)
atgagtttgttttggcgccccgaaaggcaatatatattgaccagttttaacgaactcggcctctccgaaaagattgtggccagtgttacccagcttggctatacgacccctacccccattcaggcgaaagccattccgctgctgctcgaaggccgtgacctgatcggcctcgcacagaccggcaccggcaagacggccgctttcgggctgccgatcatcgaaatgctgatgaagcaggcggatcgtccggcaaatcgcaccacccgcacgctgatccttgcaccgacccgcgaactggtgaaccagatcggcgacaacctgcgttccttcgtgaagaagacgccgttgcgcatcaaccaggttgttggcggcgcgtcgatcaacaagcagcagcttcagctcgaaaagggcactgacatcctcgtggcgacccccggccgcctgctggacctcatcgcccgcaacgccatctcgctctcgaaggtgacgtatctcgttctcgacgaagccgaccagatgctcgatctcggcttcatccatgatctgcgcaagatttcccgcatggttccgcccaagcgccagacgctgctgttttcggccaccatgccgaaggccatttccgagcttgccagcaacttcctgaccgacccgatcaaggtcgaggtgacacctccgggcaaggctgccgacaaggtcgagcagtacgtgcatttcgtcgccggcaagaacgacaagaccgatcttttgaagaagtcgctcaacgagaacccggatggccgctccatcgtgttcctgcgcaccaagcacggcgcggagaagctttacaagcatctcgaacatatcggcttcaaggtcgcctccattcacggcaacaagagccagggccagcgcgagcgggcactgaagggcttcaaggacggtgagatcaaggttctggtcgcgaccgacgtcgctgcccgcggcatcgatatcccggccgtaacgcacgtcttcaattacgacctcccggaagtgccggatgcttacgttcaccgcatcggccgtaccgcccgcgccggccgcgacggcatcgccatcgctttctgcgcaccggacgaaacccgcctgctgcacgacatcgaaaagctgatgaagatcgatatcccggttgcgtctggcgaacgtccggctggtcttgcaagccccacacgccccaataacaaccgtggcggtcgcaacaacaatggcggccagccgcgcggcccgcgtgaaggtggacgtcacaacggcgaatcccgcccgtcccgcaaccacgcgccgcgtgatgcggacaacgatctggaagtaacctccgacttcaagcgcgttaagcaggctgaaggcgacgcaggccgcccggccggcccgcgcaagcagcgccgccccgcccgcaagcccggcggcagcggcgccaaccgccacgcacctgctggcggcaacggccaggaaaagcgtgcttccggcaacggcaatcgcggccgtaaccgctaa

SEQ ID NO: 38532 - protein, 502 aa, Agrobacterium tumefaciens str. C58
MSLFWRPERQYILTSFNELGLSEKIVASVTQLGYTTPTPIQAKAIPLLLEGRDLIGLAQTGTGKTAAFGLPIIEMLMKQADRPANRTTRTLILAPTRELVNQIGDNLRSFVKKTPLRINQVVGGASINKQQLQLEKGTDILVATPGRLLDLIARNAISLSKVTYLVLDEADQMLDLGFIHDLRKISRMVPPKRQTLLFSATMPKAISELASNFLTDPIKVEVTPPGKAADKVEQYVHFVAGKNDKTDLLKKSLNENPDGRSIVFLRTKHGAEKLYKHLEHIGFKVASIHGNKSQGQRERALKGFKDGEIKVLVATDVAARGIDIPAVTHVFNYDLPEVPDAYVHRIGRTARAGRDGIAIAFCAPDETRLLHDIEKLMKIDIPVASGERPAGLASPTRPNNNRGGRNNNGGQPRGPREGGRHNGESRPSRNHAPRDADNDLEVTSDFKRVKQAEGDAGRPAGPRKQRRPARKPGGSGANRHAPAGGNGQEKRASGNGNRGRNR

SEQ ID NO: 38533 - DNA, 1608 bp, Brucella melitensis 16M
  CDS (1)..(1608)
atgggccgactgattttcatcggctttcccggacttggacttgttgcgtcacatcttccacaccggaatggtccagcagaggaagggacccgaaatcagttcgggcacgacagcgcaagtcgccagagagttttccggcgtcccgtcgttatcattaaatggaattatgttcggcaagttgcgcttgcccggcgttttaaagcggaccgcgaatgcgcggtgccgctgaaagagattgaattgacaaaagaaaacacgggcggcttcgccgctctcggtatcaccggcgttctgctcaaaggcgtggaagctgccggcatgaccgagccgaaaccgatccagacgcaagccatcccgtcgcaacttgaaggccaggacatcctcggcatcgcccagacgggttccggcaagacggcggctttcagcctgcccatccttcagaaaatcatcggccttggcgacaagcgccgcccgaaaaccgcacgcgcgctaatcctggcgccaacgcgtgaactggcagtacagattgagcagacgatccgcaatgtctccaaaagcgcgcatatctccaccgcgttggttctcggcggcgtgtccaagctttcgcagatcaagcgtatcgcacccggcatcgatgtgctcatcgcaacacccggccgcctgacggacctgatgcgcgatggcctcgtggacctgtcgcagacccgctggctggttctcgatgaagccgaccgcatgttggacatgggcttcatcaatgatgtgaagcgcattgccaaggcaacacacgccgaacgccagaccgcactgttctcggctaccatgccaaaggagatcgcatcgctggccgaacgtctgctgcgcgatccggtacgggtggaagtggcgccacaaggcgccacggcttctgaaattacgcaggtcgtgcatccagtgccgacgaaggagaagcgccgcctgctttcagccatgctgaccgatgccgacatgcgttccgtcatcgtcttcacgcgcaccaagcacggagcagatgccgtcgtgcgccatcttgagcgcgaccgctatgatgttgcggccatccacggcaataagtcgcagaatgcacgccagcgcgcgctgaacggtttccgcgatgggaccctgcgcattctggttgcaacggatattgcagcgcgcggcatcgacgtgcccggcatcagccatgtggtgaattacgacctgccggacgagccggaaacctatgtgcaccgcatcggccgcaccggccgcaacggcgcaagcggcgcttccatcacgctttatgatccggctacggaagaatcaaagctgcgggcggttgagcgcgtcacgcggagcaaactttcgatcaaggatgcgccggtgaagcttgcaccagcacctgtcgccaaaggccccgcaccccagggccagcggactgaacaggctgagagccgcaaggcgcccgcgcacaagcatcgccgccccgcacagaaggcgggcgagcagcatcgcgccggggcacatgccagcgccggtgaggccgcgccgaagccgaagcgtcccttccgccgcaagcgccgcagcaatggcggccagcgcgccgcctga

SEQ ID NO: 38534 - protein, 535 aa, Brucella melitensis 16M
MGRLIFIGFPGLGLVASHLPHRNGPAEEGTRNQFGHDSASRQRVFRRPVVIIKWNYVRQVALARRFKADRECAVPLKEIELTKENTGGFAALGITGVLLKGVEAAGMTEPKPIQTQAIPSQLEGQDILGIAQTGSGKTAAFSLPILQKIIGLGDKRRPKTARALILAPTRELAVQIEQTIRNVSKSAHISTALVLGGVSKLSQIKRIAPGIDVLIATPGRLTDLMRDGLVDLSQTRWLVLDEADRMLDMGFINDVKRIAKATHAERQTALFSATMPKEIASLAERLLRDPVRVEVAPQGATASEITQVVHPVPTKEKRRLLSAMLTDADMRSVIVFTRTKHGADAVVRHLERDRYDVAAIHGNKSQNARQRALNGFRDGTLRILVATDIAARGIDVPGISHVVNYDLPDEPETYVHRIGRTGRNGASGASITLYDPATEESKLRAVERVTRSKLSIKDAPVKLAPAPVAKGPAPQGQRTEQAESRKAPAHKHRRPAQKAGEQHRAGAHASAGEAAPKPKRPFRRKRRSNGGQRAA

SEQ ID NO: 38535 - DNA, 1437 bp, Clostridium perfringens str. 13
  CDS (1)..(1437)
atgaaatttaatgaattaaatttaagtgaggatattattaaagcgcttaataatttaggatataaaaatccatcagaggttcaggaagcttctattccaaaattattaaagggtgaagatataatagttaaatctcaaactggtagtggtaaaactgcaagttttggaatacctgtttgtgaaaagataaatattgaagaaaaaaaggttcagtgtctagttttaacaccaactagagagttagcaattcaagttaaagatgaactttctaatataggaagaataaaaaaggttagatgtgcggctatatttgggaaacaaccttttaatgagcaaattagagagcttaaacaaagagtacatatagtagtaggaactccaggaagagtatttgatcatatggaaagaggaactttagacttaagtgaagttaactatgtagtcatagatgaagctgataaaatgctttcaatgggatttattgatcaaataaaggacatattaggagaattaagattaaataaaaccactgcattattttctgctacattttctaaggaaatagaggaaatatgtgaagagtatatgagaaatcctatgcttttagaggttaaatcaaaagtattcaatagggatagaatagaagaaagtgcaattgaaatagaggagaaaaataaggagaaagctttatggaaatgcctttatgcttatcatccagagagtgctatagtattttgtaatacaagaaataaggttaagtctgtttataaaatgcttaaggatgagggaataacttgtaatgagcttcatggcgatatggagcaaaagaagcgtattgaggttatggaaaactttagagataagcactttaaagttttagtttgtactgatatagcggctagaggaattcacgtagatagtatagaacttgttataaactatgaggttccaatggaaacagaaagctatgttcatagaataggaagaacaggtagagcaggaagagaaggaaaggctattacctttgtaaatcattatgagaagaaatatttagagaatgttgaagaatatattggttatgaaataaaaaaagtaagtcttccttctgatgaagaagttaaagctggaagaaaaatatttaaggaaagtcaaaaggttcaattaaaagagagtaaaaaacctaagaaagaagttcatggtgatatagttaaaatacatgttaatggcggaaagaaaaagaaaataagagcctttgatattgttggatgttttagtaacttaccaggtttaacaggagaagatattggaataatagatgttcaagatggtttctcttatgttgatatattaaatggaaaaggtgataaagttttaaaaagctttaaggaagttactataaagggtaaaaaagttaaaatacaaaaagcaagaaaataa

SEQ ID NO: 38536 - protein, 478 aa, Clostridium perfringens str. 13
MKFNELNLSEDIIKALNNLGYKNPSEVQEASIPKLLKGEDIIVKSQTGSGKTASFGIPVCEKINIEEKKVQCLVLTPTRELAIQVKDELSNIGRIKKVRCAAIFGKQPFNEQIRELKQRVHIVVGTPGRVFDHMERGTLDLSEVNYVVIDEADKMLSMGFIDQIKDILGELRLNKTTALFSATFSKEIEEICEEYMRNPMLLEVKSKVFNRDRIEESAIEIEEKNKEKALWKCLYAYHPESAIVFCNTRNKVKSVYKMLKDEGITCNELHGDMEQKKRIEVMENFRDKHFKVLVCTDIAARGIHVDSIELVINYEVPMETESYVHRIGRTGRAGREGKAITFVNHYEKKYLENVEEYIGYEIKKVSLPSDEEVKAGRKIFKESQKVQLKESKKPKKEVHGDIVKIHVNGGKKKKIRAFDIVGCFSNLPGLTGEDIGIIDVQDGFSYVDILNGKGDKVLKSFKEVTIKGKKVKIQKARK

SEQ ID NO: 38537 - DNA, 1587 bp, Clostridium perfringens str. 13
  CDS (1)..(1587)
atgaacaatataaaatttgatgacttaggtcttaaggaaagcttacttaaagctataaaagatatgggatttgaagagccatctcaaatacaagctgaaagtattcctgtagccctagaaggacacgatataatcggtcaagctcaaactggtactggtaaaacagctgcttttggatgcgctataataaataatgctgatttttcaggaaagaagaaatctccaaaagcacttattttagcaccaactagagagcttgctatacaagttaatgaagaacttgtaagacttggaaaacatgaaaaactttctgttttaccaatatacggtggtcaaccaatagatagacaaattagagctttaaaaaatggtgttgatatagttgttggaacacctggtagagtattagatttaataagaagaaagagtttacctcttaacgatataggattcctagtgttagatgaagctgacgaaatgttaaacatgggattcattgatgatttagaagaaattgttaaatcattaaaaactgatagacaaacacttttattctctgctactatgcctccgcaaataaagaaattagctagaaattacatgaaagaagatactaagcacatcgcaataaagaaaagttctttaacagtttcaaaaatagaacaattttattttgaaataaaacatagagatagatttgaaacactttgtagagttttagattttgatgaaccaaatgctgcaataattttctgcaaaacaaaaaaaggtgttgacgaagttgtagaaaaaatgcaagctagaggatatatggttgaaggtatgcacggagatatgagccaaaaccatagacttcaaactttaagaaaattcaaagaaggaagcttagacttcttagttgctactgatgttgcagctagaggaatagacgttgaaagcgtaactcacgttataaactacgatctaccacaagacaatgaaagttatgtacatagaatcggaagaacaggtagagctaacagagagggagttgcttattctttagttactccaaaagaatatatgatgcttaagcaaatacaaaagcatactaagagtaaaataataagaaaagctgtacctacagttgatgaaatattccaaaataaacataataacataataaataatgtaaaatctactatagaagaagcttcagaagatttccaaaagtttattccaatagctactcaattagatgaagattatagcttagtagatgttgcagctgctcttttaaaaatagtatttgataaagaatcttcttttgattacacttcaaattctatagaagctcctgtaatggacgaaactagattatttatgtctgttggaagaagagatggtataactcctaaatctcttgttaacttcttaaaagagactgctagaataagccctaagcaagttggagatatagacataaaagaaaacttctgctttgctaacgttgatgctgatgcagtaaataatataatgaaaaaatcaatgggtaaaaaacttaacaaaagaactgttaatatagaagttgctaaaaaaagaaaataa

SEQ ID NO: 38538 - protein, 528 aa, Clostridium perfringens str. 13
MNNIKFDDLGLKESLLKAIKDMGFEEPSQIQAESIPVALEGHDIIGQAQTGTGKTAAFGCAIINNADFSGKKKSPKALILAPTRELAIQVNEELVRLGKHEKLSVLPIYGGQPIDRQIRALKNGVDIVVGTPGRVLDLIRRKSLPLNDIGFLVLDEADEMLNMGFIDDLEEIVKSLKTDRQTLLFSATMPPQIKKLARNYMKEDTKHIAIKKSSLTVSKIEQFYFEIKHRDRFETLCRVLDFDEPNAAIIFCKTKKGVDEVVEKMQARGYMVEGMHGDMSQNHRLQTLRKFKEGSLDFLVATDVAARGIDVESVTHVINYDLPQDNESYVHRIGRTGRANREGVAYSLVTPKEYMMLKQIQKHTKSKIIRKAVPTVDEIFQNKHNNIINNVKSTIEEASEDFQKFIPIATQLDEDYSLVDVAAALLKIVFDKESSFDYTSNSIEAPVMDETRLFMSVGRRDGITPKSLVNFLKETARISPKQVGDIDIKENFCFANVDADAVNNIMKKSMGKKLNKRTVNIEVAKKRK

SEQ ID NO: 38539 - DNA, 1989 bp, Schizosaccharomyces pombe
  CDS (1)..(1989)
atgacagcgcaagactctataccttcgctggagcagcttgttcagcaaaaaagagttaaggaagagaaggcggcgagaccaaagtttttatccaaagctgaaagagctcgattggcccttgaaagacgacaaaaagaggttgaagaagcgaaagcaaaacagaatgacaaattattagatttaagaaaaaggacttttaccaatcatttagaaaataatgaattagcagatgatgaaaaaaaatcccaggtatcctctgtatctagcaataacagtggcacagagagctccgcaacggacgaagcattcagcatgaccattcgtcaaaggtacatgggtataaagcctcctgtggtaaaaaaaagaagaagaaatgctgataaaaaatttgtatttgattgggacgccacagacgataccatgaaggatgcggaaacctcggcatcacctgaggctacaattgctgtatttggaagggggaaattaggcggatttgatgaccagtcgattcgaaaagcgaaaagtaattctggtttgattcagcgtttgcttcaaggaacggagcaggataaggctcgcgcacacgagttgattcagcttcaagaaaaacgagccaaaaaaatagattgggacgatgtgccatggagggaaaagccattggaagccatgaaacccagagactggagaatcctcaaggaagattataatatatccattaaaggggatgatttaccaaatcctttaagaaattgggaagaagcaggcttaccaagtgagatgcttaaagttttgaagaaagttaactataaagaaccaagttctattcaaagggcagccatacctgttttactacagcgtaaagatttaattggaattgccgaaactggtagtggtaagactgccgcctttataatccctctcataattgccatatcaaaattgcccccattaaccgaatcaaacatgcatcttggcccatatgctgtagttttagcaccaacacgtgaattggcccagcaaattcaagtggaaggcaacaagtttgcggaacctttgggtttccggtgtgtttctgtcgttggtggtcatgcttttgaagagcaatcatttcaaatgagtcaaggtgctcatatagttgtagctactcctggtcgtcttcttgattgtcttgaaagacggctatttgttctcagccaatgcacttatgttgtaatggacgaggcggataggatgcttgacatgggatttgaagatgatgttaataaaattttgtcatcactcccttcctcaaatgcttctgaaaaggatgggtcaattcttgctactgcaaattcctcttcgtcaagacgtcaaaccattatgttcagtgcgaccttacccccacgtgttgctaatttggcaaagagctatttaattgaaccagtgatgttaactattggaaacattggccaggcagttgaccgcgttgaacagcgtgttgagatgatatctgacgatagcaaaaaatggagaagagttgaggagattttggaatctaatcgattttcacctcctattatcatatttgtaaatctcaagcgtaatatcgaggctattgcgaagcaattaaatgccattggttggcatgctgttactcttcatggcagtaaaagtcaagaacagagagagcgagctatcgaacagttaaggaataagacggctgatattcttgttgcaactgacattgcaggtcgtggtattgatatacctaatgtctctttggtattgaattacaacatggctaaaagcattgaagactatacccatagaattggtcgtacaggtcgtgcaggaaaatctggtacagcaataacgtttttgggaccagaggatactgatgtatattatgatttacgcgtgttattaagccgaagcgcgaaagcacatattcctgatgaattacggaatcatgaagcagcatttgttagacatgcagcaatcacccagtaa

SEQ ID NO: 38540 - protein, 662 aa, Schizosaccharomyces pombe
MTAQDSIPSLEQLVQQKRVKEEKAARPKFLSKAERARLALERRQKEVEEAKAKQNDKLLDLRKRTFTNHLENNELADDEKKSQVSSVSSNNSGTESSATDEAFSMTIRQRYMGIKPPVVKKRRRNADKKFVFDWDATDDTMKDAETSASPEATIAVFGRGKLGGFDDQSIRKAKSNSGLIQRLLQGTEQDKARAHELIQLQEKRAKKIDWDDVPWREKPLEAMKPRDWRILKEDYNISIKGDDLPNPLRNWEEAGLPSEMLKVLKKVNYKEPSSIQRAAIPVLLQRKDLIGIAETGSGKTAAFIIPLIIAISKLPPLTESNMHLGPYAVVLAPTRELAQQIQVEGNKFAEPLGFRCVSVVGGHAFEEQSFQMSQGAHIVVATPGRLLDCLERRLFVLSQCTYVVMDEADRMLDMGFEDDVNKILSSLPSSNASEKDGSILATANSSSSRRQTIMFSATLPPRVANLAKSYLIEPVMLTIGNIGQAVDRVEQRVEMISDDSKKWRRVEEILESNRFSPPIIIFVNLKRNIEAIAKQLNAIGWHAVTLHGSKSQEQRERAIEQLRNKTADILVATDIAGRGIDIPNVSLVLNYNMAKSIEDYTHRIGRTGRAGKSGTAITFLGPEDTDVYYDLRVLLSRSAKAHIPDELRNHEAAFVRHAAITQ

SEQ ID NO: 38541 - DNA, 1398 bp, Schizosaccharomyces pombe
  CDS (1)..(1398)
atggcaccttctgagaaaaaacttactgaggataaaaaaaattcctcattgaataaaaagattgaaacatctaattcaagctctgaaaaatcttcggaaaataataatggtgactcacaaaacaacgaagcccctaaaacttttaaggaattaggagtaattgacgaattatgcgaagcttgtgaaaaactgggatttaaaactccaactccgattcaacaagaagccattccagttgtattgaataaacgagatgttataggtctagctcaaactggtagtggtaaaactgcagcatttgcgctgcctgtcattcaagaattgtggaacaatccgagcccattttttgcagtcgtgcttgctccaactcgagaacttgcctatcaaatatctgaacaattcgaggctataggaggtagtatcggcgttcgcagtgttgtaattgttggtggtatggatatggtaactcaagcagtcgctttatcaaaaaagcctcatgtcctagtttgtacacccggacgtctgatggatcatttggagaacacgaaaggttttagtttaaagaatttgaaatatttaatcatggatgaagccgatcgtcttcttgatatggattttggtccaattattgataaaattcttaaaattattcctcatgaaagacgtactttgttattttctgctactatgactagcaaggttgaaaagcttcagcgtgcatcccttcaccaacccgtgcgtgttgctgtatcttccaagtttagtaccgtcgataccctaatacaacggtatttgttttttccatttaaacacaaggacacgtatctcgtttacttggtaaatgaacttgccggcaattcaattatcatattcgctcgtacagtaaacgatactcaacggttggccatattattacgtaccttaggattttctgctattcctttacatggacagttgtctcaaagtaatcgtcttggggctttaaataaatttaagtcaggtgcgagatctactcttgttgcaactgatgtcgctgccagaggtctagatatacctcttgttgatgtagtaattaattacgacattcctaccgactcaaaggcatatattcatagagttggtcgtaccgctcgagcaggtcgggcaggtaaatctattgcattggttactcagtatgatttagaaccttttcttcgaattgaagctacaattggcaaaaaaatgcaggaatatgaaattgacaaggagggtgtatttcttttatctgaacgtgttggagaagctcaacgtgaagctattattcaaatgaaggagattcacgataggagaaaatcaaagggaaaattgcacacgaagcgcaaacgtgatgatcttgatcgtgaagaacaaatctattaa

SEQ ID NO: 38542 - protein, 465 aa, Schizosaccharomyces pombe
MAPSEKKLTEDKKNSSLNKKIETSNSSSEKSSENNNGDSQNNEAPKTFKELGVIDELCEACEKLGFKTPTPIQQEAIPVVLNKRDVIGLAQTGSGKTAAFALPVIQELWNNPSPFFAVVLAPTRELAYQISEQFEAIGGSIGVRSVVIVGGMDMVTQAVALSKKPHVLVCTPGRLMDHLENTKGFSLKNLKYLIMDEADRLLDMDFGPIIDKILKIIPHERRTLLFSATMTSKVEKLQRASLHQPVRVAVSSKFSTVDTLIQRYLFFPFKHKDTYLVYLVNELAGNSIIIFARTVNDTQRLAILLRTLGFSAIPLHGQLSQSNRLGALNKFKSGARSTLVATDVAARGLDIPLVDVVINYDIPTDSKAYIHRVGRTARAGRAGKSIALVTQYDLEPFLRIEATIGKKMQEYEIDKEGVFLLSERVGEAQREAIIQMKEIHDRRKSKGKLHTKRKRDDLDREEQIY

SEQ ID NO: 38543 - DNA, 1362 bp, Schizosaccharomyces pombe
  CDS (1)..(1362)
atgtcagaacatacaagaaaatcattctctgatttaggaatatcgccatggcttatcgatacgctaaaagcacttgcaatatatgaacctacagatattcaggaaggagtaattgctcagattttagaaggacgtaattgtattggaggtgctaaaacaggttctggtaaaactgctgcttttgctttgcctattattgaaaaatggtctaaggatccatcaggaatatttgctcttattttgacaccaaccagagaacttgcaatacagattgatgaacaatttgctgctttaggtgctaatcttaatttaaagcatgcgctcatcgttggaggcatggatatgatacgacaatctattgatttatcgaaacggccccatgttgttgtagctactcctggtcgcctagctgacttgattagaagtaatggtgaagaaacgatagccggactacgtcgaataaaatttttggtaatggacgaagccgaccgtttgttgtctcctacctttgctgatgacttggatgattgcttttctgttcttccagcctctgaagatcgtcaaacgcttttgtttactgcaactgttactgatgctattcgtcagctcaaatatcagccacagaaaaataataagcctcccctttggttatacgaagttgaaactgataacatttccgtaccttctactttgcagcaaagttacatatttgtttcctcacaagtacgagaagcttatttggtgcatttgttaacgattcctgagaacgctaaaaagtctgcaattatctttgtaaatcggactcgcactgctgaattgatatattctattcttcgattgctcgagcttcgtgtcaccgaacttcattcagaaatggtacaacgtgaaaggatcaattcacttggacggtttcgtgcggaagctgcaaaaattttggtagccactgacgttgcaagcagaggtttggatattccttctgtgcaactagtaattaacttcgaccttcctcgtgacccagacgactatattcaccgagtaggtcgtacagctcgtgctggacgcagtggcgagtccatttccattgtaacggagagagatgttgatttagtccatgctattgaggatcgagtaggaactaagctttctgaatatgaacacgtgtcagagaataagatgcttgaatacatcaaggaagttacggacgctaaacgccaggcttctcttgagatgatcgataggggatttggtgaaaggagacagaagcgaaacgagaaaaggctgatggccaatggtatttctaataaattaaaaaattctggacgcaaaaagaaagcgaagaatactttatctacggaaaagtag

SEQ ID NO: 38544 - protein, 453 aa, Schizosaccharomyces pombe
MSEHTRKSFSDLGISPWLIDTLKALAIYEPTDIQEGVIAQILEGRNCIGGAKTGSGKTAAFALPIIEKWSKDPSGIFALILTPTRELAIQIDEQFAALGANLNLKHALIVGGMDMIRQSIDLSKRPHVVVATPGRLADLIRSNGEETIAGLRRIKFLVMDEADRLLSPTFADDLDDCFSVLPASEDRQTLLFTATVTDAIRQLKYQPQKNNKPPLWLYEVETDNISVPSTLQQSYIFVSSQVREAYLVHLLTIPENAKKSAIIFVNRTRTAELIYSILRLLELRVTELHSEMVQRERINSLGRFRAEAAKILVATDVASRGLDIPSVQLVINFDLPRDPDDYIHRVGRTARAGRSGESISIVTERDVDLVHAIEDRVGTKLSEYEHVSENKMLEYIKEVTDAKRQASLEMIDRGFGERRQKRNEKRLMANGISNKLKNSGRKKKAKNTLSTEK

SEQ ID NO: 38545 - DNA, 1275 bp, Corynebacterium glutamicum ATCC 13032
  CDS (1)..(1275)
gtgtcttctgaaagccccagacctacgttcacagagctcggcgttgcggtggaaatcaccgacgcactcgaagccctcggcatcaaccgaactttcgcgatccaggagtacacacttcccatcgcgctcgacggccacgacttcatcggccaagcccgcaccggcatgggcaaaacctacggattcggtgtcccactcctcgatagagtcttcgactcagccgacgtcgcagaaaccgacggtaccccccgagccctcgtcatcgtgcccacccgagaactcgcagtccaagtcggcgacgacctccaacgcgcagcaaccaacctgccgctaaagatcttcaccttctacggcggcaccccctacgaagaacagatcgacgcactcaaagtcggcgtcgacgttgtcgtaggcacacccggacgattactcgacctgcacaaacgaggcgcgctatcgctcgacaaagtagcgatcttagtcctcgatgaagccgacgaaatgctcgatctgggctttctgcccgacatcgaaaaaatcctccgtgccctcacccaccagcatcaaaccatgctgttctctgccacgatgcccggcgcgatcctcacactcgcacgcagcttcctgaacaaaccagtgcacatccgagccgagacatcggacgcctcagcaacacacaaaaccaccagacaagtggtttttcaggcacacaaaatggacaaggaagccatcaccgcgaaaattctgcagtcgaaagatcgcggcaaaacgatcatcttcgcccgcacgaaacgcaccgcagcgcaagttgccgaagacctagcctccagaggattctccgtcggatcagtgcacggcgacatgggccaaccagcccgcgagaaatcactcaacgcattccgcacaggaaaaattgacatccttgtagccacagacgtagccgcccgaggcatcgatgttgatgacgtcacccacgtcatcaactaccaaacccccgacgatcctatgacctacgtccatcgtatcggacgcacgggacgcgcagggcacaacggaacagccgtcactcttgtcggctacgacgaaaccctcaaatggactgtcatcgacaacgaactcgaactcggccaaccaaacccaccacaatggttctccacctcaccagagctgcttgaaacactcgacatcccagaaggtgtcaccgaacgagtcggaccaccaaccaaagttctaggcggaacagccccacgaccaccacgccgcacccggaaataa

SEQ ID NO: 38546 - protein, 424 aa, Corynebacterium glutamicum ATCC 13032
MSSESPRPTFTELGVAVEITDALEALGINRTFAIQEYTLPIALDGHDFIGQARTGMGKTYGFGVPLLDRVFDSADVAETDGTPRALVIVPTRELAVQVGDDLQRAATNLPLKIFTFYGGTPYEEQIDALKVGVDVVVGTPGRLLDLHKRGALSLDKVAILVLDEADEMLDLGFLPDIEKILRALTHQHQTMLFSATMPGAILTLARSFLNKPVHIRAETSDASATHKTTRQVVFQAHKMDKEAITAKILQSKDRGKTIIFARTKRTAAQVAEDLASRGFSVGSVHGDMGQPAREKSLNAFRTGKIDILVATDVAARGIDVDDVTHVINYQTPDDPMTYVHRIGRTGRAGHNGTAVTLVGYDETLKWTVIDNELELGQPNPPQWFSTSPELLETLDIPEGVTERVGPPTKVLGGTAPRPPRRTRK

SEQ ID NO: 38547 - DNA, 2199 bp, Corynebacterium glutamicum ATCC 13032
  CDS (1)..(2199)
atgagtaataccgagaacgtcaacggcgacgtagaacagccgaataacgtcatttcgtcggaatctcaggaaaccccgcagggtgactcagcatcagctgacttcgctctcgaaaccccaaccaacactgttgaagatgcaccagcatctgagggtagcgaagagatcaccagggttgcggatacttctgaggacgccgactctgcagatgcagacaacgcgagcaatgtaatcaatgagaatgaggactcctcggaaggtgctaaccagccttcaaacgagtcatcctctacggaagccaaatccggcttcgatgcactcggactgccagagcgtgttcttgacgctgtgcgcaaggtgggttacgaaactccttccccaattcaggcacaaaccatcccaatcctcatggagggccaggatgttgttggtctagcacagaccggtaccggtaagactgcagctttcgcgctgccaatccttgcccgtattgacaagtccgtgcgcagcccacaggcacttgtgcttgcccctacccgtgagctggcacttcaggttgctgactccttccaatccttcgctgaccacgtcggtggcctgaacgttctgccaatctatggtggacaggcttacggcattcagctctctggcctgcgtcgtggcgctcacatcgtcgtgggtaccccaggccgaatcatcgatcacctcgaaaagggctccctggatatctccggactgcgcttcctcgtgctcgatgaagcagacgagatgctgaacatgggcttccaggaagatgtcgagcgcatcctcgaggacaccccagacgagaagcaggttgcactattctccgcaacgatgccaaacggcattcgtcgcctgtccaagcagtacctgaacaaccctgctgaaatcaccgttaagtccgagaccaggactaacaccaacatcacccagcgcttcctcaacgttgcacaccgcaacaagatggatgcactgacccgtattctcgaggtcaccgagtttgaagcaatgatcatgttcgtgcgcaccaagcacgaaactgaagaagttgctgaaaagctccgtgcacgcggattctccgcagcagccatcaacggcgacattgctcaggcacagcgtgagcgcaccgtcgaccagctgaaggacggccgcctggacatcctcgttgcaaccgacgttgcagcccgtggtcttgacgttgagcgcatctcccacgtgcttaacttcgacattccaaacgacaccgagtcctacgttcaccgcatcggccgcaccggccgtgcaggacgtaccggcgaggcaatcctgttcgtgaccccacgtgagcgtcgtatgcttcgctccatcgagcgcgcaaccaacgcaccactgcacgaaatggaactgccaaccgtcgatcaggtcaacgacttccgcaaggtcaagttcgctgactccatcaccaagtccctcgaggacaagcagatggacctgttccgcaccctggtcaaggaatactcccaggccaacgacgttcctctagaggacatcgcagcggcactggcaacccaggcacagtccggcgacttcctgctcaaggagctcccaccagagcgccgtgagcgcaacgaccgccgtcgtgaccgtgacttcgacgaccgtggtggacgtggacgcgaccgtgaccgtggcgaccgcggagatcgtggctcacgcttcgaccgcgacgacgagaacctggcaacctaccgcctcgcagtgggcaagcgccagcacatccgcccaggcgcaatcgttggtgcacttgccaacgaaggtggcctgaactccaaggacttcggccgcatcaccatcgcagccgaccacaccctggttgaactgccaaaggatctcccacagagcgttcttgacaacctgcgcgacacccgcatctccggccagctcatcaacatagaacgcgactccggtggacgcccaccacgccgcttcgagcgcgatgaccgtggcggacgcggcggattccgcggcgaccgtgatgaccgcggtggacgtggacgtgaccgtgacgatcgtggaagccgtggaggtttccgcggtggacgtgaccgtgatgatcgtggcggacgcggtggattccgcggacgcgacgaccgcggagaccgtggtggccgtggcggttaccgtggcggacgcgactaa

SEQ ID NO: 38548 - protein, 732 aa, Corynebacterium glutamicum ATCC 13032
MSNTENVNGDVEQPNNVISSESQETPQGDSASADFALETPTNTVEDAPASEGSEEITRVADTSEDADSADADNASNVINENEDSSEGANQPSNESSSTEAKSGFDALGLPERVLDAVRKVGYETPSPIQAQTIPILMEGQDVVGLAQTGTGKTAAFALPILARIDKSVRSPQALVLAPTRELALQVADSFQSFADHVGGLNVLPIYGGQAYGIQLSGLRRGAHIVVGTPGRIIDHLEKGSLDISGLRFLVLDEADEMLNMGFQEDVERILEDTPDEKQVALFSATMPNGIRRLSKQYLNNPAEITVKSETRTNTNITQRFLNVAHRNKMDALTRILEVTEFEAMIMFVRTKHETEEVAEKLRARGFSAAAINGDIAQAQRERTVDQLKDGRLDILVATDVAARGLDVERISHVLNFDIPNDTESYVHRIGRTGRAGRTGEAILFVTPRERRMLRSIERATNAPLHEMELPTVDQVNDFRKVKFADSITKSLEDKQMDLFRTLVKEYSQANDVPLEDIAAALATQAQSGDFLLKELPPERRERNDRRRDRDFDDRGGRGRDRDRGDRGDRGSRFDRDDENLATYRLAVGKRQHIRPGAIVGALANEGGLNSKDFGRITIAADHTLVELPKDLPQSVLDNLRDTRISGQLINIERDSGGRPPRRFERDDRGGRGGFRGDRDDRGGRGRDRDDRGSRGGFRGGRDRDDRGGRGGFRGRDDRGDRGGRGGYRGGRD

SEQ ID NO: 38549 - DNA, 1668 bp, Methanosarcina acetivorans C2A
  CDS (1)..(1668)
atggaaaaattagcaaaatttaaggcgcttgggctctcggacagtacattgaaagccctcaaaaagaaaggtttcgaagaaccaaccccgattcaggaaaaagtcatccctctttttttgaaaggagaatctgatattataggacaggctcagacaggaacaggaaaaacaaccgctttcggagcccccattatagaaaaaatccctgaaaaatcaggatacgttcaggcaataatcctgactcctacaagggaacttgcaattcaggtttcagaggagctcaactccataaaaggagacaaaaagcttcacgtcgtgccgatttacggcgggcagtccatgacccagcagctccgcgtactgaagagcggagtggacattgtcgtagggacccccggaaggatcatcgatcacctcgaaagaaagagcctggacctcgaacatatcgcgtatttcgtacttgacgaagctgacgaaatgctgaacatgggtttcattgacgatattaaggaaatcttaaaggcaacaggtcctgataaaaggatgctcttcttttcagccacaatgccaaagccaattcttggaatcgtcaagaagtatatgcagaactacgagcatgttacaattgagaaagaggagcttgcagcaaagctgaccgaacagatctatttcgaggttcaggaaaacgacaagtttgaagctctcagcagaatcatcgatatcgaagacgaattctacgggctcgttttctgccggacaaagaccgacaccggccagcttgcccagaaactcagcgacagaggctatgaagccgatgccctgcacggagacctctcccagcaggaaagggaaaaaatcctgaacaagttcaggaagcagaagataaacgttcttgtcgcaaccgatgttgcagcaagaggtatcgatatcatggatctgacccatgttatcaactattccctgccccaggaccctgagtcttacgtgcacaggataggaaggaccggaagggcaggcaaacagggaactgctatcacctttgttacatccaccgagttcaggcggctcacttacataaaaaagacctcaaagtccgaaatgaagaaaggtcgcatccccgaaataaaagatgtaattaaagccaaaagggcgagagtaaaagccgaactcgaagagaccataaagacagaagaatacggggactgcctcgaaatgagtgaaaggctccttgaggaataccccgcagagaaaatcctggctgcccttttgaaatacactttcaaagaaaagttcgacgaaagtatgtatacggagatttccagccccagctcctatgtcgacaggaaaggaaaaaccaggctcttcatagccatgggaaaagccgatggcatgagtccggaaaaactttcatactttattcaggaagaacttggagacagcgaacttaaagtgagggatgcagagattttccctcacttctcctttgtaaccctgccctttgcccaggctgaagctctgctcgaaatctttaaaaacaaaagaagaggcagaaaaccctttgtggaacttgcccagaaatcaaaaggaagaagcctaaaaggttctaacaacgggcgtagcaacggcagaccaagaaatcccagcagaccaagaaatacgaaaaaataa

SEQ ID NO: 38550 - protein, 555 aa, Methanosarcina acetivorans C2A
MEKLAKFKALGLSDSTLKALKKKGFEEPTPIQEKVIPLFLKGESDIIGQAQTGTGKTTAFGAPIIEKIPEKSGYVQAIILTPTRELAIQVSEELNSIKGDKKLHVVPIYGGQSMTQQLRVLKSGVDIVVGTPGRIIDHLERKSLDLEHIAYFVLDEADEMLNMGFIDDIKEILKATGPDKRMLFFSATMPKPILGIVKKYMQNYEHVTIEKEELAAKLTEQIYFEVQENDKFEALSRIIDIEDEFYGLVFCRTKTDTGQLAQKLSDRGYEADALHGDLSQQEREKILNKFRKQKINVLVATDVAARGIDIMDLTHVINYSLPQDPESYVHRIGRTGRAGKQGTAITFVTSTEFRRLTYIKKTSKSEMKKGRIPEIKDVIKAKRARVKAELEETIKTEEYGDCLEMSERLLEEYPAEKILAALLKYTFKEKFDESMYTEISSPSSYVDRKGKTRLFIAMGKADGMSPEKLSYFIQEELGDSELKVRDAEIFPHFSFVTLPFAQAEALLEIFKNKRRGRKPFVELAQKSKGRSLKGSNNGRSNGRPRNPSRPRNTKK

SEQ ID NO: 38551 - DNA, 1764 bp, Methanosarcina mazei Go1
  CDS (1)..(1764)
atggaaaaattagcaaaatttaaggcacttgggctctcggacagtacattgaaagccctcaaaaagaaaggtttcgaagaaccaaccccgattcaggaaaaagtcattccgctttttttgaaaggagaagcagacattatagggcaggcccagacaggaacaggaaaaacgacagccttcggagcccccatcatagagaaaattcctgagaaatcaggacacgttcaggcaataatcctgacccctacaagggaactcgcaattcaggtttcagaagaacttaactccataaaaggagacaagaaactatacattgtccctatatatggaggacagtccatgacccagcagcttcgcgtgctgaagagcggcgtggacattgttgtaggaactcctggaagggtcatcgaccacctcgaaagaaagagcctcaacctcgaacatatcgcatatttcgttcttgacgaagccgatgaaatgctgaacatgggctttattgacgacataaaagagatcttaaaatcaaccggcccgaataagaggatgcttttcttttcagccacaatgccaaaggcaattcttggaatcgtcaagaagcatatgcagaactatgagcacattacaatcgaaaaagaggaacttacagaaaccctgaccgaacagatctattttgaggtcaaggaaagcgacaagttcgaagctctctgcaggattatcgacattgaagacgaattctacgggctcgtgttctgccggacaaaaactgacacaagccagcttgcccagaaactcagcgacaggggttatttagccgatgccctgcacggagacctttcccagcaggagagagaaaagatccttaacaagttcaggaagcagaagataaacatccttgcagcaaccgacgtcgccgcaagaggcatcgacattatggacctgacccacgtcatcaactatgccctgccccaggacccggagtcctatgtgcacaggataggaaggacaggaagggcaggcaagcagggaactgccattacttttgtcacatccacggaattcagaaggcttacttacattaaaaagacttcaaagtccgaaatgaagaaaggccacattcccgaaataaaagatgtaattaaagccaaaagggccagagtaagaacagaactcgaagagaccataaagacggaagagtacggggactgccttgagatgagccagaagctccttgaagaataccctgcagaaaaaattctggctgcccttttgaagttcaccttcaaagacaagttcgatgaaagcatgtacactgaaatctccagcggcagctcctatgtcgacaggaaaggcaaatccaggctcttcatagctatgggtaaagcagacggcatgactccggacaaattgtcgtatttcattcaggaagaactcggggacggcgaactcaaagtaagggatgcagaaattttcccgcatttctcctttgtaactctgccatttgctcaggctgaaaccctgatcgaaatattcaaaaacaaaaggagaggaagcaaacccttcgtggaactcgcccagaaatccaggggaagaagctcaaaggattcaggggagaccagaagcgataatcgaggcacttctagaggcaattccagaaacggtgaatccagaggggattctagaggcgaatctcgcggcacaaaaagcacaaattactcaagaagtaccagaagtacaagaagcacgaaaaagaaagactcttattaa

SEQ ID NO: 38552 - protein, 587 aa, Methanosarcina mazei Go1
MEKLAKFKALGLSDSTLKALKKKGFEEPTPIQEKVIPLFLKGEADIIGQAQTGTGKTTAFGAPIIEKIPEKSGHVQAIILTPTRELAIQVSEELNSIKGDKKLYIVPIYGGQSMTQQLRVLKSGVDIVVGTPGRVIDHLERKSLNLEHIAYFVLDEADEMLNMGFIDDIKEILKSTGPNKRMLFFSATMPKAILGIVKKHMQNYEHITIEKEELTETLTEQIYFEVKESDKFEALCRIIDIEDEFYGLVFCRTKTDTSQLAQKLSDRGYLADALHGDLSQQEREKILNKFRKQKINILAATDVAARGIDIMDLTHVINYALPQDPESYVHRIGRTGRAGKQGTAITFVTSTEFRRLTYIKKTSKSEMKKGHIPEIKDVIKAKRARVRTELEETIKTEEYGDCLEMSQKLLEEYPAEKILAALLKFTFKDKFDESMYTEISSGSSYVDRKGKSRLFIAMGKADGMTPDKLSYFIQEELGDGELKVRDAEIFPHFSFVTLPFAQAETLIEIFKNKRRGSKPFVELAQKSRGRSSKDSGETRSDNRGTSRGNSRNGESRGDSRGESRGTKSTNYSRSTRSTRSTKKKDSY

SEQ ID NO: 38553 - DNA, 1290 bp, Methanosarcina mazei Go1
  CDS (1)..(1290)
ttgtttttaatatatcttaaatatatgaatatgaaaaagcaattaagtagctttttcagaaaaatcatggaaagtctaactatgaataattttaaaaaactaggtctcagtaatgctgttttgaaatcaatagatgaacatggctttgaaagccctacagcaatacaggaaaaatcaattcccctaatacttgctggggaagatgttataggcggagccgcaacaggttccggaaaaacactctcatttgcttccggcatattacaaaattccgaaaaaggaaaaggaattcaggctttgatcctgacccctacaagagaactggcggagcaggtagcaaattctttaaggaaattctcaaaatacgacccgttaaatatcgcatctatctatggcggtgtagggatcaatacacaaattaaagaattaaaaaatgccgaggttgttgtgggaacacccggtaggctactcgatcatatcagcagaaatactatcaaactcaataatgtgaaaacccttgtccttgatgaggcagaccatatgtttgatatgggattcaaagtggatgtagaaaaaattatcaaggaatgtcctcaaaacaggcagacccttttgttctctgcgaccattacaaaagatattgtccggctttcccgcaagtacatggaaaatccggttcgagtatcaacagagtcttatatcgacccgcaaaaattgaatcaggtcgtttataaagtacaggatgacatgaaattatctctgctcgtgtaccttctacaaaatgagaagtcaaacctcggtatggttttctgcaacacaaaaagaaacactgacaaagtcgcaaaaaacctgagaaaatcaagtatcaatgccgtggcaattcatggaggattgacacagaacgaacgaactcgcatactggaaaaattccattccgggaacataggtgtccttgtatgcacagatgtagccggaagagggcttgatatacagggtgtttcccatgtttacaattatgatattcccagggagagtaaacagtatattcacaggattggaagaactgcacgagcaggaacagaaggaaaagcgataaatatcctttccaaaaatgaccatgctaatttcatgagtgtgctgaaagacaatgatgtggatattaaggaacaggcactacctgctctgaagaagattgtaattgaaagaccggatataaggttgccaaagccggtaaataggatgaacaacccctccagaaaaggtcgtaaacccaggcacaaaaactgttag

SEQ ID NO: 38554 - protein, 429 aa, Methanosarcina mazei Go1
MFLIYLKYMNMKKQLSSFFRKIMESLTMNNFKKLGLSNAVLKSIDEHGFESPTAIQEKSIPLILAGEDVIGGAATGSGKTLSFASGILQNSEKGKGIQALILTPTRELAEQVANSLRKFSKYDPLNIASIYGGVGINTQIKELKNAEVVVGTPGRLLDHISRNTIKLNNVKTLVLDEADHMFDMGFKVDVEKIIKECPQNRQTLLFSATITKDIVRLSRKYMENPVRVSTESYIDPQKLNQVVYKVQDDMKLSLLVYLLQNEKSNLGMVFCNTKRNTDKVAKNLRKSSINAVAIHGGLTQNERTRILEKFHSGNIGVLVCTDVAGRGLDIQGVSHVYNYDIPRESKQYIHRIGRTARAGTEGKAINILSKNDHANFMSVLKDNDVDIKEQALPALKKIVIERPDIRLPKPVNRMNNPSRKGRKPRHKNC

SEQ ID NO: 38555 - DNA, 1293 bp, Xanthomonas campestris pv. campestris str. ATCC 33913
  CDS (1)..(1293)
atgtcactgaaagcagatttgctgtcgctacagctacagcccgtgttcgagtccgcgctcgccagggccggtgtgcgtgcgctcacgccgatccaggtcgcgatgattccgccgatgctggccgcacgcgacctgatcgccaccgcgcagaccggctcgggcaagaccctggcgtatgccttgccgctgctgcagcagcgcctgcaggcgccggaacaggcgccgcgcgtgctgggcgggctgatcctggtaccgacgcgtgagctggtcgcgcaggtcgcgcacaccctgctgtcgctggccgccgccttgccgcgacggctgaagatcgtcgccgccaccggcggtgaagccatcaatccgcagctgatggccttgcgcggtggcgccgacatcgtcatcgccaccccggggcggctgctggacctggtgacgcacaatgcgctgcgcctctcgcaggtaagcacgctggtgctggacgaagccgatcgcctgctcgacctgggctttggcgccgagctcgatcgcatcctggccttgctgcctgcccagcggcaaagcgtgctggtctcggccaccttcccagccgccatcgcgtcgctggccaagcgtcgcctgcgcgatccgttgcgcatcaccctcggcggcacgcccgaacaggcaccggcgatcgcgcaacgcgccatcgcagtggatgccggccaacgtacgcagctgctgcgccacctgctgctggaacacggatggccgcaactgctggtcttcgtcaccagccgccacggcgccgacaaggttgccgagaaactgagcaagaccggcatcgccgccttgccgctgcacggcgaattgagccagggccgccgcgaacgcacgctgcgcgccttcaaacaggcggacgtgcaggtgctggtggccaccgacctggccgggcgcggcatcgacatcgacgccttgccggccgtgctcaattacgacctgccccgctccactgtcgactacacccaccgcatcggccgcaccgcacgcgccggtgccagcggcgtggcgatcagcttcgtcacggcagacagcgcccagcagtggcggctgatcgaaaaacgccagggcctgcgcgtgccgaccagcgtgatcgaagggttcgagccaactccggtccaggcgcctgcccccgaccatgcgtccggcgcagcggcgcgtgcagcggatgacaacggcggcatcaagggcaagcggccgagcaagaaggacaaattacgtgccgcggcgcaggcgcaggctggcaagccgggctga

SEQ ID NO: 38556 - protein, 430 aa, Xanthomonas campestris pv. campestris str. ATCC 33913
MSLKADLLSLQLQPVFESALARAGVRALTPIQVAMIPPMLAARDLIATAQTGSGKTLAYALPLLQQRLQAPEQAPRVLGGLILVPTRELVAQVAHTLLSLAAALPRRLKIVAATGGEAINPQLMALRGGADIVIATPGRLLDLVTHNALRLSQVSTLVLDEADRLLDLGFGAELDRILALLPAQRQSVLVSATFPAAIASLAKRRLRDPLRITLGGTPEQAPAIAQRAIAVDAGQRTQLLRHLLLEHGWPQLLVFVTSRHGADKVAEKLSKTGIAALPLHGELSQGRRERTLRAFKQADVQVLVATDLAGRGIDIDALPAVLNYDLPRSTVDYTHRIGRTARAGASGVAISFVTADSAQQWRLIEKRQGLRVPTSVIEGFEPTPVQAPAPDHASGAAARAADDNGGIKGKRPSKKDKLRAAAQAQAGKPG

SEQ ID NO: 38557 - DNA, 1377 bp, Xanthomonas campestris pv. campestris str. ATCC 33913
  CDS (1)..(1377)
atgaacgaattctccgcgctgccgctctcgccagccttggcccccggcatcgatgccctgggctacaccaccctcacgccgatccaggcgcagagcctgccgccgatcctccaggggctggatgtgattgcccaagcgcccaccggcagcggcaagaccgccgcgttcgggctgggcctgctgcaaaagctcgacccggcactgacccgtgcgcaagcgctcgtgctgtgccccacgcgcgaactggcagaccaggtcggcaagcaactgcgcaagctggccaccggcattcccaacatgaagttgctggtgctcaccggcggcatgccgcttggtccgcagctggcatcgctcgaagcgcacgacccgcaggtcgtggtcggcacgcccggccgcatccaggaactggcgcgcaaacgcgccctgcatctgggcggcgtgcgcacgctggtgctggacgaggccgaccgcatgctcgacatgggctttgaagaacccatccgcgagatcgccagccgctgcgacaaacaccgccagagcctgctgttctcggcgaccttccccgacatcatccgcacgctggcgcgcgagctgttgaaggacccggtggaaatcaccgtggaaggtgcggacaacgcaccggagatcgaccagcagttcttcgaagtggaccccacttatcggcagaaggcggtggccgggctgctgctgcgcttcaatcccgaatccagcgtggtgttctgcaatacccgcaaggaagtggacgaagtcgccggctcgctgcaggagttcgggttctccgcgctggcattgcatggcgacatggagcaacgcgaccgcgacgaggtgctggtgcgcttcgtcaatcgcagctgcaacgtactggttgccagtgacgtggccgcgcgcggcctggatgtggaagacctcgcggcagtggtgaattacgagcttcccaccgacaccgaaacctatcgccaccgcatcggccggactgcgcgcgccggcaagcacggcttggcactcagcctggtggcgccgcgcgaaagcgctcgtgcgcaggcgctggaggccgagcacggccagccgctcaagtggtcacgcgcaccgctggccaccgcacgcccggcgcaattgccgctggccgcgatgaccacgctgcgcatcgacggcggcaagaccgacaaactgcgtgccggcgacattctgggcgcattgaccggcgaagcaggcttgtcgggtgcggcgatcggcaagatcgccatctaccccacccgctcgtacgtggcgattgcgcgggcgcaggtcgctcgtgcactgacccacttgcaggccggcaagatcaagggccgccgcttccgggtgaccaagctctag

SEQ ID NO: 38558 - protein, 458 aa, Xanthomonas campestris pv. campestris str. ATCC 33913
MNEFSALPLSPALAPGIDALGYTTLTPIQAQSLPPILQGLDVIAQAPTGSGKTAAFGLGLLQKLDPALTRAQALVLCPTRELADQVGKQLRKLATGIPNMKLLVLTGGMPLGPQLASLEAHDPQVVVGTPGRIQELARKRALHLGGVRTLVLDEADRMLDMGFEEPIREIASRCDKHRQSLLFSATFPDIIRTLARELLKDPVEITVEGADNAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLAAVVNYELPTDTETYRHRIGRTARAGKHGLALSLVAPRESARAQALEAEHGQPLKWSRAPLATARPAQLPLAAMTTLRIDGGKTDKLRAGDILGALTGEAGLSGAAIGKIAIYPTRSYVAIARAQVARALTHLQAGKIKGRRFRVTKL

SEQ ID NO: 38559 - DNA, 1293 bp, Xanthomonas axonopodis pv. citri str. 306
  CDS (1)..(1293)
atgtcattttccgatctctcgctgtcgccgcagctgcagccgttcttcgataccgcgctggccaaggccggtctgcgcacacccacgcccatccagcagcaggcgatcccgccgatgctggatgggcgcgatctgattgcgatggcgcaaaccggctcgggcaagaccctggcctatgccctgccgctgctgcagcagcgctgcctggcgcccgacaccgccccgcgcgtgctcggcgcgctggtgctggtgcccacgcgcgaactcgccgcgcaggtggaggacgcgctgcgccagctggccgcgcatctgccgcgtcgcctgaagagcgtggtcgccaccggcggtagttcgatcaatccgcagctattggcgctacgcggtggcgccgacctcgtggtggccacgcccggccggttgctggatctagtcgagcacaacgcgctgcgcctgaacggggtgaccacgctggtgctggacgaagccgaccgcctgctcgagctgggcttcggtgccgaactcgatcgcatcctggccttgctgccagcgcagcggcagaccgtgctgttttcagccacctttccgcccgccatcgcgtcgctggccaagcgtcgcctgcgcgacccgttgcgcgtcaccatcgacgccacgcccgaacaggcaccggcgatcgcgcaatgcgcgattgcggtagatgccggccagcgcacgcagctgctgcgtcatctgctgcaggaacacgcctggccgcagctgctggtgttcgtcgccagccgccacagcgcagacaaggtggccgaaaaactgagcaagaccggcatcgccgccttgccgctgcacggcgaattgagccagggccgccgcgaacgcacgctgcgcgccttcaaacaagcggacgtgcaggtgctggtcgccaccgacctggccgggcgcggcatcgatatcgacgccttgccggcggtgctcaactacgatctgccccgctccactgtcgactacacccatcgtatcggccgcaccgcacgcgccggtgccagcggcgtggcgatcagcttcgtcacggcagacagcgcccagcagtggcggctgatcgaaaaacgccagggtctgcgcgtgccgaccagcgtgatcgaaggcttcgagccgaccccggtcgaggcgcccgcctccgataatgcgcccggcacagcgatgcgtgcaccgaatgacaacggcggcatcaagggcaagcggccgagcaagaaagacaaactgcgcgccgcggcgcaggcgcagactggcaagccgggctga

SEQ ID NO: 38560 - protein, 430 aa, Xanthomonas axonopodis pv. citri str. 306
MSFSDLSLSPQLQPFFDTALAKAGLRTPTPIQQQAIPPMLDGRDLIAMAQTGSGKTLAYALPLLQQRCLAPDTAPRVLGALVLVPTRELAAQVEDALRQLAAHLPRRLKSVVATGGSSINPQLLALRGGADLVVATPGRLLDLVEHNALRLNGVTTLVLDEADRLLELGFGAELDRILALLPAQRQTVLFSATFPPAIASLAKRRLRDPLRVTIDATPEQAPAIAQCAIAVDAGQRTQLLRHLLQEHAWPQLLVFVASRHSADKVAEKLSKTGIAALPLHGELSQGRRERTLRAFKQADVQVLVATDLAGRGIDIDALPAVLNYDLPRSTVDYTHRIGRTARAGASGVAISFVTADSAQQWRLIEKRQGLRVPTSVIEGFEPTPVEAPASDNAPGTAMRAPNDNGGIKGKRPSKKDKLRAAAQAQTGKPG

SEQ ID NO: 38561 - DNA, 1974 bp, Chlorobium tepidum TLS
  CDS (1)..(1974)
atggcagccacttttttatcaatgacccggaaggagacaatgaacgaaccaaccatgagcgaacagcaagacaattccgtgaatttccgcagccttgaactggctgaacccctgcttcgggccctcgaagcggtcggttatgaaaatccaacccccattcaggccagcaccattccgctgcttcttgaaggtcgtgatgtgctcggtcaggcccagaccggcaccggcaaaacggcggcgtttgccttgccagtcctctcgaatatcgatctttctgccaccgatccgcaggcgcttgtgctcgctccgacccgtgagctggcgatccaggtggccgaggcgtttcacacttacgccgagttcatgccgggctttcacgtgctgccgatctatggcggtcaggattacggcgtgcagatccgcaacctcaagcgcggcgtgcatgtggtggttggcactccgggccgcgtgatggatcacatgcgtaagggcacgctgaacctcgacaacctgaagtgcctcgtgcttgacgaggccgacgagatgctgcgcatgggctttatcgacgatgtcgagtggattctcgaccagacgcctgaaagccgtcaggtggcgctcttttcggccaccatgcctcagccgattgtacgcatcgcccgcaagtatctcaaggctccggccgaaatcacgattcagacaaagaccaccacggttgaaaccatccgccagcgctactggatggtcggcggccaccacaagctcgatgccctgacccgaatccttgaagtggagccgtttgacggcatcatcattttcgtacgtaccaaaaccgagaccgtggcacttgccgaaaagcttcaggctcgcggttacgccgctgccgcgctgaatggcgacatggtgcagtcggcccgcgaacgcaccatcgagcagctcaaggacggcacgctgaacatcgttatcgccaccgacgttgccgctcgcggcctcgatgttgagcgtatcagccacgttatcaactatgacattccgaccgacaccgagtcttacgtgcaccgcatcggcaggaccggacgcgccggacgcagtggcgaggcgatcctgtttgtctctccgagagagcgcgggatgctcttcgctatcgagcgagccacgcgcaagcgcatcgagctgatggagctgccctcgaccgagatcgtcaacgacaagcgcatcgcgaagttcaaacagcgcatcaccgacacagttggagccgaagacctcgaattctacatcggcctgatcgggcagtactgccaggagcacgacgtttccgaactcgaagccgccgctgcgctggccaagctgttgcagggcgacgagccattcctgctttccgcgaaacctgagcgcgaacgaccggttcgccgcgaagagcgggagccgcgctacgaccgagaacatggacgcgattcgttccgtgacgattttcgtaaagagcgcgagccgcgcaggcagagcaagggtggtttgtactcggacgagaagcgggaaacctatcggctcgaggttggtaaagttcacgatgtcaaaccgggcaacatcgctggagcgatcatcaacgagatcggtctcgatcccgaagcggttggcaagatcgtcatcaacgaccagtacagcacggttgaactgcctgccggaatgccgaacgacgtgttccaggagctgaaaaaggtccgggtgtgcggacgccagctcagggtctcgaaaatggatgagcatcagggtggctacggcgaccggcacgaccgtggatttggcggtgatcgcagtggcaatcgcagctttggaaaagatcgtagtggtgaccgtggattcggcggcgacaagaagaagagcttcggcaagccctcgggcggaggcaagcgcaaaaaagatgatggtgcgttcttcaccggttttaccggcaccaaaaagaagcgcatgaaggactga

SEQ ID NO: 38562 - protein, 657 aa, Chlorobium tepidum TLS
MAATFLSMTRKETMNEPTMSEQQDNSVNFRSLELAEPLLRALEAVGYENPTPIQASTIPLLLEGRDVLGQAQTGTGKTAAFALPVLSNIDLSATDPQALVLAPTRELAIQVAEAFHTYAEFMPGFHVLPIYGGQDYGVQIRNLKRGVHVVVGTPGRVMDHMRKGTLNLDNLKCLVLDEADEMLRMGFIDDVEWILDQTPESRQVALFSATMPQPIVRIARKYLKAPAEITIQTKTTTVETIRQRYWMVGGHHKLDALTRILEVEPFDGIIIFVRTKTETVALAEKLQARGYAAAALNGDMVQSARERTIEQLKDGTLNIVIATDVAARGLDVERISHVINYDIPTDTESYVHRIGRTGRAGRSGEAILFVSPRERGMLFAIERATRKRIELMELPSTEIVNDKRIAKFKQRITDTVGAEDLEFYIGLIGQYCQEHDVSELEAAAALAKLLQGDEPFLLSAKPERERPVRREEREPRYDREHGRDSFRDDFRKEREPRRQSKGGLYSDEKRETYRLEVGKVHDVKPGNIAGAIINEIGLDPEAVGKIVINDQYSTVELPAGMPNDVFQELKKVRVCGRQLRVSKMDEHQGGYGDRHDRGFGGDRSGNRSFGKDRSGDRGFGGDKKKSFGKPSGGGKRKKDDGAFFTGFTGTKKKRMKD

SEQ ID NO: 38563 - DNA, 1245 bp, Chlorobium tepidum TLS
  CDS (1)..(1245)
atgcctttttccgctctcggcatcatcgatcatctgcgcaaagctctcgccgaagagggctacaactcccccaccccgatacagaaagaagctatcccggtcattctcgaaggtaacgacctgctcgcttgcgcccagaccggcaccggcaaaaccgccgcgttcgcgctgcccgtgctgcaacggctgcaccagagccggatgcatggcgaaaagcgtaaaatccgctgcctcgtgctcaccccgaccagagagctcgcaatccagatcggcgaaagcttcactgcctatggccgtcataccggcctcataaacaccgtgatttttggcggcgtcaaccagaacccgcagaccgcgcggctcgtgcgaggcgtcgatattctggtcgccacgccgggccgcctgctcgatctgatcggccagggccacctgcacctgcgcgacatcgaatatttcgtgctcgacgaagctgaccggatgctcgacatgggcttcatccacgacatcagacgagtactggcggttctaccgaaaaaacggcagtcactcttcttttcggccaccatgccacccgaaatcatcaagctctccgctgcgattctgcacaacccgaaagaggtcatggtcacgccggtttcatcgaccgtcgagatcatcaaccagcagattctgttcgttgatcgcgaaaacaagaacagcctgctcgcgcacctgctcaaggaacgaaacatcgaaagcgcgctggtcttcacgcgaaccaagcacggcgcggacaaggtggcccgttttctggcgcaccacgacatcaccgccgaggcgattcacggcaacaaatcgcaaaacgcccgccagcgcgcgctcggcaacttcaagacgaggcaaacgagagtgctggtcgccaccgacatcgctgcgaggggaatcgacatcgatgaactcgaatatgtcatcaacatcgatttgcccaacatcccggaaacctacgtgcaccgcattggccgaactggccgggccggaaaccgtggagccgcatactccttctgcaacgccgaagaaaaagcctatctccgcgacatcgaaaaactgatcgcccgaaaaatcccggtcatcgaagatcatccctttccgatggtgaacacgattccggaaaatgctgcagcatcaaagcaaccggcaagaaaggtcccccatcagaaaaaaccttctggaacccaccccggcaactctcactggaaacggaaatga

SEQ ID NO: 38564 - protein, 414 aa, Chlorobium tepidum TLS
MPFSALGIIDHLRKALAEEGYNSPTPIQKEAIPVILEGNDLLACAQTGTGKTAAFALPVLQRLHQSRMHGEKRKIRCLVLTPTRELAIQIGESFTAYGRHTGLINTVIFGGVNQNPQTARLVRGVDILVATPGRLLDLIGQGHLHLRDIEYFVLDEADRMLDMGFIHDIRRVLAVLPKKRQSLFFSATMPPEIIKLSAAILHNPKEVMVTPVSSTVEIINQQILFVDRENKNSLLAHLLKERNIESALVFTRTKHGADKVARFLAHHDITAEAIHGNKSQNARQRALGNFKTRQTRVLVATDIAARGIDIDELEYVINIDLPNIPETYVHRIGRTGRAGNRGAAYSFCNAEEKAYLRDIEKLIARKIPVIEDHPFPMVNTIPENAAASKQPARKVPHQKKPSGTHPGNSHWKRK

SEQ ID NO: 38565 - DNA, 1488 bp, Oceanobacillus iheyensis HTE831
  CDS (1)..(1488)
gtgacaaaatttaacgaactaggtgtttccgccccaataatgaaagctttagaaaaaatggggtttgaggaagctacaccaattcaagcggaaactattccacatgcactagaaggccatgatgttattggccaagcacagacaggaacaggtaaaacagcagcattcggtattccgttaatcaataaaattaatgcaaaactaagaaaggtgcaaggtttaattgttgcaccaacacgtgaacttgctattcaagttgcagaagaaataaatcgtttagcgaaattcaagagtgttagagctcttgcaatatatggtggccaaccaatggaccgacagatccgagcactgaaagatggtccacagatcgtagtggctaccccgggtagattattagatcatatgcgcagaaaaacgattcgtattgatcaagtgcatacggccgttctagatgaagctgatgaaatgctaaacatgggctttattgatgatatacgtgagattctaaaagggattccagaagaaagacaaactctacttttctctgcgacaatgccaaaagaaatccgtaatatcgctactacgcttatgaaggaaccaaaagaagttaaagttaaagcgaaagaaatgaccgtagagaatattgatcagtatttcattgaaattcctgagaagtataaatttgatacactaaacaatcatttggatattaattcaccagaacttgcgattatttttgctcgtacgaagaagcgtgtggatgaagtagctgaaggattacaagcgagaggatatcgctcagaaggaatccacggtgatttaacacaaggaaaacgtatgtctgtactgaagaaatttaagcaaggtcgtgtagatgtattagtcgctacagatgtggcagcacgtggattagatatttctggtgtaactcatgtttataactttgatataccacaagatccagaaagttatgtacatcgtattggacgtacaggacgtgctggaaaaatgggtgaagcaatttctttcattaccccgagagaaatggctcatttaaatctaattgaacaaacgacaaagagtaaaatgaagcgtatggcaccaccgacaaatcaagatgctcgtcgtggccaacagcaagtaactattgaaaagctaaagaatgcaattaatgagaaagacttaaaagtatacgaagatgcagcgaaagaattattggatgagtatgattcaattactgttgtttcagctgctatcagcatgatgacaaaagagcgtcgtgatactccagttcgtatttcttctgtcgcaccaatcagcgtgaagaaagcgaaaaaccaaaaagataataaaactaaaggacgttctaataacaaacgtttctatggtggtcgtggacaaggtggacgaaaccaaggaggacgcggtcaaggcggtcgcaaccgaaaaggaaaaggtaactaccaacgacgtaatagagataattaa

SEQ ID NO: 38566 - protein, 495 aa, Oceanobacillus iheyensis HTE831
MTKFNELGVSAPIMKALEKMGFEEATPIQAETIPHALEGHDVIGQAQTGTGKTAAFGIPLINKINAKLRKVQGLIVAPTRELAIQVAEEINRLAKFKSVRALAIYGGQPMDRQIRALKDGPQIVVATPGRLLDHMRRKTIRIDQVHTAVLDEADEMLNMGFIDDIREILKGIPEERQTLLFSATMPKEIRNIATTLMKEPKEVKVKAKEMTVENIDQYFIEIPEKYKFDTLNNHLDINSPELAIIFARTKKRVDEVAEGLQARGYRSEGIHGDLTQGKRMSVLKKFKQGRVDVLVATDVAARGLDISGVTHVYNFDIPQDPESYVHRIGRTGRAGKMGEAISFITPREMAHLNLIEQTTKSKMKRMAPPTNQDARRGQQQVTIEKLKNAINEKDLKVYEDAAKELLDEYDSITVVSAAISMMTKERRDTPVRISSVAPISVKKAKNQKDNKTKGRSNNKRFYGGRGQGGRNQGGRGQGGRNRKGKGNYQRRNRDN

SEQ ID NO: 38567 - DNA, 1566 bp, Leptospira interrogans serovar Lai str. 56601
  CDS (1)..(1566)
ttgaaaggaacatctatgaaaaaactcaagtttagtgaactaaacttatccgccgagatccaaaacgcaattttagaaatgggttttgaagaagcttcaccgatccagtcagaagcaattccggttatattaaaaggaaaagatattatcggacacgctcaaaccggcactggtaaaaccgcagcgtttgcaattcctacaattgaactcctcgaagtagaaagtaaacatttacaagccttaattctttgtccgactcgagaattggtgatacaagttagcgaacaatttcgcaagctaataaaatacaaaggcaactttgaagttgttccaatttacggcggccaagagattgaaagacaacttagagcccttcgcaaaaaccctcagatcgtaattgcgactccaggtagaatgatggaccacatgagaagaggttctatccacctcgacgaaatcaaaatcgtagttttagacgaagcagatgaaatgttagacatgggttttcgggaagatatggaattcatcttaaaggatacacctgcagatcgtcagacaattatgttttccgctacgatgacggacgatgtacttactttgatgaaaaaatttcaaaatcatccccaaattatagatgttactcatcagaaattgagtgctcctaaaattgaacagatctactacgaaattcaagaaaacgcaaaaggagaagcccttgcgagattgatcgaatacagaaatgtaaaactagcattagtattttgtaatacaaaagcgcaagtagatacggttgtagaacttttgaaatccagaggttactttgcagaagcactccacggagacttgaatcaaaaacaaagagataaagtgatgagcggttttagaaaaggaagcatcgagattttagttgcaactgacgtggccggaagggggatcgatgtcaataacgtcgaagccgtttttaactacgatcttccaagagacggagaggactacgttcatagaattggtagaaccggaagagccggtaaaaaaggaatcgcattttcttttatcgtaggaaaacaaatctacaacttgaaaaaaatagaacgtatcaacggaatcaaaatcgaagccggtaagattccaacgttagacgatttagaagaaacaaaaattcattcttacacttctaaagtaagatccatcgtagacgccggtcatattggcaaatacgtaaaccaagtagaaaaactgatgggagacgattacacggctctcgacatcgccgccgccttatttaaaatgacaattttaaaagacagcgttacctttgacgattccgttcaatttgaatctgattttaaatacgaagaaaaacattctactaaaaagaaatctggtggtggaagatacagagaccggaatttcggtagatccggttctgggtctagatccaaatcaaattcgaattctcatttcggcaataactccaaggacggttctcgttctaaattctccaagggagataaaaatcaaaaacagggtggtggggctacttctttcaaaaaaaagaaaaagtaa

SEQ ID NO: 38568 - protein, 521 aa, Leptospira interrogans serovar Lai str. 56601
MKGTSMKKLKFSELNLSAEIQNAILEMGFEEASPIQSEAIPVILKGKDIIGHAQTGTGKTAAFAIPTIELLEVESKHLQALILCPTRELVIQVSEQFRKLIKYKGNFEVVPIYGGQEIERQLRALRKNPQIVIATPGRMMDHMRRGSIHLDEIKIVVLDEADEMLDMGFREDMEFILKDTPADRQTIMFSATMTDDVLTLMKKFQNHPQIIDVTHQKLSAPKIEQIYYEIQENAKGEALARLIEYRNVKLALVFCNTKAQVDTVVELLKSRGYFAEALHGDLNQKQRDKVMSGFRKGSIEILVATDVAGRGIDVNNVEAVFNYDLPRDGEDYVHRIGRTGRAGKKGIAFSFIVGKQIYNLKKIERINGIKIEAGKIPTLDDLEETKIHSYTSKVRSIVDAGHIGKYVNQVEKLMGDDYTALDIAAALFKMTILKDSVTFDDSVQFESDFKYEEKHSTKKKSGGGRYRDRNFGRSGSGSRSKSNSNSHFGNNSKDGSRSKFSKGDKNQKQGGGATSFKKKKK

SEQ ID NO: 38569 - DNA, 1377 bp, Shewanella oneidensis MR-1
  CDS (1)..(1377)
atggctttctcgacccttaagctaaaaaccgaactgcttgagaacctttcttctatgggctacaacgagatgacgcccattcaggcgcaaagcttgccagccattttagcgggcgaggatgtgataggtcagggtaaaacggggtcaggtaaaacggcggcctttggtctaggtttactaaataaattagacgttaagcgttttcgcattcaaaccttagtactgtgtccaacccgcgagctggccgaccaagtggcgcaggagatccgtactctggcccgcggtatacacaatgtgaaagtattaaccctgtgtggtggtgtgcccatggggccgcaaattggctctttggagcatggtgcccatattattgtgggaaccccagggcggatcgtcgatcacttagaccgcaatcgtttagatttaagtaatctgaatatgttagtgcttgatgaagctgaccgcatgctcgaaatgggcttccaacctcagctcgatgccattattgaacagtcaccacgagagcgccaaacgctgctgtttagtgcgacattccctgagcaaattcaatcgattgctaaacaaatcatgtataaccctgtgatggttaaggccgcggttacccatgaaaaaaataccatcgaacagcatttttatcagttagatgacgataagtcgcgcatgcaagcgctgcaattattactgttagaacataagccagaaagcgccgtggtgttttgtaataccaagcgtgaaacgcaaaaagtggccgacgaacttgagggtttaggctttagtgttttagccttgcacggcgatttagagcagcgcgatagggacgaaaccctgttgcaatttgccaataagagtgcctgtgtattagtggctaccgacgtggccgcccgtggtttagatatcgatgcactagatgcggtatttaactaccatgtggcctacgataccgaagttcacattcaccgtatcggccgtacaggtcgtgcgggcagtaaaggcgctgcttataccttttacaacgatcaagacggttacaagattgccttgctagaagagtacttagatcgagaaattaccagtgaatcactgccatcattaagcttgcttggcagtgcgcccaatgcgccaaccatgatcactctgcaaatcgatggcggtaaaaaagagaaacttcgccctggcgatattcttggcgccctgacgggtgataatggcattgaaggtacgcaggtgggcaaaattcttgtgactgattatcgcgcttatgtggcggtaaaccgtaaagtggctaaaaaggcactgagcaagatcaccagcggccgcattaagggtaagtcttaccgcgcatggttgatgaaataa

SEQ ID NO: 38570 - protein, 458 aa, Shewanella oneidensis MR-1
MAFSTLKLKTELLENLSSMGYNEMTPIQAQSLPAILAGEDVIGQGKTGSGKTAAFGLGLLNKLDVKRFRIQTLVLCPTRELADQVAQEIRTLARGIHNVKVLTLCGGVPMGPQIGSLEHGAHIIVGTPGRIVDHLDRNRLDLSNLNMLVLDEADRMLEMGFQPQLDAIIEQSPRERQTLLFSATFPEQIQSIAKQIMYNPVMVKAAVTHEKNTIEQHFYQLDDDKSRMQALQLLLLEHKPESAVVFCNTKRETQKVADELEGLGFSVLALHGDLEQRDRDETLLQFANKSACVLVATDVAARGLDIDALDAVFNYHVAYDTEVHIHRIGRTGRAGSKGAAYTFYNDQDGYKIALLEEYLDREITSESLPSLSLLGSAPNAPTMITLQIDGGKKEKLRPGDILGALTGDNGIEGTQVGKILVTDYRAYVAVNRKVAKKALSKITSGRIKGKSYRAWLMK

SEQ ID NO: 38571 - DNA, 1302 bp, Shewanella oneidensis MR-1
  CDS (1)..(1302)
atgagatttgaatcttttagtttttgccccgagattttacgcgctatctcagattgcggttatcaaaaaatgacaccgattcagcagcaagcgatccccgccatccgccgcggccaagatgtgctcgccagcgcgcaaactggcacgggtaaaaccgccgccttcgcactgccgatactgcaaaaaatggttgaaaacccaagcgagaccttaaaatctaatacccgggtactcatcctcaccccaacacgcgaactggccgcccaagtagcggaaaacgttgaagcctacagcaagtatttaaatttcagcgtattaacgatttacggcggcgtaaaggttgagactcaagcccaaaagttaaaacgcggcgccgatattattgtcgcgaccccaggccgtttactcgaacacctcaccgcctgtaacttaagtctgtctagcgttgactttttagtcctcgatgaagccgatcgcatgctggatatgggctttagtgccgacatccaaaaaatcctccaagcggtcaataagaagcgtcaaaacctactgttttcggccaccttctccagcgcagtgaaaaaactggccaatgagatgatgatcaaaccccaagtgatcagcgccgataaacaaaacaccaccgccgatactgtaagccaagtggtttatccggtagagcagcgtcgtaaacgcgagctgttatctgagttgattggtaaaaagaactggcaacaagtgttggtctttaccgcgacccgcgatgcggcggatactctggttaaagaattaaacttagacggtattccctctgaagtggtacacggtgaaaaggcccaaggtagccgtcgccgtgcgctgcgtgagtttgtgtccggtaaagtgcgcgtattagtcgcgaccgaagtggccgcccgcggtttagacattcccagtcttgagtatgtggtgaacttcgacttacccttccttgccgaagattatgttcaccgtatcggccgtacaggtcgagcaggtaaaagtggcgtggcaatctcatttgtaagccgtgaagaagaacgcacccttgcggatattgaaaaactcatcggccaaaaaattcgccgcattaccgtacctggatatgaggtcggtagccgtgacttgctgttaaagcagctacaaacccgccgcagtttcgctaagaaacaacagcgacaggacaatgttagcgagcaaatgattgccgagaaaagcatgcagggccgccgcgttaaaatgaaagttggccaagcaccaagcaaagcgaaaaagctaaaataa

SEQ ID NO: 38572 - protein, 433 aa, Shewanella oneidensis MR-1
MRFESFSFCPEILRAISDCGYQKMTPIQQQAIPAIRRGQDVLASAQTGTGKTAAFALPILQKMVENPSETLKSNTRVLILTPTRELAAQVAENVEAYSKYLNFSVLTIYGGVKVETQAQKLKRGADIIVATPGRLLEHLTACNLSLSSVDFLVLDEADRMLDMGFSADIQKILQAVNKKRQNLLFSATFSSAVKKLANEMMIKPQVISADKQNTTADTVSQVVYPVEQRRKRELLSELIGKKNWQQVLVFTATRDAADTLVKELNLDGIPSEVVHGEKAQGSRRRALREFVSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRQDNVSEQMIAEKSMQGRRVKMKVGQAPSKAKKLK

SEQ ID NO: 38573 - DNA, 1284 bp, Shewanella oneidensis MR-1
  CDS (1)..(1284)
atgacccaagcttcttcctccgtcgccagctttgccgaacttggcattattgcaccgctaggtaatcgactaaccgagctcggttatgtttcacccacccctgtacaagcggccacgattccagccgtgctgagtgggcgggacgtattagcgggggcaaataccggctcaggaaaaaccgccgcttttgcactgcccttattgcagcgtttgagtgaagcaaaaagtgctgataagtcggccggtgttgtacgttgtttggtgctcgtgcctacgcgcgaattggcacagcaagttgccgatagctttttatcctatgcatcccacttcaatggccaacttaagattgtcgccgcttttggtggtgtgtctgtcaatctgcaaatgcaaagcctacgcgctggcgcggatgttctggttgcaacgcctgggcgtttactggatttattagcaagcaacgcgcttaagttaactcaagtgtctgcattcgtcctcgatgaagcggatcgcatgttaagccttggctttaccgaagagttagaacaagtgcttgcagcgttaccgcgtcaaaagcaaaccctattgttttcggcgaccttccccgaagaagtgcgtgcactgacaaccaaattactccatcaaccgcttgaatatcatctgcaaagtgagcaagaaagtaccattgagcagcgtgtgataaccgtgaaccgtgaacaaaaaacggcgttgttggcccacttgattaaacagcatcaatggtcacaggcattgatttttgtcagtgctaaaaatacctgtaatcatcttgcacaaaagctctcaaaacgtgggattagcgctgaagtattccatggcgataaagcccaaggtgcacgaactcgcgtgctcgatggttttaaaaatggtgaaattagtgtgctgattgcgaccgatatcgcagctcgtggtattgatattgataaactccccgtcgtgattaactttgatttgccaagaagcccggcagattatatgcaccgtattggtcgtagtggccgtgcgggggaggcgggtcttgcggtgaccttaatttcccatgaggaatatcatcactttggcgtgattgaaaagaaaaacaaaatcaaacttgtacgtgaacaaatccccggatttgaagccaatgccgaaataccgcttgaagtgttagcgcaggaaaaacctcaggccaagcctgaaggcactggcaagaaaaaacgtaagcagttacccgcagcgaatgttgaattttggggtaaaaagtcttaa

SEQ ID NO: 38574 - protein, 427 aa, Shewanella oneidensis MR-1
MTQASSSVASFAELGIIAPLGNRLTELGYVSPTPVQAATIPAVLSGRDVLAGANTGSGKTAAFALPLLQRLSEAKSADKSAGVVRCLVLVPTRELAQQVADSFLSYASHFNGQLKIVAAFGGVSVNLQMQSLRAGADVLVATPGRLLDLLASNALKLTQVSAFVLDEADRMLSLGFTEELEQVLAALPRQKQTLLFSATFPEEVRALTTKLLHQPLEYHLQSEQESTIEQRVITVNREQKTALLAHLIKQHQWSQALIFVSAKNTCNHLAQKLSKRGISAEVFHGDKAQGARTRVLDGFKNGEISVLIATDIAARGIDIDKLPVVINFDLPRSPADYMHRIGRSGRAGEAGLAVTLISHEEYHHFGVIEKKNKIKLVREQIPGFEANAEIPLEVLAQEKPQAKPEGTGKKKRKQLPAANVEFWGKKS

SEQ ID NO: 38575 - DNA, 1230 bp, Shewanella oneidensis MR-1
  CDS (1)..(1230)
atgtcttttagcgcgctttctttaaatacccaattagtggacaccttagctgaacttggctatcagcagccaacgcctattcaagtcgaggctattcccgcgatcttaacaaaacaagatgtcatggcgggggctcaaacaggaacggggaaaaccgcagcctttgccttaccgattctgcagttgttaatggctgataaccaaagcgatcacgcggcgaaagcaatccgcgccttagttttagtgccgacgagggagttggcactacaagttcagcaaagctttgtaaaatatgcgaaaggaacagatattcgtgtagggattgcctatggcggagtcagtattgaagcgcagcaagcggtgtttaacgcagggattgatgtcttgattgcaacccctggccgcttgcttgatcatttgcgtcaaggtgcacttaatcttaaccaattgaacacactggtatttgatgaagccgaccgtatgcttgatatgggatttatggatgaaatccaagccgtgctaaaacaagtgccagcccagagacaaaccctgctgttttccgccaccttggatgattcgatttttagttttagtaaaaatctcctgcgtgaccccaaacggattgaagtggctaaacctaatacgaccgcagcccagatagagcagcgggtctatgccattgatagcgatcgtaaaactgaatttgtcagtcatttagtccgcagcaaaaactggcagcaagtgttgatatttagccgcactaaacaaggggtcgataagttaacagcccaacttaataagctaggggtggcgacgcagtccttccacggcgatttatcccaaggtgcacgagaaaaagtattacaggaatttaaacaaggacttgtgcaagtcttagttgccaccgatgtggctgccagagggctcgatattgccgagctacagtatgtgattaatttcgaattgccgtttattgctgaagattatattcaccgtatcggtcgaactggccgggccggtagcgctggtttggcaattacgctttttagccaagaagatgcgctactgctagaagaggtcgagacactgctcgataaacgtctgccacaacaatggtatcccggctttgaacctgattttaacaaaatgctccccgagccgagacgcaatagcaaagccgctcaaaaacaacgggctaaaaaacgcgccttaggtggtaaaaagcgctaa

SEQ ID NO: 38576 - protein, 409 aa, Shewanella oneidensis MR-1
MSFSALSLNTQLVDTLAELGYQQPTPIQVEAIPAILTKQDVMAGAQTGTGKTAAFALPILQLLMADNQSDHAAKAIRALVLVPTRELALQVQQSFVKYAKGTDIRVGIAYGGVSIEAQQAVFNAGIDVLIATPGRLLDHLRQGALNLNQLNTLVFDEADRMLDMGFMDEIQAVLKQVPAQRQTLLFSATLDDSIFSFSKNLLRDPKRIEVAKPNTTAAQIEQRVYAIDSDRKTEFVSHLVRSKNWQQVLIFSRTKQGVDKLTAQLNKLGVATQSFHGDLSQGAREKVLQEFKQGLVQVLVATDVAARGLDIAELQYVINFELPFIAEDYIHRIGRTGRAGSAGLAITLFSQEDALLLEEVETLLDKRLPQQWYPGFEPDFNKMLPEPRRNSKAAQKQRAKKRALGGKKR

SEQ ID NO: 38577 - DNA, 1608 bp, Shewanella oneidensis MR-1
  CDS (1)..(1608)
atgagtttttccgccttaggtttatccgcaccacttcaaaaagctgtgtccgaacagggctatgacacgccatctccaatccaagctcaggctattccagctgtgctaacgggcaaagacgtcatggcagcggcccaaactgggacaggaaaaactgcaggttttacgctgccattactggaattactcgctaaaggccacaaagccaagtcaggacaaacccgcgccttagtcttaacacctacgagggaactggcggcacaagttggcgaaagtgttgaaacctatggtaaatatctaccgctgcgttccgctgtagtatttggtggtgtacccatcaacccacaaatcaataaattacgccatggtgttgatgtgctagttgccacacctgggcgactattagatcttgtgcagcaaaatgcggtgaagtttaatcaactcgaaatcttagtgctcgacgaagcggaccgtatgttggatatgggctttatccgcgatatcaaaaagatccttgcactcttgcccgcaaagcgacaaaacctgatgttttctgccaccttctccgatgagatccgtgagcttgcaaaaggattagttaatcatccggttgagatttccgtcacgccgcgcaatgcagctgcaaccacggttaagcaatggatttgtcccgtcgataaaacgcaaaaatcagccttgctgatccaactcatcaagcaggaaaactggcagcaagtgttagtgttttcacgcaccaaacatggcgcgaatcggctcgctaagagccttatccaagccgagatcagtgctgctgcaatccacggtaataaaagccaaggtgcccgtactaaagccctcgccgactttaaaagcggtgaagttcgcgtattggttgcgaccgatattgccgctcgcggtttagatatcgatcaattaccacaggtcgtaaacttcgatttacctaacgtgcctgaagattatgtgcatcgcattggccgtacagggcgtgctggcgccacaggccaagccgtttccttagtcagcagcgaagaaattaaactgcttaaagatattgagcgattaattaatcgcgtgctcgagcgccaagaagttgaaggttttagccctgtacatgcattgccagagacaacactcaatccccaaggcaaagataccaaagttaaagccgtggcaaatcatcgtaagcaccgcagcgcaggaaaacctgcaccacggtctggttctggccgtgatacgcaaggcaatcgagaaaacagccagaggcagaacagcgcatcatctcgcaacagcaatgaacataataataccgaggcagcagttgcgcgctcgccaaaaccaaaaagtaagcatcctcagcgcgatggcggcaccgctaacagtgcaacggcggggaacaatgctaaagcgaaaccgcattcaggtgcacagcaacgtagccatgcagaacgaagcgaaaaatcaaacaatgatggacgccgccaagagcaacccaaaggccgcaatccgcaaagtgcaaaacctgcttcgaatcagccgaaacagcactcacatcgcgccgataaccgcccgaatagtgtcaagccttaa

SEQ ID NO: 38578 - protein, 535 aa, Shewanella oneidensis MR-1
MSFSALGLSAPLQKAVSEQGYDTPSPIQAQAIPAVLTGKDVMAAAQTGTGKTAGFTLPLLELLAKGHKAKSGQTRALVLTPTRELAAQVGESVETYGKYLPLRSAVVFGGVPINPQINKLRHGVDVLVATPGRLLDLVQQNAVKFNQLEILVLDEADRMLDMGFIRDIKKILALLPAKRQNLMFSATFSDEIRELAKGLVNHPVEISVTPRNAAATTVKQWICPVDKTQKSALLIQLIKQENWQQVLVFSRTKHGANRLAKSLIQAEISAAAIHGNKSQGARTKALADFKSGEVRVLVATDIAARGLDIDQLPQVVNFDLPNVPEDYVHRIGRTGRAGATGQAVSLVSSEEIKLLKDIERLINRVLERQEVEGFSPVHALPETTLNPQGKDTKVKAVANHRKHRSAGKPAPRSGSGRDTQGNRENSQRQNSASSRNSNEHNNTEAAVARSPKPKSKHPQRDGGTANSATAGNNAKAKPHSGAQQRSHAERSEKSNNDGRRQEQPKGRNPQSAKPASNQPKQHSHRADNRPNSVKP

SEQ ID NO: 38579 - DNA, 1872 bp, Shewanella oneidensis MR-1
  CDS (1)..(1872)
atgtcatccgatgaaagaactttccgtgaactcggcctatccgagaatttgttgcgtgctcttgacgagctaggttacgaaaaaccaacgccaatccaatcagccagtattgatccacttatggctggcaaagatattttaggtcaagcgcaaacaggtacaggtaaaactggcgccttcgcgctgccgctactaaacaaagtcaccagccaaacaacaccgcaaattttagtactcgcaccaacgcgtgaactagcggttcaggttgctgaagcattcagtagctatgccaaatttatgaagaatttccatgtactgccaatttacggcggtcaaagcatgcaacaacagttgaatgcccttaagcgtggcccgcaagtgatcgtgggtacaccgggtcgtgttatggaccatatgcgccgtggcactctgaaactggaaaccttgcaagccctcgttctcgatgaagccgacgaaatgttaaaaatgggctttatcgatgatatcgaatggattctggaacacactccaccacaacgccaacttgccttgttctcggcaaccatgccagagcaaattaagcgggttgctaacaagcatttaaaaaatgcgactaatatcagcatcgctgcaagtcacaccacagttgactcaatcgagcaacgttttgtgcaggtgtcacagcacaataaattagaagccttagtacgcgtattagaagttgaaaatactgaaggtattatcatcttcgttcgtacccgtaactcatgcgttgaattagctgaaaaacttgaagcccgtggctatgcctcatcaccactacacggtgatatgaaccagcaagcccgtgagcgcgcggttgagcagcttaaaaacggcaagctagacattctgatcgcaactgacgttgcggcccgaggtctggacgttgagcgtatcggccacgtagttaactacgatatcccttacgatactgaagcttacgtacaccgtattggtcgtactggccgtgcgggtcgtaccggtatggcgattctgttcgtcaccagccgtgaaatgcgtatgctgcgcaccatcgagcgcgcaaccaacagccgtatttcgccaatgaaagtgccaagcccagagacggttgcagaacgtcgtctgtctcgcttaggtgagcagctcgctcaaaccatgaataacgatctcgaatttatgcgtgaagcggttgcccagttatgccagcaacttgaagtagatacggatctgctcgcggctgccctgctgcaccaagttcagcaggaacgtccattgcaattacctgcgattcaagagcgtgttcgcgatgaacgcagtgagcgcagcgaacgtggttcagaccgtggcgctgagcgtggtgaacgccgtagccgtgaatcacgtccaatgccagcaagcttaggcagcgctgaagcgttaaaagacaatccagacctgaaaatgtgccgttatgtgatcgacgtaggtcgtgaaaatggcgtaggtgtaggcaatatcgttggcgccatcgcaaacgaagccaatatcgacagccgttatatcggtgcaatccaactttatgattcagtgacaactgttgacctgccagacggcatgccaaaagatgtactacaacacctcaagaaagtgcgtgtgtgtggtaagccattgaatatccgtgaagctggcgaccaagtctttgttgactctggccgtggcgcccgtagcgaccgtcgtccacgtagcgaccgcccagcgggtgatcgcaagccacgtgcagcgtctggtgacaaaccgtttgcagaccgcaaaccacgttcagacaagccagcaggcgagcgtagaccacgtaaaccacgcgaagagtaa

SEQ ID NO: 38580 - protein, 623 aa, Shewanella oneidensis MR-1
MSSDERTFRELGLSENLLRALDELGYEKPTPIQSASIDPLMAGKDILGQAQTGTGKTGAFALPLLNKVTSQTTPQILVLAPTRELAVQVAEAFSSYAKFMKNFHVLPIYGGQSMQQQLNALKRGPQVIVGTPGRVMDHMRRGTLKLETLQALVLDEADEMLKMGFIDDIEWILEHTPPQRQLALFSATMPEQIKRVANKHLKNATNISIAASHTTVDSIEQRFVQVSQHNKLEALVRVLEVENTEGIIIFVRTRNSCVELAEKLEARGYASSPLHGDMNQQARERAVEQLKNGKLDILIATDVAARGLDVERIGHVVNYDIPYDTEAYVHRIGRTGRAGRTGMAILFVTSREMRMLRTIERATNSRISPMKVPSPETVAERRLSRLGEQLAQTMNNDLEFMREAVAQLCQQLEVDTDLLAAALLHQVQQERPLQLPAIQERVRDERSERSERGSDRGAERGERRSRESRPMPASLGSAEALKDNPDLKMCRYVIDVGRENGVGVGNIVGAIANEANIDSRYIGAIQLYDSVTTVDLPDGMPKDVLQHLKKVRVCGKPLNIREAGDQVFVDSGRGARSDRRPRSDRPAGDRKPRAASGDKPFADRKPRSDKPAGERRPRKPREE

SEQ ID NO: 38581 - DNA, 1554 bp, Streptococcus mutans UA159
  CDS (1)..(1554)
ttgaaatttacagaattacatttggcggaagacattctttctgctgttgcaaaagtcggctttgttgagccatcacctatccaagaattgactattcctcttgcccttgaaggaaaagatgttattggtcaagcacaaactgggacaggaaaaacagcagcctttggtctgccaaccctgaataagattgacgtgactaataacgttgttcaagcccttgttattgcgccaacgcgagaattggctgttcaaagtcaagaggagctctttcgttttgggcgtgaaaagaaagttaaagttcgttcggtttatggtggttcaagcattgaaaaacaaattaaggctcttaaatcaggagcccatattgttgttgggacaccgggacgtctgcttgatttgattaaacgcaaggcgcttaaattaaatcatgtggaaacccttattttggatgaagcagatgaaatgctcaacatgggctttttagaagatattgaagccattatttcacgtgtaccagaaacacgccaaaccttgctcttttcagcaaccatgccagatgccatcaaacgtattggcgtaaagttcatgaaagaaccagaacatgttaagattgctgccaaagaattaacaacagatttggtggatcaatattatatccgtgtcaaggaaaatgaaaaatttgatacgatgacccgtcttatggatgtggaacagccagaactttctatcgtttttggccgtactaagcgccgtgttgatgagttaacaagaggattaaaactgcgtggctatcgtgcggaagggattcatggggatctcgatcaagggaaacgtctgcgtgttcttcgggattttaaaaatgataaccttgacattttggtcgcgacagatgtggcggctcgtggtctcgatatttcgggcgtcactcatgtttataactatgatattccgcaagaccctgaaagttatgttcatcgcattggtcgtacaggtcgtgctggtaagcacggtcagtcaatcacttttgtggctcccaatgaaatgggctatcttcaaattattgaaaagctcactaaaaaacgcatgaaaggcatgaaacccgctacagcgcaagaagcctttcaagcaagcaaaaaagtggccctcaaaaagattgagcgtgactttgctgatgaaaagattcgttctaattttgataagtttaccaaagatgctgaaaaattggctgctgaattttcaccagaagaattagcacaatatatcttgactctaactgttcaagatccagaaatgctgcctaaggttgaaattgctcgcgaaaaacccttgccatttaaatttgctggtaaaggaaagggcggcaatcgtcgtcgtgaggatcgtcggggaggtcgcgacagtcgccgtaatcatcgtgacggtggccgtcgtgaatttaaacggacttctaacaaaaatcgcaaagattttgaaaataagagcaataaacgtcctcaccgtacttccagcgaaaagaaaagcggctttaccattcgcaataaaggtgacagataa

SEQ ID NO: 38582 - protein, 517 aa, Streptococcus mutans UA159
MKFTELHLAEDILSAVAKVGFVEPSPIQELTIPLALEGKDVIGQAQTGTGKTAAFGLPTLNKIDVTNNVVQALVIAPTRELAVQSQEELFRFGREKKVKVRSVYGGSSIEKQIKALKSGAHIVVGTPGRLLDLIKRKALKLNHVETLILDEADEMLNMGFLEDIEAIISRVPETRQTLLFSATMPDAIKRIGVKFMKEPEHVKIAAKELTTDLVDQYYIRVKENEKFDTMTRLMDVEQPELSIVFGRTKRRVDELTRGLKLRGYRAEGIHGDLDQGKRLRVLRDFKNDNLDILVATDVAARGLDISGVTHVYNYDIPQDPESYVHRIGRTGRAGKHGQSITFVAPNEMGYLQIIEKLTKKRMKGMKPATAQEAFQASKKVALKKIERDFADEKIRSNFDKFTKDAEKLAAEFSPEELAQYILTLTVQDPEMLPKVEIAREKPLPFKFAGKGKGGNRRREDRRGGRDSRRNHRDGGRREFKRTSNKNRKDFENKSNKRPHRTSSEKKSGFTIRNKGDR

SEQ ID NO: 38583 - DNA, 1446 bp, Clostridium tetani E88
  CDS (1)..(1446)
atggaaaagttaagttttaaaagttttggaataagtgaagatatactagaggcactattaaaattagggtataaaaatccttcaaaggtacaacaaaaagttattccagtagctattaagaataaagatataatagtaaaatcaaaaactggaagtggtaaaacagcgtcatttggaattccaatatgtgaaaatgttaatttagaagagagaaagcctcaggcactagtgcttacacctacaagggaactttgtattcaagtaaaagaagatataaaaaatattggaaggtttaaaagaataaaatgttctgcaatctttggaaagcaaccctttaaaactcaagctctggagctaaaacaaagaactcacgtggtagttggaacaccgggtagaacattggatcacatagaaagaggaacaatagaccttgacaaaattaaatatttcattgtagatgaaggggatgaaatgtttaatatggggtttatagatcaagttgaaagtattatgagaaagttacctaaaaaaagagttaatatgcttttctctgctacaataccagaaaagatcgaaaaactatgtgaaaaatatatgaaatctcctattatgatagaagttaatccagaagaatttacagaggaaaaaatacagcatatatattatgaaattgaagataaaaataagtttgatcttctaaacaaaatattaattactgaaaatcctgatagctcaattatattttgtagaactcaagaaaatgtaaataagcttgcaaagctaatggaaaataaagattatccatgtaaggctcttcatggtggaatgatgcaagataaaagaatagatattatgaatagatttaaaagaggagaatttatgtttttagtagcaacggatcttgcagcgagaggcatagatgtagaaaatgtaacgcatataataaactatgatatccctatggaaaaggaaaattatgttcatagaactggcagaacaggaagagctggaagggaaggttgtgcaataagtttagttacaccttatgaagataggttctttaagcaaattgaagagtacataggctttaaaataaaattaggagatgaaattacaaaagaaagtgtagaaaatggagaaaaagcatttattgaaaaaattaaagctatgccaaaaattaaaaagcaaaaggctgataaattagataaggacataacaaaaatataccttagtgcaggtaaaaagaaaaaaataagaccaggagatatagttggaggaattacaaatatttctggtgttactccagaagatataggtataatagatatacaagatgtttgttcctatgtagatatattaaatgggaaaggaaaacttgtattagaaggattaaaatctacaactataaagggaaaaaagcttagagcagaaaaggcaactaagtaa

SEQ ID NO: 38584 - protein, 481 aa, Clostridium tetani E88
MEKLSFKSFGISEDILEALLKLGYKNPSKVQQKVIPVAIKNKDIIVKSKTGSGKTASFGIPICENVNLEERKPQALVLTPTRELCIQVKEDIKNIGRFKRIKCSAIFGKQPFKTQALELKQRTHVVVGTPGRTLDHIERGTIDLDKIKYFIVDEGDEMFNMGFIDQVESIMRKLPKKRVNMLFSATIPEKIEKLCEKYMKSPIMIEVNPEEFTEEKIQHIYYEIEDKNKFDLLNKILITENPDSSIIFCRTQENVNKLAKLMENKDYPCKALHGGMMQDKRIDIMNRFKRGEFMFLVATDLAARGIDVENVTHIINYDIPMEKENYVHRTGRTGRAGREGCAISLVTPYEDRFFKQIEEYIGFKIKLGDEITKESVENGEKAFIEKIKAMPKIKKQKADKLDKDITKIYLSAGKKKKIRPGDIVGGITNISGVTPEDIGIIDIQDVCSYVDILNGKGKLVLEGLKSTTIKGKKLRAEKATK

SEQ ID NO: 38585 - DNA, 1575 bp, Clostridium tetani E88
  CDS (1)..(1575)
atggaaaatttaaaatttaataatttaggacttaacgaagatatactcaaagcaattgaagatatggggtttgaaactccttctaaaattcaagctgaggttataccaattgttttacaaggatttgatgttataggtcaggctcaaacaggtactggaaagacccttgccttcggtgctcctgttttaaatagtattagtaatgaatctaaaaaagttaagagtataatactagctcctacaagagaacttgctattcaggtatataaagagcttacaactgtagcaaaatacactaaattcaaattgttacctgtatacggaggagattccatagacagacagataaaaagcttaaaaaaaggaatagatattgtaataggtactcctggaagagttcaagatttaatcaatagaaaagctcttaatctatctcatattgaatttcttgttcttgatgaggctgatgaaatgcttaatatgggctttgtggatgatatagaaaatatattaaaaagttgtaatgaagatagacgtactttattattttctgcaacaatgccaagtgaaataaagaagatagctaaaaagtatatgaaaaaagatgctaagcatgtagctatagctcaaaattctatgacagtatcttctgttgaacaattttattacgaagttaaacaaaaaaataaatttgaatctttatgcaaagtactttctgttgacgaaccaactagagctataatattttgcaaaactaaaaaaggtgtagatgaattagtatcatctatgaaagaaaaaggttttagtgcagagggaatgcatggtgatatgactcaaagtcatagattaaatactttaaatagatttaaagaaagaactattcctttccttgtagccactgatgtagctgcaagaggtatagatgttaaggatacaagtcatgttataaactatgatttacctcaagatacagaatcctatgtgcacagaattggtagaacaggaagagctaataaaaaaggtacagcatatacttttgttacacctaaagagtttagttctcttaaaagaatacaaaaaataagtaaaagtaaaataaataaaagacaattacctactatggatgatgtgctaaaagctaaatttgatagtatattaaatgatgtagaacaaactttatctaaggataattataatacttttatacctttagttaaagatttggaaagcaaattcgatctaacaaatgttactgctgctttaatgagcatgttatataatgacgaaatttcttatgattatgatgatgataatacagagtcaaattccttagactacactagaatattcttaaatgtaggtcgtaaggatagacttaaccctaaaattctattagagtttttagataataatgctaatataaataaaagccaggttggaagtatagatatactagataaatttgcttttgtagatatagcaacagatcgtgtcggtgatttaatggataactgcatagataaaacattatgtagaagaaaattaaacatagaagtggccaaaaaatctaaataa

SEQ ID NO: 38586 - protein, 524 aa, Clostridium tetani E88
MENLKFNNLGLNEDILKAIEDMGFETPSKIQAEVIPIVLQGFDVIGQAQTGTGKTLAFGAPVLNSISNESKKVKSIILAPTRELAIQVYKELTTVAKYTKFKLLPVYGGDSIDRQIKSLKKGIDIVIGTPGRVQDLINRKALNLSHIEFLVLDEADEMLNMGFVDDIENILKSCNEDRRTLLFSATMPSEIKKIAKKYMKKDAKHVAIAQNSMTVSSVEQFYYEVKQKNKFESLCKVLSVDEPTRAIIFCKTKKGVDELVSSMKEKGFSAEGMHGDMTQSHRLNTLNRFKERTIPFLVATDVAARGIDVKDTSHVINYDLPQDTESYVHRIGRTGRANKKGTAYTFVTPKEFSSLKRIQKISKSKINKRQLPTMDDVLKAKFDSILNDVEQTLSKDNYNTFIPLVKDLESKFDLTNVTAALMSMLYNDEISYDYDDDNTESNSLDYTRIFLNVGRKDRLNPKILLEFLDNNANINKSQVGSIDILDKFAFVDIATDRVGDLMDNCIDKTLCRRKLNIEVAKKSK

SEQ ID NO: 38587 - DNA, 1113 bp, Clostridium tetani E88
  CDS (1)..(1113)
atgacaaattttaaagaattaggacttagcaatgatttaatacaaaatcttaaaactcaagggataaatagccctactccaattcaaagagaaagtatactccttataaaggagggtaatgatgttatagctgaggcacaaactggtactggaaaaactttggcatttcttttacccatgtttgaaaatatgtctcctaatataaatacaattcaaggtttaatagtaactccaacacgggaacttgctattcaaataactgaggaagctatgaaattaaatgaatctaaggacttaaatattttatctgcatatggtggtaaggatataggaagtcagctaaataaattaaaaggcaatattcatttagttattgcaactccaggtaggcttttagatcatttagatagaaatacaatagatcttaaaaatttgaaaacattagttttagatgaggcagatcaaatgcttctcatgggatttaaaaatgaagttgagaccattataaaacatacatctaaaaaccgtcagactttatgtttttcagcaacaatgaactcttctgttaagaaacttgcctataaatacatggatgatcccaaattaataacaatacaaaaagaagaaataactcttaaaaatattaaacaagttttaatagaaacaacggataggaataagcttgatgatttatgtaaagttttaaatgaaactaatccatttatggcaatcatcttttgtagaactaaaagaagagttgataaacttgaaatggatctttatcaaaggggttataattgtaaaaagttacatggagatttaactcaatccaaacgtgaaaaagtgatgaaagacttcaaaaatacaaaaattcaatatttaatagccactgatgtagctgctagaggactcgatataacaggtgttactcatatatataactacgatatacctgaaaatactgagaattacatacatcgtataggtcgaaccggaagagctggcgaaaaaggatatgcttacctttttatagatctaaaagataaagaaactttgaatataattgaaaaaggaataaagactaaaattgagagaataaaaaatcataaataa

SEQ ID NO: 38588 - protein, 370 aa, Clostridium tetani E88
MTNFKELGLSNDLIQNLKTQGINSPTPIQRESILLIKEGNDVIAEAQTGTGKTLAFLLPMFENMSPNINTIQGLIVTPTRELAIQITEEAMKLNESKDLNILSAYGGKDIGSQLNKLKGNIHLVIATPGRLLDHLDRNTIDLKNLKTLVLDEADQMLLMGFKNEVETIIKHTSKNRQTLCFSATMNSSVKKLAYKYMDDPKLITIQKEEITLKNIKQVLIETTDRNKLDDLCKVLNETNPFMAIIFCRTKRRVDKLEMDLYQRGYNCKKLHGDLTQSKREKVMKDFKNTKIQYLIATDVAARGLDITGVTHIYNYDIPENTENYIHRIGRTGRAGEKGYAYLFIDLKDKETLNIIEKGIKTKIERIKNHK

SEQ ID NO: 38589 - DNA, 1587 bp, Lactobacillus plantarum WCFS1
  CDS (1)..(1587)
ttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgacaaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcccggccggttgcttgaccacattcgccggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgacccggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattctggttgcaaccgatgtggctgctcggggacttgatgtttctggtgtgacccacgtttacaattatgatattccacaggatccggacagttatgttcaccggattggccgtactggccgtgccggacacaagggtgtttcattaacttttgtaacaccaaacgaaatggaatatttgcgggtcattgaaaagttgaccaagaagcggatgttaccattgaagccaccaactgaatctgaagcttttgctggccaactagctgctgcagaagccaatgttgattcattagttgccaagacttcaactgaaaagtatgctgatcaggctgctgaattattacaaaaatacgatgctactgatctagttgctgccttgttaaatgacttaactaaggacgacgcctcagccgtacccgttaagattacgccagaacgcccattacctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggcgatcggaagagcaatggttataaaggtcgcagtcgcgatgataaccggagcagcaaccgcaaccatgatgaaggtcgcaagcaaagcagcaagcggagctatacgatccgcaccaatgattaa

SEQ ID NO: 38590 - protein, 528 aa, Lactobacillus plantarum WCFS1
MKFTELGLSDSLLKAVNRAGYEEATPIQAETIPMVLEGKDVIGQAQTGTGKTAAFALPILQRLDFDNHNIQALVVSPTRELAIQTQEEIFRLGKDERAKVQVVYGGADIRRQIRNLKQNPQVIVGTPGRLLDHIRRGTVKLDHVKMLVLDEADEMLNMGFLEDIESIIKQVPDERQTMLFSATMPPEIKRIGVQFMKEPHHVKIKSKEMTADTVDQYYVKAKEFEKFDIMTRLFDVQAPELTIVFGRTKRRVDELSKGLEARGYNAAGIHGDLSQQRRTQIMRQFKAGKLDILVATDVAARGLDVSGVTHVYNYDIPQDPDSYVHRIGRTGRAGHKGVSLTFVTPNEMEYLRVIEKLTKKRMLPLKPPTESEAFAGQLAAAEANVDSLVAKTSTEKYADQAAELLQKYDATDLVAALLNDLTKDDASAVPVKITPERPLPRHKGGGGNNRRGGYRGGNRNRNNSHGNGRGGYSHNGRNRDRDRNGGRGDRKSNGYKGRSRDDNRSSNRNHDEGRKQSSKRSYTIRTND

SEQ ID NO: 38591 - DNA, 1380 bp, Vibrio parahaemolyticus RIMD 2210633
  CDS (1)..(1380)
gtgagcaaacaaacttttgaccaagtaggcctgaacccagcgctactagaaacgctggattcattgaactacacccatatgacgccaattcaagcgttaagcttaccggcgattttgaatcagcgtgacgtaattggtcagggtaaaacgggctcgggtaaaacagcggcgtttggtcttggcgtgctatcaaatctaaacgtaaaacgatttcgcgtgcaggctttggtgctgtgtccgactcgcgaactggcggatcaagttgctaaagaaattcgaacgctagggcgtggtatccataacattaaagtacttacgttgtgcggcggtatgccgatgggaccgcaaattggttcgttagagcatggtgcacatatccttgttggtactccggggcgtattctggatcaccttgagaaaggccgtattaacttggaagagctgaatacactggtgctggatgaagccgatcgtatgctagaaatgggcttccaagacgctttggatgcgattattaatgcggcgcctaaacagcgtcagacattgctgtttagcgcaacattcccagagaagatcgagaaaatcgctcagcgtattatgaaatcgccagagatgatcaaggttgaatcgactcacgatacttccagcattgctcaatacttctacaaagtagaaggaactgaagcgcgtgatgaggcgctagccaatcttcttttgacttaccaaccagagtcggcggtggtgttctgtaatacgaagaaagaagtgcaaaatgtcgcggatgaattacaccatcgcggctttagcgtgatcgatattcacggtgatcttgaacagcgtgaacgtgatcaagcactggtgcaatttgcgaacaagagcgtttctattcttgtggcaacggacgtggcggcacgaggtttggatgtggacaatcttgatgctgtgttcaactttgagctgtctcgtgacccagaggtacacgtgcaccgtattggccgtactggccgagcaggcagtaaaggtttggcgttcagcttttttggcgaaaaagacggtctacgtgttgctcgtatcgaagagtacttagagatggatgtggtacccgcgaccttgccagcgaaatcaaatcagcagccataccaagcgaagatggtgaccatcaacattgatggcggcaagaagcaaaaagttcgtcctggcgatattcttggttgtttgactggcaaaaatggcatcccaggtgcgcaagtgggcaagattcatttgttccctgtacgttcttacgttgctgtagaaaagtctgccgcgaagaaagcattgcaaattatcagtacgggtaagatgaaagggcgtcagttccgagcgcgtcttcttaaataa

SEQ ID NO: 38592 - protein, 459 aa, Vibrio parahaemolyticus RIMD 2210633
MSKQTFDQVGLNPALLETLDSLNYTHMTPIQALSLPAILNQRDVIGQGKTGSGKTAAFGLGVLSNLNVKRFRVQALVLCPTRELADQVAKEIRTLGRGIHNIKVLTLCGGMPMGPQIGSLEHGAHILVGTPGRILDHLEKGRINLEELNTLVLDEADRMLEMGFQDALDAIINAAPKQRQTLLFSATFPEKIEKIAQRIMKSPEMIKVESTHDTSSIAQYFYKVEGTEARDEALANLLLTYQPESAVVFCNTKKEVQNVADELHHRGFSVIDIHGDLEQRERDQALVQFANKSVSILVATDVAARGLDVDNLDAVFNFELSRDPEVHVHRIGRTGRAGSKGLAFSFFGEKDGLRVARIEEYLEMDVVPATLPAKSNQQPYQAKMVTINIDGGKKQKVRPGDILGCLTGKNGIPGAQVGKIHLFPVRSYVAVEKSAAKKALQIISTGKMKGRQFRARLLK

SEQ ID NO: 38593 - DNA, 1932 bp, Vibrio parahaemolyticus RIMD 2210633
  CDS (1)..(1932)
atgcaagattctgttattcaattcagcgatttatctctgaatgattctatcctttctgctctagacggaatgggtttcgtgtcaccaactccaattcaggctgcggcaatcccacacctattggaaggtgctgacgcgctgggtaaagcacagacgggtacaggtaaaacggcagcattctctctgcctcttctaaacaagctagatcttgatcaacgtaaaccacaagcaatcgttcttgctccaactcgtgagctagcgatccaggttgcggctgaaatgaaaaaccttggtaaaaacatcaagggtcttaaagttctagaaatctacggtggtgcatctatcgtagatcaaatgcgtgctcttaaaaacggtgcacacgttgttgttggtactcctggccgtgttcaagaccttatcaaccgtgaacgtctacatcttgacgaagtgaatactttcgtacttgatgaagcggacgaaatgctaaacatgggtttcgtggacgacgtaactgcaatcatggagcacgctcctgaatcagcacaacgcgttctattttctgcaactatgccaccaatgctgaaaaacattgttgagcgcttcctacgtgatcctgtaactgttgacgttgctggtaaaaaccacactgtagacaaagttcaacagcagttctgggtagtgaaaggtgtagagaaagatgaagctatgtctcgtcttcttgaaactgaagaaactgacgcgtcaatcgtattcgtacgtactcgtcaagacaccgagcgtctagctgactggctatctgcacgtggcttcaaagctgctgcactgcacggtgacattcctcagtctctacgtgagcgtactgttgatcacatcaaacaaggtgttatcgacatcctagtggcaactgacgttgttgcacgtggtcttgatgttccacgtatcactcacgtatttaactacgacatcccattcgatgttgagtcttacatccaccgtatcggtcgtactggccgtgcaggacgtaaaggcaaagcgatccttctagttcgcactaaccaaatccgcatgcttcgcactatcgagcgcgtgactaagtcatctatggaagaaatccaacttcctctacgtgaccaagttgcagaagctcgtctaaacaagctagcggctgaactggaagctgagaaagagcacaaagcactagacaagttcgcagagctagtagagaaactacaaacttctctagaaatcgaccctgcgatgcttgctgcaatgcttcttaagcgtcaacaaggtaaacgtcctctgttctacattggtgaagacccaatggttgaagcgattgagcgtgacaagcagcgtcgtaaagaacgccgtgaaggtggccgtgaaggcggtcgtagcttcaacaaccaagactgggatacttaccagcttcaagttggtcgcgagcaaggcgttcaagttaaagatatcgttggtgctctagcaaacgaactaggcctaggtaaaggttctatcggtgcgatcaagctagcgcaaggtcacacattcgttcagctaccaaaagcaatgacttctgaagctgcgagcaaactaagcaaactgcgtatccgtcaacaagatgttggtgctgtagtatgtgatttcgatgatttccgcgagtctcgtggtggtcgccgtgacggtggtcgtcgcgatggcggccgtcgtgaaggtggtttccgtggtaaccgcgaaggtggcaaccgtggtggtgagcgtcgtgaaggcggtcgtcgtgaaggtggcttccgtggtaaccgtgacggcaaccgcgaaggtaaccgtgaaggtggcgaacgtcgtttcgatcgtaaccgtggtggtgatcaccgtggtaactaccgtggcgaacgtggtcacggccgtggccgtcgtactcaagacgcataa

SEQ ID NO: 38594 - protein, 643 aa, Vibrio parahaemolyticus RIMD 2210633
MQDSVIQFSDLSLNDSILSALDGMGFVSPTPIQAAAIPHLLEGADALGKAQTGTGKTAAFSLPLLNKLDLDQRKPQAIVLAPTRELAIQVAAEMKNLGKNIKGLKVLEIYGGASIVDQMRALKNGAHVVVGTPGRVQDLINRERLHLDEVNTFVLDEADEMLNMGFVDDVTAIMEHAPESAQRVLFSATMPPMLKNIVERFLRDPVTVDVAGKNHTVDKVQQQFWVVKGVEKDEAMSRLLETEETDASIVFVRTRQDTERLADWLSARGFKAAALHGDIPQSLRERTVDHIKQGVIDILVATDVVARGLDVPRITHVFNYDIPFDVESYIHRIGRTGRAGRKGKAILLVRTNQIRMLRTIERVTKSSMEEIQLPLRDQVAEARLNKLAAELEAEKEHKALDKFAELVEKLQTSLEIDPAMLAAMLLKRQQGKRPLFYIGEDPMVEAIERDKQRRKERREGGREGGRSFNNQDWDTYQLQVGREQGVQVKDIVGALANELGLGKGSIGAIKLAQGHTFVQLPKAMTSEAASKLSKLRIRQQDVGAVVCDFDDFRESRGGRRDGGRRDGGRREGGFRGNREGGNRGGERREGGRREGGFRGNRDGNREGNREGGERRFDRNRGGDHRGNYRGERGHGRGRRTQDA

SEQ ID NO: 38595 - DNA, 1125 bp, Bacteroides thetaiotaomicron VPI-5482
  CDS (1)..(1125)
atgacatttaaagaattaaatataaccgaacctattttaaaagcaattgaagaaaaaggatatacagtacctactcctattcaggagaaagcgattcctgtagcattggcaaaaaaagacattttaggctgtgcgcagactggaaccggaaagactgcttcatttgcaatacctattatacaacatttgcatctcaataagggagagggcaagcgttcggaaatcaaagctctgattttgactcctacccgcgaactcgcattgcaaatcagtgaatgtattgaagattattcaaagtatacacgtatccgtcacggagtcatcttcggaggcgtgaatcaacgtccgcaagtggatatgctgcataaaggaattgatattctggttgctactccggggcgtctgctcgatttgatgaatcaaggacatatacgattggataatattcagtattttgttctggacgaagcagaccgtatgcttgatatgggctttattcatgatattaaacggatattgccgaagcttccgaaagaaaagcaaacgttgttcttttcggctacgatgcctgatacgattattgctctgactaattccttgttgaagaatccggtgaagatttatgttacaccgaaatcatcaacggtagattctataaagcagttggtttactttgttgagaagaaagaaaagagcctgttgctgatttcaattttgcaaaaatcggaggaccggtcggtacttatcttttcgcgtaccaagcataatgctgataagatagttaaaatattgggtaaagccggcattggcagccaggctattcatggaaataagagtcaggcggcacggcagtccgcattgggtaacttcaagtcgggtaagacgcgagtgatggttgctactgatatcgcttcccggggaattgatattaatgaactgccgttggttatcaattatgatcttcctgatgttcccgagacatatgtacaccgaatcgggcgtacgggaagagctggaaatgcaggtatggcacttacattctgctctcaggaagaacgcaaacagattaatgatattcagaaattgacaggcaaaaaactaaatagggctgattttacaatttaa

SEQ ID NO: 38596 - protein, 374 aa, Bacteroides thetaiotaomicron VPI-5482
MTFKELNITEPILKAIEEKGYTVPTPIQEKAIPVALAKKDILGCAQTGTGKTASFAIPIIQHLHLNKGEGKRSEIKALILTPTRELALQISECIEDYSKYTRIRHGVIFGGVNQRPQVDMLHKGIDILVATPGRLLDLMNQGHIRLDNIQYFVLDEADRMLDMGFIHDIKRILPKLPKEKQTLFFSATMPDTIIALTNSLLKNPVKIYVTPKSSTVDSIKQLVYFVEKKEKSLLLISILQKSEDRSVLIFSRTKHNADKIVKILGKAGIGSQAIHGNKSQAARQSALGNFKSGKTRVMVATDIASRGIDINELPLVINYDLPDVPETYVHRIGRTGRAGNAGMALTFCSQEERKQINDIQKLTGKKLNRADFTI

SEQ ID NO: 38597 - DNA, 1944 bp, Bacteroides thetaiotaomicron VPI-5482
  CDS (1)..(1944)
atgaagacatttgaagagcttggcgtttctccggagatacgtaaagcaattgaagagatgggatatgagaatcccatgccggtacaagaggaagtgattccgtaccttttaggagaaaataatgatgtagtagctcttgcacaaactggaacaggtaaaacagccgcattcggcctgcctctgctccaacagattgacgtaaagaacagggttccccagtcactaatactttgccccacccgtgagctatgcctccagatagcgggcgatctgaacgattactcaaaatacattgacggactgaaagtactgccagtttacggcggttcttccatcgacagccagatacgcagcctgaaacgcggcgtacatatcatcgtggccacaccgggacgactgctcgacctgatggagcgcaaaaccgtatctttatcgaccgttcacaacatagtgatggacgaagcggacgaaatgctgaatatgggattcaccgacagcatcaacgctatccttgccgatgtccccaaagaacggaacaccttgctcttctcggcaaccatgagccccgaaatcgcccgcatctccaagaactacttgcagaatgccaaggagattaccatcggacgcaagaacgaaagtacaagcaatgtgaaacacgtagcttataccgtacaagccaaagacaaatatgcagccctgaaacgcattgttgactattacccgcaaatatatggtatcattttctgccgtacccgtaaagaaacgcaggaaatagccgataaattgatgcaggaaggctataacgcagattcactgcacggagaactgtcacaggctcagcgcgatgccgtgatgcagaaattccgcatccgcaacctgcaattactggttgctacggacgttgccgcacgcggactggacgtagacgacctgacacacgtgatcaactacggcctgcccgatgatacggaaagctacacacatcgtagcggacgtaccggacgtgccggaaagacaggtacttccatcgctatcatcaacctgcgcgaaaaaggaaagctgcgtgagatagagcgcatcatcggcaagaagtttattgccggagaaatgccgacaggcaagcagatctgcgaaaaacagcttatcaaagtgattgatgaactggaaaaggtgaaggtaaacgaagaagaaatcacggacttcatgccggagatttatcgtaagctggaatggctgagcaaagaggatctgatcaaacgcatggtatcgcatgagttcaatcgttttctggactactaccgcgaccgtgaagagatcgagactccgaccgacagccgcgaacgtaacacacgtgacagccgtgaaagaggcagccgcaaggcagcgccgggtttcacccgcttattcatcaatctgggaaaaatggacagtttcttcccaagcgaactgatcagcttgctgaacagcaatacacgtggacgaatcgagttgggacgcattgacttgatgaaaaatttctccttcttcgaagtagaagagaaagaagcacaaaacgtagtgaaggcgttgaaccgcgctaactggaacggccgcaaagtatctgtagaagttgccggtgaggaagcaggagaaggtcggagaggcagtggttctgccgaacgcagaggaggaaaacgtcctttcggaagttcctccgaaaagcgtagtgacagtagccgcaactcacgttccgaaagatcggacagagcaccgcgagctgacagagcgactaaaggcagtgacaagaccgacaagaaaaaaagaagcgacaagcccagccgcgaagaacggggttacggagcacgtggtcctaaaaagacagacgactggcaacagttctttaaagataaagagcctgacttcagcgaggaaggatgggcacgcagaaagccgaaaaagaagtaa

SEQ ID NO: 38598 - protein, 647 aa, Bacteroides thetaiotaomicron VPI-5482
MKTFEELGVSPEIRKAIEEMGYENPMPVQEEVIPYLLGENNDVVALAQTGTGKTAAFGLPLLQQIDVKNRVPQSLILCPTRELCLQIAGDLNDYSKYIDGLKVLPVYGGSSIDSQIRSLKRGVHIIVATPGRLLDLMERKTVSLSTVHNIVMDEADEMLNMGFTDSINAILADVPKERNTLLFSATMSPEIARISKNYLQNAKEITIGRKNESTSNVKHVAYTVQAKDKYAALKRIVDYYPQIYGIIFCRTRKETQEIADKLMQEGYNADSLHGELSQAQRDAVMQKFRIRNLQLLVATDVAARGLDVDDLTHVINYGLPDDTESYTHRSGRTGRAGKTGTSIAIINLREKGKLREIERIIGKKFIAGEMPTGKQICEKQLIKVIDELEKVKVNEEEITDFMPEIYRKLEWLSKEDLIKRMVSHEFNRFLDYYRDREEIETPTDSRERNTRDSRERGSRKAAPGFTRLFINLGKMDSFFPSELISLLNSNTRGRIELGRIDLMKNFSFFEVEEKEAQNVVKALNRANWNGRKVSVEVAGEEAGEGRRGSGSAERRGGKRPFGSSSEKRSDSSRNSRSERSDRAPRADRATKGSDKTDKKKRSDKPSREERGYGARGPKKTDDWQQFFKDKEPDFSEEGWARRKPKKK

SEQ ID NO: 38599 - DNA, 1611 bp, Enterococcus faecalis V583
  CDS (1)..(1611)
gtgaagacacctgaaactaggaagaaatcgttctttccgaaacaaaatctaggaggatatcatttgaaatttaaagaacttggtttagcgccagaattattatcagcggtagaacgcgcaggcttcgaggaagcaacccctattcaatcagaaacaattccgttagcgttagcaggaaaagacgtaatcggacaagcacaaacaggaacagggaaaaccgctgcttttggcttaccaatgcttaacaaaattgacgcagacaatcgcgttattcaaggattagtcattgcaccaacccgtgagttggctatccaaacacaagaagagttattccgtttaggccgcgataaaaagattcgcgtccaagccgtttacggtggggctgatatcggtcgccaaatccgtggactaaaagatcgtccacatatcgttgtaggtacaccaggacgtttactagatcatattaatcgtcgtaccttgaaattagaaactgttgaaacattagttttagacgaagcagatgaaatgttaaacatgggcttcttggaagacattgaaaaaatcatctcacaagtgccagaacaacgtcaaacacttctattttcagcaactatgccgccagcaatcaagaatattggcgtgaaattcatgaaacaaccagaacatgtgaagattaaagccaaagaaatgacggctgatttaattgatcaatattatgtacgttcaaaagactttgaaaaatttgacattatgacacgtttactagacgtgcaaaccccagaattgaccattgtctttggtcggacaaaacgccgtgttgatgaacttgcccgcgggttagaagcgcgtggttacaaagcagaaggcatccatggcgacctatcacaacaaaaacggatgagcgttttacgttcattcaaaaatggtaacttagatatcttagtggcaacagatgtagcagcacgtgggttagatatttcaggtgtcactcatgtctataactacgatattccacaagatccagaaagttatgttcaccgtattggtcggacaggtcgtgctggtaaaggcggtatgtctgtgacgtttgtaacaccaaacgaaatgggttacttacatgtcatcgaaaacctaacgaaaaaacggatgacaccattacgtccaccaaccgaaaaagaagcatttaaaggacaattaagtgcagctgttgaaaccatcgaaagtgatctagaagaaaatggtttagacaaatatctagaatctgctgaagcgttattagaaaaatattcagcgacagacttagctgcgttattattaaaaacagtagcgaaagatccagcagatgcggttcctgtaaaaattaccccagaacgaccattgccttcaaataaaaaaggctttaacaaaaatggccgtggtggtggcggtgggaacaaccgtaatcgcaaccgtggtggcaatggtaaaggtggcagctatcgtggcaacaaaaaccataaagatggcgaccgtaattacaaaaatagcgaccgcaaaaataaagatcaacgtggcggcaaacgtcataacgataaaaaacgtggtttcgtcattcgcgaaaacgccaaataa

SEQ ID NO: 38600 - protein, 536 aa, Enterococcus faecalis V583
MKTPETRKKSFFPKQNLGGYHLKFKELGLAPELLSAVERAGFEEATPIQSETIPLALAGKDVIGQAQTGTGKTAAFGLPMLNKIDADNRVIQGLVIAPTRELAIQTQEELFRLGRDKKIRVQAVYGGADIGRQIRGLKDRPHIVVGTPGRLLDHINRRTLKLETVETLVLDEADEMLNMGFLEDIEKIISQVPEQRQTLLFSATMPPAIKNIGVKFMKQPEHVKIKAKEMTADLIDQYYVRSKDFEKFDIMTRLLDVQTPELTIVFGRTKRRVDELARGLEARGYKAEGIHGDLSQQKRMSVLRSFKNGNLDILVATDVAARGLDISGVTHVYNYDIPQDPESYVHRIGRTGRAGKGGMSVTFVTPNEMGYLHVIENLTKKRMTPLRPPTEKEAFKGQLSAAVETIESDLEENGLDKYLESAEALLEKYSATDLAALLLKTVAKDPADAVPVKITPERPLPSNKKGFNKNGRGGGGGNNRNRNRGGNGKGGSYRGNKNHKDGDRNYKNSDRKNKDQRGGKRHNDKKRGFVIRENAK

SEQ ID NO: 38601 - DNA, 1236 bp, Coxiella burnetii RSA 493
  CDS (1)..(1236)
atgtcatttgaagttctcggcttgtcggctgagttattacgtgctattcgtgaacaaggttacgttgagcccacacccgttcagcgacaggcgattccggttatcttgcaagcgcgggacgttatggttactgctcagacgggcactggcaaaaccgcgggatttacattgcctttattgcaacggttatttgtttctcgtccccccttacagcgttctgctaaacctgtgattcgggcattgattttgacgcccacgcgggaattagctgtgcaagtctttgagtgcgttcgggcctacggtaaatatcttccattgaaagctaccgtagttcacgggggcgtgagcatcaagccgcagatcaatcatttgcgacgaggcgtcgatatcctggttgccacgccgggccgtcttcttgatttagtcaatcaaggtgttttaaacctatcgcgggttgaattcttcgttttagatgaagccgatcgcatgcttgatatgggttttttacctgatattcgccgaattttgaagctgttgccggaatctcgtcagaatctcttattttcagcgactttttcaaaagagattaaagaactcacggataaattattacattcaccggcactgattgaagtggcgcgccgcaacacggctgcagcacgcatcacccacgttgttcatcctgttgatcgtcagcgcaagcgtgaattgctttcgtttatgattggctccaagaactggcggcaggtattggtatttacgcgaacaaagcacggggcaaaccgtttgtcacaacaattggagagcgatgggttgtcctcagcggcgattcatggcaataaaagccaagcggcacgaatgcgcgcgctcactcagtttaagcaaggaaaaattcgggtgttagtggccaccgatgtagctgcgcgaggactggatatcgataaacttccccatgtaattaactttgagcttccggatgcggcaaaggattacgtccatcgcgtggggcgaactggtcgggccagtaatgacggcgttgctatttcgttagtttctggggatgaagttagattattgagagatattgagaagttgttgcaatctaaaatgccgcaggaagtgattcctgggtatgaacctagcccttttacaaaggcagcgcctgttcaagcggtgcggcgtgctcggagtaatcagcgtggaaaaaataatgggaaaagggcgcggtggggttga

SEQ ID NO: 38602 - protein, 411 aa, Coxiella burnetii RSA 493
MSFEVLGLSAELLRAIREQGYVEPTPVQRQAIPVILQARDVMVTAQTGTGKTAGFTLPLLQRLFVSRPPLQRSAKPVIRALILTPTRELAVQVFECVRAYGKYLPLKATVVHGGVSIKPQINHLRRGVDILVATPGRLLDLVNQGVLNLSRVEFFVLDEADRMLDMGFLPDIRRILKLLPESRQNLLFSATFSKEIKELTDKLLHSPALIEVARRNTAAARITHVVHPVDRQRKRELLSFMIGSKNWRQVLVFTRTKHGANRLSQQLESDGLSSAAIHGNKSQAARMRALTQFKQGKIRVLVATDVAARGLDIDKLPHVINFELPDAAKDYVHRVGRTGRASNDGVAISLVSGDEVRLLRDIEKLLQSKMPQEVIPGYEPSPFTKAAPVQAVRRARSNQRGKNNGKRARWG

SEQ ID NO: 38603 - DNA, 1545 bp, Bacillus cereus ATCC 14579
  CDS (1)..(1545)
atgggctttgaagaggctacaccaattcaagctgaaacaattccacatgcattgcaaggtaaagatattattgggcaagcgcaaacaggtacagggaaaacagcagcattcggattaccactattagataaagtggatacacataaagaatcggttcaaggtattgttatcgcgccaacgcgtgaattagcaattcaagttggagaagaattatacaaaattggtaagcataaacgcgttcgtattttaccgatttatggtggtcaagatattaaccgccaaattcgtgctctaaaaaaacacccacacattattgttggtacgccgggtcgtattttagatcatattaaccgtaaaacacttcgtctgcaaaacgtagagacagttgttcttgacgaagcggatgaaatgttaaacatgggcttcattgaagacattgaagcaattttaacagatgtgccagaaacacatcaaacattactattctcagcgacaatgccggatccaatccgccgtattgctgagcgtttcatgactgagcctcaacacattaaagtaaaagcaaaagaagtaacaatgccaaacattcagcagttctatttagaagtgcaagaaaagaaaaagtttgacgtgttaacacgcttattagatattcaatctccagagcttgcaatcgtatttggtcgtacaaagcgtcgtgttgatgaattatcagaagcattaaacttacgtggttatgctgcagaaggtattcacggtgatttaactcaggcgaaacgtatgtctgtattacgtaaatttaaagaaggttctattgaagttcttgttgcaacagacgttgctgcgcgtggtcttgatatttcaggcgtaacgcacgtatataacttcgatattccacaagatccagaatcatacgttcaccgtatcggtcgtactggtcgtgcaggtaaaaaaggtattgcaatgctatttgtaacaccacgtgaatcaggacaattaaaaaatatcgagcgtacaacaaaacgtaaaatggaccgtatggatgcaccgacacttgacgaggcattagaaggtcaacaacgtttaatcgctgaaaagcttcaaagcacaattgaaaatgaaaacttagcatactacaagcgtattgcagaagaaatgttagaagaaaatgactctgtaacagtagtagctgctgctttaaaaatgatgactaaagagccggatacaactccgatcgctttaacatcagaaccacctgttgtttcaagaggcggcggttctaaaaaacgcggcggtaacggaggcggataccgtgatggtaaccgtaatcgtagtcgtgatggacgcggcggtggcgatggacgtaatcgtgaccgtaaccgtgatggacgtaatcgtgacggaaaccgtgatcgcaatcgtgatggtaaccgcgatcgtaatcgtgatggtggtagtcgtggtcgtagaggtgaaggccaaggtcgccctggttcttcaaatggacgcggcgaaagaaaacatcatagccgtccacaagcttaa

SEQ ID NO: 38604 - protein, 514 aa, Bacillus cereus ATCC 14579
MGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVSRGGGSKKRGGNGGGYRDGNRNRSRDGRGGGDGRNRDRNRDGRNRDGNRDRNRDGNRDRNRDGGSRGRRGEGQGRPGSSNGRGERKHHSRPQA

SEQ ID NO: 38605 - DNA, 1377 bp, Bacillus cereus ATCC 14579
  CDS (1)..(1377)
gtggtctatttgaaaaactttttagaattaggaattagtgaaacttttaatcatacattacgtgaaaatggaattacagaagcaacaccaattcaagagaaggcaattccagttattctgtcaggtaaagatattattgggcaggcgaaaacaggaacgggtaaaacgttagcattcgtgttaccgattttagaaaaaattgatccagagtgtagtgatgtccaggctttaatcgttgcgccaacaagggaattagccctgcaaattacaactgaaattaaaaaaatgcttgttcaaagagaagatattaatgtactagcgatttatggtgggcaagatgtagcacaacaattgagaaaattaaaaggtaatacacatattgttgttgcaacaccaggacgattattagatcatatacgacgtgaaacaattgatttaagtaatctttcaacgattgtactagatgaagcggatcaaatgctttattttggtttcttatatgatattgaagacattttagatgagacaccaggtagtaaacaaacgatgttattctcagcaacgatgccaaaagatattaaaaaattggcgaagcgttatatggatgaaccgcaaatgattcaagtacaaagtgaagaagtaacggttgatacaattgagcagcgtgtcattgagacgacagaccgtgcaaagccagatgcacttcgttttgttatggatcgtgatcagccatttttagctgttattttctgtcgtacaaaggttagagcaagtaagctttatgataatttaaaaggactaggttataattgtgctgaacttcatggtgatatacctcaagcgaaacgtgaaagagttatgaagagtttccgcgaagctaaaattcagtacttaatcgcaacggatgtagcagctcgtggacttgatgtagatggtgtaacgcacgtatttaactatgatatccctgaagatgtagaaagttacattcatcgcattggccgaacaggacgtgcaggtggatcaggtcttgcaattacgttcgttgcagcgaaagatgaaaaacatttagaagaaattgaaaaaacgcttggtgcaccaatacaaagagaaataatcgaacaaccgaagataaaacgtgtagatgaaaatggaaaaccggtaccaaagccggctccgaagaaatcaggtcaaaatcgtcaaagagatagccgcgaaggttcaagaagtgattcaagacgtgattcgagaaatagctcaagaagtgattcaagaaatagttcgagaaatagttctagaaatgaaaataaccgatcatttaataagccaagtaataaaaaaggtagtacaaagcaaggtcagcaaagacgtggtcgttaa

SEQ ID NO: 38606 - protein, 458 aa, Bacillus cereus ATCC 14579
MVYLKNFLELGISETFNHTLRENGITEATPIQEKAIPVILSGKDIIGQAKTGTGKTLAFVLPILEKIDPECSDVQALIVAPTRELALQITTEIKKMLVQREDINVLAIYGGQDVAQQLRKLKGNTHIVVATPGRLLDHIRRETIDLSNLSTIVLDEADQMLYFGFLYDIEDILDETPGSKQTMLFSATMPKDIKKLAKRYMDEPQMIQVQSEEVTVDTIEQRVIETTDRAKPDALRFVMDRDQPFLAVIFCRTKVRASKLYDNLKGLGYNCAELHGDIPQAKRERVMKSFREAKIQYLIATDVAARGLDVDGVTHVFNYDIPEDVESYIHRIGRTGRAGGSGLAITFVAAKDEKHLEEIEKTLGAPIQREIIEQPKIKRVDENGKPVPKPAPKKSGQNRQRDSREGSRSDSRRDSRNSSRSDSRNSSRNSSRNENNRSFNKPSNKKGSTKQGQQRRGR

SEQ ID NO: 38607 - DNA, 1446 bp, Bacillus cereus ATCC 14579
  CDS (1)..(1446)
atgagtaaaaaaagtttttctgattataaattaagtaaggaaattgtaagggcacttactgggttagggtatgatcatccaacagaagtacaaggtgaggttattccagttgcattacaaaagaaggatcttgttgtgaagtcccagactggaagtggaaaaacagcttcatttggtattccactttgtgaaatggtggagtgggaagagaataaaccacaagcattagttttaacaccaacgagagagcttgcggtacaggtaaaagaagatattacaaatataggtcgattcaaaaggattaaggctgcggcagtttatgggaaatctccatttgcacgtcaaaaattagaattaaagcaaaagacacatattgtagttgggactcctggtcgtgtgttggatcatattgagaagggtaccctttctttagagtgtttgaagtatttagttattgatgaagcagatgagatgctaaatatgggctttatcgatcaagtagaggcaattattgatgaattacctacaaaaagaatgacgatgttattttcagcaacacttccagaagatgttgagaaattgtctcgtacatatatgaattcaccaactcatattgaaattaaagcggctgggattacgacggataaaattgaacatactctttttgaggtgatagaagacgagaagctttcactacttaaagatgtaacaacgattgagaatcctgatagctgtattattttctgccgtacacaagaaaatgtagatcatgtatatagacaattaaaacgagctaactatccctgtgacaaaatacatggtggtatggtacaagaagatcgttttgaagtcatggatgattttagaaaaggaaaattccgttatttagtagcaacagatgtagctgcgagaggaattgatattgataatattacacatgttattaattatgatattccacttgaaaaagaaagctatgtacatcgtactggaagaacgggacgagctggaaatagtggaaaagctattacatttataacaccatatgaaaatagatttttagaagagattgaggagtatattggatttgaaattccaaaggcaattggaccttcaaaagaagaagttatgaaagagaaagctgcatttgaagaaaagctacatgctaaaccaattataaagaaagataaaaatgcagacatcaacaaaggcattatgaagctgtactttaatggcgggaagaaaaagaaaattagggcggtagatttcgtcggtacaattgctaaaattaaaggtgttacagcagaagatataggtattattacgatacaagataatgtttcttatgttgaaatattaaatggaaaaggaccactcgtcttgaaagtcatgaagactacaacgattaaagggaaacaactaaaagttcatgaagcaattaagtaa

SEQ ID NO: 38608 - protein, 481 aa, Bacillus cereus ATCC 14579
MSKKSFSDYKLSKEIVRALTGLGYDHPTEVQGEVIPVALQKKDLVVKSQTGSGKTASFGIPLCEMVEWEENKPQALVLTPTRELAVQVKEDITNIGRFKRIKAAAVYGKSPFARQKLELKQKTHIVVGTPGRVLDHIEKGTLSLECLKYLVIDEADEMLNMGFIDQVEAIIDELPTKRMTMLFSATLPEDVEKLSRTYMNSPTHIEIKAAGITTDKIEHTLFEVIEDEKLSLLKDVTTIENPDSCIIFCRTQENVDHVYRQLKRANYPCDKIHGGMVQEDRFEVMDDFRKGKFRYLVATDVAARGIDIDNITHVINYDIPLEKESYVHRTGRTGRAGNSGKAITFITPYENRFLEEIEEYIGFEIPKAIGPSKEEVMKEKAAFEEKLHAKPIIKKDKNADINKGIMKLYFNGGKKKKIRAVDFVGTIAKIKGVTAEDIGIITIQDNVSYVEILNGKGPLVLKVMKTTTIKGKQLKVHEAIK

SEQ ID NO: 38609 - DNA, 1374 bp, Nitrosomonas europaea ATCC 19718
  CDS (1)..(1374)
gtgtcatttgaaaatttgaatctgcatcccgcaatcgtaaaagccgtactggcagcgggttatactgcccccacccccattcagcagcaagccattccggatctgatcgcaggccatgatgtcatggcaagtgcacagaccggaaccggcaaaacagccgccttcatgctgccggcattgcatcgtctggccacacccgcacaaattcgcggacgtggcccgcgcatactggttctgacaccaacacgtgaactggctctgcaggtttccgatgctgccagcaaatatggaaaattcctgccacgtatcaatgtcgtcagtattctgggcggtatgccctaccccctgcaaaataaactcctgtcacaaaccgtcgatgtactggtcgccacacccgggcgtttgatcgatcacatcgaacgcgggcggatagatttttcgcggctggaaatgctggtactggacgaagcagatcgcatgctggatatggggttcatccaggatgtcgagcgcatcgctctctcgacacccgcaaccaggcaaacgctgctgttctcggcaacgctggacgttgcaatcgagaaaatcgccacacgtctgctgaaagcaccgaaacgcattcaggtggctgctcagcataccaaactcgatcacatcgaacagcgtatgcattatgtagatgatctcacgcacaaaaacaggttactggaccatctgctgcgtgacaccaccatcaaacaggcaatcgtatttactgcaacgaaacgtgatgccgattccctcgcagataatctttcttcccagggacacaaggctgccgccatgcacggagacatgacgcagcgtgaacgtacacgcactctgaccggcctgcgtcagggccggctcaagattctggtggctacggatgtcgccgcacgcggaatcgatattgccgacattacccatgtcatcaatttcgatttgccaaagtttgcagaagactatgtgcatcggatcgggcggaccggccgggctggcgcttccggtatcgcagtttcgttcgcatccgggaaagatgttgctcatctgaagagaatcgaacggtttaccggcaatcgctttgaatttcatgtcatacccggtatagaaccacgtaccaaaccaagatttggtcgtagtgacgacaaaccaggaagaagaccatcttcctctgctgctgcacacaaaaccagacgttcatggtcggacaatcccaatacacgcacggcttccccaggtcaccgaggagacaaagatgctgggttcgggcaaccatttggtcgtgaaacccgtaaacgtccgttcagggacagcaaattcaacagcgccgatcgttttgcccgcacggagtaa

SEQ ID NO: 38610 - protein, 457 aa, Nitrosomonas europaea ATCC 19718
MSFENLNLHPAIVKAVLAAGYTAPTPIQQQAIPDLIAGHDVMASAQTGTGKTAAFMLPALHRLATPAQIRGRGPRILVLTPTRELALQVSDAASKYGKFLPRINVVSILGGMPYPLQNKLLSQTVDVLVATPGRLIDHIERGRIDFSRLEMLVLDEADRMLDMGFIQDVERIALSTPATRQTLLFSATLDVAIEKIATRLLKAPKRIQVAAQHTKLDHIEQRMHYVDDLTHKNRLLDHLLRDTTIKQAIVFTATKRDADSLADNLSSQGHKAAAMHGDMTQRERTRTLTGLRQGRLKILVATDVAARGIDIADITHVINFDLPKFAEDYVHRIGRTGRAGASGIAVSFASGKDVAHLKRIERFTGNRFEFHVIPGIEPRTKPRFGRSDDKPGRRPSSSAAAHKTRRSWSDNPNTRTASPGHRGDKDAGFGQPFGRETRKRPFRDSKFNSADRFARTE

SEQ ID NO: 38611 - DNA, 1860 bp, Arabidopsis thaliana
  CDS (1)..(1860)
atggctgctaccgctgctgcttctgttgtccgttacgcacctgaggatcatactcttcccaagccctggaaaggccttatcgatgatagaactggttacttgtacttttggaatcctgagaccaatgttactcagtacgagaaaccaaccccctctctacctcctaagttttctcccgccgtttctgttagctcttccgttcaggttcaacaaactgatgcctatgctcctcccaaggatgacgataagtactccagaggctctgaacgtgtgtccaggttttctgagggtggcaggagtggaccgccttattcgaacggtgctgctaatggagttggggattctgcttatggtgcagcatctaccagagttcctcttccttcatcagctccagcaagtgaactatcccctgaggcctattcccgccgtcatgaaattactgtcagtgggggccaagtaccaccacctctaatgtcctttgaagctactggttttccacctgagcttctgcgggaggtactcagtgcaggtttctctgctccaactccaattcaagctcagtcatggcccattgctatgcaaggtagggacatagtagccattgctaaaactggctcgggaaaaactttgggttacttgattcctggatttttgcatcttcaacgtatccgaaatgattcgcgaatgggcccaacaatcttggtattgtctccaacgagagagctggccacacaaatccaagaagaagctgttaaatttgggaggtcatcaagaatttcgtgtacgtgtttgtatggtggtgcaccaaagggccctcagttgagggatttagaaagaggagcagatatcgtggttgcaactcctgggagattgaatgatatccttgaaatgaggaggattagtctgcgtcagatatcttatcttgtgctagatgaggcagatagaatgttggacatgggttttgaacctcagataaggaagattgtgaaagaaattcccactaagcgtcaaacccttatgtacacagctacatggccaaagggagttaggaaaattgcagctgacttgcttgttaaccctgctcaagtcaacattggcaatgttgacgagcttgtggctaacaagtcaatcacacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacagtagaagcagcaatggatggggaagagagcgagaaaggagccgtagccctgagagattcaacagagctccaccaccgtcttccaccggatctcctcctcgcagcttccacgagacgatgatgatgaaacacagatga

SEQ ID NO: 38612 - protein, 619 aa, Arabidopsis thaliana
MAATAAASVVRYAPEDHTLPKPWKGLIDDRTGYLYFWNPETNVTQYEKPTPSLPPKFSPAVSVSSSVQVQQTDAYAPPKDDDKYSRGSERVSRFSEGGRSGPPYSNGAANGVGDSAYGAASTRVPLPSSAPASELSPEAYSRRHEITVSGGQVPPPLMSFEATGFPPELLREVLSAGFSAPTPIQAQSWPIAMQGRDIVAIAKTGSGKTLGYLIPGFLHLQRIRNDSRMGPTILVLSPTRELATQIQEEAVKFGRSSRISCTCLYGGAPKGPQLRDLERGADIVVATPGRLNDILEMRRISLRQISYLVLDEADRMLDMGFEPQIRKIVKEIPTKRQTLMYTATWPKGVRKIAADLLVNPAQVNIGNVDELVANKSITQHIEVVAPMEKQRRLEQILRSQEPGSKVIIFCSTKRMCDQLTRNLTRQFGAAAIHGDKSQPERDNVLNQFRSGRTPVLVATDVAARGLDVKDIRAVVNYDFPNGVEDYVHRIGRTGRAGATGQAFTFFGDQDSKHASDLIKILEGANQRVPPQIREMATRGGGGMNKFSRWGPPSGGRGRGGDSGYGGRGSFASRDSRSSNGWGRERERSRSPERFNRAPPPSSTGSPPRSFHETMMMKHR

SEQ ID NO: 38613 - DNA, 1593 bp, Helicobacter hepaticus ATCC 51449
  CDS (1)..(1593)
atgaataatttgggatacttattaaatgttaaggtaaaacgaatggataatgcttctctcatacaacaatcagaagagtctccgagtgtgacaataaaacaaggattgaaatcaaaacataaacaagatacgcaaggttttgatgtatttggacttaaagattttgtattaaagggcattagagaagcaggctttagcacacctagtccagtgcaatctcaaagtataccaattattttacagggcaaagaccttattgcgcaggctcagacaggcacaggaaagactgctgcatttgctatacctattcttaacacccttaatcgcaataaagatattgaagcgcttattatcactcctacacgggagcttgctatgcaaattagtgaggagattctaaaattagggcggtttggacgaattaaaacaatttgtatgtatggaggacagagcattaaacgacaatgtgatttgcttgagaaaaaacctaaagcaatgatagctacacccggaaggttacttgaccatttacaaaatggtagaattgcacatttttcgcctcaaattgttgtgcttgatgagagtgatgaaatgcttgatatgggctttttagatgatattgaagagatttttaaatttttgcccaatacgcgccagacattacttttttcagctacgatgccagaaccaattaaagctttagcaatgaaaatacttaatgaacctgcttttgtaaaaattacccccacagatgttacaaatcaagatattgaacagcaatattatattatcaatgaaggtgagcgcgatgaagcgattgtgcgcttaattgagacacaaaatcctacaaaaagcattatttttacgcgtatgaaaaaagaagctgatgctttagctataagacttgcaaatcgtggatttaaagctatagcattacacggagatatggaacagagggatagaagagaggcgattaaggcatttagggaaaataaaattgaaattcttgttgctactgatgttgcatctcgcggattagatataagtgatgtaagccacgtatttaattatcatataccactcaatcctgagagttatgtgcatcgtatagggcgcacaggacgtgcaggaaaaaaaggtgttgcagttacacttgctacaccacttgagtataaagatttaagtaagattaaacaaattaccaaagccaaacttaaactctgcgagataaagcaagaatatagtgatgacgcattttcacaggaactttcgcatacaaagattagtgataaatcggtggccatttatgaaaaactcaaagacaaaatagatactacacagctttgtcttaagcttatttcattacatttagaaaaaaatagcagtcttaaaattggtttaagcaaggaacaaatagccaaacttgaagaaaactatgaaagtgaacaacctaaaaaatctaataaaaaatttgtaggaaatacacgtagtgctactaaaggtaatctacgtggtggtaaagggagtaaaaataataagcgatatgataatattgatagaagtcagccttacacaaatagcatttgggggtaa

SEQ ID NO: 38614 - protein, 530 aa, Helicobacter hepaticus ATCC 51449
MNNLGYLLNVKVKRMDNASLIQQSEESPSVTIKQGLKSKHKQDTQGFDVFGLKDFVLKGIREAGFSTPSPVQSQSIPIILQGKDLIAQAQTGTGKTAAFAIPILNTLNRNKDIEALIITPTRELAMQISEEILKLGRFGRIKTICMYGGQSIKRQCDLLEKKPKAMIATPGRLLDHLQNGRIAHFSPQIVVLDESDEMLDMGFLDDIEEIFKFLPNTRQTLLFSATMPEPIKALAMKILNEPAFVKITPTDVTNQDIEQQYYIINEGERDEAIVRLIETQNPTKSIIFTRMKKEADALAIRLANRGFKAIALHGDMEQRDRREAIKAFRENKIEILVATDVASRGLDISDVSHVFNYHIPLNPESYVHRIGRTGRAGKKGVAVTLATPLEYKDLSKIKQITKAKLKLCEIKQEYSDDAFSQELSHTKISDKSVAIYEKLKDKIDTTQLCLKLISLHLEKNSSLKIGLSKEQIAKLEENYESEQPKKSNKKFVGNTRSATKGNLRGGKGSKNNKRYDNIDRSQPYTNSIWG

SEQ ID NO: 38615 - DNA, 1359 bp, Rhodopirellula baltica SH 1
  CDS (1)..(1359)
atgaacagaatgagaaatcaacgcccaccgcgtacaggacgcggatcacgaccagctcgcttcgaagaaccggtcgacacaattgctctgctagaatccgttggcccggtggaaacaccgccagaaatggattcctttgacgaattggatttgtcgccgatcatgcgtcgagcggtcaaagacgcgggcttcacaaccccgtcgccgattcaagccgcattgatcccacacgctttgaatggcaaagacgtgatcggccaggcacggacaggaaccggcaaaactgccgcgttcagcatcccgatcctcgagcagctcgattccctggaagattgtcgcgacccgcaagcgatcgtgatcgtcccaactcgcgaattggctgaccaagtcgccgccgaagccgaaaggctcgcccgcggggttccgacggaaatcgcagtgctgtcgggcggcaaaaacatgaaccgccagcttcgccaattggaaaatggcacccagctcgttgtcggcacccccggacgcgtgcacgatcacctgcaacgaggaacattgcgaaccaacaacgtgtggtgcgtggttctggacgaagccgaccgaatgctggacatcggattccggccgcaaatcgaacggatcatgcgaaagtgcccgcggaaccgacaaacattgctgctgtcggcaacgcttcctcccgtcgttcgccgcttggccgaaagctacatgcacgaaccagtcgtgattgactgctgccgtgacgaaatggcggtcgacacgatcgagcaacggtatttcaccatcgcgcaagacgacaaagtcagattgctggaatcgcttctgaaacgcgaaaaacctgaacaagcgatcatcttctgccgaaccaaacgcggaacggatcgcctgcaccggaagctctctcacgaatacgggagcgcatgcggtgcgattcatggtgatttgcagcaacgcgaacgcgaccgagtccttcaaaaactccgtgacggcaacctgaaattcctcgttgcaacggacgtcgtgggacgcggaattgacatcagtacgatctcacacatcgtcaactttgatgtcccgcaagattgcgacgattacgttcaccgcgttggccgaaccggccgaatgggtcgagacggtgtcgcgtacaccttcgtcgtccccggtgaaggcgacatcctgacgagcattgaacaacggatcaacaaattgctgattcgggacaaaatggacggttttgaatcgcccgccgagaaggctgcagcggttgccgcggcggcgcccgagcccgagaaagagctgcggcgcaccctcaatcctatgacacgaaaacgccctcgccggcgttga

SEQ ID NO: 38616 - protein, 452 aa, Rhodopirellula baltica SH 1
MNRMRNQRPPRTGRGSRPARFEEPVDTIALLESVGPVETPPEMDSFDELDLSPIMRRAVKDAGFTTPSPIQAALIPHALNGKDVIGQARTGTGKTAAFSIPILEQLDSLEDCRDPQAIVIVPTRELADQVAAEAERLARGVPTEIAVLSGGKNMNRQLRQLENGTQLVVGTPGRVHDHLQRGTLRTNNVWCVVLDEADRMLDIGFRPQIERIMRKCPRNRQTLLLSATLPPVVRRLAESYMHEPVVIDCCRDEMAVDTIEQRYFTIAQDDKVRLLESLLKREKPEQAIIFCRTKRGTDRLHRKLSHEYGSACGAIHGDLQQRERDRVLQKLRDGNLKFLVATDVVGRGIDISTISHIVNFDVPQDCDDYVHRVGRTGRMGRDGVAYTFVVPGEGDILTSIEQRINKLLIRDKMDGFESPAEKAAAVAAAAPEPEKELRRTLNPMTRKRPRRR

SEQ ID NO: 38617 - DNA, 2796 bp, Rhodopirellula baltica SH 1
  CDS (1)..(2796)
gtgaatgagaagcggcgtcgtggttgtgtcggaatgcaagggttcgaaggtcctggaggactgaatcgaaccgcagacaaccagatccagggctctgaaagagtcctcttggtttggcattccatccttaccaattctgccgcgaccatgaccgcctgcgaaacgcagcgtgggtgcggctacctttttaagcgcacgagttttttgatgtctgatcatcccgcttccaatgaaacgttggtcgatcctacgtccgagttgaattcgcaagaacgagctcaggacacatttgaaatgtcgacaaccgagacggtcgtcgatccttcggcacaatgggcggctcactatgccaacccagtgattgatccgagcgaaatgccatcgccggctgtcgacgaatccttgctgttctatcaagccgactgcaccgatgaagcgtccgacgtgatcgtcgaagtgcaagcagagccagcgatcgaactgaacacagaacctgttcaggtcgaaatcgctgaaccagagcagcacgttcaagagcaaccgaaatcgcaggaacagccagctgaatccgatgctgttgcatcaccagatgcagtgatcgctgagcctgaggtggctcgcgaaccagaacctgcgaatgaagccgtggtggaatcgcagcccgttgcaacgatggcgccacctgtcgtcgaagagcctgttgcggctgcggaaacagcggccagcccagaaccagtcgttgaaccggaagtggttgcggagcaaaagcccgcagttcaatcagaacccgttgctaaacaagaacagtctgttcgcgaagaattggctccgccagctcagagccagtccgcacaaacagaagagcccgcgaaggcggagaaggcacctgagtcgaacgagccggctgagccactgttccgcgatttggacctgcgagcagaagttcaaaaagcggttgccgcatcgggttacgataaaccaactccaattcaagccgagatcatcccctacatgttggatggtcgcgacgttttggcacagtcgcaaactggcaccggcaaaacggctgcatttgcattgccgatcttgtcgcgtgtcgatgttcgcagccgtcgcccacaagtcctcgtgctggcaccaacacgcgaattggcgatccaagtggctcggtcgttcaccaagtacggtgctgatctgagtggtttccaggttgctgctatctacggtggacaagactacgaaccacaactcaaacagctccgtcgcggtgtccaagtcgtcgtcggcacaccgggccgagtcattgatcacgtcaaacgcggtacgttggatctcggttcgctcgattgccttgtgctcgatgaagccgacgaaatgctcaacatgggattcttggaagacgttcagtttgtcctcgaaaaatcgcctgaaggacggcaagtcgcgttgttctctgcgacgttgccaaagccaatccgcaagatcgctgacgagtatctcaacgacccagctcggatcacgatcaagtcaaagacgatcaccgccgcttcggttcgccagcgtgcgttgtttgtttcaccacgcgacaaaattgatgcgttgactcgcatcttggaagtggaagaaaccgatggagtgatcgtcttcacgaagacaaaggactccacgctgagtgtggctgaaaagctgagccagcaagggttttccgctatcgcactgaacggcgacatgccacagaaggttcgagagcggacaattgaccaactcaagcgtggtcaactcgacgttttggttgcaaccgacgtcgcggctcgaggtttggacgtgccacggatcagtcacgtgttcaactttgatttgccgcacgacagcgaatcgtatgtgcaccggattggtcgtaccggtcgagcgggacgcagcgggcaagccatcatcttcttgaccaatgctcagcgtcgtcagcttcggttcattgagaacacgaccaagcaacccattgaaatcatcgacatcccaacggttgccgatatcaacgaggctcgcgtgcggcgtttcaagcaacgcatcaccgatgtttccgctgatcaggatttgacggtctacaaagacatgatcgctcagtacgcggaagaatctggcaaaccgatggagatgatcgctgccgcactggcagaaatgagccagaacggacgtccgttcttgttgaaggaacgtcccaagaagcagcgcgaacgttccgaccgagacaattctcgcggtcgtgactcatttgattcgaacgatcgctccggcaatcgtggatccttcggcgatgatcgccctcgtcgtcccaaaggccgtccactcacacccgtcaaagaaggcatgactcgatatcgccttgatgtcggttggcaggacggagtcaaacccggcaacattgttggtgcagttgcaaacgaagctggtatcgatggcgaatacatcggcccgatcaacattcgcgactcgcacactttgatcgacctgcccgaaggcatgccctcggacatctatcaaacgcttcgcaaaacttgggtggccggcaaacggttgaaccttgaagaagcaggtgacgtcgtcgatgacttcgaaggcgacggtggccgcagcaacttccgcaaggagggtttccgcaaaggcaagttctctggcaacggaggttcgggcggcaagaacttcagtggcggaaagcgttcgtttggcaataagtctcgcaataacggaagcaccgcacccaccgcgaaacgcggcaagaagaagttcaaaccttcttga

SEQ ID NO: 38618 - protein, 931 aa, Rhodopirellula baltica SH 1
MNEKRRRGCVGMQGFEGPGGLNRTADNQIQGSERVLLVWHSILTNSAATMTACETQRGCGYLFKRTSFLMSDHPASNETLVDPTSELNSQERAQDTFEMSTTETVVDPSAQWAAHYANPVIDPSEMPSPAVDESLLFYQADCTDEASDVIVEVQAEPAIELNTEPVQVEIAEPEQHVQEQPKSQEQPAESDAVASPDAVIAEPEVAREPEPANEAVVESQPVATMAPPVVEEPVAAAETAASPEPVVEPEVVAEQKPAVQSEPVAKQEQSVREELAPPAQSQSAQTEEPAKAEKAPESNEPAEPLFRDLDLRAEVQKAVAASGYDKPTPIQAEIIPYMLDGRDVLAQSQTGTGKTAAFALPILSRVDVRSRRPQVLVLAPTRELAIQVARSFTKYGADLSGFQVAAIYGGQDYEPQLKQLRRGVQVVVGTPGRVIDHVKRGTLDLGSLDCLVLDEADEMLNMGFLEDVQFVLEKSPEGRQVALFSATLPKPIRKIADEYLNDPARITIKSKTITAASVRQRALFVSPRDKIDALTRILEVEETDGVIVFTKTKDSTLSVAEKLSQQGFSAIALNGDMPQKVRERTIDQLKRGQLDVLVATDVAARGLDVPRISHVFNFDLPHDSESYVHRIGRTGRAGRSGQAIIFLTNAQRRQLRFIENTTKQPIEIIDIPTVADINEARVRRFKQRITDVSADQDLTVYKDMIAQYAEESGKPMEMIAAALAEMSQNGRPFLLKERPKKQRERSDRDNSRGRDSFDSNDRSGNRGSFGDDRPRRPKGRPLTPVKEGMTRYRLDVGWQDGVKPGNIVGAVANEAGIDGEYIGPINIRDSHTLIDLPEGMPSDIYQTLRKTWVAGKRLNLEEAGDVVDDFEGDGGRSNFRKEGFRKGKFSGNGGSGGKNFSGGKRSFGNKSRNNGSTAPTAKRGKKKFKPS

SEQ ID NO: 38619 - DNA, 1752 bp, Wigglesworthia glossinidia endosymbiont of Glossina brevipalpis
  CDS (1)..(1752)
atgaataaaaaagaattatctttttctgaattaggtttgaaagattttattttactagcgttaaatgatttaggttataaaaaaccatcgccaattcaagaaaaatgcattccttttttgctaaaaggatatgatgttctaggaatagctcaaactggaagtggaaaaactgctgctttttttttgccattattgaataatattgatttaaaattaaaacttccccaaataataattttgactccaacaagagagcttgctttacaaataaaatttgcttgttgcagtttgtcaaaatatataaaagaaattaatataattgctttatatggaggccaaaattattcaatacaaataaaatctttaaaaagaaatccacaaatagttgtgggaactccaggacgaatattggatttattaaataaaaaatatttaaatttatcagaaattactagttttgtgttagatgaagcagatgaaatgttaagaatgggttttatagaagacgttgaaaatatatttctaaaatcatcaaagcaacatcaaactatattattttccgctactatgcctgcagctattcatagaataactaaacgttttatgaaaaaacctaaagaaataagaattaaagcaagcgaaaatactagacctaatattaaacaaaattattggatagtttatggattatgtaaaattgaagcattattaagatttttagaagtagaaatttttgatgcagtgattatttttgtacgcactaaaaatgctactttagaagtttctgatgtgttagaaaaaaatgggtataacagctcatctctaaatggagatatgaatcaaattttaagagaaaaaacattaaatagattcaaaacaggtttattggatattttagtagctaccgacgtagctgcaagaggtttggatgtagaccgtatcagtttagttataaattatgacataccattagacgtagagtcttatattcatagaattggaagaacaggcagagctggaagaacaggaaaagctttaatgtttgtagaaaatagagaaagaaaaatattgtacaatattgaacgtaatattaaagaaaaattatctcaaataaaattacctagcgtagaactattatgtaaaaaacgtttaaataatttttctgaaaaaattaaaaatcaaataaatagtttagatttgaataaatatcaaaatttattatctaaaattatttcttttataggaatatctgatgttaaaattatttccgctgccttattaaaggtagctcaaaaaaacaagcctttaataatatctccagataatttttttaacaaaaacaaaaaaattaatttgttaataaacaaaaataataagcgcaaaaaattaaatattataaaaaataaaaaaaaatcaataagtttatataaagctgaaattggaaaaaaagacggaatagaatcaaaacatatagttaggacaatgataaatttaggaaaaataaaatccaatgatattggtagtataaaaatattttttaattattctactattgaaatatacaaaaaaatacctttaaatttattatcaatattatcaaaatctacaattttcaaaaaatctttaaatttaaaattattaaatcacaataaaatttcaaaaaagcctattttaaaaaaaataggatctagattatctaatagaatttcaaaaaatacatcaaataaaatctcatataatagacaaatttaa

SEQ ID NO: 38620 - protein, 583 aa, Wigglesworthia glossinidia endosymbiont of Glossina brevipalpis
MNKKELSFSELGLKDFILLALNDLGYKKPSPIQEKCIPFLLKGYDVLGIAQTGSGKTAAFFLPLLNNIDLKLKLPQIIILTPTRELALQIKFACCSLSKYIKEINIIALYGGQNYSIQIKSLKRNPQIVVGTPGRILDLLNKKYLNLSEITSFVLDEADEMLRMGFIEDVENIFLKSSKQHQTILFSATMPAAIHRITKRFMKKPKEIRIKASENTRPNIKQNYWIVYGLCKIEALLRFLEVEIFDAVIIFVRTKNATLEVSDVLEKNGYNSSSLNGDMNQILREKTLNRFKTGLLDILVATDVAARGLDVDRISLVINYDIPLDVESYIHRIGRTGRAGRTGKALMFVENRERKILYNIERNIKEKLSQIKLPSVELLCKKRLNNFSEKIKNQINSLDLNKYQNLLSKIISFIGISDVKIISAALLKVAQKNKPLIISPDNFFNKNKKINLLINKNNKRKKLNIIKNKKKSISLYKAEIGKKDGIESKHIVRTMINLGKIKSNDIGSIKIFFNYSTIEIYKKIPLNLLSILSKSTIFKKSLNLKLLNHNKISKKPILKKIGSRLSNRISKNTSNKISYNRQI

SEQ ID NO: 38621 - DNA, 1821 bp, Haemophilus ducreyi 35000HP
  CDS (1)..(1821)
atgacaaataatactttaactttctctgacttaggtcttcctcaatcaattctcgatgctgtcaatgatatgagttttgtaactccatctcctattcaacaagaatgtattccccatttattagctggtagcgatgtactcggtatggcgcaaactggtagcggtaaaacagcggcattttcattgcctttactcgcacaaatcgatccgaatcaacgccatccacaaatgttggtgatggcaccgactcgtgaattagcgattcaagttgcggatgcttgtgagcaatttaccaaaaatatgaaaggtattcgtgtagttaccgtttatggtggtcaacgttacgatattcagttacgtgcattaaaacaaggttctcaagtggttgtgggtacacccggtcgtattcttgatcatattcgccgtggtacgttaaatttatctaccctcaaatcaatcgtgttagatgaagccgatgaaatgttacgtatgggctttattgatgatgttgaaacagtaatggcagaattaccagaaaaacaccaaacagccttgttttcagccaccatgccagagcctatacgccgtattacacgccgatttatgtctgatcctaaagaagttaaaattcaagcaacacaacgttctgcaccagatattacacaaagctactggttggtaaatggtttccgcaaaaatgaagccttactgcgctttttagaagttgaagaatttgatgcggctattattttcactcggactaaaacaggcacgattgatatcaccgaattatgtgagcgtaatggctatcgcaccgcagcgctcaacggtgatatgactcaacaagctcgtgagcaaactttagataaattaaaatcaggtcgtttagatattcttgtggcaacagatgttgcagcacgtggcttagatgtggaacgaattagcttagtggttaactacgatattccattagactctgaaagttatgtacatcgaatcggtcgtactgggcgtgctggccgttcagggcgtgcattattatttgtcgaaccaagagaacgtcgcttattacgcaacatcgaacaattaatgaaaaaaccaattgatccggtggctattccaaatcatcaagtattaatggaaaaacgccgtgagaaatttaaagctaagatttctaaacagttagaacatcatgatttagaaaaatatcgtgaattgcttgaaaacttattcacggccgatcaagatcacgaagaacttgcagcggctatgatgatgcttcaagaaaaacagaaattaatattaccgcctgatccagaagtacgtaatttacgcagtgaacgtggtcgccgtgatcgtaacgaacgtaacgatcgccgtaatggtcgcgaacatcgtgaaaataatggtgtagctatggacttataccgtatcgaattaggccgtgaagatggtgtggaagttcgccatattgttggcgcaatcgcaaatgaaggtgatattaatagccgttatattggtcatattaaattgcatgatcgctattcaactattgaattacccaaaggtataccaaaccatatcgtacaacactttgcacataaggcgcgcgtattaaacaaacaaatgcaaatgtcattattaggccctgccggtggtgctaataatcaaccatttgaagaacgccgtggaagtcgtcgtgatcaacgcaatagcggtcgtaatagtcgtccaaattaccgcgaagatagctttaataaagagcgtaaaaatactggctttaaagaaaaacgctttaataacaaaagtagccgtgattaa

SEQ ID NO: 38622 - protein, 606 aa, Haemophilus ducreyi 35000HP
MTNNTLTFSDLGLPQSILDAVNDMSFVTPSPIQQECIPHLLAGSDVLGMAQTGSGKTAAFSLPLLAQIDPNQRHPQMLVMAPTRELAIQVADACEQFTKNMKGIRVVTVYGGQRYDIQLRALKQGSQVVVGTPGRILDHIRRGTLNLSTLKSIVLDEADEMLRMGFIDDVETVMAELPEKHQTALFSATMPEPIRRITRRFMSDPKEVKIQATQRSAPDITQSYWLVNGFRKNEALLRFLEVEEFDAAIIFTRTKTGTIDITELCERNGYRTAALNGDMTQQAREQTLDKLKSGRLDILVATDVAARGLDVERISLVVNYDIPLDSESYVHRIGRTGRAGRSGRALLFVEPRERRLLRNIEQLMKKPIDPVAIPNHQVLMEKRREKFKAKISKQLEHHDLEKYRELLENLFTADQDHEELAAAMMMLQEKQKLILPPDPEVRNLRSERGRRDRNERNDRRNGREHRENNGVAMDLYRIELGREDGVEVRHIVGAIANEGDINSRYIGHIKLHDRYSTIELPKGIPNHIVQHFAHKARVLNKQMQMSLLGPAGGANNQPFEERRGSRRDQRNSGRNSRPNYREDSFNKERKNTGFKEKRFNNKSSRD

SEQ ID NO: 38623 - DNA, 1812 bp, Prochlorococcus marinus subsp. marinus str. CCMP1375
  CDS (1)..(1812)
atggcaaaaacgaagtccaacgaagacataagtacttctaatgtttcttcaaattcagatccatctatctctattgaaagtgaaactgaagaacatatttccataacagaagttgatgcttctcagcttgaaaatgtagagaaggcaagtaatggtttcgaaggtttcggttttagtgaagccttactaaaaacccttaagaacaaagggtatgaagagcctacaccaattcaaaaagcttctatcccagaattaatgctggggagagatctgcttggacaagctcaaactggtacaggtaaaacagcagcatttgctctacctttacttgaaagaataaatagcaaagagcgtaacccacaagtacttgtcttaacacctactcgtgaacttgcaatgcaagttgcagagtcctttaaagcatactcagaaggtcatgcaaatataaatattttagctgtatatggaggatctgattttcgatcacaaatatattccttaaaaagaggtgttgaaatcatagttggaactccaggacgagtaatggaccatatacgccaagggacattaaatcaagattctctccagtgcctagtcctggatgaagctgatgagatgttgcgtatgggctttatagatgatatcgaatggatacttgagcaattaccgaatgagcgtcaaatggtcctcttctctgccacaatgcctccggagataagaaaactttcaaaaagataccttagagatcccgctgaaataaccattaaggcgaaaaagaaagaagctcaactaattagacagcattatataactgttcagaatagctataagctagaagtattgagacgtgttcttgaacttaactatggtgaaggagttataatatttgcaagaacaaaagctattacactaaagctggcagaaagcctggaagcatcaaaccacaatgtggctgtgctaaatggagatgttcctcaaaatctaagagagagaactgtcgaaagattacgccaaggcggcataaatattcttgttgcaactgacgttgccgctaggggattagatgtagagcgcataggactagtgattaattacgatatgccctttgattctgaagcatatgttcatcggataggtagaactggtagagctgggcgcagcggtgaagcaatcctttttatcagtccaagagaaaggtcctacctaaacaatctagaaagagctgttggacaaagtattgagcggatggaaatacctaataatgaaagtataaataaccatagaatacaaaaaatcaagagagatcttctaacaaccgcttctcaaaagcgaaaagatcaagaggaaacaaacctgatcaaagaagttataaatgaaatagagagtgaactggaaatcactcctaaagaaattgctttagctgcaataaacctgtctataggtgaatcaccgttattaattaatactgatgaaagctggatcaaccaagcagaaaggtttcgtaaaagcaatgatcgacgtgataatcgtggaagaagtcgtcgtagaaatgatttagatatagggactacagaaaaagacaaagagcgttttagagtagatgttggtcatcgagacagagtaaagccagggaacatagttggtgcaatagctaacgaatcaggtttaaatggtcgaatgatcggaaggatacagatttttgaaagttatagcttggtcgatctacccaaagggatgccaactaaaatttttcaaagtctcaaaagagtaaaagttatgaataaagagttaaatatcaaccgttatacataa

SEQ ID NO: 38624 - protein, 603 aa, Prochlorococcus marinus subsp. marinus str. CCMP1375
MAKTKSNEDISTSNVSSNSDPSISIESETEEHISITEVDASQLENVEKASNGFEGFGFSEALLKTLKNKGYEEPTPIQKASIPELMLGRDLLGQAQTGTGKTAAFALPLLERINSKERNPQVLVLTPTRELAMQVAESFKAYSEGHANINILAVYGGSDFRSQIYSLKRGVEIIVGTPGRVMDHIRQGTLNQDSLQCLVLDEADEMLRMGFIDDIEWILEQLPNERQMVLFSATMPPEIRKLSKRYLRDPAEITIKAKKKEAQLIRQHYITVQNSYKLEVLRRVLELNYGEGVIIFARTKAITLKLAESLEASNHNVAVLNGDVPQNLRERTVERLRQGGINILVATDVAARGLDVERIGLVINYDMPFDSEAYVHRIGRTGRAGRSGEAILFISPRERSYLNNLERAVGQSIERMEIPNNESINNHRIQKIKRDLLTTASQKRKDQEETNLIKEVINEIESELEITPKEIALAAINLSIGESPLLINTDESWINQAERFRKSNDRRDNRGRSRRRNDLDIGTTEKDKERFRVDVGHRDRVKPGNIVGAIANESGLNGRMIGRIQIFESYSLVDLPKGMPTKIFQSLKRVKVMNKELNINRYT

SEQ ID NO: 38625 - DNA, 1464 bp, Candidatus Blochmannia floridanus
  CDS (1)..(1464)
atgttagactctgaaaattctttcgtagatttagggttaaatacatatattgtagatatgttaagtaatattggatatcaggctccgttgcctattcaaactcaatgtattcctttgctgttgaaaggatgtgatttattaggaatggctcatactggtagtggtaaaactgcggcgtttttattgcctttgttgcaaaatattgatattaaacaacgttttgttcaaggtttaattatagttccgactcgagaattagctattcaaataggtcatgtatgtatgtattttattaagtctttgagtcatataattaatattgcagttttatatggtggacaaaattatagaattcaatttaatgatttaaagaaaaatcctcatattatcataggaaccccaggtagattattagatcatttaagtcgaggattagatatatcaaaattaaaaactttgattatagatgaagctgatgaaatgttacgtatgggatttattgaagatatagaacatattattcgttatgttccaactcataggcagacagcattattttctgctactttacctgtgagtattagaaaattaagttataagtttatgtgtaatcctaaggaaatctatatcaatcctagtatttcagcatgtgctgatattaagcagagttattggttagtacatggtatatctaaacatgaagctttgatgcgttttttggaagtagaaaagtttgaagcagtaataatatttgtacgtactaaatctgcaaccttgcaaatttctgaaattttgcaacgttttggttataatagtgcggctttaaatggggatatgaatcaatctgtacgttgtaaaacaatatctcgtctacggtgtggtacgttggatatattgataaccactgatgttgccgctcgtggattggatattaatcgtattagttttgtaattaattatgatattccatgtaattataatgcttacgtacatcgtatcggaagaacaggtagagctggtcgttctggaaaatctttgttatttgtagaacgtcaagaatatcatttatttaattatgttattaaaagaagagtattaaattctaatattgtgaaagttaaatgtcctacatcgaatgatttggtacgttgtcgattaaaaaaatttactgataaagtagtaaataatttggaatctaaagatatagaacagtatcaatctttattagggaaaataaagattgacttggatataactatagaaaaattagctgccattttattaaaaatagcacaaggtagtcaatcattaataatatcatcagatgatcaaagaataaataaaaaaataatttattataataaatctgatttaaaaaaaaattctgcgcataaaaataaaagttattttgtacattctcgtcgatcaataaaatgtagcaatgtatattataaaaaaaaataa

SEQ ID NO: 38626 - protein, 487 aa, Candidatus Blochmannia floridanus
MLDSENSFVDLGLNTYIVDMLSNIGYQAPLPIQTQCIPLLLKGCDLLGMAHTGSGKTAAFLLPLLQNIDIKQRFVQGLIIVPTRELAIQIGHVCMYFIKSLSHIINIAVLYGGQNYRIQFNDLKKNPHIIIGTPGRLLDHLSRGLDISKLKTLIIDEADEMLRMGFIEDIEHIIRYVPTHRQTALFSATLPVSIRKLSYKFMCNPKEIYINPSISACADIKQSYWLVHGISKHEALMRFLEVEKFEAVIIFVRTKSATLQISEILQRFGYNSAALNGDMNQSVRCKTISRLRCGTLDILITTDVAARGLDINRISFVINYDIPCNYNAYVHRIGRTGRAGRSGKSLLFVERQEYHLFNYVIKRRVLNSNIVKVKCPTSNDLVRCRLKKFTDKVVNNLESKDIEQYQSLLGKIKIDLDITIEKLAAILLKIAQGSQSLIISSDDQRINKKIIYYNKSDLKKNSAHKNKSYFVHSRRSIKCSNVYYKKK

SEQ ID NO: 38627 - DNA, 1725 bp, Bordetella pertussis Tohama I
  CDS (1)..(1725)
atgcatatgcgccgctatatgcggcaaggaaaagctatgtctttcgaagacttgggcttggcgcccactattctctcggccctgagcgaggccggtttcaccgaacccacttcggtgcaagccgctgccattccccaggccatggccggcgccgacctgatggtctcttcgcaaaccggtagcggcaagaccgccgcgttcatgctgccggcgctcaaccgcatcgcccaccagcccggcaacaagggcgtcggcgtgcaagtgctggtgctgaccccgacgcgcgaactggcgctgcaggtcgccgacgccacggcgtcgtatggccgcaacctgcccggcctgcgcaccgccaccgtcgtgggcggcatgccctatggcgcgcagctcaaggcgctgtcgcgccgcgtcgacgtgctggtggccaccccaggccgcctgatcgaccacctgaaagccggccgcgtcaaactgaataccgtgcacaccctggtgctggacgaagccgaccgcatgctggacatgggcttcatcgaagatatcgaaaccatcatcgagcgcctgccgaaagagcgccagaccctgctgttctcggccaccctggacggcagcgtggcgcgcctggccgagcgcatgatgcgcgagccacagcgcatcgaaatcgccggccatcgccagaagcacgccaacatcacgcaaagcctgctgtacgccgacgacgccgcgcacaagatgcgcctgctggaccacgtgctgcgcgacgcgcgcctggaccaggccatcgtgttcacggccaccaagcgtggcgccgacgacctggcagaccgcctggccgaccagggctttgccgccgcggcgctgcatggcgacatgaaccagcgccagcgcacccgtacgctgggccagctgcaacgcggccagctgcgcgtgctggtggcgaccgacgtggccgcccgcggcatcgacgtgcaaggcatcagccacgccgtcaacttcgacctgcccctgcaggccgaggattacgtgcaccgcatcggccgcaccggccgtgccggccgcgacggccaggccttcacgctggccacgcacgccgaacgccacaaagtgcgccgcatcgagcactacatcggccagtcgatcaacgccgaagtcatcgccggcctggagccgcagcgcaccccgcgcccgagcacgggcggcccgcgccgcggcggcaagccgatgggcggcaagcgtcccggcggctacggcgcgccgcgcgagttcggcgatcggccccagcgcccctatggcgaccgtccgcaacgcgacttcggcgatcggccccaacgcgacgccagcgaccgcccgcagcgcagcttcggcgatcgtccccagcgcgatttcggtgaccggccccagcgcccctacggcgaccgtccgcaacgcgacttcggcgatcgtccgcaacgcgatttcggtgaccgtccccagcgcccctacggcgaccgtccgcagcgcgacttcggcgatcgcccgcagcgcagcttcggtgaccgtccgcaacgcgacgtcggtgaccgtccgcaacgcgacttcggcgaccgcccgcagcgcagcttcggcgaccatccccagcgcgaaggcggctggcatggcgccccgcgtgaaggccgttcgttcgacaagcgccccggcggccccgccaagcgctttgccaagccggccgcgccccgccgcggctaa

SEQ ID NO: 38628 - protein, 574 aa, Bordetella pertussis Tohama I
MHMRRYMRQGKAMSFEDLGLAPTILSALSEAGFTEPTSVQAAAIPQAMAGADLMVSSQTGSGKTAAFMLPALNRIAHQPGNKGVGVQVLVLTPTRELALQVADATASYGRNLPGLRTATVVGGMPYGAQLKALSRRVDVLVATPGRLIDHLKAGRVKLNTVHTLVLDEADRMLDMGFIEDIETIIERLPKERQTLLFSATLDGSVARLAERMMREPQRIEIAGHRQKHANITQSLLYADDAAHKMRLLDHVLRDARLDQAIVFTATKRGADDLADRLADQGFAAAALHGDMNQRQRTRTLGQLQRGQLRVLVATDVAARGIDVQGISHAVNFDLPLQAEDYVHRIGRTGRAGRDGQAFTLATHAERHKVRRIEHYIGQSINAEVIAGLEPQRTPRPSTGGPRRGGKPMGGKRPGGYGAPREFGDRPQRPYGDRPQRDFGDRPQRDASDRPQRSFGDRPQRDFGDRPQRPYGDRPQRDFGDRPQRDFGDRPQRPYGDRPQRDFGDRPQRSFGDRPQRDVGDRPQRDFGDRPQRSFGDHPQREGGWHGAPREGRSFDKRPGGPAKRFAKPAAPRRG

SEQ ID NO: 38629 - DNA, 1389 bp, Bordetella bronchiseptica RB50
  CDS (1)..(1389)
gtgaccaacacgtctttttcctccctgcctcttctgcccgccttgctcgacaacctgcaaggcctgggcttcgaacagatgacgccgatccaggcgcaaagcctgccgctcatcctggaaggccgcgacctgatcgcgcaagccaagaccggcagcggcaagaccgccgcattcggcctgggcgtgctgcagaacctggacgtcaaccgcctggcgccgcaggcgctggtgctctgtcccacccgcgaactggccgaccaggtggcccaggagctgcgccggctggcccgcctgattcccaacgtcaaggtgctgacgctgtgcggcggcgccgccgcgcgtccccaggccgaatcgctggcgcgcggcacgcatctggtggtgggtacgcccggccgcatccaggaccacctggcgcgcggcagcctggacttgtccacgctgaacacgctggtgctggacgaggccgatcgcatggtggacatggggttctacgacgacatcgccgccattgcctcgcattgcccggccaggcggcagaccctgctgttctcggccacctaccccgacaacatccgcaagctgagcgcccgcttcctgcgcaatccggccgaaatcaaggtggaggcccagcacgacgccagccgcatcgagcagctcttcttcgagatcgacgaaggccagaggctggatgccgtggcggcgctgctggcccacttccgcccggcgtccacgctggcgttctgcaacaccaagatccgcagccacgacctggtcgaacgcctgcgcgcccagggcatcagcgcccaggcgctcaacggcgacctggagcagcgcgagcgcgatgaaatcctgatccagttcgccaaccagagctgcgccgtgctggtcgccaccgacgtggccgcccgcgggctggacatccagaatctgggcgcggtcatcaacgtggacgtgaccaaggacaccgaagtccacgtgcaccgcatcggccgcagcggccgcggcgaccagaaagggctggcgctgagcctgtgttcgcccgaggaaatgcgctgggccaacctcatcgagcaataccagggcgccccgctgaaatgggccgacctcggctcgctgcggcccaagtccgaccgccccttgcgcgcgcccatgatcaccctgtgcatccagggcggcaagaaggacaagctgcgtcccggcgacctgctgggcgccctgaccggtgacggcgggctggcgttcgagcaggtcggcaagatcaacatcaccgaattcaacgcctatgtggcgctggaccgccaggtcgccaagcaggccttcgcgcgcctgtccaacagcaatatcaagggacggcggttccgcatgcgcttcctggaagagttctga

SEQ ID NO: 38630 - protein, 462 aa, Bordetella bronchiseptica RB50
MTNTSFSSLPLLPALLDNLQGLGFEQMTPIQAQSLPLILEGRDLIAQAKTGSGKTAAFGLGVLQNLDVNRLAPQALVLCPTRELADQVAQELRRLARLIPNVKVLTLCGGAAARPQAESLARGTHLVVGTPGRIQDHLARGSLDLSTLNTLVLDEADRMVDMGFYDDIAAIASHCPARRQTLLFSATYPDNIRKLSARFLRNPAEIKVEAQHDASRIEQLFFEIDEGQRLDAVAALLAHFRPASTLAFCNTKIRSHDLVERLRAQGISAQALNGDLEQRERDEILIQFANQSCAVLVATDVAARGLDIQNLGAVINVDVTKDTEVHVHRIGRSGRGDQKGLALSLCSPEEMRWANLIEQYQGAPLKWADLGSLRPKSDRPLRAPMITLCIQGGKKDKLRPGDLLGALTGDGGLAFEQVGKINITEFNAYVALDRQVAKQAFARLSNSNIKGRRFRMRFLEEF

SEQ ID NO: 38631 - DNA, 1779 bp, Prochlorococcus marinus subsp. pastoris str. CCMP1986
  CDS (1)..(1779)
atggcttcaaataaagacaatcaattagtagaaaaaaatgacgataatttgggggtagaaaatatttctaataatccttcaattcaatcagaacaaaaattagaagttaccgaagatgaaatttcttttaaagaagaggatcttgataatggatttgcttgctttgggtttaataaattaatattaaattcattagaaagtaaaggatataaaactcctacacctatacaaaaagcagcaattccagaattaatgcttggaagagatttgttaggacaagctcagactggtacaggtaaaacagcagcctttgctctcccattaatagaaaagcttgaaaataataaagaatcaaacgctaaagttttggttatgaccccaacaagagagttggctactcaagttgcagattcttttaaaagttatagtgctgaatcaactaatttaaggacattagcaatatatggaggaactgattttaggaatcaaatctcatcacttaaaagaaagacagacattgtcgttggaactcctggaagaataatggatcatataagacaaggaacttttaagatcaataacataagttgtcttgttcttgatgaagcagatgaaatgttaaaaatgggatttcttgaagatattgaatggattatagataaacttccagaaaataaacaaatggttttgttctctgcaacaatgccaaatgagataagaaacatagcaaaaaaatatctaaatgaaccagctgaaatacttattaaaagcgttaaacaagaaactcaattaattactcaaaaatatattaatgttcaaaggcaccataagttagatgctctaaaaagaatattagaaataacgaatgaaggagtaataatatttgtaaggactaaattacttactacctcaattgcggaagctctagaaaactcaggtcatagtgtagctgttcttaatggtgacatcccacaaaatcaaagagaaaatacagttgatagattaaaaaaaggatttattgatattcttgttgcaactgatgtcgctgctagaggcctagatgttgaaaggattaaactcgttattaattacgattttccttttgataaggaaacatatactcatagaatcggtagaacagggagggcaggtaggtctggggaagcaattttatttgtaaatcaaagagaaaaacattttcttaggaatttagaaaattcaacaagaaataaaatagaagaaatcgagatacctaataataaaataattaatgaaaaaagaatgggtaaattaattacaaatttgaatgaaagttctttagatcaggaaaataatgaagaaaaaaaagctttgatgatcgatattctggataccctaagagaaaagcattctatggaagattcaaatatagcaatggcagctattaatttagcaataggtaataaatctttctttattaacgaagacgagtcttggctttatagacaaaataattctgatcgtaatagatcaaatagaaatggaaataatcgtatgagaaatacaaatagaagaaataattatcaaaatgattcttttgaaacctataaatttaattttggcaaaatggacagagttagagtagcaaatattatttcttctatttgtacgtctacaaatattaatggaagattgattggaaagatacaaatatttaatgagtacagcttggtagatttaccaagagatttacatggtgaagttaagaacaaactaaaaaatttaagaataaggaattaa

SEQ ID NO: 38632 - protein, 592 aa, Prochlorococcus marinus subsp. pastoris str. CCMP1986
MASNKDNQLVEKNDDNLGVENISNNPSIQSEQKLEVTEDEISFKEEDLDNGFACFGFNKLILNSLESKGYKTPTPIQKAAIPELMLGRDLLGQAQTGTGKTAAFALPLIEKLENNKESNAKVLVMTPTRELATQVADSFKSYSAESTNLRTLAIYGGTDFRNQISSLKRKTDIVVGTPGRIMDHIRQGTFKINNISCLVLDEADEMLKMGFLEDIEWIIDKLPENKQMVLFSATMPNEIRNIAKKYLNEPAEILIKSVKQETQLITQKYINVQRHHKLDALKRILEITNEGVIIFVRTKLLTTSIAEALENSGHSVAVLNGDIPQNQRENTVDRLKKGFIDILVATDVAARGLDVERIKLVINYDFPFDKETYTHRIGRTGRAGRSGEAILFVNQREKHFLRNLENSTRNKIEEIEIPNNKIINEKRMGKLITNLNESSLDQENNEEKKALMIDILDTLREKHSMEDSNIAMAAINLAIGNKSFFINEDESWLYRQNNSDRNRSNRNGNNRMRNTNRRNNYQNDSFETYKFNFGKMDRVRVANIISSICTSTNINGRLIGKIQIFNEYSLVDLPRDLHGEVKNKLKNLRIRN

SEQ ID NO: 38633 - DNA, 1797 bp, Synechococcus sp. WH 8102
  CDS (1)..(1797)
atgaatgaccaacagctcggggagaccccgtgcgccgtcgatctgtccgcatcttcgctgcctgagcaggccacttcagagcagggttctgcagacgtcttcaccacaacgatcgacgcccagcaaccggaatcgggtttcgatggtttcggattcagtgaggcattgctgaagacgctggcggataaggggtacagcgagccttcaccgattcagaaggcggccttccctgaattgatgctggggcgtgacctggtgggccaggcccagaccggtaccggaaaaacggcggccttcgcgttgccattgctcgaacggctcgccagtggccagaaaactccgcaggccctcgtgctggcacccacccgcgaactggccatgcaggtggctgattcgttcaaggcctattccgctgggcatccgcatctgaaggtgctggcggtttacgggggcaccgacttccgttctcagatcaacaccctgcgccgtggcgtggacgttgtggtggggacaccgggccgggtgatggatcacatgcggcagggcaccttggacacctccggcctacgcagcctggtgctggatgaggccgacgaaatgctgcggatgggcttcatcgacgatgtcgagtggatcctggagcaactgccgcaggaacggcaggtggtgctgttctccgcgaccatgccaccggagatccgtcgcctgtcgaagcgctatctgaaggatccagccgaggtcacgatccgcaccaaggatcaggaaggcaaacggattcgccagcgttcgatcaccgtgccgatgccccacaagctggaggctctgcagcgggtgctcgatgcctgcggtggtgaaggagtcattatttttgcccgcaccaaggccatcaccctcaccgtggccgagacgcttgaggcgggcgggcatcaggtggccgtgctcaacggtgatgtgccgcagaaccagcgggagcggacggtggaacggctgcgcagtggttccgtcgacatccttgtggccaccgatgtggccgctcggggcctggatgttgatcgcatcgggttggtgatcaactacgacatgccgttcgacagcgaggcctacgtccaccgcatcggtcgtaccggccgggccggtcgcacgggggaggccgtgctgtttgtcaccccgcgcgagcgtcgcttcatcaacaaccttgagcgggcaacaggccagccgatcgaggcgatggaggtgccaggcaactccgcgattaaccagggtcgactcgatcgtttgcacaaacgcctcagcgaagcagcccacaacgagcggtcctatgaggaagaagcggcgctgctgaaagagctgttgcaacgcatcggcacggaactggagctcagccctgagcaactggcctacgccgccctcagcatggccatcggcccagaccctttgctgcgccagaagggcgacgacgagtggattcacaacaaccagcgccgcgatcgtgatcgtgaccgtgatcggggcggcgaacggagagagcgccgctccgatcgtccggcccgtgccccggaggagaacatgcagcgctaccgcgtcgaggttgggcaccgtgatcgggtcaagcccggaaaccttgtcggggccatcgccggagaaaccggtctgcagggccgtgcgatcggccggattcagattttcgacaaccacagctttgtggatctgcctaaaggcatgccggaggatgtctttaacagcttgcggcggcttcgggtgatgaaccgggagctacagatcactcaggcgtcgtga

SEQ ID NO: 38634 - protein, 598 aa, Synechococcus sp. WH 8102
MNDQQLGETPCAVDLSASSLPEQATSEQGSADVFTTTIDAQQPESGFDGFGFSEALLKTLADKGYSEPSPIQKAAFPELMLGRDLVGQAQTGTGKTAAFALPLLERLASGQKTPQALVLAPTRELAMQVADSFKAYSAGHPHLKVLAVYGGTDFRSQINTLRRGVDVVVGTPGRVMDHMRQGTLDTSGLRSLVLDEADEMLRMGFIDDVEWILEQLPQERQVVLFSATMPPEIRRLSKRYLKDPAEVTIRTKDQEGKRIRQRSITVPMPHKLEALQRVLDACGGEGVIIFARTKAITLTVAETLEAGGHQVAVLNGDVPQNQRERTVERLRSGSVDILVATDVAARGLDVDRIGLVINYDMPFDSEAYVHRIGRTGRAGRTGEAVLFVTPRERRFINNLERATGQPIEAMEVPGNSAINQGRLDRLHKRLSEAAHNERSYEEEAALLKELLQRIGTELELSPEQLAYAALSMAIGPDPLLRQKGDDEWIHNNQRRDRDRDRDRGGERRERRSDRPARAPEENMQRYRVEVGHRDRVKPGNLVGAIAGETGLQGRAIGRIQIFDNHSFVDLPKGMPEDVFNSLRRLRVMNRELQITQAS

SEQ ID NO: 38635 - DNA, 1419 bp, Chromobacterium violaceum ATCC 12472
  CDS (1)..(1419)
atgtccgatcttaccttcgccgacctcggcctggccgacccgctgctgcgcgcggtcgccgacaccggttataccacgccgacccctatccaggcccaggccatcccgcaagtgctgcaaggcggcgatctgctggccgccgcccagaccggcaccggcaagaccgccggcttcacgctgcccttgctgcagctgctgatgtgctcgcccagccatcacgccggccgtccgcgcgcgctggtgctgacccccacccgagaactggccgcccaggtggaagagtcggtgcgcacttacagcaaatacctgccgttgaagtcgctggtgatgttcggcggcgtcaacatcaatccccagatcaaggcgctgcgcgcgccggtggatatcctggtggcgacgccgggccgcctgctggaccatgtcggccaaaagaccgtcgacctgtccggcgtggaaatcctggtgctggacgaggccgaccgcatgctggacatgggcttcatccacgacatcaagaaggtgctggccaagctgccggcccagcgtcagaacctgctgttctccgccaccttctccgacgagatcaaggcgttggccgacaagctgctggacaaccccaagctggtggaggtggcgcgccgcaacaccaccaacgaactggtgagccaaaaggtacacctagttgaccgcgacaagaagaccgagctgttgatccatctcatccgcgagcagaattggttccaggtgctggtgttcacccgcaccaagcacggcgccaaccgcctggcggagaagctggacaagatcggcatcccggccgcggccatccacggcaacaagagccagaacgcgcgcacccgcgcgctggccgacttcaagagcggcgaattgcaggtactggtggccaccgacatcgccgcgcgcggcctggacatcgaccagctgccgcacgtggtcaatttcgagctgcccaacgtgccggaagactacgtgcaccgcatcggccgcaccggccgcgccggcagcccgggcgaagcgttgtcgctggtgtgcgtcgacgagttcagcttcctgcgcgacatcgagaagctgatcaagatgtcgatcgagcgcttcaccgtgccgggcttcgaggccgacctcaacgtcaagccggagccgattccgatgggcggcggcgcgcgcggccgcggacaaggccagggacgcggcggccagggacaaggccagcgccacggccaggggcagggccagccgcgcaacgcgccggccaagccgcgccaccagaccgaaagcaagccggccggccatggccgcaacggcggtccgcgccaggggcagggcgccggccagggcggccgcgccgccaagccggcggcggccaagtccgcgctgttcagtccgccgaaaaaccgctga

SEQ ID NO: 38636 - protein, 472 aa, Chromobacterium violaceum ATCC 12472
MSDLTFADLGLADPLLRAVADTGYTTPTPIQAQAIPQVLQGGDLLAAAQTGTGKTAGFTLPLLQLLMCSPSHHAGRPRALVLTPTRELAAQVEESVRTYSKYLPLKSLVMFGGVNINPQIKALRAPVDILVATPGRLLDHVGQKTVDLSGVEILVLDEADRMLDMGFIHDIKKVLAKLPAQRQNLLFSATFSDEIKALADKLLDNPKLVEVARRNTTNELVSQKVHLVDRDKKTELLIHLIREQNWFQVLVFTRTKHGANRLAEKLDKIGIPAAAIHGNKSQNARTRALADFKSGELQVLVATDIAARGLDIDQLPHVVNFELPNVPEDYVHRIGRTGRAGSPGEALSLVCVDEFSFLRDIEKLIKMSIERFTVPGFEADLNVKPEPIPMGGGARGRGQGQGRGGQGQGQRHGQGQGQPRNAPAKPRHQTESKPAGHGRNGGPRQGQGAGQGGRAAKPAAAKSALFSPPKNR

SEQ ID NO: 38637 - DNA, 1326 bp, Chromobacterium violaceum ATCC 12472
  CDS (1)..(1326)
atgttgttttccgaactcggcttgtcgccggaaatcctgcgcgccatcgacgagcagggctatagccagccgacgccgatccaggagaaggcgattccgctggtgttgtccggtcgcgacctgctggccgccgcccagaccggcaccggcaagaccgccgccttcatgctgccgatactggagcggctgaagaagttcgccaataccagcgtgtcgccggcgatgcatccgatccgcgcgctggtgctgtcgccgacccgcgagctggccgaccagatcggcgtcaacgtgcagacttacaccaagtacctgccgctgcgcgccaccaccgtcttcggcggcgtcaacatggacccgcagacccaggagttgcgccgcggcgtggaaatcctgatcgcgacgccgggccgcctgctggaccacatccagcagaaaacggtgcagctgaacaaggtggaagtgctggtgctggacgaaggcgaccgcatgctggacatgggcttcatccaggatatccgcaagatcatgggcatgctgcccaaggagcgccagacgctgctgttctcggccaccttcgcgccggagatcaagcgcctggcggccgacttcatgcatgcgccgcagaccgtcgaggtcgcccgccagaacgccaccaacgaccaggtcgagcaactggtgttccaggtggacaacttcaagaagcgccagctgctggcccatttgatccgctcgcgcgagatgagccaggtgatcgtgttctgcaagaccaagatcagcgccgaccagctggcgcgcgatttgaagcgcgatggcctggacgccgaggccatccacggcgacaagacccagggcgcgcggctggagacgctggctggcttcaaggaaggcaagctgcgcgtgctggtggccaccgacgtcgccgcgcgcggcctggacatttccgagctgccttatgtggtgaacttcgagctgcccacctctccggaagactatgtgcaccgcatcggccgaaccggccgcgccggcgccaagggcatcgcgatctcgctgatgtgcccggacgagtccaggcagcacgaggcgatcgaaaagctgaccaagcagacgctgacgccgcagagcgtcgacggtttctggccgtcctggctgccgcgtcccaagccggcgcgcgagccctcgtccgcgtcgccgtccatgccggccctgtcggccggcaagagcgaaggactgaaacaggcccgccctggccgccgcagccgcaaggccaagcgcgaaattccggcgctgctgctgccgccgcgctacaaggtggaaatcatccgctga

SEQ ID NO: 38638 - protein, 441 aa, Chromobacterium violaceum ATCC 12472
MLFSELGLSPEILRAIDEQGYSQPTPIQEKAIPLVLSGRDLLAAAQTGTGKTAAFMLPILERLKKFANTSVSPAMHPIRALVLSPTRELADQIGVNVQTYTKYLPLRATTVFGGVNMDPQTQELRRGVEILIATPGRLLDHIQQKTVQLNKVEVLVLDEGDRMLDMGFIQDIRKIMGMLPKERQTLLFSATFAPEIKRLAADFMHAPQTVEVARQNATNDQVEQLVFQVDNFKKRQLLAHLIRSREMSQVIVFCKTKISADQLARDLKRDGLDAEAIHGDKTQGARLETLAGFKEGKLRVLVATDVAARGLDISELPYVVNFELPTSPEDYVHRIGRTGRAGAKGIAISLMCPDESRQHEAIEKLTKQTLTPQSVDGFWPSWLPRPKPAREPSSASPSMPALSAGKSEGLKQARPGRRSRKAKREIPALLLPPRYKVEIIR

SEQ ID NO: 38639 - DNA, 1263 bp, Chromobacterium violaceum ATCC 12472
  CDS (1)..(1263)
atgccattcgcttccctgggcctgcagcccgacctggtccagtcagccctggaacaagactatgtccggcccaccgccatccaaagcgccgccattcccgccattctgcaaggcggcgacgtgctggccaccgcgcagaccggctccggcaagaccgcggccttctgtctgccgctgctgcaacaatggctggacagcccgcgcgccatcctgcgacagccgcgcgcgctgattctgctgccgacccgcgaactggcggcccaagtcggcgacatcctgcgagacctcgcccagtccctgccgcgcaagctgaaagtggccgtggtctacggcggcgtatcgatcaatccgcagatgatggcgctgcgcggcggcgccgacatcgtggtggccacgcccggccggctgctggatttgctcgaccacaacgcgctgcgtctttccgccgtcaaaaccctggtgctggacgaggccgaccgcctgctggacctgggcttcgccgacgagctgggcagcgtgctggaccggttgccgccggcgcggcagaacctgctgttttccgccaccttcccgcccgcggtgcgcgcgctggcggaaaaactgctgaagcagccgctgcggatagacatcgaacacgccgccgccaccgcgccagacatccgccagcgcgcgatcgaggtggacgccggcaagcgcaccctgctgctgcgccacctgctggcgacgcgcgattgggacaaggcgctggtattcgtcgccagccgccaggccgccgaccgggtggcggacaagctgcggcgcaacggcgtgcccgccgccgccttgcacggcgactgcagccagggccagcgcggccaggcgctggccgatctcaaatcgggacgtttgcgggtgctggtggccaccgacgtggcggcgcgcggcatcgacatcgcccggctgccgctggtggtgaactacgacctgccgcgctcgccggtggactatacccaccgcatcggccgcaccggccgcgccggcgcccgcggcgaagccatcagcttcgtcagcgcagactgcgccgcccatttccggctgatagaaaaacgccagcagctgcggctgccgcgcgaacggatcgccggcttcgagccgaccgagacggccatcgcggccgcctcgctgaccgacccggacggcaatggcggcatcaagggcaaacgcaagagcaagaaggacaagctgcgcgaagccgccgccatgcaggaggccggcggcaactaa

SEQ ID NO: 38640 - protein, 420 aa, Chromobacterium violaceum ATCC 12472
MPFASLGLQPDLVQSALEQDYVRPTAIQSAAIPAILQGGDVLATAQTGSGKTAAFCLPLLQQWLDSPRAILRQPRALILLPTRELAAQVGDILRDLAQSLPRKLKVAVVYGGVSINPQMMALRGGADIVVATPGRLLDLLDHNALRLSAVKTLVLDEADRLLDLGFADELGSVLDRLPPARQNLLFSATFPPAVRALAEKLLKQPLRIDIEHAAATAPDIRQRAIEVDAGKRTLLLRHLLATRDWDKALVFVASRQAADRVADKLRRNGVPAAALHGDCSQGQRGQALADLKSGRLRVLVATDVAARGIDIARLPLVVNYDLPRSPVDYTHRIGRTGRAGARGEAISFVSADCAAHFRLIEKRQQLRLPRERIAGFEPTETAIAAASLTDPDGNGGIKGKRKSKKDKLREAAAMQEAGGN

SEQ ID NO: 38641 - DNA, 1383 bp, Chromobacterium violaceum ATCC 12472
  CDS (1)..(1383)
gtgaaaccagccgctttttccaccctgcccctgcccgctcccttgctgtccaacctggacagcctgggctaccaccagatgaccgccatccaggccgccagcctgcccgccattctggaaggccgcgacctgatcgcccaggccaagaccggcagcggcaagacggctgcgttcggcctgggcctgttgtccagcatcaatccgcgctggttcggcgtgcaggcgctggtgatgtgcccgacgcgcgagctggccgatcaggtggcgcaggaaatccgccgcctggcgcgcgccatcgacaatatcaaggtggtgacgctgaccggcggcacgccgatgggaccgcagatcggctcgctggagcacggcgcccatatcgtcgtcggcacgccgggccggctgcaggaccacctgttccgcgaaacgctgaacctgaccggcgtgaagacgctggtgctggacgaggcggaccgcatgatagacatgggcttcatcgaggaaatcgtcggcatcgtccgcgcctgcccgagaacccgccagaccctgctgttctcggccacctatccggaagacatccgcaaggccagcgcgcagttcctgaaaaatccggtggaagtgaaggtggagtcgctgcacaaggccgaccacatcgagcagtggttctacaaggtgaagccggaaacccggctggagacggtcagccgcatcctgcgccacctacgccccacttcggcgctggccttctgcaacacccgcgagcgctgcaaagagctggtgcgcgagctgcaggaacagggcttccacgcgctgacgctgcacggcgacctggagcagcgcgagcgcgaccagatcctgctgcgcttcgccaacaagagcgccaccgtgctggtggccaccgacgtggcggcgcgcggcctggacatcaaggagctggacgtggtgatcaatgtcgacgtcacccacgatccggaagtgcacatccaccgcatcggccgcaccggccgcggcgagcagcacggcctggcgctgaccctggccaccgacagcgaagccaagcgcctggtgcagatcgaaaactaccagcaggccgagctgacctgggccgacgtcgaagagctgaccccggcgccgggcggcccgctgctgccgccgatggtgacgctggagatcgccggcggcaaacgcgagaagctgcgcccgggcgacctgttgggcgcgctgaccggcgaggccggcttcgccggcagccagatcggcaagatcaacatcttcgagttcaacagcttcgtcgcgctggaccgcgccatcgccgaagacgcgctggccaagctatcccgcggcaagatcaagggcaagcagttcaagatgcgcttggtcggctga

SEQ ID NO: 38642 - protein, 460 aa, Chromobacterium violaceum ATCC 12472
MKPAAFSTLPLPAPLLSNLDSLGYHQMTAIQAASLPAILEGRDLIAQAKTGSGKTAAFGLGLLSSINPRWFGVQALVMCPTRELADQVAQEIRRLARAIDNIKVVTLTGGTPMGPQIGSLEHGAHIVVGTPGRLQDHLFRETLNLTGVKTLVLDEADRMIDMGFIEEIVGIVRACPRTRQTLLFSATYPEDIRKASAQFLKNPVEVKVESLHKADHIEQWFYKVKPETRLETVSRILRHLRPTSALAFCNTRERCKELVRELQEQGFHALTLHGDLEQRERDQILLRFANKSATVLVATDVAARGLDIKELDVVINVDVTHDPEVHIHRIGRTGRGEQHGLALTLATDSEAKRLVQIENYQQAELTWADVEELTPAPGGPLLPPMVTLEIAGGKREKLRPGDLLGALTGEAGFAGSQIGKINIFEFNSFVALDRAIAEDALAKLSRGKIKGKQFKMRLVG

SEQ ID NO: 38643 - DNA, 1320 bp, Chromobacterium violaceum ATCC 12472
  CDS (1)..(1320)
atgacgttctccgatctgggcatcgccccgaccatcctgcgcgcgctgcaagccgccggctacgaaaacccgaccgcggtgcaggctgaagccgtgccggcggccatcgccggccgcgacctgctggtatccgcccagaccggcagcggcaagaccgcggccttcctgctgccggcgctgaccaagctgtccgagcgctccaccgccaagggccagggcccgcgcgtgctggtgctgacgccgacccgcgaactggcccagcaggtggagaagaacgcgctggaatacggcaaggacctgcgctggatgcgcaccgcctgcctggtgggcggctcctccttcggctaccagatccgcgcgctgtcgcgcccgatcgacctgatcgtggccaccccgggccgcctgatggaccacatgcgctccggccgcatcgacttctcccgcctggaaatgctggtgctggacgaagccgaccgcatgctggacatgggcttcatcgacgatatcgaagccatcgtcaaggccaccccggaaacccgccagaccgtgctgttctccgccacgctggacggcatcgtcggccgcatggctgaaaagatgacccgcgatccgcagcgcatcgagatcgcccgcaccgaaacctccggcggcaccatcgaagaacacctgctgtacgcggacgacctgaaccacaagcaccgtctgctggactacatcctgaaagaatccggcttcgaccagtgcgtgatcttctccgccaccaaggcttactcggaagaactggccgacaagctgtccgaccagggctactccgccgcctgcctgcacggcgacatgccgcaaagctggcgcaaccgcacgctgaacgacctgcgccgcggccgcatcaaggtgctggtggccaccgacgtggccgctcgcggcatcgacgtgccgaccatcacccacgtggtgaacttcgacctgccgaagcaggctgaagactacgtgcaccgcatcggccgcaccggccgcgccggccgcgacggcaccgcgatcaccctggcggaatccaaggaattccacaaggtgcgccgcatcgagcaatacctgaagcgccagatcaccgaaggcgtgatcgacggcctggaaccgacccgtcgcccgcccaagggcccgcgccgcaacaacaacggcaagggcggctacggcgaccgccgccatggcagcggcaacggccgcggcggctacggcaacaaccgtcgcgaaggcggctaccagggccagcgccgcgaaggcggctatcaaggcaaccgcggtccgcgcagcagcgcgcagtaa

SEQ ID NO: 38644 - protein, 439 aa, Chromobacterium violaceum ATCC 12472
MTFSDLGIAPTILRALQAAGYENPTAVQAEAVPAAIAGRDLLVSAQTGSGKTAAFLLPALTKLSERSTAKGQGPRVLVLTPTRELAQQVEKNALEYGKDLRWMRTACLVGGSSFGYQIRALSRPIDLIVATPGRLMDHMRSGRIDFSRLEMLVLDEADRMLDMGFIDDIEAIVKATPETRQTVLFSATLDGIVGRMAEKMTRDPQRIEIARTETSGGTIEEHLLYADDLNHKHRLLDYILKESGFDQCVIFSATKAYSEELADKLSDQGYSAACLHGDMPQSWRNRTLNDLRRGRIKVLVATDVAARGIDVPTITHVVNFDLPKQAEDYVHRIGRTGRAGRDGTAITLAESKEFHKVRRIEQYLKRQITEGVIDGLEPTRRPPKGPRRNNNGKGGYGDRRHGSGNGRGGYGNNRREGGYQGQRREGGYQGNRGPRSSAQ

SEQ ID NO: 38645 - DNA, 1815 bp, Porphyromonas gingivalis W83
  CDS (1)..(1815)
atgaaaacatttgaagaattaggcattgccaaaccgtttttgaaagcaattgccgaattgggcttcgaacagcccatgcctgtgcaggaagaagtaataccctatctcctcggagaggacatcgacctgatcgctttggcacagaccggcacaggcaagactgccgctttcggccttccgctgctccagaaaattgatttgtcgggaggacgaccgcaggctttggtactctgcccgactcgcgaactgtgtctacagatagcagacgacttgaacagctattccaagtatttgtccgatgtgcacatcctacccgtttacggaggtacgcctatagatgcgcagatcagagccttgcgccgtggtgtgcaaatcgtcgtggcaacgcccggccgtctcctcgacctgatgcgccgtgaggccgtcagcctgtcggacattcatacggtagtattggatgaagcggatgaaatgctcaatatgggctttgcagaagatctggagcaaatcctcgcagatattccatccgaacgccatctgctattgttttcggctacgatgcccaaagagatctccaagatcgccacttcgtacatgaaggaccccaaggaaattgttatcggcaataagaatgagggcaatgccaatatcaagcatctatactacatggtctcggcgcgccataaatatcttgcgctaaagcgaattgccgactactatcccaatatctatggtattgttttctgtcgcacccgtaaggaaacgcaggagattgccgatcaactgattcaagacggctataacgcggattctcttcatggcgatctcagtcaggctcagcgcgactatgtgatgcagaagtttcgcgtccgcaaccttcaactgctcgttgccaccgatgtggctgcccgcggattggatgtgaacgatctgacccatgtgattcacttcggtcttcccgatgatgtagagagctacacccaccgcagcggtcgtacagctcgtgcagggaaaacaggtctttcgatcgccatctgccatgtcaaggagaaaggcaaaatcaagaatatagagcgcacgatgcagaagcagatcgaacgtgcacgcatcccttccggagcagagatatgcgaaaagcaactgttcaatctggccgatcgtatagaacgtgtggatatagagaacacaacggccatcgactctgtcttgaacgaagtgaacaagaagctcgaatggattgaaaaagacgaattgattcgtcgggtaatggcattggagttcaatcgcatgctcgactattaccaacgtgccgaagacgtggaagaagtggtcgagagaaaaaaagacgaggtttcgggagatcgtaaaaaccgaaaacgaggagccggcgaagcagaagaagggatgacccgtctgttcatcaattttggcaagatggatcaaatgtttcccaaccgactgatcgagctgatcaaccgttgtatcccggggcgtgtcaatatcggacggatcgacctgatgccccgattcgctttcttcgatgtagacgagttcgaagccaagaacgtagtagaaaccctcaatcggtacgaagtggatggtcgccgcatccatgtagagtatgcggataccaagaaagactatgccggggggaaaaaaggcggagataagaacttttccgctcgtcgcaaagatttcgacgggcgacgtagtgaaaatcccacttcacgcaaaaacaaaggtcgcaaagagaaaccgacggaaggacgtttctacgacaagttcgactccaaacagcgcaagcgtcggaagtaa

SEQ ID NO: 38646 - protein, 604 aa, Porphyromonas gingivalis W83
MKTFEELGIAKPFLKAIAELGFEQPMPVQEEVIPYLLGEDIDLIALAQTGTGKTAAFGLPLLQKIDLSGGRPQALVLCPTRELCLQIADDLNSYSKYLSDVHILPVYGGTPIDAQIRALRRGVQIVVATPGRLLDLMRREAVSLSDIHTVVLDEADEMLNMGFAEDLEQILADIPSERHLLLFSATMPKEISKIATSYMKDPKEIVIGNKNEGNANIKHLYYMVSARHKYLALKRIADYYPNIYGIVFCRTRKETQEIADQLIQDGYNADSLHGDLSQAQRDYVMQKFRVRNLQLLVATDVAARGLDVNDLTHVIHFGLPDDVESYTHRSGRTARAGKTGLSIAICHVKEKGKIKNIERTMQKQIERARIPSGAEICEKQLFNLADRIERVDIENTTAIDSVLNEVNKKLEWIEKDELIRRVMALEFNRMLDYYQRAEDVEEVVERKKDEVSGDRKNRKRGAGEAEEGMTRLFINFGKMDQMFPNRLIELINRCIPGRVNIGRIDLMPRFAFFDVDEFEAKNVVETLNRYEVDGRRIHVEYADTKKDYAGGKKGGDKNFSARRKDFDGRRSENPTSRKNKGRKEKPTEGRFYDKFDSKQRKRRK

SEQ ID NO: 38647 - DNA, 1284 bp, Porphyromonas gingivalis W83
  CDS (1)..(1284)
atgcgctttgatgaattgaatttaggagatgaagtattggatggtctcgatgccatgaatttcatcgagaccacacctgtgcaggctgcaaccatcccacccattctggagggtcgcgatgtgatcgcttgtgcccagaccggcaccggcaagacggcagcctatctgctccccatactggatcgcctgagtgcaggcgagtttgcctccgatgtggtgaatgccgtgatcatggctcccactcgcgaactggcgcagcaaatagatcagcaagtggaagggttttcttacttcatgccggtatcggccgtagccatatacgggggtacggacggggtggcatgggagcagcaacgtcgggggatggctatgggggcggacatcgtgatagccacaccgggacgtctgatctcgcatctgaatctcggttcggccgacctctcccacgtctcctacttcgtattggacgaagccgaccgcatgctggacatgggtttcttcgatgacatcatgcagatatacaagcagctgccgagttcgtgccagacggttatgttttcggctacgatgccccccaagatccgcaagctggcagcatctattctaagggatccgatagaggtggagatcgccatcagccgtccgcccgagagcatcatgcagagcgcatacatttgtcacgaagcgcagaagctgccgatactccgcaagctcttcgagcagtcggctccgaagcgtaccattattttcgcctcggccaagctcaaagtgcgtgagctgacttccactctccgcaagatgggtttcaatgtggccgatatgcactccgatctggagcagtcccagcgcgaacaggtgatgcgcgacttcaaaaacggctatgtggatgtacttgtggccactgacatcgtagcgcgagggatcgacatcgacaacatacgcgtagtcatcaactacgacattccccacgatcccgaggactatgtacaccgtatcgggcgtactgcccgaggaacaaacggggagggtctggctatcactttcgtctccgaggaagagcagagcgacttccacaagatcgagacgtttctgggcaaatcggtctataaattgcctgtcgatctggagtttggtgaagtcccggcttacgaaccggcgaaacgtcgccctcgccgtttggggcgaagcggcgaagcgcgttctggtcgatccgaaacgaacaaaagacagggaaaaaccgcttcgaacggacgcaggcgcggaggcacgagacagaggcgatag

SEQ ID NO: 38648 - protein, 427 aa, Porphyromonas gingivalis W83
MRFDELNLGDEVLDGLDAMNFIETTPVQAATIPPILEGRDVIACAQTGTGKTAAYLLPILDRLSAGEFASDVVNAVIMAPTRELAQQIDQQVEGFSYFMPVSAVAIYGGTDGVAWEQQRRGMAMGADIVIATPGRLISHLNLGSADLSHVSYFVLDEADRMLDMGFFDDIMQIYKQLPSSCQTVMFSATMPPKIRKLAASILRDPIEVEIAISRPPESIMQSAYICHEAQKLPILRKLFEQSAPKRTIIFASAKLKVRELTSTLRKMGFNVADMHSDLEQSQREQVMRDFKNGYVDVLVATDIVARGIDIDNIRVVINYDIPHDPEDYVHRIGRTARGTNGEGLAITFVSEEEQSDFHKIETFLGKSVYKLPVDLEFGEVPAYEPAKRRPRRLGRSGEARSGRSETNKRQGKTASNGRRRGGTRQRR

SEQ ID NO: 38649 - DNA, 1518 bp, Wolinella succinogenes DSM 1740
  CDS (1)..(1518)
atggataaccacgtaaacgcacacgaagagcaagagcaagcaggatttgagcagtttggcttcaaagagaatcttcttagagggattcacgaagcaggcttcaaagttcctagccccatccaagtcgaagccattcccttggttcttggaggccacgacctcatcgctcaagctcaaacagggacaggcaaaacggctgccttcggactccctatcatccaaaacctcaaaaatgatggctccattgaagcccttatcatcactcctacgcgagagctcgctgtccaaatcagtgatgaaattttcaaactcggccgcaactgccgcaccaaaaccgtctccgtctatggcggtcaagcgattcgacgccaggttgagctcctagagaaagctccccaagtcatcatcgctacccccggacgacttcttgatcacttaagaaatgatcgactcaaaaatttcaaccccaccactatcgtcttagacgaatccgatgagatgcttgatatgggattcctcgatgatatcgaagagattttcacctacctgcccgctagtcgccaaacccttctcttctctgcgaccatgcccgcccccatcaagaacctcgctcaaaagattctccacaaccccaaaatggtgaaggtgaccaccaacgaaaccaccaacagtgacatctcccaacgctactacatcatcaatgaatatgagcgcgaagatgcgattgtgcggctcatcgatagcgaagcgcccagcaaaaccatcatcttcacccgaatgaaaaaagaggccgatgacctctccaatcgacttatcgctaagggctaccaagcaggagcgcttcatggtgatatggaacaacgagagcgccaagctgcggtgaacgccttcaaacaaggggcgattgatattcttgtggccaccgatgtagcggcacgaggactcgatatcagcaatgtaagccatgtctttaactaccacatccccctcaatcccgagagttatgtccaccgaatcgggcgaacaggccgcgcaggtaaaaaagggatcgctatcacgctcgccactcctttggaatttaaagagattcgacgaatctctgaaaccaccaaagccacgattgagctctatgaaattcccaccatcgctgagaccctcaagcagaccgattctaagctcattcaaaatcttctcaaccactccatcaccgatgatgccctccgaatctatgagcagattcgaggagagattgacaccacgcagcttgcgtgcaaactcctctccatgctcatgaaaaagagttctatcatggggcccaacaagattggtctctccaaagaggatcttatgcagctcaaaaaccgcctaagtggcgatgataggcgcgatcgaaactctagaggaggcaaagggggctctagaggaggctctagaaactccggcggctaccgaagagatagccgtgatgggaatcgctcctctgagggcaactactctagacgcaaaagacgcgactaa

SEQ ID NO: 38650 - protein, 505 aa, Wolinella succinogenes DSM 1740
MDNHVNAHEEQEQAGFEQFGFKENLLRGIHEAGFKVPSPIQVEAIPLVLGGHDLIAQAQTGTGKTAAFGLPIIQNLKNDGSIEALIITPTRELAVQISDEIFKLGRNCRTKTVSVYGGQAIRRQVELLEKAPQVIIATPGRLLDHLRNDRLKNFNPTTIVLDESDEMLDMGFLDDIEEIFTYLPASRQTLLFSATMPAPIKNLAQKILHNPKMVKVTTNETTNSDISQRYYIINEYEREDAIVRLIDSEAPSKTIIFTRMKKEADDLSNRLIAKGYQAGALHGDMEQRERQAAVNAFKQGAIDILVATDVAARGLDISNVSHVFNYHIPLNPESYVHRIGRTGRAGKKGIAITLATPLEFKEIRRISETTKATIELYEIPTIAETLKQTDSKLIQNLLNHSITDDALRIYEQIRGEIDTTQLACKLLSMLMKKSSIMGPNKIGLSKEDLMQLKNRLSGDDRRDRNSRGGKGGSRGGSRNSGGYRRDSRDGNRSSEGNYSRRKRRD

SEQ ID NO: 38651 - DNA, 1215 bp, Oryza sativa (japonica cultivar-group)
  CDS (1)..(1215)
atggcggcggccaccacgtcccggcgcggccccggcgccatggacgacgagaacctcaccttcgagacctcccccggggtcgaggtcatcagcagcttcgaccagatggggatccgcgaggacctcctccgcggcatctacgcctacggcttcgagaagccctccgccatccagcagcgcgccgtcctccccatcatcagcggccgcgacgtcatcgcccaggcccagtccggaaccggcaagacctccatgatctcgctctccgtctgccagatcgtcgacaccgccgtccgagaggttcaggccttgatactctcaccaactagagaacttgctgcacaaacagaaagagttatgctggccattggtgattacatcaatatccaagtgcatgcttgtattggtggcaaaagtattggtgaggatattagaaagcttgagcatggagtgcatgttgtgtcaggaacacctggcagagtctgtgatatgatcaagagaaggaccttgcgtacaagagccattaagctcctaattctggatgaagccgatgagatgttgggcagaggctttaaggatcagatatatgatgtctacagatatctacccccagagctccaggtttgcttgatctccgcaactctgccacatgagatcttggaaatgaccagcaagttcatgactgacccagtccggatccttgtaaagcgtgatgaattgaccctagagggcatcaaacaattctttgttgctgttgagaaagaagaatggaagtttgatactctttgtgatctttatgatacactgacaatcacccaagctgtcattttctgcaacacgaagagaaaggttgattggcttacagaaagaatgcgcagcaataacttcacggtatcagctatgcatggtgacatgcctcaaaaggaaagggatgccattatgggtgaattcaggtctggtgcaacccgtgttctaattacgacagatgtgtgggctcgaggcctggatgttcagcaggtctctcttgtcataaactatgatcttccaaataatcgtgaactttacatccatcgcattggtcgctctggacgttttggtcgcaagggtgtggccatcaattttgtcaaaaaggaagacatccgtatcctgagagatattgagcagtactacagcacacagattgatgaaatgccaatgaatgttgctgatctaatttga

SEQ ID NO: 38652 - protein, 404 aa, Oryza sativa (japonica cultivar-group)
MAAATTSRRGPGAMDDENLTFETSPGVEVISSFDQMGIREDLLRGIYAYGFEKPSAIQQRAVLPIISGRDVIAQAQSGTGKTSMISLSVCQIVDTAVREVQALILSPTRELAAQTERVMLAIGDYINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVWARGLDVQQVSLVINYDLPNNRELYIHRIGRSGRFGRKGVAINFVKKEDIRILRDIEQYYSTQIDEMPMNVADLI

SEQ ID NO: 38653 - DNA, 2277 bp, Oryza sativa (japonica cultivar-group)
  CDS (1)..(2277)
atggcttccctcctcacgctcccctccctctccctctccaaccctagcgcctccgccgccgccgcgggagccggagcggcgccgtctctgcgcctccgcgccgccttccgctgctgggcgctgcggcgcgcgggcggcggccggtgggcggccgcgggggccatcgcgtcgcccaactcggtgctcagcgagcacgcgttcaagcggctgcagctcagcgacgaggaggaggaggaggaggagggggcctacgggagtgacgaggagggggtcgaggcggtgggtggcggggagggggacgaggacgagctcgccattgccaggctcggcctgcccgagcagctcgtatccacgctcgagaagcgcgggattacccacctgttccccatccagagggctgtattgattccagctcttgacggccgtgacctgattgctagagcaaagacaggaaccgggaagacgctagccttcggcattcccatgatcaagcaattaatggaggaggatgatggacggagtgtgaggcgaggtcgtattcctcgtgttttggttctagcacctactagggagttagccaagcaagttgagaaggaaataaaagaatcagcacccaagctcagtacagtctgtgtttatggaggtgtctcatataatgtccagcagaacgcactctcccgtggtgttgatgttgttgtaggaacacctggtcgcattattgatttgataaatggcggaagtcttcagttgggagaagttaagtacttggtccttgatgaggctgaccaaatgcttgcagttgggtttgaggaggatgtggaaacgatattacaacagctaccagctgagaggcaaagcatgctcttctctgccaccatgcctggttgggtgaagaaattatctaggcgatacttgaacaatcctttgacaattgacttggtcggcgatcaagatgaaaaacttgctgaaggaatcaaactttatgctatcccgctcacatctacatcgaagcgcactgttcttagtgatctcattacggtgtatgcaaagggtgggaaaaccattgtgttcaccaagacgaaaagggatgcagacgaggtatcattagcactgacaaacagtattgcttcggaggcactgcatggtgatatttcacagcatcagcgtgagaggacactaaatggttttcgtcaagggaaatttactgttctcgtagcaaccgatgttgctgcccgtggtcttgatataccgaatgttgatttgattatccattatgaattgcccaatgatccagagacttttgttcatcgttctggacgcactggccgagctgggaaagcaggaactgcaatcttgatgttcacaaacagccagagaaggacagttagatcacttgagcgtgatgttggatgcagatttgacttcataagtcctccagcaattgaggatgtgctggagtcctctgctgaacatgtcatagctactttaagaggtgtgcacacggagtcgattcagtacttcattccagcagctgaaagactgcaagaagaattaggacctaatgctcttgcttctgcattggcacatctgagtggattttctcagccaccctcttcacgttctcttatcagtcatgagcagggatgggtgactttgcaactaactagagatccaggatatggaagggggttcttttctcctagatctgttactggctttctgtctgatgtttcttcagctgctgctgatgaagttggcaaaattttccttacagcagatgagaaggttcaaggtgcagttttcgatttacctgaggagattgcgagggatttgcttagtatggaactgcccccaggaaacaccataaccaaagtgacaaagctacctgcattacaggatgatggtcctgctactgatagttatggccgattctcaaactcggaccggggtttcaggaacagacggtccaggggtggtggctcaagaggcgggcggggtggttgggactctgatggtgaagacagatttcgccgtggtggcaggagcttcagatctgacaatgatagttggtcagatgatgactttggtggcgggagaagatcgaaccgttcgtcatcctttggtggccgcgggtcatcttacggcagtcgtagctcgtcatcctttggtggccgctcatcatcttttgggtctagggacagcagcaggagcttcagtggtgcttgcttcaactgtggcgaaagcgggcaccgagcatcagactgcccaaacaagtag

SEQ ID NO: 38654 - protein, 758 aa, Oryza sativa (japonica cultivar-group)
MASLLTLPSLSLSNPSASAAAAGAGAAPSLRLRAAFRCWALRRAGGGRWAAAGAIASPNSVLSEHAFKRLQLSDEEEEEEEGAYGSDEEGVEAVGGGEGDEDELAIARLGLPEQLVSTLEKRGITHLFPIQRAVLIPALDGRDLIARAKTGTGKTLAFGIPMIKQLMEEDDGRSVRRGRIPRVLVLAPTRELAKQVEKEIKESAPKLSTVCVYGGVSYNVQQNALSRGVDVVVGTPGRIIDLINGGSLQLGEVKYLVLDEADQMLAVGFEEDVETILQQLPAERQSMLFSATMPGWVKKLSRRYLNNPLTIDLVGDQDEKLAEGIKLYAIPLTSTSKRTVLSDLITVYAKGGKTIVFTKTKRDADEVSLALTNSIASEALHGDISQHQRERTLNGFRQGKFTVLVATDVAARGLDIPNVDLIIHYELPNDPETFVHRSGRTGRAGKAGTAILMFTNSQRRTVRSLERDVGCRFDFISPPAIEDVLESSAEHVIATLRGVHTESIQYFIPAAERLQEELGPNALASALAHLSGFSQPPSSRSLISHEQGWVTLQLTRDPGYGRGFFSPRSVTGFLSDVSSAAADEVGKIFLTADEKVQGAVFDLPEEIARDLLSMELPPGNTITKVTKLPALQDDGPATDSYGRFSNSDRGFRNRRSRGGGSRGGRGGWDSDGEDRFRRGGRSFRSDNDSWSDDDFGGGRRSNRSSSFGGRGSSYGSRSSSSFGGRSSSFGSRDSSRSFSGACFNCGESGHRASDCPNK

SEQ ID NO: 38655 - DNA, 1485 bp, Oryza sativa (japonica cultivar-group)
  CDS (1)..(1485)
atgagccgcttcgacggccgcgccgcggaccccggctcgtaccgcgaccgccgcagcgaaggggcgttcgggggcgggacgagggcgttcgccccgacgagcaaggcggactccgcggccgcggccgctgacctggatgggctgccgcggttcgagaagaacttctacgtggagtccccctccgtggccggcatgacggaggaggaggtggaggcctaccggcgccgccgggagatcaccgtggagggccgcgacgtgcccaagccagtgcgcgagttccgcgatgtcggattcccagaatatgttttgcaagaaattacaaaagctgggtttgtagaacctactcctatccagtctcaaggttggccaatggcactgaggggacgtgatcttattggcattgctgaaacaggatcagggaaaacacttgcttaccttttacctgccattgttcatgttaatgctcagccgattctagcacctggcgatggtccaattgttctggtgttagcccctacacgtgaacttgctgtgcagatacagcaagaggcaactaagtttggtgcgtcatcaaaaataaaaagtacttgcatatatggtggtgttccaaaaggtcctcaagttcgcgatcttcaaaaaggcgttgaaattgttatagccacgccaggaagactgattgatatgatagaatcacatcatacaaatttgcggagggtcacttaccttgttttagatgaggcagaccggatgctggatatgggctttgaacctcagattaagaaaattgtttctcagattcgtccagatcgccaaacattatattggagtgctacttggccaaaggaagttgaacagctagcaaggaactttcttttcgacccatacaaggtcataattggttctgaggagttgaaagctaatcatgccatttctcaacatgtggagatattatccgagagtcagaagtacaataagttggttaatctactggaggatataatggatggcagccggatattaatatttatggacacgaagaagggatgtgatcaaatcactagacagcttcggatggatggttggcctgctctgtctatccatggtgacaaaagccaagctgagagggattgggttctttctgaatttaaatcagggaaaagccctatcatgacagcgactgatgtggctgctcgaggcttagatgttaaggatgttaaatatgtcattaactatgactttccgggatcattggaggattatgttcatcgcattggtcgaactggcagagctggagcaaaaggaacagcttacacgtttttcactgctgctaatgccagatttgccaaggatctgatcaacatactagaagaagctggacaaaaggtcagccctgaattagctaatatgggtcgtggtgcaccacccccttcttcaggccaccgtgatagatatagagggtatggaggtggccggtcatggagctga

SEQ ID NO: 38656 - protein, 494 aa, Oryza sativa (japonica cultivar-group)
MSRFDGRAADPGSYRDRRSEGAFGGGTRAFAPTSKADSAAAAADLDGLPRFEKNFYVESPSVAGMTEEEVEAYRRRREITVEGRDVPKPVREFRDVGFPEYVLQEITKAGFVEPTPIQSQGWPMALRGRDLIGIAETGSGKTLAYLLPAIVHVNAQPILAPGDGPIVLVLAPTRELAVQIQQEATKFGASSKIKSTCIYGGVPKGPQVRDLQKGVEIVIATPGRLIDMIESHHTNLRRVTYLVLDEADRMLDMGFEPQIKKIVSQIRPDRQTLYWSATWPKEVEQLARNFLFDPYKVIIGSEELKANHAISQHVEILSESQKYNKLVNLLEDIMDGSRILIFMDTKKGCDQITRQLRMDGWPALSIHGDKSQAERDWVLSEFKSGKSPIMTATDVAARGLDVKDVKYVINYDFPGSLEDYVHRIGRTGRAGAKGTAYTFFTAANARFAKDLINILEEAGQKVSPELANMGRGAPPPSSGHRDRYRGYGGGRSWS

SEQ ID NO: 38657 - DNA, 2676 bp, Oryza sativa (japonica cultivar-group)
  CDS (1)..(2676)
atgtcggcagggaccgccccggccgcgccgcggtacgcgccggacgacccgtcgctccccaagccgtggcgcgggctcgtcgacggcaccaccggctacctctactactggaacccggagaccaacatcacccagtacgagaagccgctgccgcccgaggaccagctcccgccgcccccgccgctccccccgccgcctccccgctccggccgaggcgaccgagaccgcgaccgccgcgaccgctcccgatcccgcaccccgccgcggcgcgaccaccgggaccgcgaccgggaccgcgacaggcgccacgacgaccacaggtcggcgccttcccaccaccatcctcttccggccgccgccgccatcgccgccgatgatccctccaccgaggcgtatcgccaccgccacgagatcaccgttgtcggggacaacgtgccagctccgataacttcgtttgagactggtggattcccaccggaaatcctcaaggagatacaacgtgctggattctcaagtccaacgccaatccaagctcagtcatggccaattgccttgcagtgtcaagatgttgtagctattgcaaagacaggatctggaaaaactcttgggtatctacttcctggatttatgcatattaaacgcttgcaaaacaacccaaggtctggtccaacagtgctagttttggcaccgacaagggagcttgcaactcagattttggaagaagctgtgaaatttggcagatcatcaagaatttcttccacgtgtctatatggtggtgctccaaaaggcccccagctaagagatttggatagaggggtcgatgtcgttgttgctacaccaggaaggttgaatgacatcctagaaatgcgaaggataagccttaagcaagtgtcgtaccttgttctagatgaagctgaccgtatgttggacatgggatttgaaccacaaattcggaagatagtgaaagaaattcctcctcgtcggcaaaccctcatgtacactgctacttggcctaaggaagtccgacgaattgcagaggatcttcttgttcaccctgtccaggtgaccattggaagtgttgatgagcttgttgctaatagtgctattactcagaatgtggagctgatcacaccgtccgaaaagcttcgccgtctggagcaaattttgcgatcccaggattcaggttcgaaggtactaatattctgtaccactaagagaatgtgcgaccaacttgcaaggacacttactaggcaatttggagcttctgccattcatggtgataagtcccaaagtgaaagagagaaggtcctgagccattttagatctgggcgatctcctattttggttgcaacagatgttgctgcacgaggcttagacatcaaagatatcagggttgtgatcaattatgatttccccactggcattgaagattatgttcaccggattggcaggactggaagggctggtgccactggtgtggcctatacgtttttctgtgaccaggattcaaaatatgctgctgatcttattaaaattctggaaggcgcaaaccaacgtgtgcctcgtgacttggcggacatggcctctcggggtgggcgtggtggtaggaagcgtaaccggtgggcaacccgctctgataggggtggttcgcattctgaactggattctaggtatggtggaagagatggtctgtcagggtcttctggcagattggatagtagtcgcagtagtcgcaggcatgactatggtgatgatggacggtctcgcaggtctgggagaggtcgcagtaggagccgtagcagaagtgacagtgataggtatagccgaagtcctaagaggtcacgccgtcatagccgtagcaggaccaggagtcggagccgaagcaggagcaggagctacactaggaaccgtcgtgctagccgcagcaggagccgtagccctggtgctagccgtaggcatgaaagaagcgctactggctctgggtctgcactgccagactctgggcacggtgagcgcaaaagaacaccagaagctgacccatcaagaaaccatacaaaccactcagacccgaaagatgaccgacacccagaggatgggaaggtgggaaaggttgatctcgatcggtcgcctactccacaagacaagtctggcccatatagtcctgcttacaatggaaaaaccagtcgctcagtgagccctggtaatcaggtggaaggaaacaacaaagctgcggaggtttctaagaatcctgatccttcatcgccaccccatcatggtaagaccagggaggacgaagaggaaggcgctcttggactccatgcttgccaaccggcgctccctatccatgaaggccctgcggcggctgtgggagaagcggcgtggtcggcgtggcccagcggctgcagcgggaggagcggcgtggtcggcgtcgtcggcgtggcgctgcggctgcgggaggagcgactggagtcgtcgcctcatcggcgtggccttgcggcctttgcggctgcaaccagcgggaggagccggtgggcagggcagcgctgcagcctgtggcgtgccggcggcggaaggagaagggcgaggcagcgctgcggcggcgcaagagaaggcgacagcggcgcaagagtaggcgacggcggcagcctgctactctgcggcggcgcatgcgcatga

SEQ ID NO: 38658 - protein, 891 aa, Oryza sativa (japonica cultivar-group)
MSAGTAPAAPRYAPDDPSLPKPWRGLVDGTTGYLYYWNPETNITQYEKPLPPEDQLPPPPPLPPPPPRSGRGDRDRDRRDRSRSRTPPRRDHRDRDRDRDRRHDDHRSAPSHHHPLPAAAAIAADDPSTEAYRHRHEITVVGDNVPAPITSFETGGFPPEILKEIQRAGFSSPTPIQAQSWPIALQCQDVVAIAKTGSGKTLGYLLPGFMHIKRLQNNPRSGPTVLVLAPTRELATQILEEAVKFGRSSRISSTCLYGGAPKGPQLRDLDRGVDVVVATPGRLNDILEMRRISLKQVSYLVLDEADRMLDMGFEPQIRKIVKEIPPRRQTLMYTATWPKEVRRIAEDLLVHPVQVTIGSVDELVANSAITQNVELITPSEKLRRLEQILRSQDSGSKVLIFCTTKRMCDQLARTLTRQFGASAIHGDKSQSEREKVLSHFRSGRSPILVATDVAARGLDIKDIRVVINYDFPTGIEDYVHRIGRTGRAGATGVAYTFFCDQDSKYAADLIKILEGANQRVPRDLADMASRGGRGGRKRNRWATRSDRGGSHSELDSRYGGRDGLSGSSGRLDSSRSSRRHDYGDDGRSRRSGRGRSRSRSRSDSDRYSRSPKRSRRHSRSRTRSRSRSRSRSYTRNRRASRSRSRSPGASRRHERSATGSGSALPDSGHGERKRTPEADPSRNHTNHSDPKDDRHPEDGKVGKVDLDRSPTPQDKSGPYSPAYNGKTSRSVSPGNQVEGNNKAAEVSKNPDPSSPPHHGKTREDEEEGALGLHACQPALPIHEGPAAAVGEAAWSAWPSGCSGRSGVVGVVGVALRLREERLESSPHRRGLAAFAAATSGRSRWAGQRCSLWRAGGGRRRARQRCGGAREGDSGARVGDGGSLLLCGGACA

SEQ ID NO: 38659 - DNA, 1155 bp, Gloeobacter violaceus PCC 7421
  CDS (1)..(1155)
atgacttttgctgatctccaattgcacccggacctggtgcgcgctgttgagcaattgggttttacccagcccacgcccatccagactctggccataccaccggcactggcgggccgcgatgtgctcgcctgcgcaatgaccggcagcggcaaaacagccgcttttttattgccgattttgcagcagctcattgcccagccccgcagtaccacccgggcgctggtgctgacaccgacgcgcgaactggccggccagatcgagatgcacctcggccagcttgctcgctacagcgccctgcgcggcgcctcgattatcggcggtgtgtcccctgagccccaggcgcgtgcttttcacaagggcgtcgaggtgctgatcggcacaccgggccgtctgctcgaccacttcgatcagccctatgcccggcttgcgaacctggagatcctggtgctcgatgaggccgaccggatgctggagatgggtttcttgcccgacatccgccgcatcctcagacacacgggccaccgtcgccagacgctctttttctctgccaccatgccgggaccgatcgccaagctcgccaccgaaattctgcgcaaccccgttaccctcaaccaggagcgcaaggccgccccggcagtcggtatcacccacagcgtctatccggtggcccagaatcttaaatcgaagtttttgctggaattgctggagcgcgaagggatgcgccaggtgatcgtgtttacgcgcaccaagcatcgcgccaaccgcctgtctgagtatctcagcaaagccagaatcagctgcgagcgcatccacggcaaccgctcccaggggcagcgtaccgaggctctggcgggcttcaaaagcggcaagtaccgggtgctggtggccacagacatcgcctcgcgcggtatcgacatcgaggcactcggacatgtcgtcaacttcgatgtcccccaggccgctgaggattacatccaccgcgtcggccgcacggcgagagccgagcgcaccggcgacgccttcaccttcgtctcccccgaagaagaagaccaattgcgggcgatcgagcgcgccattggcaagcgcctgccgcgcctgaccctattaaacttcgactatgccgttgcaccccagggatccagactttccggctga

SEQ ID NO: 38660 - protein, 384 aa, Gloeobacter violaceus PCC 7421
MTFADLQLHPDLVRAVEQLGFTQPTPIQTLAIPPALAGRDVLACAMTGSGKTAAFLLPILQQLIAQPRSTTRALVLTPTRELAGQIEMHLGQLARYSALRGASIIGGVSPEPQARAFHKGVEVLIGTPGRLLDHFDQPYARLANLEILVLDEADRMLEMGFLPDIRRILRHTGHRRQTLFFSATMPGPIAKLATEILRNPVTLNQERKAAPAVGITHSVYPVAQNLKSKFLLELLEREGMRQVIVFTRTKHRANRLSEYLSKARISCERIHGNRSQGQRTEALAGFKSGKYRVLVATDIASRGIDIEALGHVVNFDVPQAAEDYIHRVGRTARAERTGDAFTFVSPEEEDQLRAIERAIGKRLPRLTLLNFDYAVAPQGSRLSG

SEQ ID NO: 38661 - DNA, 1314 bp, Gloeobacter violaceus PCC 7421
  CDS (1)..(1314)
atggccactgcattttcggcactcgggctcagcgagtccgtggtgaaggcgctcgacgaactcggtttcgagcagccgactccgattcaactgaagagcatcccctttttgctggacggccgcgacctgctcgcccaggcccagaccggcaccggcaagacggcggctttcggcctgccgctggtcgaccgttcagacccgcaggacgcccgggtgcaggcgttggtgcttgcccccacgcgcgaactggccgtgcaggtgtgtgaggccattcatacctacagcaagcattcgggcgtgcgggtgctgcccatctacggcggccagcccatcgatcgccagatgcgtcgtctgcgcgccggtgcacagatcgtggtgggcacccccgggcgggtgctcgatctgatgcggcgcggcagtctcgatctgagcgcattgcgcacgctggtgctcgacgaagccgaccagatgctggatatgggctttatcgaggaagtccagaccattcttgatgcggctcccccagagcggcaactggtcttcttctcagccacactgcctgcgagtatccgcaaacttgccgcccgccacctgcgcacgccgatgacgctcaccatgcccgccgaggagcgcgacaccccggccatcgcccagcgggtctacttcgtcaacttcaaaaaccgcgcccaggctctaacccgcgtgctcgcggccgaagatccggcctcggccttgatttttacccgcaccaaacaggcggcggacgaactggccgaacaactgcaggacgacggtcaccgcgccgaggccctgcacggggatctcaatcagagtgcgcgcgaggcggtgctggggcgctttcgccgccagcagctcaacgtggtggtggcgaccgacgttgccgcccgcggcctcgatatcgccgatctcagccacgtcatcaactacgacatgccccaggacggcgaatcgtacatccaccgcatcggccgcaccggccgggcggggcgcaccggggtggcgatcagcttcgctctgcccaccgaccgctatcggttgcggctgattgaacgggcgaccggctcgacgctcgttccagccaagattccctcagcgggagaaatccaggtgcggcgcaccgaacgcctcgtcgagcagttgcgcaggcagttgcaggcggacgagagtgatccgagcctcgtactttaccgcgaggtcgtgggacagttgcgcgaggaattcgacttgggcgatattgccgccacgttcctcaagctcgctcagcagcggcccggcagtaccgggagcggctga

SEQ ID NO: 38662 - protein, 437 aa, Gloeobacter violaceus PCC 7421
MATAFSALGLSESVVKALDELGFEQPTPIQLKSIPFLLDGRDLLAQAQTGTGKTAAFGLPLVDRSDPQDARVQALVLAPTRELAVQVCEAIHTYSKHSGVRVLPIYGGQPIDRQMRRLRAGAQIVVGTPGRVLDLMRRGSLDLSALRTLVLDEADQMLDMGFIEEVQTILDAAPPERQLVFFSATLPASIRKLAARHLRTPMTLTMPAEERDTPAIAQRVYFVNFKNRAQALTRVLAAEDPASALIFTRTKQAADELAEQLQDDGHRAEALHGDLNQSAREAVLGRFRRQQLNVVVATDVAARGLDIADLSHVINYDMPQDGESYIHRIGRTGRAGRTGVAISFALPTDRYRLRLIERATGSTLVPAKIPSAGEIQVRRTERLVEQLRRQLQADESDPSLVLYREVVGQLREEFDLGDIAATFLKLAQQRPGSTGSG

SEQ ID NO: 38663 - DNA, 1305 bp, Photorhabdus luminescens subsp. laumondii TTO1
  CDS (1)..(1305)
ctggagcatttcttatttatgaatttcaaatcacttggcttaagtgctgatattttgcgtgccgttgaagaacagggttattcagcgccgacaccaatccaacaacaggcaattcctgttgtattagcaggtaaagatttattagcgagtgctcaaacaggcacaggtaaaaccgcaggttttaccttacccatgctgcaacggttaaatgattcccctattcagatgaaagggcgccggccagtcagagcattaatcctgactccaactcgtgaattggctgctcaagtgggtgaaaatgtccgcgactacagtaaatacctcagactgcgctctctggttgtttttggcggtgtcagtattaaccctcagatgatgaaattgcgtgggggtgtggatattttagtcgcaacaccggggcggttactggatcttgaacatcaaaatgcggttgatttatcccgggtagaaattttggtattggatgaagctgaccggatgctggatatggggtttattcatgatattcgtcgagtgctgaataaattaccaccgaaacggcaaaatttactgttttccgcgactttctctgacgatatcaaaagcttagccagtaagttattgcgtgatcccgtcagtgttgaagttgcacgtcgtaactctgcttctgaacagattgaacagcttgttcactttgtcgataaaaagcgtaaaggtgagctgctctctttcttgatcggcagccgtaactggcagcaagttctggtatttacccgaaccaaacatggcgcgaaccgtttggcagaacagttaaataaagatggtgtaacggcttcggctattcatggtaataaaagtcagggggcgagaacccgtgcactggctgattttaaagatggccggatcagagtgctggtagcgacagatattgcggcccgtggtctggacattgatcaactgccttatgtggtgaattttgaattgcctaatgtcgctgaagattatgtccaccgtattggtcgtactggccgagcagatgcaacagggcaggcactttctctggtctgtgttgatgagcataagctgttgaaagatattgagcgtttgttaaaacgggagattccccgtatggcaattcccggttatgagccagatccaacgatcaaggctgaacctatccaaaacggtcgtcaggcacgtggcgataatcggcagaaaaatagccatcgccgttctggggcaccttcgcgtcagcgtagcagcagtcatgatgtatcccataaatcgcctaacgtcagaggttaa

SEQ ID NO: 38664 - protein, 434 aa, Photorhabdus luminescens subsp. laumondii TTO1
MEHFLFMNFKSLGLSADILRAVEEQGYSAPTPIQQQAIPVVLAGKDLLASAQTGTGKTAGFTLPMLQRLNDSPIQMKGRRPVRALILTPTRELAAQVGENVRDYSKYLRLRSLVVFGGVSINPQMMKLRGGVDILVATPGRLLDLEHQNAVDLSRVEILVLDEADRMLDMGFIHDIRRVLNKLPPKRQNLLFSATFSDDIKSLASKLLRDPVSVEVARRNSASEQIEQLVHFVDKKRKGELLSFLIGSRNWQQVLVFTRTKHGANRLAEQLNKDGVTASAIHGNKSQGARTRALADFKDGRIRVLVATDIAARGLDIDQLPYVVNFELPNVAEDYVHRIGRTGRADATGQALSLVCVDEHKLLKDIERLLKREIPRMAIPGYEPDPTIKAEPIQNGRQARGDNRQKNSHRRSGAPSRQRSSSHDVSHKSPNVRG

SEQ ID NO: 38665 - DNA, 1935 bp, Photorhabdus luminescens subsp. laumondii TTO1
  CDS (1)..(1935)
atgaggcaccattacatgaccactgagactgaaatctcttttgctgatctgggtttatcagcacctatcctttctgcgctggaagatcttggctatgaaaagccatctccaattcagcaacaatgtattccccatttattaaatggccgtgacgtactgggtatggcacagacggggagtggtaaaacagcggcattcagtctgcctttactacataatatcaatgctgagttgaaagctccgcagatccttgtgttggcaccgacccgtgaactggcggtacaggtagccgaagcgtgcgcagatttttctaaacatatgcgtaacgtgaatgttgttgcactgtatggtgggcaacgttatgacgttcagttacgcgctttacgtcaagggccacaaattgttgtgggtacaccagggcgtcttctggaccatctgaagcgtggtacgttggatctgtctaacctgagcggtttagttttggatgaagcagacgaaatgctgcgtatgggctttatcgaagatgttgaaaacatcatgagccagattcctgctgaacatcagactgcactgttctctgcaactatgccagaagctatccgtcgcattactcgtcgttttatgaacgatccgcaagaagtgcgtatccaagcgagtgtaacgactcgtcctgacatcagccagagctactggtctgtttacggtatgcgtaaaaatgaagctttggtgcgtttccttgaagctgaggattttgatgctgcgattatttttgtgcgtaccaaaaatgcaacgttggaagtagcagaagcactggagcgtaatggctacaacagtgcggcgctaaacggtgatatgaaccaggcactgcgtgagcagacattggaacgtctgaaagatggccgtttggatattttgattgcaactgatgttgcagcgcgtggcttggatgttgagcgcatcagtctggttgttaactatgacattccaatggatgcggaatcttatgttcaccgtattggccgtactggccgtgcaggtcgtgcaggtcgtgcattgttgtttgtagaaaaccgtgaacgtcgcttgttacgtaacgttgaacgtacaatgaagctgactatcccggaagttgaactgccaaatgctgaattattgagtcagcgtcgtctggaaagatttgccgctaatgtacagcagcaattggaaagtagcgatctagatcagtaccgtactctgttgtctaaactgcaacctgcggaagatctggatatagaaacgctggcggctgcattattgaaaatggcacagggtgagcgcccgttgattctgcctccggacccggttcgtcgtcctcgccgcgaattcaacgaacgtgatgatcgtcgtcgtaatggttttgatgatcgtggcgaacgtagtgatcgtcctcgtcgtgaacgccgtgatgttggtgaaatggagttgtaccgtattgaagtgggccgcgatgatggtgttgaagttcgtcatatcgttggtgcgattgctaatgaaggtgatatcagcagccgttatattggcaacatcaaattgtttgcaacgcattccacgattgaattgccaaaaggcatgccaggtgatttgttatcccactttacccgtacccgcattctgaataagccaatgaatatgcagttaatgggtgatgcacagccatttgagcgccgtgaacgtcgtggtggtgggcgtaacggcaatggtaacggtaatagtagtggtagtggccctcgccgtgatcgtgagaatttcaatggtggtggccgtcgcttcaatggtgaacgccgcggtggagaaggtcgtggtgaaggtcagagccgtagcaatttccgtggtcgtggtgatgatcatggttcatctgctccacgccgtcgttataacaatagtaacgcacagtaa

SEQ ID NO: 38666 - protein, 644 aa, Photorhabdus luminescens subsp. laumondii TTO1
MRHHYMTTETEISFADLGLSAPILSALEDLGYEKPSPIQQQCIPHLLNGRDVLGMAQTGSGKTAAFSLPLLHNINAELKAPQILVLAPTRELAVQVAEACADFSKHMRNVNVVALYGGQRYDVQLRALRQGPQIVVGTPGRLLDHLKRGTLDLSNLSGLVLDEADEMLRMGFIEDVENIMSQIPAEHQTALFSATMPEAIRRITRRFMNDPQEVRIQASVTTRPDISQSYWSVYGMRKNEALVRFLEAEDFDAAIIFVRTKNATLEVAEALERNGYNSAALNGDMNQALREQTLERLKDGRLDILIATDVAARGLDVERISLVVNYDIPMDAESYVHRIGRTGRAGRAGRALLFVENRERRLLRNVERTMKLTIPEVELPNAELLSQRRLERFAANVQQQLESSDLDQYRTLLSKLQPAEDLDIETLAAALLKMAQGERPLILPPDPVRRPRREFNERDDRRRNGFDDRGERSDRPRRERRDVGEMELYRIEVGRDDGVEVRHIVGAIANEGDISSRYIGNIKLFATHSTIELPKGMPGDLLSHFTRTRILNKPMNMQLMGDAQPFERRERRGGGRNGNGNGNSSGSGPRRDRENFNGGGRRFNGERRGGEGRGEGQSRSNFRGRGDDHGSSAPRRRYNNSNAQ

SEQ ID NO: 38667 - DNA, 1380 bp, Vibrio vulnificus YJ016
  CDS (1)..(1380)
gtgactgcaccatttaacactctttctctcaagcctgaactgctatcgactcttgatagcttgggctatacagagatgacgccaattcaagctcagagcctaccattggtgctcgatggaaaggatgtgattggtcaaggaaaaacaggttcagggaaaaccgccacctttgctttgggtctgctgagcaacctgaatgtctcgcgctttcgcgttcaatcgcttgttctttgccctacacgtgaattggcggatcaagtcgcaacggaaattcgtactttggctcgtggcattcacaacattaaagtgctgactttgtgtggtggcatgcctatggggccacaaattctttcgttggaacatggtgcacacatcttagttggcacaccggggcgcattctcgatcacttaagcaaaggccgtattgatcttgcagaactgaatacgttagtgcttgatgaagccgacagaatgttggaaatgggcttccaagatgcgattgatgccatcattgacgccgcaccgactcaacgccagacgttacttttcagtgcgaccttcccagagcagattgaaaccatcgcaagcaaagtgatgcagaatccggagatggtgaaagtagagtctacacaccaaaagagcaccatcgaacaacgcttttatcagctcgagagcaccgaagaacgtgacaacgctttggaagctctgctgcttacgcacagacctgaatctaccgtggtcttttgcaataccaagaaagaagtgcaaaacgtcaccgacgagctgaaccatcgtcgcttcagcgttatcgaactgcacggtgacatggaacagcgtgaacgtgaacgcgcgttaaccatgtttgccaacaaaagcatttctattttggtcgcaactgacgttgccgctcgtggtttagacgtggataacctagacgccgtgattaactttgagctttctcgtgaccctgaagtgcatgttcaccgcattggtcgtactggccgcgcgggtgcgaaagggattgcgatcagcttcttcagtgagaaagagctgtatcgagtagagcgtattgaagaatacatgggtattgatgtgcatccggccaaactgcctcaaccggaaaaccctaaaccttactacccttcaatgcgtacgattcaaattttgggtggcaaaaagcaaaaagtccgtgctggcgatatcttaggcagcctaaccaaagaagccggaattgatggtaagttgattggtaaaatcaatatcttacctatggtctcctatgttgctatcgataactctgtggccaaaatcgccgaacagcaactgcaaaacggcaaaatgaaagggcgtaactttaaagcccgaattatgaaaggttaa

SEQ ID NO: 38668 - protein, 459 aa, Vibrio vulnificus YJ016
MTAPFNTLSLKPELLSTLDSLGYTEMTPIQAQSLPLVLDGKDVIGQGKTGSGKTATFALGLLSNLNVSRFRVQSLVLCPTRELADQVATEIRTLARGIHNIKVLTLCGGMPMGPQILSLEHGAHILVGTPGRILDHLSKGRIDLAELNTLVLDEADRMLEMGFQDAIDAIIDAAPTQRQTLLFSATFPEQIETIASKVMQNPEMVKVESTHQKSTIEQRFYQLESTEERDNALEALLLTHRPESTVVFCNTKKEVQNVTDELNHRRFSVIELHGDMEQRERERALTMFANKSISILVATDVAARGLDVDNLDAVINFELSRDPEVHVHRIGRTGRAGAKGIAISFFSEKELYRVERIEEYMGIDVHPAKLPQPENPKPYYPSMRTIQILGGKKQKVRAGDILGSLTKEAGIDGKLIGKINILPMVSYVAIDNSVAKIAEQQLQNGKMKGRNFKARIMKG

SEQ ID NO: 38669 - DNA, 1407 bp, Danio rerio
  CDS (1)..(1407)
atggccacgtttgagtctctcgggctgtctgagtggctgatccagcagtgtaagcagatgggcatcagccgaccgaccgctgtacaggagaagtgtatccctgctatattagacggtcgggattgcatgggctgtgcaaaaactggaagtggaaaaacagcagcatttgttcttccggtactgcagaagttgtccgaggacccttatggtgttttctgcttagtgttaacacccaccagagagcttgcttaccaaattgcagagcaatttcgagttttagggaagccacttggtttaaaagactgtatcattgtgggaggaatggacatggttactcagggtttggagttgtcaaaaaagccacatgttgttgttgccacaccgggacgacttgctgatcacattcgcagctctgacacaattaacctaaacagaatccaatttctaatcatggatgaagctgatcgtcttctggagcagggctgtactgattttactaaagatttagaggtcattctcagtgcggtgccagcaaagcggcagactcttctgttcagtgccacgctcacagacacactgcagcagctgcagagcatcgctatgaacaggcccttcttctgggagcataaatcagatgtgcaaacagtggaagaactggatcagagattcatcctcactcctgagaaagttaaagatgcttacctggtccatctcatccaaactttccaggatgaacatgatgattggtctatcataatattcaccaacacgtgcaagagctgtcagatactcactatgatgctgcgggaattcaatttcccaaccatctctctgcactcaatgatgaagcagagacagcgttttgccaaccttgcaaaattcaagtctaacgtcttcaaaattctcatagccacagatgttgctgccaggggtttggatattcccacagttcaggttgttattaatcacaacacacccggtttgccaaaaatctacatccacagagtaggacgaaccgctcgagctggccggaatggagtatcaatcactctagttacacagtatgacattcaccttatcaatgccatagaggaacaaaaccagacgaaactgaaagaatttcctattgaagaaaaagaggtgctgaagatccttacgcaggtcaatgtaacgagacggcagtgtgaaattaaattagagtcgacagattttgatgagaaaaagaagataaacaaaaggaagcagatgattctggatggaaaagatcctgatttggaagaaaaaaggaaaaatgaattagagaagatccgaggaaaaaataagaaactcaaaggaaaaaacccccagagcaaaaaggaaaagaaaaaacatgagaaaagtgcaaaagcaacagaagttggctcttaa

SEQ ID NO: 38670 - protein, 468 aa, Danio rerio
MATFESLGLSEWLIQQCKQMGISRPTAVQEKCIPAILDGRDCMGCAKTGSGKTAAFVLPVLQKLSEDPYGVFCLVLTPTRELAYQIAEQFRVLGKPLGLKDCIIVGGMDMVTQGLELSKKPHVVVATPGRLADHIRSSDTINLNRIQFLIMDEADRLLEQGCTDFTKDLEVILSAVPAKRQTLLFSATLTDTLQQLQSIAMNRPFFWEHKSDVQTVEELDQRFILTPEKVKDAYLVHLIQTFQDEHDDWSIIIFTNTCKSCQILTMMLREFNFPTISLHSMMKQRQRFANLAKFKSNVFKILIATDVAARGLDIPTVQVVINHNTPGLPKIYIHRVGRTARAGRNGVSITLVTQYDIHLINAIEEQNQTKLKEFPIEEKEVLKILTQVNVTRRQCEIKLESTDFDEKKKINKRKQMILDGKDPDLEEKRKNELEKIRGKNKKLKGKNPQSKKEKKKHEKSAKATEVGS

SEQ ID NO: 38671 - DNA, 1425 bp, Rhodopseudomonas palustris CGA009
  CDS (1)..(1425)
atgatggaaagaaccaaccttttgacctcctttcaggaattcggcctcgccgatccgatcgctcgcgctcttcaggaagaaaactaccacaccccgacgccgatccaggcgcagaccatccccctcgccctcgccggccgcgacgtcgtcggcatcgcccagaccggcaccggcaagaccgcctcgttcgcgctgccgatcctgcaccgcctgctgcagaaccggatcaagccggcctccaagacctgccgcgtgctggtgctgagcccgacccgcgagctttccgggcagatcctcgacagcttcaatgcctatggccgccacgtccatctcagcgccgcgctggcgatcggcggcgtgccgatgggccgccaggttcgcagcctgatgggcggcgtcgacgtcctcgtcgccaccccgggccgcctgctcgacctcgtgcagggcaacgcgctgaagctgacccaggtcgaattcctggtgctggacgaagccgaccgcatgctcgacatgggcttcatcaacgacatccggaagatcgtcgccaagctgccgatcaagcggcagacgctgttcttctcggccaccatgccgaaggacatcgccgacctcgccgagcagatgctgcgcgaccctgcccgcgtggcggtgacgccggtgtcctcgacggtggagcggatcaaccagcgggtgatccagctcgaccattccgccaagccggccgcgctcgcccagatcctcaaggacgacaaggtcaatcaggcgctggtcttcacccgcaccaagcatggtgccgacaaggtggtgaagggcctcgcccgggccggtattaccgccgacgcgattcacggtaacaagtcgcagaactaccgcgagcgcgtgctggcggcattccgcaccggcgaattgcgcaccctggtagcgaccgatatcgccgcgcgcggtatcgacgtcgacggcgtgtcgcacgtggtcaacttcgatctgccgaatattcccgagacctacgtccaccgcatcggccgcaccgcgcgcgccggagcggacggcactgcaatctcgctttgcgccggcgaagagatggcgtatctgcgcgacatcgaaaaactcatcaaggtgtcgttgccgaaggaagatcgccgtaccccgggcgcccacgctgctcccaccccgccgccgcatcgcggcccccgtcaagcgccccacggccattctccgcgcaatggcgatgcaccgacgcggggaaagaatcatcggcgccgcggtcccgcagccgggcctgcccgccagtcggacgccagccgccacgaggcggcgccgcgaccgcagcacggtggcaacggtgagggactgcagggcgtggcgtttttgcagcgcaaaaaccgtccggcgcagccgaccgctcagcaccgaccgcatcgctaa

SEQ ID NO: 38672 - protein, 474 aa, Rhodopseudomonas palustris CGA009
MMERTNLLTSFQEFGLADPIARALQEENYHTPTPIQAQTIPLALAGRDVVGIAQTGTGKTASFALPILHRLLQNRIKPASKTCRVLVLSPTRELSGQILDSFNAYGRHVHLSAALAIGGVPMGRQVRSLMGGVDVLVATPGRLLDLVQGNALKLTQVEFLVLDEADRMLDMGFINDIRKIVAKLPIKRQTLFFSATMPKDIADLAEQMLRDPARVAVTPVSSTVERINQRVIQLDHSAKPAALAQILKDDKVNQALVFTRTKHGADKVVKGLARAGITADAIHGNKSQNYRERVLAAFRTGELRTLVATDIAARGIDVDGVSHVVNFDLPNIPETYVHRIGRTARAGADGTAISLCAGEEMAYLRDIEKLIKVSLPKEDRRTPGAHAAPTPPPHRGPRQAPHGHSPRNGDAPTRGKNHRRRGPAAGPARQSDASRHEAAPRPQHGGNGEGLQGVAFLQRKNRPAQPTAQHRPHR

SEQ ID NO: 38673 - DNA, 2085 bp, Rhodopseudomonas palustris CGA009
  CDS (1)..(2085)
ttgtcgttcgtgacatttccgaccagtcccccgccgctcgcgcgagctttggcggagcgcaattatctacaggcgacgccggtgcagagcgctgtgctggcgccggacaccgccggccgcgacctcctggtctcggcgcagaccggctccggcaagaccgtggcttatggcctcgcgatcgcgcaggacctgttgggcgacgccgagcagtttgcgcccgccgcagcgccgctggcactgatcgtggcgccgacccgcgagctggcgctgcaggtgcatcgcgaattgagctggctgtatcgccacgccggcgggcggatcgtctcctgcgtcggcggcatggacccgcgccgcgagcagcgcgagctggcggacggtgcccacatcgtggtcggcacgccggggcggctgtgcgaccatctgcgccgcaaccggctcgacgtctcgcagctgaaagccgtggtgctcgacgaggccgacgagatgctcgatctcggcttccgcgaggacatggagttcatcctcgaaaccacgccggaaacccgccgcaccctactgttctcggcgacgctgccgcgcggcatcatcgcgctggccaagacctatcagcacgacgcgatgcggatcgaggtcgaaggcgccgaaggcggccacgccgacatcgagtatcgcgccatccgcatcgcgccgaatgatgtcgagcacgccgtcgtcaacgtgctgcgctacgtcgaatccccgaccgcgatcgtgttctgcaacacccgcagcgcggtgaaccatctgcagacggcgttgctggaacgcggcttcgccgtggtggcgctgtccggcgaactcacccagaacgaacgcaccggcgcgctcaacgcgctgcgcgacggccgcgcgcgcgtctgcgtcgccaccgacgtcgcggcgcgcggcatcgatctgccgaacctcggcctcgtcattcacgccgagcttccgaacgacgccgaagtgatgcagcatcgttcgggccgcaccggccgtgccggcaacaagggcgtcagcgtcctattagttccgccggcgcggcggcggcgcgccgagttgctgctgcagctcgccggcatcgaggcgaactggggcaccgcgccgcaggccgacgagatccgcagcctcgatcagcagcgcatgctgcaggacccgctgttcaccgaagagccgaccgccgaagatcaggcgctggcgcaggcgctgctcgccgagcgctcgcccgagcagatcgcggtcgcgctggccagggtggtgcgggcccggatgccggcgccggaggacattctcgatcccggcgagcggccggcccgcggccgcgacgaacgtcccggcaagaccgcgcgcgaaccgcgcgatcacgaggcgcgcgacaaggctccacggtctcggtcggccaaggccggcgagaagcacgcgatcacgggcggcgtgtggtttcgcgctgcaatcggcaagcgcaagaacgccgaagcgcgctggctgctgccgatgatctgccgccgcggcggcatcacccggcaggacatcggcgcgatccgcatcctcgacaccaccaccgaattcgagatctcgtccgccgctgccgacgccttcgcggcgcagatcaagcgccccgatcacgacgacaacatccgcatcgagccgctgatcggcgccaagccgatcccgccgcgcgacgacaaccgcccgccgcggcaggacgcggaccgcaagcccgatcgcgagacgcgtcgcgccaagcgccccgactcgtggtcgccgctgtccggcgaaccgctgcccgatccccgcgaacaggacgcgccgcgccccggcaagcgcgtgccgcacgacgacgctccgcgcggcggcaagccggcgcggttcaaagacaagggattcaagacgcgcggcgaggacgcgttcgagggcgatttcaaagccaagccgttcaagaccgacggcttcaaggcaggcaaggcgaagggcgacaagccggcctatgtcagcaaggcccgccgcgccgatccgtcggccaagaacccaccgttcaagaagaaggcgaagaagaagtttcgctga

SEQ ID NO: 38674 - protein, 694 aa, Rhodopseudomonas palustris CGA009
MSFVTFPTSPPPLARALAERNYLQATPVQSAVLAPDTAGRDLLVSAQTGSGKTVAYGLAIAQDLLGDAEQFAPAAAPLALIVAPTRELALQVHRELSWLYRHAGGRIVSCVGGMDPRREQRELADGAHIVVGTPGRLCDHLRRNRLDVSQLKAVVLDEADEMLDLGFREDMEFILETTPETRRTLLFSATLPRGIIALAKTYQHDAMRIEVEGAEGGHADIEYRAIRIAPNDVEHAVVNVLRYVESPTAIVFCNTRSAVNHLQTALLERGFAVVALSGELTQNERTGALNALRDGRARVCVATDVAARGIDLPNLGLVIHAELPNDAEVMQHRSGRTGRAGNKGVSVLLVPPARRRRAELLLQLAGIEANWGTAPQADEIRSLDQQRMLQDPLFTEEPTAEDQALAQALLAERSPEQIAVALARVVRARMPAPEDILDPGERPARGRDERPGKTAREPRDHEARDKAPRSRSAKAGEKHAITGGVWFRAAIGKRKNAEARWLLPMICRRGGITRQDIGAIRILDTTTEFEISSAAADAFAAQIKRPDHDDNIRIEPLIGAKPIPPRDDNRPPRQDADRKPDRETRRAKRPDSWSPLSGEPLPDPREQDAPRPGKRVPHDDAPRGGKPARFKDKGFKTRGEDAFEGDFKAKPFKTDGFKAGKAKGDKPAYVSKARRADPSAKNPPFKKKAKKKFR

SEQ ID NO: 38675 - DNA, 1659 bp, Onion yellows phytoplasma OY-M
  CDS (1)..(1659)
atgaatactttattcgaacaattacctattttagagcaaactaaaaaagctttaaaagaactcaattttattgatgctactccaattcaggccttagtaattccagaaattataaaaggacacgacgtaattggacaagctcaaacaggaacaggaaaaacttttgcttttggtattcccattatcgaaaaaattgaaccaaaaatccaaaaaactcaaagtttaattttatgccccactagagaattaactctccaagtatacgaagaattaaaaaaattactaagattttatcaagaaataagaatcgctgttgtttatggtggtgaatcttacaccaaacaatttagagccctagaagctaaacctcatttaattattgctactcctggacgtgcaattgaccatctagaaagaggtaaaatcgacctctcagcactaaaaattctaactcttgacgaagcagatgaaatgttaaaaatgggattccaagaagccttagaaacaatcttaaaaaagattccagaagaaagacaaactgttttattctcagcaactctacctccatttattaaaaaaatagcaagcaaataccaaaaagacactaaaatcctacaagttcctgttaaaaacattgcagttaatgcaatcgaacaaaattactttttagtaaaagaagttgacaaagctaaattattagtacgtttactagacttaaaaaaagattattcagctatcttatttgcaaacactaaaaaagatgttgacgaaattacagcctaccttcaagacaaaggttttttagctgatgcagttcacggcgatttaaaacaaaatcaaagacaatatgtaatgaataatttccgtaaaggcaaaatcaaaatcttaattgcaactgatgtagctgcaagaggacttgacatttctgacatcaaaatggtaattaactatgacttaccacacgaagacgaagtttatgttcaccgtatcggaagaactggaagagctggcaaaaaaggtttagcttacagtttaattagcccaagaaaagtaagccaacttaaaaaattagaatactacttaaaagaaaaaattactttactagatattccttctgttcaaagcatcaaattacaaaatgccaaagatttagaaaaaaagctattaaacatcattgaaaaaaacaacgaagacgctactccaaatcaattagcacaaaagttattagaaactttttcttctgaacaaattatccaaggattattgaaaaaatttttaccaaaagaaagaaattacactgacatccttcctccaaaaatgactactaacaattcttttaccagatcacgttttggtggcgaatctagatttggttcttatggttctaacaactcttacggcaataaatcttaccaaagagcaaatagcaactttatagaagtagttattaatttaggcaaaaaagacaatattaatcctccaatattattaaaattattaaaagaccatttccaaatttatggcaaaaatattggcaatatcaaacacttaactcacgaaactatttttgaagtagcaagtcgtttttggaatcaaatgaaaagcaaaactaatattcgtttccaaaacaaaactttaattcttaacaaaaaagattaa

SEQ ID NO: 38676 - protein, 552 aa, Onion yellows phytoplasma OY-M
MNTLFEQLPILEQTKKALKELNFIDATPIQALVIPEIIKGHDVIGQAQTGTGKTFAFGIPIIEKIEPKIQKTQSLILCPTRELTLQVYEELKKLLRFYQEIRIAVVYGGESYTKQFRALEAKPHLIIATPGRAIDHLERGKIDLSALKILTLDEADEMLKMGFQEALETILKKIPEERQTVLFSATLPPFIKKIASKYQKDTKILQVPVKNIAVNAIEQNYFLVKEVDKAKLLVRLLDLKKDYSAILFANTKKDVDEITAYLQDKGFLADAVHGDLKQNQRQYVMNNFRKGKIKILIATDVAARGLDISDIKMVINYDLPHEDEVYVHRIGRTGRAGKKGLAYSLISPRKVSQLKKLEYYLKEKITLLDIPSVQSIKLQNAKDLEKKLLNIIEKNNEDATPNQLAQKLLETFSSEQIIQGLLKKFLPKERNYTDILPPKMTTNNSFTRSRFGGESRFGSYGSNNSYGNKSYQRANSNFIEVVINLGKKDNINPPILLKLLKDHFQIYGKNIGNIKHLTHETIFEVASRFWNQMKSKTNIRFQNKTLILNKKD

SEQ ID NO: 38677 - DNA, 1383 bp, Geobacter sulfurreducens PCA
  CDS (1)..(1383)
atgaatccgaaagcattttcgtcgcttcgcctgaaagcccccatgctcaggaacctggcctccctcggctatgccgagatgacaccgattcaggcccacagcctgccgctcatcctggccggcaaggatgtgatcgccagggccaagaccggtagcggcaagaccgcggcttttggcatcggactgctgtcgcgtctggatgcattatccttccgggtgcaggcgttggtgctctgcccgacccgtgagctggccgatcaggtgggcaaggaactgcggcgtctggctcgattcaccgacaacatcaagatcttgaccatctgtggcggtgttcccttcgggccccagctgggttcgctggagcatggggcccatgtggtgataggcacacccggccgcctgctggatcacttgcggcgcggcagccttgacctctccgcgctgcggaccctggtattggacgaggcggaccggatgctcgacatggggttccaggatgacatcagtgccctgatcgccgccgccccgcccaagaggcagactctcctcttttccgccacctacccggactccattgccgccatgagcgccggggtccagagggagccggtggaggtcagcgtggacgaggtccatggggagggggccatcgagcaggtattctacgaggtggacagcggccagcggatcgaagcggtcgagcggattctcgggcactatcgtcccgagtctgctctcatcttctgcaacacgaagctggagtgccaggaggtggccaatgccctggccgtccgggggtatgccgcactggccatccatggtgacctggaccagcgggagcgggaccgggtgctggtccggtttgccaacaggagcgcatcggtgctggtagcaaccgacgttgccgcccgggggctggacatcaaggagctttcggcggtgattaactacgagttgacccgcaatccggaggtccatacccaccgcatcggccgcaccggtcgcgccggggagcgggggctggccgtaagcttggtaacgccccgggaaagccgtctgattgcagccatcgcggatgtgcccggcagcattatcgcccgtggcgacctgtccacgctggcaccgctaacggcgaagccgccgctgccccccatggtgacgctctgcatcgacgggggccgcaaaaacaagctgcggcccggtgatattctgggggcactcaccggagagggaggtatgccggccagcgaggtggggaagattgatgtgttcgatttctttacctacgtggccattgcgcggcagagcagtgagcaggccttgaactttctgaggggacacaggatcaaggggcgtttcttcaaggtgaggaaagcagtctga

SEQ ID NO: 38678 - protein, 460 aa, Geobacter sulfurreducens PCA
MNPKAFSSLRLKAPMLRNLASLGYAEMTPIQAHSLPLILAGKDVIARAKTGSGKTAAFGIGLLSRLDALSFRVQALVLCPTRELADQVGKELRRLARFTDNIKILTICGGVPFGPQLGSLEHGAHVVIGTPGRLLDHLRRGSLDLSALRTLVLDEADRMLDMGFQDDISALIAAAPPKRQTLLFSATYPDSIAAMSAGVQREPVEVSVDEVHGEGAIEQVFYEVDSGQRIEAVERILGHYRPESALIFCNTKLECQEVANALAVRGYAALAIHGDLDQRERDRVLVRFANRSASVLVATDVAARGLDIKELSAVINYELTRNPEVHTHRIGRTGRAGERGLAVSLVTPRESRLIAAIADVPGSIIARGDLSTLAPLTAKPPLPPMVTLCIDGGRKNKLRPGDILGALTGEGGMPASEVGKIDVFDFFTYVAIARQSSEQALNFLRGHRIKGRFFKVRKAV

SEQ ID NO: 38679 - DNA, 1353 bp, Geobacter sulfurreducens PCA
  CDS (1)..(1353)
atgacctttgctgaactgaaacttgccccgcacattctcaaagccgtagccgcctgtggttacacagagccgacgccggtccaggctgccgcagttccccgcgcactggagaacgtggacctgcttgccaccgcccagaccggtaccggcaaaaccgccgcattcgtcctcccggccctgcaacggctgagttctccgcctcagggccccgggcgcgggccgcgtgtgctcgtgctcactcctacccgtgagctggcccagcaggttaccgacgcagtgcggacgtacggggcattcatgcgggtacgcagtggcgccatcctcggcggcatgccctaccacgcacagctccgccttctctccgcgcccgttgatttcatcgtggccacgccgggtcggctggtagacctgctcgaccggaggagtctcgatctttcccgtctcgaattgctggtcctcgacgaagcggaccggatgctcgacatggggttcagcgacgacgtggaccgcatcgccgccgcatcccccgccacgcgtcagaccctgctgtttacggcaaccatggacagcgccatggccagactggcgggccggctcctgcgtgagccggagcggatcgacatcgccggcaccaaaactacccatgagcacattgaacagcgccttcacgtggcagatgacctgcaccacaagaaccggctgctgcggcacctgattaccgacgaaagcctgcgcagggcaattatcttttcggcgaccaagcgtgatgccgaaaacctggcactggaactcaaggcccagggccattcggcagcagcactccatggcgacatgccccagaacgcccggaatcgaaccattgccgccatgaagcaaggacggatcaggcttctcgtagccaccgacgtggcagcccgggggctggatgttaccggcatcagccatgtcatcaacttcgacctgcccaagttcgccgaggattacgtccatcgcatcggccgcaccggccgggcaggcgcctcgggaatcgccatctccttcgcctcgctcaacgaggtcaattacctggcccgcattgagcgttacatcggccagacactccccgaacaccacatccctgggctggaaccctcgcgcccgcttcgccgcgtatcagcgggatcaggccgtaaaccgggaatgggagccggtcccgcccggaagggctcctcgaaccgcccctccggcgccgcgcccggccggtccggtaaatcgtcggaccgtacatcctgggggagcagacggtcaaaagatccggttgtggaataccggacagggaggcacggagcaggacaaccccgtagatcatcataa

SEQ ID NO: 38680 - protein, 450 aa, Geobacter sulfurreducens PCA
MTFAELKLAPHILKAVAACGYTEPTPVQAAAVPRALENVDLLATAQTGTGKTAAFVLPALQRLSSPPQGPGRGPRVLVLTPTRELAQQVTDAVRTYGAFMRVRSGAILGGMPYHAQLRLLSAPVDFIVATPGRLVDLLDRRSLDLSRLELLVLDEADRMLDMGFSDDVDRIAAASPATRQTLLFTATMDSAMARLAGRLLREPERIDIAGTKTTHEHIEQRLHVADDLHHKNRLLRHLITDESLRRAIIFSATKRDAENLALELKAQGHSAAALHGDMPQNARNRTIAAMKQGRIRLLVATDVAARGLDVTGISHVINFDLPKFAEDYVHRIGRTGRAGASGIAISFASLNEVNYLARIERYIGQTLPEHHIPGLEPSRPLRRVSAGSGRKPGMGAGPARKGSSNRPSGAAPGRSGKSSDRTSWGSRRSKDPVVEYRTGRHGAGQPRRSS

SEQ ID NO: 38681 - DNA, 1455 bp, Lactobacillus johnsonii NCC 533
  CDS (1)..(1455)
ttgaaattttctgaaatgaacttaaaacctgagattttaaaagctattaagcgttcaggttttgaagaagctacaccaattcaagaaaaaaccattcccctagttttggagggaaaagatgtaattggtcaagcccagacagggactggtaaaactgctgcttttggtttgccaattttacaaaacttagataagcaacacgattcaattcaagctattattattgaacctacccgtgaattggctattcaaacccaagaagagttgttccgtttaggtcgtgatgaaaaagctcgcgttcaagtagtttatggcggtgctgatattagacgtcagattcgtgctttaaaacaaacgccagcaattttggtaggaacacctgggcgtttgcttgatcatttaaaacgtggcacaattgatatttctaaagtcaaaacaattgttttagatgaagcagatgaaatgcttgatatgggatttattcaagatattgaaagtattttgaaatatgcatcaagtaaacatcaaacattacttttctctgctacaatgccaaagccaattttacgaattggtgaaaaattcatgaatgatcctgagattgtaaaaatcaaaggaaaagaattaactgctaatttaattgatcagtattttgtgagagcaaaagaaaatgaaaagttcgacattctatgtcgcttaattgacgttcaaaatcctgatttagctgttatttttggtagaactaagagacgtgttgatgaattaacacgtgggctacaagcacgtggatataacgctgctggaattcatggtgatctttctcaagctaagcgaatgagcgtgttaaagagattccgtaaaggtaagctagatattttagttgcaactgatgtggcagctcgtggattagatatttctggggtaagtcatgtttataactatgatattccgcaggatccaaattcttatgttcaccgtattggtagaactggacgtgctggtcagaacggaatgtctgtaacttttgttactccaaatgaaattggctatatgcgtactatagaacaattaacgcataaaaagatgatgccacttaagccaccaactgatgaagaagcatttaaaggtcagctaagtgcagctaataaaaaggtagcagaattgcttgatagcgatctttctaaatatactgaagaagcatctcaacttcttgacgattattctgcgattgatttagtggccgctttattgaaggacttgtctaaagatgcagatagtgtaaaagtaaaaattacacctgaaaagccgttaccatttaaatcaaagcatggtaataatcgaaactttaaacgtaatttcaaacgtggtggagatcgaaatgaacgatatcatcgtaagcctagtgcccgtaaaggtggtagaaagcatgatttcgttataaagaaaaaagattaa

SEQ ID NO: 38682 - protein, 484 aa, Lactobacillus johnsonii NCC 533
MKFSEMNLKPEILKAIKRSGFEEATPIQEKTIPLVLEGKDVIGQAQTGTGKTAAFGLPILQNLDKQHDSIQAIIIEPTRELAIQTQEELFRLGRDEKARVQVVYGGADIRRQIRALKQTPAILVGTPGRLLDHLKRGTIDISKVKTIVLDEADEMLDMGFIQDIESILKYASSKHQTLLFSATMPKPILRIGEKFMNDPEIVKIKGKELTANLIDQYFVRAKENEKFDILCRLIDVQNPDLAVIFGRTKRRVDELTRGLQARGYNAAGIHGDLSQAKRMSVLKRFRKGKLDILVATDVAARGLDISGVSHVYNYDIPQDPNSYVHRIGRTGRAGQNGMSVTFVTPNEIGYMRTIEQLTHKKMMPLKPPTDEEAFKGQLSAANKKVAELLDSDLSKYTEEASQLLDDYSAIDLVAALLKDLSKDADSVKVKITPEKPLPFKSKHGNNRNFKRNFKRGGDRNERYHRKPSARKGGRKHDFVIKKKD

SEQ ID NO: 38683 - DNA, 1227 bp, Wolbachia endosymbiont of Drosophila melanogaster
  CDS (1)..(1227)
gtgaataattttcatgagatgggtctcccagcttcgcttagacaagctctagataaaaataatcttttcgtcccaactccaattcaaatacaagcgattcccttagcgctacaaggtaaagatattctcggatctgctcaaacggggactggaaaaactttagcatttgctattccgttggttgctaagttgctgaatgagcctaacactggttcagctttagtcatcgtgccaaccagagagcttgcgcatcaggtaacaaatgagataagaaaactcttatctcaaaattctgcactaagggtcgctttgttgattggtggtgagcctatttttaggcagctaaatcagcttcagaaaaaaccacaaattgtaataggtactcctggtcgtattatagaccatattgagcgtaaaactttgattactcgcaatgttagcgttcttgtgcttgatgaaacggatcgtatgtttgatatgggctttggagttcagattgaagaaattatgaagcatttgcctaaaataaggcaaactcttatgttttctgcaactcttcctggagatatagtaaaacttgctgagaagtaccttaatcgaccagaacgtatttctgttgattgtgaggctacaacttctgtaaaaattaagcaagaaattgtttatgcatcagaatcagaaaaatatgaaaagcttgttacacaactatgtcagcgcgaaggatcaatcattatctttgtcaaaacaaagcgaggagcggatcagctagctaacagattgcacaaagatgactatagcgctttagcaattcatggtgatttaaggcagcacaagcgcgaaagggtcattaattcttttcgtcgtggccgtaatcaaatcatggttgcaacagatgttgcttctcgcggccttgatattccccacattcaacatgttatcaattatgatgcaccacaatcgcaagctgactatattcatcgtataggtagaactgcacgcgctggagctgaagggtatgcgctatcttttgttacacctcaagataagagaagactgcctgcactggcagacaaagaaggagagctaaattttgattgtagtgtgcaatttaaaaaacgtaacagcaaaaaggtctttaaaaggccaagtacgttaaagactaaatacggtagaaaaaagatcaatgcatttaagaagaaaagcagagtactagaaaaagcgtattaa

SEQ ID NO: 38684 - protein, 408 aa, Wolbachia endosymbiont of Drosophila melanogaster
MNNFHEMGLPASLRQALDKNNLFVPTPIQIQAIPLALQGKDILGSAQTGTGKTLAFAIPLVAKLLNEPNTGSALVIVPTRELAHQVTNEIRKLLSQNSALRVALLIGGEPIFRQLNQLQKKPQIVIGTPGRIIDHIERKTLITRNVSVLVLDETDRMFDMGFGVQIEEIMKHLPKIRQTLMFSATLPGDIVKLAEKYLNRPERISVDCEATTSVKIKQEIVYASESEKYEKLVTQLCQREGSIIIFVKTKRGADQLANRLHKDDYSALAIHGDLRQHKRERVINSFRRGRNQIMVATDVASRGLDIPHIQHVINYDAPQSQADYIHRIGRTARAGAEGYALSFVTPQDKRRLPALADKEGELNFDCSVQFKKRNSKKVFKRPSTLKTKYGRKKINAFKKKSRVLEKAY

SEQ ID NO: 38685 - DNA, 1518 bp, Bdellovibrio bacteriovorus HD100
  CDS (1)..(1518)
atgacgacgactaaatttaccgaccttcctttgattgcccctcttcaattttcacttaaagaagcaggatacgaaactccaaccccgattcagttggcagcgatccctgttattcttgaagggcacgacctattgggcatcgcccagaccggcaccgggaaaactgcggcgttttctttgccgatcctgcaaaacctttccaaacacacacgcaagatcgaaccgaaatccccgcgttgcctgattttgactccgacccgcgagctggcgattcagattcacgaaaacatcgaggcttacagcaaacacctgaacatgaaacacgctgtgatcttcggcggcgtgggacaaaatccccaagtgcgcgccctgcaaggtggcgtggacattctgattgcgactccgggccgcctgatggacctgcacggacaaaagcacctgaagctggatcgcgtggaaatctttgtactggatgaagccgaccgcatgctggacatgggcttcatgcaggatattaaaaagatcctgcccctgcttccgcaaaaacgtcacaacctgttcttctctgcaaccatgccacacgagattcagactttggccaacaggattctggtgaatccgaaaaaagtggaagtgactccggtttcttcaacggctgaaaaagttgaacagcgtgtgatgttcgtagacaaacctcagaagctggatctattgctgcacattctgaaagacgaatctttgtccaaagtgctggtatttgtgcagatgaaatacggcgccaaccgcgtcgttgaccgactgacgaaggcgggcgttgcggccgccggcattcacggcgacaaatcccagaaccagcgtcagcgtgcgctggaagaattcaaaaacggcgatgtgcgtgtgttggtagcgactgacatcgccgcccgtggtattgatatcgacggcattactcacgtgatcaacctggagcttccgcacattccggaatcctacgttcaccgtatcggaagaaccgcgcgcgcaggcgctaccggtatttctatttccttctgcactgctgaagaaagatccttcctgtttgcgattgaaaaaaccacacgcacgaaagtcactgtggtcgaagatcatccgttccattccaccgaaattgccaacgctccggtgatgaccgtgggtaaagccaaagcgattctggaaggccagcgcctgcagaataaggctaaaaatcgcggtggcgggccaagacgtcaaggcggtggcgcccctcaaggcggtcatggcggaaagaaagcgggaggcaaacctcagggcggcaataagcctgatcatggtggcaagactcatactaaatccgagcacaaatctgaaggtgccgcttcccacaaaactcacagcaaacctgcgcacgcaaaaccggctcacaaacctgctcacaaaagtgaaggcaagtctgctggcaaaagtgagcacgctcccaagaagcgcagcttctggagccgtctgcgcaacaaggactaa

SEQ ID NO: 38686 - protein, 505 aa, Bdellovibrio bacteriovorus HD100
MTTTKFTDLPLIAPLQFSLKEAGYETPTPIQLAAIPVILEGHDLLGIAQTGTGKTAAFSLPILQNLSKHTRKIEPKSPRCLILTPTRELAIQIHENIEAYSKHLNMKHAVIFGGVGQNPQVRALQGGVDILIATPGRLMDLHGQKHLKLDRVEIFVLDEADRMLDMGFMQDIKKILPLLPQKRHNLFFSATMPHEIQTLANRILVNPKKVEVTPVSSTAEKVEQRVMFVDKPQKLDLLLHILKDESLSKVLVFVQMKYGANRVVDRLTKAGVAAAGIHGDKSQNQRQRALEEFKNGDVRVLVATDIAARGIDIDGITHVINLELPHIPESYVHRIGRTARAGATGISISFCTAEERSFLFAIEKTTRTKVTVVEDHPFHSTEIANAPVMTVGKAKAILEGQRLQNKAKNRGGGPRRQGGGAPQGGHGGKKAGGKPQGGNKPDHGGKTHTKSEHKSEGAASHKTHSKPAHAKPAHKPAHKSEGKSAGKSEHAPKKRSFWSRLRNKD

SEQ ID NO: 38687 - DNA, 1518 bp, Bdellovibrio bacteriovorus HD100
  CDS (1)..(1518)
atgccacaaaagagcctgtcgggatacctaaatctgggatcggtcattttttcgtattttcattcagggctcgactttaaaagccccccctgttacctaagtgttttccattttttccgaggtgtgcccgtgtcccagaatgaattttctactcttcccctgtccccggaacttctgactgtggttcaggagctgggctttgagacactgacccccatccaacaggaaagcatcccgctgctgctggcaggaaaagacatcatcggccaggccaaaaccggcagtggaaagaccgccgctttttctttgcccatcctgaacaaaatcaatctggatcagccgctgttgcaagccctcattctgtgcccgacccgcgagctggcaagccaggtggtcacagagatccgcaaactggggcgccgccttccaggattgaaagttctggccatgaccggaggccaatccggacgtgaacaggctgacgctttggaaaacggagtgcagatcgttgtcggcacaccaggccgtctggcggactttgtcggccgtaaccgcattgatctttctgcggtaaaaaccgtagtactcgatgaagccgacaaaatgctggatatgggttttgccgatgaaatcaaaactgtgatgcgtgatctgccagggtcccgccagacagttctgttttccgccactttcccggaatccatcgaacatctttcccgcaaataccagcgccatgcccagcaggtgatcatcgaggatgaagagcaaaacctgattgaacaacttgtttatgacagcgaagacaacgacaaaaccaacgtgctgatgcgtattttgcagcagcatccttcggattccactatcatcttctgcaacaccaaaaatgcagtggcggaaattgcagaacgcctgaatgacctgggtgccgccagcggctgcctgcatggagacatggaacagcgtgaacgtgatcgcgtgatggcgatgttccgcaacggatcccaccgcattctggtggccaccgacgtggcggcccggggcctggacatcgacaacctggaactggttattaactttgatctgccactttccccggaaatctatgttcaccgcatcggtcgcaccggccgagctggcaaaaccggcgttgcggtcacgattgcgcaccctaaagacactctgaaactgggccagttcgaagagctgactggcggcaagttcgcccgtccgtcattgggctttaaaaatcagtatggtttgaataaaaccctgaaagaagctccgatgaaaaccatctccatctcgggaggccgcaaggataaacttcgtcccggcgatattctgggggccttgaccggcgctgcgggtggtttgacttcggcagatgtgggcaaaattgaaattcaggacaagatctcttttgtggcggtgtctgcgaaagtcgcggacggcgccatgcaaaagttgcgtgacggccgcatcaaaggtcaaaagttccaggtcaaatttgtaaagtaa

SEQ ID NO: 38688 - protein, 505 aa, Bdellovibrio bacteriovorus HD100
MPQKSLSGYLNLGSVIFSYFHSGLDFKSPPCYLSVFHFFRGVPVSQNEFSTLPLSPELLTVVQELGFETLTPIQQESIPLLLAGKDIIGQAKTGSGKTAAFSLPILNKINLDQPLLQALILCPTRELASQVVTEIRKLGRRLPGLKVLAMTGGQSGREQADALENGVQIVVGTPGRLADFVGRNRIDLSAVKTVVLDEADKMLDMGFADEIKTVMRDLPGSRQTVLFSATFPESIEHLSRKYQRHAQQVIIEDEEQNLIEQLVYDSEDNDKTNVLMRILQQHPSDSTIIFCNTKNAVAEIAERLNDLGAASGCLHGDMEQRERDRVMAMFRNGSHRILVATDVAARGLDIDNLELVINFDLPLSPEIYVHRIGRTGRAGKTGVAVTIAHPKDTLKLGQFEELTGGKFARPSLGFKNQYGLNKTLKEAPMKTISISGGRKDKLRPGDILGALTGAAGGLTSADVGKIEIQDKISFVAVSAKVADGAMQKLRDGRIKGQKFQVKFVK

SEQ ID NO: 38689 - DNA, 1971 bp, Bdellovibrio bacteriovorus HD100
  CDS (1)..(1971)
ttggcgcatctttttgaagtgggcttggatctgccgcaagcagtgcggtatcaatgcacatatggtgttttttatttgagaccacttccaatacctgaaaggtctctaatgactccactgacaaccgtagataattttgaaagctttggactgagtgcacccgtgatggctgcgatggcagacatgggtttcaccactccaacccccatccagcgtcaggctttgccgattctgctggccggtgccaatgactttatcggtctggcatccacaggcaccggtaaaaccgcggccttcggtatcccgctgattgaaaacatcgacagcactgtgaaagacactcaagctcttgttttgagcccgacacgtgagctggctctgcaagtggcagaacagctgactttgctgggtaagaaaaaaggcgttcgcgtagtaacaatctacggtggcgcttcttaccgcacccagatcgacggcatcaaacgtggcgctcacatcgtcgtggcgactccgggccgtctggtggacttccttgaacagaaaatgatcaaacttcagagcgtgaaaactgtggttctggatgaagcggacgaaatgctttccatgggcttcaaagaagctctggaaacaatcctttccgcgactcagccggatgattccgactctgttcgtgcggcttgccgtacttggttgttctctgcaaccatgtcttctgaagttcgtcgtttgacttccacttatcttgaaaatcctgaaactgtctctgtgaacaaagtgggcggcactgctgacactatcgagcaggtttactacacagttaaaaattcctataaaactgaagtgatcggccgcctgctgcaaactcttccggaattctatggcatcatcttctgccagacgaaaatggaagtggcagaacttgcggacgttctgactcaacgtggattcccggcagattccctgcacggcgacaaatcccagcaggaacgtgaagcgactttgaagaaattcaaacagcgtcaggtaaaggtgatcgtggcaacagacgttgcggcccgtggtctggatatcaaagacctgacccacgttgtgaatcactcattgccttgggactctgagtcctatgttcaccgtatcggtcgtaccggccgtaatggtcaaaaagggactgcgatcactctggtgaacccggagcaactgactcttcttcgccgtgtgatgcaaaacacgaaagctgttttgaccaaaggtgtgatcccttctgctgacgaagtggctggcctgaaaatcaaagacgtaatggacaaagtcacttccatggatccagaagcagttcaactgcagctggcttccgacctgattcaggatctgatccaggctgaagacatcaacttcaaagaactttccaaagaagaactgctggcgcgctttatcgccgcttacttcccgaacgtgttcgtgaagaaagatctgatgcttgactacatgggtgaccgtgttccgcgtgagcttctgccacgcgatccaaacgacaaccgcttcacccgtggtggccgtggcaacgaccgtcgcgatgaccgtgatgattaccgtgcccgccgtccattcggtggtggccgtggcgccagcgcccctgcccgtggcttccgctctgaaggcgcccgtgctgaattcagcggtggcgaacagcgcgcagaaagaaccgaaagaccggctttccgtgaccgcccagaaagaactgagcgccctgaaagagccgagcgtcctgagcgcagcgaacgtgctgaacgtgccgagcgttccgaacgttcttaccgcgcttccgccagcagcgaccgtccggcccgcgcggagcgcagcgagcgctctgagcgccctcagcgcgcagagaccgaccgtccagagcgtcgtggtgaccacccgggcatcaaacgcttccgtggtccgaagcgccagttccgcgagcagtaa

SEQ ID NO: 38690 - protein, 656 aa, Bdellovibrio bacteriovorus HD100
MAHLFEVGLDLPQAVRYQCTYGVFYLRPLPIPERSLMTPLTTVDNFESFGLSAPVMAAMADMGFTTPTPIQRQALPILLAGANDFIGLASTGTGKTAAFGIPLIENIDSTVKDTQALVLSPTRELALQVAEQLTLLGKKKGVRVVTIYGGASYRTQIDGIKRGAHIVVATPGRLVDFLEQKMIKLQSVKTVVLDEADEMLSMGFKEALETILSATQPDDSDSVRAACRTWLFSATMSSEVRRLTSTYLENPETVSVNKVGGTADTIEQVYYTVKNSYKTEVIGRLLQTLPEFYGIIFCQTKMEVAELADVLTQRGFPADSLHGDKSQQEREATLKKFKQRQVKVIVATDVAARGLDIKDLTHVVNHSLPWDSESYVHRIGRTGRNGQKGTAITLVNPEQLTLLRRVMQNTKAVLTKGVIPSADEVAGLKIKDVMDKVTSMDPEAVQLQLASDLIQDLIQAEDINFKELSKEELLARFIAAYFPNVFVKKDLMLDYMGDRVPRELLPRDPNDNRFTRGGRGNDRRDDRDDYRARRPFGGGRGASAPARGFRSEGARAEFSGGEQRAERTERPAFRDRPERTERPERAERPERSERAERAERSERSYRASASSDRPARAERSERSERPQRAETDRPERRGDHPGIKRFRGPKRQFREQ

SEQ ID NO: 38691 - DNA, 1650 bp, Bdellovibrio bacteriovorus HD100
  CDS (1)..(1650)
ttgaaattctcagaattgaatttagattcccaattgttatctgcaatccagaagttgaactatgatgattgcacgccgatccaggaacaggccatcccgccggttttggacggtaaagatgttgccggccttgctcagaccggaacaggtaaaaccgctgctttcgtgattccagtgatggaacgtatcctcagagcccgcccgatccagggtgaggtgaccgaagagcaaaaagccctgatcgaaaaaagagcttacaaagactggaagcctcagaacttcgtattgatcctggttcccacgcgcgagttggcagagcaggttcaggacaacatcaacaaactgagcgttgattccggccttcgtggtttcgcgatttatggcggtacaggttacgacaaacaaaaagaggcgttgaagaacggtgttgaattcatcgtggcgactccgggacgtttgatcgatctgtacaaagaacatctggtggacctgaaacaggttcgtgcgatcgtcttcgatgaagcggacagaatgtttgatatgggcttcaaggacgacatgaagtacatccttcagcgcgttcctcgtgagcgtcagttgctggtgttcagtgcgactttgaactttgatgttttgaacaccatctatcagttcggttccgagccggtggaaatcaacatcagccgtgaccaggccaaagcggacaacgtgaaagaccagatcttccacgtgggctctgatgaaaagcctcagcatcttctgtctttgctgaaagtgcacaatccaaaacaagccatcatcttcaccaacttcaaaatgagcgtcgagcgcatcgcgaagttcctggtcgaaaacggtgtcccagccatggcgatttcaagccttctgacccaggctcagcgcaaccgcgtgattgagcagttcaaggctgaaaacgacatgaacgtgctggtggcaacggatgttgcggcccgcggtctggacatcaaaggcgtggacatggttgtgaactatgaactgccgatggactctgaatcctatgttcaccgtatcggtcgtaccggccgtgcgggcacaacgggtcaggcgttttctttggtgggcgacaaggacatcgagtctttgggtcgcattgaagattatctgaaacacaaaatcgaaatcggctatctggaaaacgaccagttgctgaaagactttaaaccgatgacttccagctatgacggtcattatccaaagtctctggaccgtgcgcgtgcgcctcgtgaaggtggacgtggtggtgacagaggtcctcgccgtgaaggtgaccgtggtcctcgtcgcgagcgcggtgatcgcggacctcgtcaggatcgcggtcctcgtccagagggtcagcagaaatctgcacagggtgcaggtgctcagcagactcaaggtggcggtcagcgtccggacagccgtccaagaagacaagagggtggtccgaagcgtcctcacgatgcaaaacgtggcgaacaaagacaaccaagaaacgaccaggctcgcaagccgcacggtcaacaacagccgcgccagggggcttctgcaaagaagcgtgtgccaatggcagcgcaaaaatccatcggccagaaggtcgcaggattcttcaaacgtctgttctcttaa

SEQ ID NO: 38692 - protein, 549 aa, Bdellovibrio bacteriovorus HD100
MKFSELNLDSQLLSAIQKLNYDDCTPIQEQAIPPVLDGKDVAGLAQTGTGKTAAFVIPVMERILRARPIQGEVTEEQKALIEKRAYKDWKPQNFVLILVPTRELAEQVQDNINKLSVDSGLRGFAIYGGTGYDKQKEALKNGVEFIVATPGRLIDLYKEHLVDLKQVRAIVFDEADRMFDMGFKDDMKYILQRVPRERQLLVFSATLNFDVLNTIYQFGSEPVEINISRDQAKADNVKDQIFHVGSDEKPQHLLSLLKVHNPKQAIIFTNFKMSVERIAKFLVENGVPAMAISSLLTQAQRNRVIEQFKAENDMNVLVATDVAARGLDIKGVDMVVNYELPMDSESYVHRIGRTGRAGTTGQAFSLVGDKDIESLGRIEDYLKHKIEIGYLENDQLLKDFKPMTSSYDGHYPKSLDRARAPREGGRGGDRGPRREGDRGPRRERGDRGPRQDRGPRPEGQQKSAQGAGAQQTQGGGQRPDSRPRRQEGGPKRPHDAKRGEQRQPRNDQARKPHGQQQPRQGASAKKRVPMAAQKSIGQKVAGFFKRLFS

SEQ ID NO: 38693 - DNA, 1776 bp, Arabidopsis thaliana
  CDS (1)..(1776)
atgagctcgtatgatcgtagatttgctgatccaaattcgtatcgccaacgctctggcgccccagttggttcgtctcagccgatggatccttccgccgcaccatacaacccacggtacactggtggtggtggaggatatggaccatctccggtaatggccggtgataattccggctataatcggtacccatctttccagccacctagtggcggtttctctgttggccgcggtggtggaagaggtggatatggtcaatacggcgatagaaacggcggagggaattggggaggaggaggaggacgtggcggatcgagtaaaagagagctagatagtgtttctcttccgaagcagaattttgggaatcttgtacattttgagaagaatttctatgtggagagtcccactgtgcaagctatgacagagcaggatgttgcaatgtacagaaccgagagggatatatccgttgaaggtcgtgatgttcctaagccgatgaagatgttccaagatgctaactttccagataacattcttgaagcaattgctaaattgggatttactgagccaacacctatacaagctcagggatggccgatggcgttgaagggtagggatttgattggtattgctgagactggctctggtaagacattggcttacttgttaccagcattggttcacgttagtgcacaacctcgattaggtcaggatgatggccccattgtgttaatattagctcccacaagagaactagctgttcagattcaagaggaatcaaggaaattcgggttgaggtctggtgttagaagtacttgtatctatggtggtgctcctaaaggacctcagattcgtgatcttagaagaggtgttgagattgtaattgctacacctggtcgtttgattgatatgttggaatgtcaacacactaatttgaagagagtgacttaccttgtactggatgaggctgacagaatgttagacatgggatttgaaccccaaattagaaagattgtatctcagatccgacctgatagacaaacacttctttggagtgcaacatggccacgagaggttgaaactcttgccaggcagtttctacgagatccatataaggccattattggatcaacagatctaaaagctaaccagtctattaaccaagtaatcgagattgtaccgacgccagagaaatacaacaggctccttacactacttaaacagttaatggatgggagtaaaatcctaatttttgtggagacaaagagagggtgtgatcaagtgactagacaattgagaatggacggatggccagctcttgccatacatggtgacaagacccaatcggaaagagaccgagtcttggcagaatttaagagtggacgaagcccgataatgactgccactgatgtagcagcaaggggacttgatgtgaaggacattaaatgtgtggttaattatgatttcccaaatacattggaggattacatccataggattggtcgaaccgggcgtgcaggagctaaaggaatggcctttacattcttcacacatgacaatgctaagtttgcgagagagcttgtcaagatccttcaagaagctggtcaagttgtacctcctactctctccgcactagtccgatcatctggttctggttatggaggttcaggtggtggaagaaacttcaggccaagaggaggaggacgtggtggtgggtttggagataaacggtcaagatcgacttcaaactttgtacctcacggtggaaagaggacttggtaa

SEQ ID NO: 38694 - protein, 591 aa, Arabidopsis thaliana
MSSYDRRFADPNSYRQRSGAPVGSSQPMDPSAAPYNPRYTGGGGGYGPSPVMAGDNSGYNRYPSFQPPSGGFSVGRGGGRGGYGQYGDRNGGGNWGGGGGRGGSSKRELDSVSLPKQNFGNLVHFEKNFYVESPTVQAMTEQDVAMYRTERDISVEGRDVPKPMKMFQDANFPDNILEAIAKLGFTEPTPIQAQGWPMALKGRDLIGIAETGSGKTLAYLLPALVHVSAQPRLGQDDGPIVLILAPTRELAVQIQEESRKFGLRSGVRSTCIYGGAPKGPQIRDLRRGVEIVIATPGRLIDMLECQHTNLKRVTYLVLDEADRMLDMGFEPQIRKIVSQIRPDRQTLLWSATWPREVETLARQFLRDPYKAIIGSTDLKANQSINQVIEIVPTPEKYNRLLTLLKQLMDGSKILIFVETKRGCDQVTRQLRMDGWPALAIHGDKTQSERDRVLAEFKSGRSPIMTATDVAARGLDVKDIKCVVNYDFPNTLEDYIHRIGRTGRAGAKGMAFTFFTHDNAKFARELVKILQEAGQVVPPTLSALVRSSGSGYGGSGGGRNFRPRGGGRGGGFGDKRSRSTSNFVPHGGKRTW

SEQ ID NO: 38695 - DNA, 1446 bp, Bacillus cereus ATCC 10987
  CDS (1)..(1446)
atgagtaaaaaagggttttttgagtataaattaagtaaagaaattgtaagggcacttactgggttagggtatgatcatccaacagaagtacaaggtgaggttattccagtcgcattacaaaagaaggatcttgttgtgaagtcccagacgggaagtggaaaaacagcttcatttggtattccactttgtgagatggtggagtgggaagagaataaaccacaagcattagttttaacaccaacgagagagcttgcggtacaggtgaaagaagatattacaaatatagggcgattcaaaagaattaaagccgccgcaatttatggtaagtccccatttgcacgtcaaaaattagagttaaagcaaaagacgcatattgtagtagggactccagggcgtgtattggatcatattgaaaaagggaccctttctttagagcgattaaaatatttagtgattgatgaagcagatgaaatgctaaacatgggctttatcgatcaagtagaggcaattattgatgaattacctacaaatagaatgacaatgttattttcagcaactttaccggaagatgttgaaaggttatcacgtacatatatgaatgcaccaactcatattgaaattaaagcggctgggattacgacggataaaattgaacataccctttttgaggcgatagaagacgagaagttttcactacttaaagatgtaacaacgattgagaatcctgatagctgtattattttctgccgtacacaagaaaatgtagatcatgtatatagacaattaaaacgagctaactatccttgtgacaaaatacatggtggtatggtacaagaagatcgttttgaagtcatggatgattttagaaaaggaaaattccgttatttagtagcaacagacgtagctgcgagaggaattgatattgataatattacacatgttattaattatgatattccacttgaaaaagaaagctatgtacatcgtactggaagaacaggacgagctggaaatagtggaaaagctattacatttataacaccatatgaaaatagatttttagaagagattgaggagtatattggctttgaaattccaaaggcaattggaccttcaaaagaagaagttatgaaagggaaagctgcatttgaagaaaagatacatgctaaaccaattataaagaaagataaaaatgcagacatcaacaaaggcattatgaagctgtactttaatggcgggaaaaaaaagaaaattagggcggtagatttcgtcggtacaattgctaaaattaaaggtgttacagcagaagatataggtattattacgatacaagataatgtttcttacgtcgaaatattaaatggaaaaggaccacttgtcttgaaagtcatgaagactacaacgattaaagggaaacaactaaaagttcatgaagcaattaagtaa

SEQ ID NO: 38696 - protein, 481 aa, Bacillus cereus ATCC 10987
MSKKGFFEYKLSKEIVRALTGLGYDHPTEVQGEVIPVALQKKDLVVKSQTGSGKTASFGIPLCEMVEWEENKPQALVLTPTRELAVQVKEDITNIGRFKRIKAAAIYGKSPFARQKLELKQKTHIVVGTPGRVLDHIEKGTLSLERLKYLVIDEADEMLNMGFIDQVEAIIDELPTNRMTMLFSATLPEDVERLSRTYMNAPTHIEIKAAGITTDKIEHTLFEAIEDEKFSLLKDVTTIENPDSCIIFCRTQENVDHVYRQLKRANYPCDKIHGGMVQEDRFEVMDDFRKGKFRYLVATDVAARGIDIDNITHVINYDIPLEKESYVHRTGRTGRAGNSGKAITFITPYENRFLEEIEEYIGFEIPKAIGPSKEEVMKGKAAFEEKIHAKPIIKKDKNADINKGIMKLYFNGGKKKKIRAVDFVGTIAKIKGVTAEDIGIITIQDNVSYVEILNGKGPLVLKVMKTTTIKGKQLKVHEAIK

SEQ ID NO: 38697 - DNA, 2205 bp, Eremothecium gossypii
  CDS (1)..(2205)
atgggtacaaaaaaagtaaaccagttcaaggactttgttccgacaattagcgacagcgaagaagacattccggacctcgatgcgtcggacgacgaatatgagacggcggggaaggtgaagtctcgcaagaagacgaagaaaggacgcaaggggggcgcagtgattgcagatgatgaggatgcacatgcagacttaaacccggagttccattttaacgatgagggcgcggagggcaccacagacttcagcgggtgggacttcgtgggggacggtgagcgtgcagaacagaaggacgtggacttggatggcatcatccgccggaagggagggctggtgcagcttgcaggtgtggaggagtctgaagaagaggtggaggaggccgaaagcgctgccggcgcaagcgacgatgaggaactggcgctggacggattcgggatgggcgcggtagcgcagcgggaggcggctggcgcagcggatgagagtgacagcgagtctgataaggacagcgacaacagtgcagaggaggcggtcgagctggacggagtcgagtttggcgatgagcaggaggaggcgcgggaagaggacaccgcagaggagatggcccagttttatgcgccttcgaacgaaggcgaggaagccaaaaacgtggtacattccactttcaacagtctctccctttcacgtcccgtcctgaagggtctagctgcattgggctacactaagccttcgcctatccagggcgcgactataccgatcgctctgttagggaaggacgtgatagcaggtgccgtcacaggttccggtaagacagctgcattcatgatcccaataattgaacgtcttttgtataagccagccaagatcgcatccacgcgtgtgctggtactaacccccacacgtgaactggcgatccaagtggcagatgtggggaagaaacttggaaagtttgttagcgggctgacgtttgggcttgcggttggtgggctgaacctacgccagcaggaacaggcgttgaagctgcggccagacatcgtgattgcgacgccaggtagaataatcgaccacatcagaaattccgcttcgttcagcgtggactctgtggaagtgttagttattgacgaggcagaccggatgctggaggatggtttccaagatgagctgaatgagatcatgtcactcattccaagcaagcggcagacactactgttctctgctaccatgaattcaagaattaagcagctcatctcattgtcgttgaaaaagcctgtgaggatcatgattgaccctccaaagcaggccgcaaacaagctgacgcaggagtttgtgcggttacggaaaagggaacacctgaagcctgcactcctttaccacttactgcggaaactggacagcactggtcaaaagaggattgttgtgtttgtagcgagaaaggaagtcgcccacaggctccgtgttatccttggactactcggtatgaaagcaggcgaactgcatgggtccttgacgcaagaacaacgtctgcagtctgtgaataacttcaagtctctggatgtgccagtacttgtctgtacagatttggcttccagaggtctggatattcctaagatcgaggtggttataaactacgatatgcctaaaacatacgagatatatcttcacagagttggtcgtacagcaagagctgggagagaaggtaagtctgtaacccttgtcggggaatcaacccaggaaagaagtatagtaaaggatgctatcaagtctgtagacggaagtaagggttctggccgggcgtgtggtcgggtagtcgattggaaacaggtggaggaaattcacaaacttgttcaagccaaggaggacgtcattggcgaaatcttggaggaggaaaagcaagagaaggagattctacgcgcagagatggagatccgcaagggtgagaacatgcttaagtttaaggaagagatcaatgctcgtccaagaagaacatggttccaatcagaatcagagaagaaaaactcatccatcttgcaggccctatcaaagaataaaaaggtcaccaatagcaagaagcgcaaaagagaagaagcccaacaagaagtagggtcgcggcaatacaagaagacccagaaggatcgtacaactaatcaagagcttgcattcaggaaacaaaagaagggcggcaataagaagaagaaggtacgcaaatga

SEQ ID NO: 38698 - protein, 734 aa, Eremothecium gossypii
MGTKKVNQFKDFVPTISDSEEDIPDLDASDDEYETAGKVKSRKKTKKGRKGGAVIADDEDAHADLNPEFHFNDEGAEGTTDFSGWDFVGDGERAEQKDVDLDGIIRRKGGLVQLAGVEESEEEVEEAESAAGASDDEELALDGFGMGAVAQREAAGAADESDSESDKDSDNSAEEAVELDGVEFGDEQEEAREEDTAEEMAQFYAPSNEGEEAKNVVHSTFNSLSLSRPVLKGLAALGYTKPSPIQGATIPIALLGKDVIAGAVTGSGKTAAFMIPIIERLLYKPAKIASTRVLVLTPTRELAIQVADVGKKLGKFVSGLTFGLAVGGLNLRQQEQALKLRPDIVIATPGRIIDHIRNSASFSVDSVEVLVIDEADRMLEDGFQDELNEIMSLIPSKRQTLLFSATMNSRIKQLISLSLKKPVRIMIDPPKQAANKLTQEFVRLRKREHLKPALLYHLLRKLDSTGQKRIVVFVARKEVAHRLRVILGLLGMKAGELHGSLTQEQRLQSVNNFKSLDVPVLVCTDLASRGLDIPKIEVVINYDMPKTYEIYLHRVGRTARAGREGKSVTLVGESTQERSIVKDAIKSVDGSKGSGRACGRVVDWKQVEEIHKLVQAKEDVIGEILEEEKQEKEILRAEMEIRKGENMLKFKEEINARPRRTWFQSESEKKNSSILQALSKNKKVTNSKKRKREEAQQEVGSRQYKKTQKDRTTNQELAFRKQKKGGNKKKKVRK

SEQ ID NO: 38699 - DNA, 1197 bp, Eremothecium gossypii
  CDS (1)..(1197)
atgtcgtttgatagaaatcaagatggtaagctgaaggtcaaaacttcctccaagttgccggtatcgccgacgttcgagtctatgaaactacaggagaacctgctacggggtatctatgggtatggcttcgaagctccttctgcaattcagtcgagggctatcacgcagatcatccgaggtaaggatgtcatcgcgcaagctcagtcaggcaccggtaagacagcaaccttcacgataggtatgttacaggtgatcgattcgagcagcaaggacttacaggctctagtgctgtcgccgactcgagagcttgcagcgcaaatctcgcaggtagtgcgtaacttgggagattacatgaacgttgtagctcttgcttgcactggggggaaggcgctgcagcaggatataagcaaggttaacaagggctgccatgtaatgagcggtaccccaggtcgggtactcgatatgattaaacgtcggattataaacaccaggcacgtgaaaatgcttgtgttagatgaggctgacgaactcctgagtgagacactaggtttcaagcagcaactttacgatatcttcacaaaattgccatcgtcagtgcaagtggtggtggtaagcgctacgatgagtaaggtcgtgttggaggtcaccaaaaagttcatgtctgatccagtcaagattttggtaaagcgggacgaggtgtcgctggaaggcataaagcaataccatataaacgtggataaagaagaatggaagttcgacacgctttgcgatttgtacgattccctgactatcacccagtgtgtgatattctgtaacacaaagaaaaaggtggattggctgtcgcacaagctgatacagaataactttgcagtcgcgtccatacatggagacatgaagcaagatgaccgagacaaagtcatgagtgactttaggtcaggcagctcccgcgtgcttatttccacagatgtgtgggcccgtgggattgatgttcaacaggtttcgctggttatcaactacgatctgcctgaacttctcgagaactacatccatcggataggccgttcgggcaggtttggaagaaagggggtagcaataaatttcattacaagagaagaggtcaccaagctgaagtcaatcgaaaagcattattcgatcaaaatcaagccaatgcccgcagatatcgacagtctttcctag

SEQ ID NO: 38700 - protein, 398 aa, Eremothecium gossypii
MSFDRNQDGKLKVKTSSKLPVSPTFESMKLQENLLRGIYGYGFEAPSAIQSRAITQIIRGKDVIAQAQSGTGKTATFTIGMLQVIDSSSKDLQALVLSPTRELAAQISQVVRNLGDYMNVVALACTGGKALQQDISKVNKGCHVMSGTPGRVLDMIKRRIINTRHVKMLVLDEADELLSETLGFKQQLYDIFTKLPSSVQVVVVSATMSKVVLEVTKKFMSDPVKILVKRDEVSLEGIKQYHINVDKEEWKFDTLCDLYDSLTITQCVIFCNTKKKVDWLSHKLIQNNFAVASIHGDMKQDDRDKVMSDFRSGSSRVLISTDVWARGIDVQQVSLVINYDLPELLENYIHRIGRSGRFGRKGVAINFITREEVTKLKSIEKHYSIKIKPMPADIDSLS

SEQ ID NO: 38701 - DNA, 1617 bp, Methanococcus maripaludis S2
  CDS (1)..(1617)
atggaaagttttaaaaatttaggtctatctgacgagatattagaagcattagaaaagaaaggcttcacaaacccaacccctattcaggaacaagcaattcctattttaattgaaggaaaaagagatattgtcggccaagctcaaacaggtacgggaaaaaccgcagcatttggtattcctattttagaaacaattgatgaacactcaaggaacacgcaagcacttattttagcacctacaagagaactcgcaatacaagttgcagaagaaatcgattcaatcaaaggttcaaaaagattgaatgttttcccagtatatggtggtcaatcaattgacagacagataagagaattaagaaggggagttcagattgttgttggaactcctggaaggatcctcgaccacatctcaagaagaacaataaaacttgaaaacgtttcatatgtagttttagatgaagctgatgaaatgttaaacatgggattcattgacgatgttgaagaaatcttaaaatcagtaagcactgacaaaagaatgcttttattctcagcaacacttcctgacagcatcatgaaacttgctaaaaattacatgagagaatacgacatcatcaaagttaaaagacagcagcttacaactactttaaccgaccaatcattctatgaaattcattcaagagataaatttgaattactttcaagaatcattgacacggaaaaagaattttacggtttaatcttctgtaaaacaaaagcagacgttgacgaagttgcaaacagattaaatgagaaagggtatgctgcagaaggtcttcacggggacatgacccaagctcaaagagaaaaaacactcgacaaatttaaaggaaagaaaatcaacgttctcgtagcaactgatgttgcagcaagaggaattgatatcaacgatttaacacacgttgtaaactttgatattccacaaaatcctgaatcatacgtccacagaattggaagaacaggccgagctggaaaacaaggttatgcaattacatttgttgaaccttcagaatttaggaagtttaaatacatccaaaaaattgcaaaaactgaaattaaaagagaagaagttcctgatgttaaagatataatcagcgctaaaaaaataaaaatcatttccggaataaaagaagttttagaatctggaaaatacgctgattgcgaaaaaatggcttctgatttattagaagatgcagatcctcaagaagttctttcagcagttttaaaatatgctttaaaagatgaattaagtgaatcaaactacaaaaaaattggaagaggttcacaaagatctgaaagatctggaagaaatgacagcagaggaagaagatctttcgcacctggtgaaaacgtaagactctttgtagctcttggtaaacttgataaaatgaaccctaaaaaattagtggatcacatttcaagaaaatccgatgttaaaggaagagacatcgacgatgtaaaagtatttgagaaattttcctttgtaacggtatcttcaagcgatgcagaaataattcttgattcattcaagaatgaaagaagaggaagaagatcaataatcgaagttgcaagcggcaactaa

SEQ ID NO: 38702 - protein, 538 aa, Methanococcus maripaludis S2
MESFKNLGLSDEILEALEKKGFTNPTPIQEQAIPILIEGKRDIVGQAQTGTGKTAAFGIPILETIDEHSRNTQALILAPTRELAIQVAEEIDSIKGSKRLNVFPVYGGQSIDRQIRELRRGVQIVVGTPGRILDHISRRTIKLENVSYVVLDEADEMLNMGFIDDVEEILKSVSTDKRMLLFSATLPDSIMKLAKNYMREYDIIKVKRQQLTTTLTDQSFYEIHSRDKFELLSRIIDTEKEFYGLIFCKTKADVDEVANRLNEKGYAAEGLHGDMTQAQREKTLDKFKGKKINVLVATDVAARGIDINDLTHVVNFDIPQNPESYVHRIGRTGRAGKQGYAITFVEPSEFRKFKYIQKIAKTEIKREEVPDVKDIISAKKIKIISGIKEVLESGKYADCEKMASDLLEDADPQEVLSAVLKYALKDELSESNYKKIGRGSQRSERSGRNDSRGRRSFAPGENVRLFVALGKLDKMNPKKLVDHISRKSDVKGRDIDDVKVFEKFSFVTVSSSDAEIILDSFKNERRGRRSIIEVASGN

SEQ ID NO: 38703 - DNA, 2100 bp, Xenopus tropicalis
  CDS (1)..(2100)
atgagtcatgtggccgtggaaaatgtcctcagtctagaccagcagtttgctggcctagatttgaattcagctgatgcccaaagtggtggttctgcaacaaaaggacgttatatccctccacatttgagaaacaaagaagcctcaaggcaagacgccaactgggacgctggccgtggcgggaatggctacgttaatggtacaaacgatgaccgtgacagtcgcatgaatggttatgatcgaagtggctatggaaatcgtggttctggacgaactgacagaggcttttatgatagagagaattctgggtggaattcaggcagagacaaagatgcatatagcagttttggctcccgtggtgagcgaggaaaaccaagcttatttaatgatagaggaggaagtggatccagaagaccggatgaccgtcgaccagacggctatgatggaatggctaacagaggtgatagaagtggctttggtagatttgacagaggcaacagccgttggtcagatgaaagaaatgatgaggatgactggtcaaaacctttagctccaaatgaccgtgtagaacaggaacttttctctgggagcaacactggcattaattttgagaagtatgatgacattccagttgaagcaacaggcaacaattgccccccgcatatagaaagttttcaagatgttactatgggtgaaattatcatgggaaacattcagctaagccgttacacacgaccaactccagtgcagaaacatgcaattccaattattattgagaagagagacttgatggcatgtgctcagacaggatctgggaaaactgcagcctttcttctacccatattaagtcagatctatgccgatgggcctggtgatgcaatgaagcacttaaaggaaaatggaagatatggtagacgcaaacagtttccactttctcttgttttggcacctaccagagagctagcagtacaaatctatgaagaggctagaaagtttgcatacaggtctagagttcgcccatgtgtagtctatggtggggctgatattggccagcagatacgagatctggaacgtggttgtcatctacttgttgctactcctgggcgccttgttgatatgatggaaaggggaaagattggcttggacttttgcaattatctagtactagatgaagcagacagaatgcttgacatgggttttgagcctcaaattcgtcgtattgtcgaacaagacactatgccaccaaaaggtgtaaggcagactatgatgtttagcgccactttccccaaagagattcagatacttgctcgggattttttggatgaatatatcttcttggcagttggtagagttggttccacttcagaaaatataactcaaaaagttgtttgggtcgaggagatggacaaacgttcatttttgcttgacctcctcaatgcaacaggaaaagattccttaactctagtctttgtggagaccaaaaagggtgcagatgcacttgaagatttcttgtatcatgagggttatgcctgtacaagcatccatggagacaggtctcagagagacagagaagaagcacttcaccagttccggtcaggaaaaagcccaatccttgttgccactgctgtagcagctagaggtcttgacatttcaaatgtaaagcatgtcataaactttgatctaccaagtgacattgaagaatatgtgcatcgtattggtcgtactggacgtgtagggaatcttggtcttgcaacatcttttttcaatgaaaagaacataaacataacaaaagatttgctggatctgctggtggaagccaaacaggaggttccttcttggttggagaacatggcttatgaacagcatcacaagagtagcactcgtggtcgttcaaagagtcgcttcagtggtggatttggtgctagagactatcgtcaaagtagcggtgcaagtagcggctttggcggcagcagccgcggcggccgaagcagtggtcatggaggcagccgggggtttggaggcggctatggtggcttctataacagtgacgggtatggaggcaactacgggggcagctcccaggttgactggtggggcaactaa

SEQ ID NO: 38704 - protein, 699 aa, Xenopus tropicalis
MSHVAVENVLSLDQQFAGLDLNSADAQSGGSATKGRYIPPHLRNKEASRQDANWDAGRGGNGYVNGTNDDRDSRMNGYDRSGYGNRGSGRTDRGFYDRENSGWNSGRDKDAYSSFGSRGERGKPSLFNDRGGSGSRRPDDRRPDGYDGMANRGDRSGFGRFDRGNSRWSDERNDEDDWSKPLAPNDRVEQELFSGSNTGINFEKYDDIPVEATGNNCPPHIESFQDVTMGEIIMGNIQLSRYTRPTPVQKHAIPIIIEKRDLMACAQTGSGKTAAFLLPILSQIYADGPGDAMKHLKENGRYGRRKQFPLSLVLAPTRELAVQIYEEARKFAYRSRVRPCVVYGGADIGQQIRDLERGCHLLVATPGRLVDMMERGKIGLDFCNYLVLDEADRMLDMGFEPQIRRIVEQDTMPPKGVRQTMMFSATFPKEIQILARDFLDEYIFLAVGRVGSTSENITQKVVWVEEMDKRSFLLDLLNATGKDSLTLVFVETKKGADALEDFLYHEGYACTSIHGDRSQRDREEALHQFRSGKSPILVATAVAARGLDISNVKHVINFDLPSDIEEYVHRIGRTGRVGNLGLATSFFNEKNINITKDLLDLLVEAKQEVPSWLENMAYEQHHKSSTRGRSKSRFSGGFGARDYRQSSGASSGFGGSSRGGRSSGHGGSRGFGGGYGGFYNSDGYGGNYGGSSQVDWWGN

SEQ ID NO: 38705 - DNA, 1440 bp, Xenopus tropicalis
  CDS (1)..(1440)
atggaagggttttcgaggcttgggttgtcttcctggcttatcgatcaatgtagccaactgggcatattgaaacctagtcctgtacaggagaattgcatcccgcccatcctggaaggccgagactgcatgggatgtgcaaagactggcagtggaaaaacagctgcctttgtgctgcctattctccaaaaactctctgaggatccctttggaatattttgcctggttctgacaccaactcgagaactcgcatatcagattgcagaacaatttcgggtcctagggaagccactgggcttgaaggattgcattattgttggtggaatggatatggtagcacaagctctggagttgtccagaaagccacatgttgtgatagccacaccaggccgactggctgaccacatccggagttcaaacactttcagcatcaagaagattcgtttcttggtgctggatgaagctgatcggctgctagaacaaggctgcacagatttcacccaggatttgcaggtgattcttgaagctgtccctgcgcaacgccagaccttgttattcagcgcaacccttacagacaccctgcaggaactcaaaactattgccatgaacaagccctttttttgggagtcaacctcagaggtaagaacagtggagcagttagaccagcgatacatcctagtgcctgagaaggttaaggatgcctatttggtacatcttattcagaaatttcaggatgaacacgaagattggtccatcatgatcttcactaacacctgcaaaacctgccaaatcctaaatatgatgctacgtgaatttagcttcccctctgttgctctgcactctatgatgaaacaaaaacaaagatttgctgctcttgccaagttcaagtcgagtgttttcaagattcttattgcaactgatgtggcagctaggggcctggatatacctactgtccaggttgtaatcaatcacaatactcccggcctgccaaagatctacattcaccgggtggggcgcacagcaagagcaggaaggaatggaatggcaataacattagtcacacagtatgatattcatctggtacatgcaattgaagagcaaatcaatatgaaactggaggagtttaaagtgaaggaaagtgaagtgctgaaaattttaacccaggtgaacgtgacccgacgggaatgtgaaataaaactggaatgcacagactttgatgagaaaaaagagataaacaagaggaaacagcttatcctggaaggaaaggaccctgatctggaagctaaaaggaaggcagaacttgagaaaataaagaagcagaagaagaaattcaaggagcacattcaggagaccatgcaaaagaagagagaagctcaagtgcggaggaagctaaagaagaaacgtcttcgtcaggagaagaaggctgctaaggctcctcaatga

SEQ ID NO: 38706 - protein, 479 aa, Xenopus tropicalis
MEGFSRLGLSSWLIDQCSQLGILKPSPVQENCIPPILEGRDCMGCAKTGSGKTAAFVLPILQKLSEDPFGIFCLVLTPTRELAYQIAEQFRVLGKPLGLKDCIIVGGMDMVAQALELSRKPHVVIATPGRLADHIRSSNTFSIKKIRFLVLDEADRLLEQGCTDFTQDLQVILEAVPAQRQTLLFSATLTDTLQELKTIAMNKPFFWESTSEVRTVEQLDQRYILVPEKVKDAYLVHLIQKFQDEHEDWSIMIFTNTCKTCQILNMMLREFSFPSVALHSMMKQKQRFAALAKFKSSVFKILIATDVAARGLDIPTVQVVINHNTPGLPKIYIHRVGRTARAGRNGMAITLVTQYDIHLVHAIEEQINMKLEEFKVKESEVLKILTQVNVTRRECEIKLECTDFDEKKEINKRKQLILEGKDPDLEAKRKAELEKIKKQKKKFKEHIQETMQKKREAQVRRKLKKKRLRQEKKAAKAPQ

SEQ ID NO: 38707 - DNA, 1809 bp, Anopheles gambiae str. PEST
  CDS (1)..(1809)
atgataaagaaaggaaacatgagcggagacggtgaatgggatgattgtgacgagggacgtagcttcgatcagcccaagtacgatgctaccgaaaatagtgttcaggacaacgatactaacgggttcgacaactatcagtccaacaatggtttcggtgacgagtatcaaagcaacgacaacggtggatatggcggcggtgacgatggatacggcggcggtggtcgtggaggccgtggaggccgaggtggcggacgaggtcgtggtcggggccgtggcgggcgcgatggtggcggtggcttcggtggcggtggctacggtgatcgaaacggcgatggcggccgacctgcctattctggcaacagcgatccaagcatggaccaggtgaagacggacaagccgagggagctgtacattccgccacttccgaccgaggacgaatcgctgatcttcgggtccggcatcagctccgggatcaattttgacaagttcgaggaaatccaggtgcgcgtgtcgggcgaaaatccaccggatcacgtggagagcttcgagcgctccggtttgcgcgaggaggtgatgacgaacgtgcgcaagtcgagctacacgaaaccgacgcccatccagcggtacgccatcccgatcatcctgaacgggcgcgacctgatggcctgcgcccagaccggttcgggcaagacggccgccttcatgctgccgatgatccaccatctgctggacaaggaagactcgctggagctgcgcacgcgcaacccgtacatcgtgatcgtggccccgacccgcgagctcgcgattcaaatccacgacgaggggcgcaagttcgcgcacggcaccaagctgaaggtctgcgtatcgtacggcggcacagccgtacagcaccagctgcagctgatgcgcggtggctgccacgtgctggtggcaacgcccggtcggctgctggacttcatcgaccgggggtacgtgacgtttgagaacgtgaacttcgtggtgctcgacgaagccgatcggatgctggacatgggctttctgccctcgatcgagaaggtgatgggacacgcgacgatgccggaaaagcagcagcggcagacgctcatgttttcggctacgttcccggccgaaatccaggagctggcgggcaagttcctgcacaactacatctgcgtgttcgtgggcatcgtcggcggagcgtgtgccgatgtggagcagacgatccatctggtggaaaagttcaagaagcgcaagaagctggaggagatcctgaacggcggcaatcccaagggtacgctcgtgttcgtggagacgaagcgcaatgcggactatctggcatcgctgatgtccgagacgcagttcccgaccacctccatccatggcgatcggttgcagcgggagcgcgagatggcgctgtacgatttcaagtccgggcggatggacgtgctgatcgcgacgtcggtagcggcccgcgggctggacattaaaaatgtgaaccacgtggtgaactacgatctgccgaagagcatcgatgattacgtgcaccgtatcgggcgaaccgggcgcgtcggtaacaagggccgagcgactagcttctacgacccggaggcggaccgggctatggcgagcgatctggtgaagattctcacccaggccgggcagtcggtgccggactttttgaaggatgctggcggctccggctcgtacatgggatcgtcccagttcggtggcaaggatatccgcgactcgtacggttcgcgtgtcgatgcccagccggttgccctcgagccggaggaagagtgggagtaa

SEQ ID NO: 38708 - protein, 602 aa, Anopheles gambiae str. PEST
MIKKGNMSGDGEWDDCDEGRSFDQPKYDATENSVQDNDTNGFDNYQSNNGFGDEYQSNDNGGYGGGDDGYGGGGRGGRGGRGGGRGRGRGRGGRDGGGGFGGGGYGDRNGDGGRPAYSGNSDPSMDQVKTDKPRELYIPPLPTEDESLIFGSGISSGINFDKFEEIQVRVSGENPPDHVESFERSGLREEVMTNVRKSSYTKPTPIQRYAIPIILNGRDLMACAQTGSGKTAAFMLPMIHHLLDKEDSLELRTRNPYIVIVAPTRELAIQIHDEGRKFAHGTKLKVCVSYGGTAVQHQLQLMRGGCHVLVATPGRLLDFIDRGYVTFENVNFVVLDEADRMLDMGFLPSIEKVMGHATMPEKQQRQTLMFSATFPAEIQELAGKFLHNYICVFVGIVGGACADVEQTIHLVEKFKKRKKLEEILNGGNPKGTLVFVETKRNADYLASLMSETQFPTTSIHGDRLQREREMALYDFKSGRMDVLIATSVAARGLDIKNVNHVVNYDLPKSIDDYVHRIGRTGRVGNKGRATSFYDPEADRAMASDLVKILTQAGQSVPDFLKDAGGSGSYMGSSQFGGKDIRDSYGSRVDAQPVALEPEEEWE

SEQ ID NO: 38709 - DNA, 1548 bp, Neurospora crassa
  CDS (1)..(1548)
atgtcgacaaaacggaggaaaacttctgacgagcccagtgccctcaaaaaggcggctgctccttctgcaccggagctgaagaaagaaaagaaggtcaaggataagtcgaccaaggacaagtccagcaccaagaagacagagaagacggaaaagaaacaagatgcgccagagccagcagaggagtcaactcccgccaccaactcgacagaagaggactccgtgactctcgacgttgcccctgaacaggaggaggttgagactgttaagaagacctttaaggatcttggaatcgtcgacgccctctgcgaagcttgcgaacgactcggatacaagaacccgactcccattcaagaacagtcgattcccctcgcccttcaaaaccgcgatatcattggtattgccgagactggttccggaaaaacagcagcctttgccctccccatcctacaagcgctcctcgacaagccggcccctctgttcgccctcgtccttgcgcccacaagagaacttgcagcccagatcgcccaagccttcgaagcgctcggtagcttgatctcgctaagatgcgctctgattttgggtggtatggacatggtaacacaggcaattgctctcggcaagaagccccacgttattgttgcgactcccggtagactactcgaccacctggagaagaccaagggcttcagtctgcgttccatgcagtacctggtcatggacgaagccgaccgtctgctcgacatggatttcggcccaattctcgaaaagattctcaagttccttccccgcgagcgccggacgttcctcttctccgccaccatgtccagcaaggtcgagtctttgcagcgcgcctcgttgcgggaccccctcaaggtcagcgtatcctccaacaagtacgcgaccgtctcgacgctcaagtccaactacgtcttcatcccgcacatgcacaaggacacctacctggtctacctctgcaacgagttcgccggccagaccatcatcatcttcaccagaaccgtgctagaaacccagcgcattgcgatcctgctccgcaccctcggtatgggtgccatccctctacacggtggcctctcgcagtctgctcgtctcggtgccctgaacaagttccgcgccggttcccgtgagatccttgtggctaccgatgttgctgcccgtggtctcgatattcctaacgtcgactgcgtcatcaaccatgatcttcctcaggactccaaaacctatgtccatcgtgtcggtcgtactgctcgtgcgggcaagtctggtcatgctatcagcattgtcacacaatatgatctcgaaatttggctccgaatcgaagctgctctcggccacaagcttgatgagtatcctttggagaaggacgaggttatggtgttcaagccccgcgtcgaggaggcgcaacgccatgccaggaacgagatgaagtcgttgatggagaatcagggcaagcacggtggcttgctgaagaggaagcgcggaaacggccagggtggcggccgtgatcatatggatgctgaggagggttaa

SEQ ID NO: 38710 - protein, 515 aa, Neurospora crassa
MSTKRRKTSDEPSALKKAAAPSAPELKKEKKVKDKSTKDKSSTKKTEKTEKKQDAPEPAEESTPATNSTEEDSVTLDVAPEQEEVETVKKTFKDLGIVDALCEACERLGYKNPTPIQEQSIPLALQNRDIIGIAETGSGKTAAFALPILQALLDKPAPLFALVLAPTRELAAQIAQAFEALGSLISLRCALILGGMDMVTQAIALGKKPHVIVATPGRLLDHLEKTKGFSLRSMQYLVMDEADRLLDMDFGPILEKILKFLPRERRTFLFSATMSSKVESLQRASLRDPLKVSVSSNKYATVSTLKSNYVFIPHMHKDTYLVYLCNEFAGQTIIIFTRTVLETQRIAILLRTLGMGAIPLHGGLSQSARLGALNKFRAGSREILVATDVAARGLDIPNVDCVINHDLPQDSKTYVHRVGRTARAGKSGHAISIVTQYDLEIWLRIEAALGHKLDEYPLEKDEVMVFKPRVEEAQRHARNEMKSLMENQGKHGGLLKRKRGNGQGGGRDHMDAEEG

SEQ ID NO: 38711 - DNA, 1203 bp, Neurospora crassa
  CDS (1)..(1203)
atggctgacggcggaatcgatcgcaaggccgatgaaaagattcagttctccacctccaaggaggtaacggttcatccgactttcgagtcgatgtccttgaaggagagtctccttcgcggcatctacgcctacggatatgagtccccctctgctgtccagtcccgcgccatcgttcagatctgcaagggtcgcgataccatcgcccaggcccagtccggtaccggtaaaacagccactttctcgatctctatgcttcaggtcatcgacaccgccgtgcgcgagacccaggccctcgtcctttccccgacccgcgaacttgcgacccagattcagagcgttgtgatggctttgggagattacatgaacgtccaatgccatgcttgcattggtggcaccaacgttggcgaggatattcgcaagctcgactatggtcaacacattgtctctggcactcctggtcgtgttgccgacatgattcgccgccgtcatctccgcaccagacacatcaagatgctggttctcgatgaagccgatgagctcctcaaccagggtttccgcgagcagatctacgatgtgtaccgctatcttccgcctgccacacaagtcgtcgtcgtctctgccaccctcccttatgatgtgctcgacatgaccaccaagttcatgaccgaccctgttcgtatcttggtcaagcgtgacgagttgaccctcgagggtttgaagcagtattttattgctgtggagaaggaggactggaagttcgacactctttgcgatctctacgacactctgactattacacaagccgttattttctgcaacacccgccggaaggtcgactggttgaccgataagatgcgcgaagccaacttcactgtcagcagcatgcacggcgatatgccccaaaaggagagagacagcattatgcaggatttcagacagggcaatagcagagtgctgatctcgaccgatgtgtgggcccgcggtatcgatgttcagcaggtcagcttggttatcaactatgatcttcccagcaaccgtgaaaactacattcatcgcatcggtcgttcaggtagattcggtcgcaagggtgtcgccatcaacttcgttactagcgaggatgtccgcatcttgcgtgatatcgagttgtactactcgacccagattgatgagatgcccatgaatgttgccgaccttatctcctaa

SEQ ID NO: 38712 - protein, 400 aa, Neurospora crassa
MADGGIDRKADEKIQFSTSKEVTVHPTFESMSLKESLLRGIYAYGYESPSAVQSRAIVQICKGRDTIAQAQSGTGKTATFSISMLQVIDTAVRETQALVLSPTRELATQIQSVVMALGDYMNVQCHACIGGTNVGEDIRKLDYGQHIVSGTPGRVADMIRRRHLRTRHIKMLVLDEADELLNQGFREQIYDVYRYLPPATQVVVVSATLPYDVLDMTTKFMTDPVRILVKRDELTLEGLKQYFIAVEKEDWKFDTLCDLYDTLTITQAVIFCNTRRKVDWLTDKMREANFTVSSMHGDMPQKERDSIMQDFRQGNSRVLISTDVWARGIDVQQVSLVINYDLPSNRENYIHRIGRSGRFGRKGVAINFVTSEDVRILRDIELYYSTQIDEMPMNVADLIS

SEQ ID NO: 38713 - DNA, 1278 bp, Neurospora crassa
  CDS (1)..(1278)
atggctaccgataagggactcgaggatatccccgagggtacgttcaaatcatcatcaacaccaccaaaggccatcgctacactcggtcgacggcgtcgcgcaagtattcgccgtcgcctcggacagatcgagtctaactacgatgagaccgttgattcattcgacgagatgaacctgaagcccgagttgcttcgcggtatctacgcttatggtttcgagcgcccctctgctatccagcagcgcgccatcatgcccgtcatcaagggccacgatgtcattgctcaggctcagtccggtactggcaagactgccaccttctccatctccgttctccagaagatcgaccccagcctcaaggcctgccaggctctcatcctcgcccccacccgcgagcttgcccagcagatccagaaggttgttgtcgccatcggtgacttcatgaacatcgagtgccacgcctgcattggtggtacctccgttcgtgatgacatgaaggccctccaggacggcccccaggtcgttgttggtacccccggccgtgtccacgacatgatccagcgtcgtttcctcaagaccgacagcatgaagatgttcgtccttgatgaggccgatgaaatgctttcgcgcggtttcacggagcagatttacgacatcttccagctccttccccagagcacccaggtcgtccttctctccgccaccatgccccaggacgtccttgaggttaccaccaagttcatgcgcgagcccgtccgcattctcgtcaagaaggacgagcttaccctcgagggtatcaagcagttctacattgccgttgagaaggaggagtggaagcttgacaccctctcggatctctacgagaccgttaccatcacccaggctgttatcttctgcaacacccgcagaaaggtcgactggctcaccgacaagctgactgcccgtgatttcaccgtctccgccatgcacggtgacatggaccaggctcagcgtgatttgattatgaaggagttccgttccggttcttctcgtgtcctgatcgccacggatctccttgcccgtggtatcgacgttcagcaggtttccctggttatcaactacgatctccctgccaaccgcgagaactacatccaccgtatcggtcgtggtggtcgtttcggtcgtaagggtgttgcgatcaacttcgtcaccgctgacgatgtccgcatgatgcgcgagatcgagcagttctacagcacccagattgaggagatgcccatgaacgtcgctgatctcatctaa

SEQ ID NO: 38714 - protein, 425 aa, Neurospora crassa
MATDKGLEDIPEGTFKSSSTPPKAIATLGRRRRASIRRRLGQIESNYDETVDSFDEMNLKPELLRGIYAYGFERPSAIQQRAIMPVIKGHDVIAQAQSGTGKTATFSISVLQKIDPSLKACQALILAPTRELAQQIQKVVVAIGDFMNIECHACIGGTSVRDDMKALQDGPQVVVGTPGRVHDMIQRRFLKTDSMKMFVLDEADEMLSRGFTEQIYDIFQLLPQSTQVVLLSATMPQDVLEVTTKFMREPVRILVKKDELTLEGIKQFYIAVEKEEWKLDTLSDLYETVTITQAVIFCNTRRKVDWLTDKLTARDFTVSAMHGDMDQAQRDLIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 38715 - DNA, 1278 bp, Magnaporthe grisea 70-15
  CDS (1)..(1278)
atggccgacaagggactcgaggatgtccccgaaggtacgtcggatctcagcagcttctcaggagcggttttcgcaaggagctatcggatcgaggggctaacaccccctgcgccggctacagggcagatcgagtccaattacgatgagaccgtcgactctttcgacgagatgaacctgaagtcggagctgcttcgtggtatctatgcctacggtttcgagcgcccgtctgctatccagcagcgcgctatcatgcccgttatcaagggccacgatgtcattgctcaggctcagtccggtaccggcaagaccgccactttctcgatctcggttctgcagaagatcgacaccaacgtcaagcagtgccaggccctgatccttgccccgacccgtgagcttgctcagcagatccagaaggtcgttgttgccatcggtgacttcatgaacattgagtgccacgcctgcattggcggcaccagcgttcgtgatgacatgaaggctcttcaggacggcccccaggtcgttgtcggtacccccggccgtgtccacgacatgatccagcgccgcttcctcaagaccgacggcatgaagatgttcgtccttgacgaggccgacgagatgctttcgcgtggtttcaccgagcaaatttacgacatcttccagctcctcccccagtcgactcaggttgtcctgctttcggccaccatgccccaggacgtcctggaggtcacgaccaagttcatgcgcgaccccgtccgcatcctggtcaagaaggacgagcttaccctggagggtatcaagcagttctacattgctgtcgagaaggaagagtggaagctcgacaccctctcggacttgtacgagactgtcaccattacccaggccgttattttctgcaacacccgcagaaaggtcgactggctcacggacaagctcactgcccgtgacttcactgtgtctgccatgcacggtgacatggaccaggctcagcgtgacctgatcatgaaggagttccgctcgggttcgtcccgtgtgcttattgccaccgacttgctcgctcgtggtatcgacgtccagcaggtatcgctggtcatcaactacgacctgcccgccaaccgtgagaactacatccacaggattggtcgtggtggtcgtttcggccgaaagggtgtcgccattaacttcgtcaccgccgatgatgtgcgcatgatgcgcgagattgagcagttctacagcacgcagattgaggagatgcctatgaacgtcgccgacttgatttaa

SEQ ID NO: 38716 - protein, 425 aa, Magnaporthe grisea 70-15
MADKGLEDVPEGTSDLSSFSGAVFARSYRIEGLTPPAPATGQIESNYDETVDSFDEMNLKSELLRGIYAYGFERPSAIQQRAIMPVIKGHDVIAQAQSGTGKTATFSISVLQKIDTNVKQCQALILAPTRELAQQIQKVVVAIGDFMNIECHACIGGTSVRDDMKALQDGPQVVVGTPGRVHDMIQRRFLKTDGMKMFVLDEADEMLSRGFTEQIYDIFQLLPQSTQVVLLSATMPQDVLEVTTKFMRDPVRILVKKDELTLEGIKQFYIAVEKEEWKLDTLSDLYETVTITQAVIFCNTRRKVDWLTDKLTARDFTVSAMHGDMDQAQRDLIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 38717 - DNA, 2025 bp, Magnaporthe grisea 70-15
  CDS (1)..(2025)
atggctccgctagacctggaggagatcctcaaaaagcacaaagccgcaaaggccgaggcggcaaaaccacgcttcatcccaagaggccagcgcaaaaagatggaggaagagaagaaactaaaagtggaggaagagcagaagcggcaacaggaggaactgcaaaagacacggagcgagctgcaaaaggcgcgcgaggagcttgcgggacttcagcgagtgaggcgccaggagcaatcaaggagccgggaatccgatcactctgtccctacaggaccccgcgccatgcgctcgtacgacgatgacagtttcaacggcaacggcaacggtagcaatagcaacagaaacaataacaacaaccagagagatcgacaggatgcgagcaccaaaaccaacgggagtcgaactgcagaggaggttcaagaggagaagaagtaccttgagaggtacactggcccacccgccaaagtcagcacgttctcggccaacaagaagcgaagacgtacgacggaccaaaaattcaactttgactgggatcccaaggatgatacaagccagccctggcgctacgaggagacgggcgctcatgagcggagtgccaatggggctacggagcaagtcaggagaaagaaggccacaagggattacaacgaccctaggcttgtgccttggcaagacaaggagctctctcagatgacgaccagagactggcgtctcttcaaagtcaacctcgagattgtgacaaagggcaacaatattcccaatccaatgcgtttctgggaggagtccaacctgcctcacgtacttaaggataccatcaaacaggttggctacactgagccaaccccggttcagcgtgctgccatccccattgcccttcaatgccgagacttgataggaatatcaaagaccggttccggtaaaactgcagctttcgttttgcccatgctgtcttacatagagccactacctccgctcaacgaggttacaaagacagagggtccatatgccttgattttggcacctacccgagaactggcaacgcagatccaagctgaggttatcaagtttgcgacgcgcatgggctttactgtagtctgtctcatcggaaacaagagaactatcgaggaagatgccttcgccctgcgcaacggtgcagagatcatcgtagccacccctggtcggttggtcgactgtctcgagaggcacttgcttgtgctttcgcagtgctcatacgttgttcttgatgaagcagaccgtatggttgatggaggattcgaggattccatccacaagattcttgccgcgctgccgccgtcgaacggaaagccagacgatcgggatgccgaagatccaaacatcatgtccaaattcctcacacctaatctccggtaccggcagactgtcatgtactcagccacgatgccgcccagtgttgaaagaatcgccaaaaactacctcaaacatccggcaatggttacaatcggaaccattggtgaggctgtggacacagtagaacagcaagccatgtgggtggttagcgaggacgagaggcgcaacaaactcagggcaatgcttaacacgtacggcaccgggaaacttgtcatcgtcttcgtcaacacaaagagtaattgtgacgcagttgccaaggatctcaagtcatcgagtttctcagccgttaccttacacggaaacaagacacaggatcaacgtgaggccgcacttcagtcgttccgcgatggcaggacaaacgttttggtggctactgatgtggctgctcgtggtttggatattcccgacgtgtcgctcgtcatcaacttcaacatggctggcacaatagaggtgtacacccaccgtatcggacgtactggacgtgctggaaaagaaggtatggctatcacgttctgcggccccgaggaccatggtgtgctgtaccacttgaagcaaatcatgagcaagagtcaaatgtccaaggttcctccttggttgaaggatcatcccgaggcgcaatccaagcctacattttaa

SEQ ID NO: 38718 - protein, 674 aa, Magnaporthe grisea 70-15
MAPLDLEEILKKHKAAKAEAAKPRFIPRGQRKKMEEEKKLKVEEEQKRQQEELQKTRSELQKAREELAGLQRVRRQEQSRSRESDHSVPTGPRAMRSYDDDSFNGNGNGSNSNRNNNNNQRDRQDASTKTNGSRTAEEVQEEKKYLERYTGPPAKVSTFSANKKRRRTTDQKFNFDWDPKDDTSQPWRYEETGAHERSANGATEQVRRKKATRDYNDPRLVPWQDKELSQMTTRDWRLFKVNLEIVTKGNNIPNPMRFWEESNLPHVLKDTIKQVGYTEPTPVQRAAIPIALQCRDLIGISKTGSGKTAAFVLPMLSYIEPLPPLNEVTKTEGPYALILAPTRELATQIQAEVIKFATRMGFTVVCLIGNKRTIEEDAFALRNGAEIIVATPGRLVDCLERHLLVLSQCSYVVLDEADRMVDGGFEDSIHKILAALPPSNGKPDDRDAEDPNIMSKFLTPNLRYRQTVMYSATMPPSVERIAKNYLKHPAMVTIGTIGEAVDTVEQQAMWVVSEDERRNKLRAMLNTYGTGKLVIVFVNTKSNCDAVAKDLKSSSFSAVTLHGNKTQDQREAALQSFRDGRTNVLVATDVAARGLDIPDVSLVINFNMAGTIEVYTHRIGRTGRAGKEGMAITFCGPEDHGVLYHLKQIMSKSQMSKVPPWLKDHPEAQSKPTF

SEQ ID NO: 38719 - DNA, 1746 bp, Gibberella zeae PH-1
  CDS (1)..(1746)
atggctgccactaagcattcactcgctgacagcgaggatcgacccaccaagaagaccaaggtcgactccgaagagaaggctcgcctaaaggctgagaagcgagagcgcaaggagaagaagaagagccaagagtctgagcctagtgctgagaactctgatgctgaccgtgctgctgagaaggagcgcaagaaggctaagaaggccaagaagctggagaagaagcagaagctggccgaagctgaggcatctgctgagcctgctgccgaagtctctgatgaggctcccaagaagtccaagaaggagaagaagactaccactaccgaagcctcttctaactccgaggctccctcaagcggctcttacattcaaaccattgcgctctctaacgttccccaagctgagattgacgagtttctctccaagaacgaaatccacattaccgaccccaagaccgagaacgttactcttcgccccgtcctggaattccaccagctccctgctacaaacctcctcgagaagaagccctcaccattcgccaactataaggcgcccacacccattcagtccgcttcatggcctttcaccctctctggccgtgatgtgattggtgttgccgagacaggatccggaaagacaatggctttcgcgcttccctgtgttgaggccatctctgccctcaagcacaagcacaccaaggctgttgttgtttcgcctacacgagaactcgctatgcagacctatgagcagatggcttccgttgcggctctcaacaggatgaagtgtgtctgcctctacggtggtgcttccaaggatgaccagcgaaacctcctcaaccgtggtgctgacatcattgtcgcaacacccggtcgtcttaaagatttcatgtccgatggaactgtcgatcttagccactcggccttcgccgttcttgacgaggccgaccgtatgcttgacaagggtttcgaggaggatattaagatgattctcagctcttgccctcctcgcgagaagcgccagacactcatgttcacagctacatggcctcagtcggtccagacgctcgcagccaccttcatggttagccccgtcaagatcgccattggatccggtggcaaggagactgctggtggagctgttgagctccaggccaacgcaagaatctcacagagcgttgaggttcttgagcccagagggaaggaattccgtctcctcgaggtcctgaaggagcaccagcagggaagcaagaagaacgaccgtattctggttttctgcttgtacaagaaggaggccactcgtattgagaacttcctgagccgcaagggtatccgcgttggtggtatccacggtgatttgcgacaggagcagcgaacaaggagtctcgaggcctttaagtctggacaaactcctgttcttgttgctactgatgtcgctgcccgtggtcttgatattcccgaggtcaagctcgttatcaacgttacattccccttgaccattgaggactacgtccaccgtatcggacgaaccggccgagctggcaagaccggccaggctatcactttctttactgttgaggacaagtctcactccggctctctcgtcaacattctccgaggtgccaaccagcccgtgcccgaggacctcctcaagttcggcaccactgttaagaagaaggctcacgacatgtacggcgctttcttcaaggatgtcgacatgaacgcaaagtccaccaagatcacatttgattag

SEQ ID NO: 38720 - protein, 581 aa, Gibberella zeae PH-1
MAATKHSLADSEDRPTKKTKVDSEEKARLKAEKRERKEKKKSQESEPSAENSDADRAAEKERKKAKKAKKLEKKQKLAEAEASAEPAAEVSDEAPKKSKKEKKTTTTEASSNSEAPSSGSYIQTIALSNVPQAEIDEFLSKNEIHITDPKTENVTLRPVLEFHQLPATNLLEKKPSPFANYKAPTPIQSASWPFTLSGRDVIGVAETGSGKTMAFALPCVEAISALKHKHTKAVVVSPTRELAMQTYEQMASVAALNRMKCVCLYGGASKDDQRNLLNRGADIIVATPGRLKDFMSDGTVDLSHSAFAVLDEADRMLDKGFEEDIKMILSSCPPREKRQTLMFTATWPQSVQTLAATFMVSPVKIAIGSGGKETAGGAVELQANARISQSVEVLEPRGKEFRLLEVLKEHQQGSKKNDRILVFCLYKKEATRIENFLSRKGIRVGGIHGDLRQEQRTRSLEAFKSGQTPVLVATDVAARGLDIPEVKLVINVTFPLTIEDYVHRIGRTGRAGKTGQAITFFTVEDKSHSGSLVNILRGANQPVPEDLLKFGTTVKKKAHDMYGAFFKDVDMNAKSTKITFD

SEQ ID NO: 38721 - DNA, 1461 bp, Gibberella zeae PH-1
  CDS (1)..(1461)
atgaacggcgcaaagaggagaaaggtcgcgcaagatacgcccagaaatacaaagcccgttgcccaagagaagcctgcccgggctgaacctaagccttccagcgacgaggaatccgaggaagagtctgcgactctagaggagccttcagcagaggagacggctgttgatgctcccaagaagaccttcaaggatctgggagtcaacgatgctctatgcgaagcctgtgagaagctcaactacaagtaccccacgcccattcaagaaaagtccatccccgtcgctctccagggccgagatatcattggtctcgccgaaacaggtagtggaaagacagcagcatttgccctgcctgttcttcaggcccttctcgacaagcctcagcctctcttcggtctcgtcctcgccccgactcgtgaattggcaacccagattggacaagcctttgaggctctcggttcgcttatctcattacgatgcgctgtaattgtcggaggtctggatatggttcctcaggcaattgcacttggaaagaagcctcacattgtcgttgcgacacctggtcgtcttgtggatcatcttgagaagaccaagggcttttccctgcgaactctcaagtacctgatcatggacgaggctgatcgtcttcttgacatggactttggacccagtattgacaagatcctcaagttcgttcctcgagagcgacgcacatacctcttctctgcaacaatcagctccaagatcgaaagcttgcagcgtgccagtttgagggatcccgtcaaagtgagcatcagctccaacaagtaccagaccgtctccaccctgctgcagaattacctcttcatccctcatccccagaaggatgtccatcttatctacttgatcaatgagcacgccggacagtctacaatcgtcttcacacgaaccgtgtgggagacgcagcgcgtttccatcttactacgaacacttggtttcggtgcaattccactccacggtcaactttctcagtcatcccgtctaggagccctcaacaagttccgttccggcacacgagatatcctggtcgccactgatgtcgccgcccgtggtctggatattccttcagtcgatgttgttctcaactacgatttgccccaggactccaagacatacatccacagagtcggacgaaccgctcgtgctggaaagtccggtgttgccatcagcttggtgacccagtacgatctcgagatctacctccgaatcgaggccgctctcggcaagaagctcgcggagtacccaacagagaaggaggaagttatggctttccagtcacgagtcgaggaggctcagcgaatcgctagaatcgaaatgaagtcgttcaccgaggagaggggcaagaagggcagcacattgaagggtggccgtggcaagaagggtggcaagagaggcagagatgacatggacagggaggagggataa

SEQ ID NO: 38722 - protein, 486 aa, Gibberella zeae PH-1
MNGAKRRKVAQDTPRNTKPVAQEKPARAEPKPSSDEESEEESATLEEPSAEETAVDAPKKTFKDLGVNDALCEACEKLNYKYPTPIQEKSIPVALQGRDIIGLAETGSGKTAAFALPVLQALLDKPQPLFGLVLAPTRELATQIGQAFEALGSLISLRCAVIVGGLDMVPQAIALGKKPHIVVATPGRLVDHLEKTKGFSLRTLKYLIMDEADRLLDMDFGPSIDKILKFVPRERRTYLFSATISSKIESLQRASLRDPVKVSISSNKYQTVSTLLQNYLFIPHPQKDVHLIYLINEHAGQSTIVFTRTVWETQRVSILLRTLGFGAIPLHGQLSQSSRLGALNKFRSGTRDILVATDVAARGLDIPSVDVVLNYDLPQDSKTYIHRVGRTARAGKSGVAISLVTQYDLEIYLRIEAALGKKLAEYPTEKEEVMAFQSRVEEAQRIARIEMKSFTEERGKKGSTLKGGRGKKGGKRGRDDMDREEG

SEQ ID NO: 38723 - DNA, 1206 bp, Gibberella zeae PH-1
  CDS (1)..(1206)
atggctgagggctcaggaattgatcgcaaggccgatgagaggatggagttttccacctctaaggaggttacagtccatcctactttcgagtctatgtcactgaaggagaacctccttcgcggtatctacgcttacggatacgagtctccttccgctgttcaatctcgagccatcgtccaggtctgcaagggtcgtgacaccatcgcccaggctcagtccggtactggaaagactgctaccttttccatcagtatgctgcaagtcatcgacaccgcggttcgcgagacacaggcccttgttctgtcgccgacacgagaattggcaactcagatccagtccgtcgtcatggcgctgggtgactacatgaacgtccaatgccacgcttgtatcggaggaacaaacgttggtgaagatatccgcaagctcgactacggccagcacattgtctctggtaccccaggccgtgtggcggacatgattcggcgacgacacttgcgcactagacatatcaagatgttggtcctcgatgaagctgacgagctcctcaacaagggattccgagagcagatctacgatgtttaccgataccttccccctgccacccaggttgtggtcgtcagtgccaccctgccttacgatgttctcgatatgactaccaagttcatgaccgatcccgttcgtattctcgtcaagcgtgacgaattgaccctcgaaggtctcaagcagtacttcatcgccgtcgagaaggaggactggaagtttgatactctatgcgatctctacgacaccctcactatcacacaagctgtcattttctgcaacacacgccgcaaggttgactggctcaccgacaagatgcgcgaggccaactttaccgtcagcagcatgcacggcgatatgccccagaaggagcgagacagcattatgcaggatttccgtcagggtaacagccgagtgctcatctcgactgacgtgtgggcccgtggtatcgatgtccagcaggtcagtctggtcatcaactacgacctgcccagtaaccgtgagaactacatccaccgtattggtcgtagtggacgattcggtcgcaagggtgttgctattaacttcgttaccaccgaagacgtgcgcatcttgagagatattgaattgtactattccacccagatcgatgagatgcccatgaacgttgccgatctcattgcttaa

SEQ ID NO: 38724 - protein, 401 aa, Gibberella zeae PH-1
MAEGSGIDRKADERMEFSTSKEVTVHPTFESMSLKENLLRGIYAYGYESPSAVQSRAIVQVCKGRDTIAQAQSGTGKTATFSISMLQVIDTAVRETQALVLSPTRELATQIQSVVMALGDYMNVQCHACIGGTNVGEDIRKLDYGQHIVSGTPGRVADMIRRRHLRTRHIKMLVLDEADELLNKGFREQIYDVYRYLPPATQVVVVSATLPYDVLDMTTKFMTDPVRILVKRDELTLEGLKQYFIAVEKEDWKFDTLCDLYDTLTITQAVIFCNTRRKVDWLTDKMREANFTVSSMHGDMPQKERDSIMQDFRQGNSRVLISTDVWARGIDVQQVSLVINYDLPSNRENYIHRIGRSGRFGRKGVAINFVTTEDVRILRDIELYYSTQIDEMPMNVADLIA

SEQ ID NO: 38725 - DNA, 1875 bp, Apis mellifera
  CDS (1)..(1875)
atggaacgagcgttggttcgttcggtgttggaaacatcgtttgatgaaggtggacgtagttatggaaaaggaagaggattcataatacaaaataacaataacgatgattggtctgtgggtaaaaaaaattccaatagtggaactataaatgaaagtgaattcaacgatgaaaattattggcaatgtaacgataaaaagaccgatattgaagaaactggtagaggtaaaggtagaggtcatggtaaaggaggatctagaggaagaggaggcaatcgtggaagaacaggatttaataataaaaataaagatggtgatgataataatgattacgaggataacgattatggtaatcaggataatagaaacgatagacgaaaaaaaacatttgctgctcgagaagataatgacgaagaagaagcacaaaagcctaaagaacaatatattccaccagaattacctaacgatgaaaagtcattatttgaaaatggtgtcgagataggcattaattttgataaatatgataatattcaggttaacgtgagtggagataatgtgcctcaaccgatagaaagtttcgaggcagctggccttagaaatattgttttagacaatataaaaaagtctggatataaaaaacctactcccgtacagaaacatgctttgccaattatcatgaatggtagagatttaatggcttgtgctcaaactggttcaggaaaaactgctgcgttcgcagtccctattataaatacattattagagagatctgtcgatttggttgtaacttcgacatattgcgaaccacaagttgtcatcgtgtcgcccactcgagaacttaccatacaaatatggcaacaaattgtcaaattttcgctcaattcaattttgaaaactgtagtcgcatatggtggaacatccgttatgcatcaaagaggaaagttgtctgctggttgccacatactcgtagcaacacctggaagattattagattttgtagaaaaaggaagagtaaaattttcttccgtacaatttctcgtattggatgaagctgaccgtatgttagacatgggatttttacctagtatcgaaaaaatggtggaccacgagactatggttcctttaggcgaaagacaaacgttaatgttttccgccactttcccggacgaagtgcaacatttggcaagaagatttttaaacaattatttgttccttgcggttggtatcgtaggtggagcttgttcagacgtggaacaaaacttttacgaagttgctagaaataagaaaaaagacttgctcaaagaaatattagaaagggaaaatgattcgggtacgttaggtggcactctagtattcgttgagatgaaaaagaaagccgattttattgccgttttcttatccgagaataattatcctaccaccagtattcatggcgatagattacagagacaaagggaagaagcattagccgatttcaaaagtggaaggatgtccattttagtagctacagcggtggctgcaagaggtttagacattaaaaatgtttcgcacgttataaattacgacttgccaaaagggattgacgagtacgttcatcgaattggaagaactggacgtgtaggaaatcgaggaagagcgacttctttcttcgatcctgaagaagatgcaccattgcgaggtgatcttgtcagaatattgaaacaagcaaatcaatccgtaccagattggatgatgggtggaaacgcgaataggaatttcatgcctggaagaggtataagcaaatttggaggtgaagatgttagagagtctgaagcattcgcggaagaatatacggaagaagcgtattccgtagcacaagaaccggaagaagaatggtag

SEQ ID NO: 38726 - protein, 624 aa, Apis mellifera
MERALVRSVLETSFDEGGRSYGKGRGFIIQNNNNDDWSVGKKNSNSGTINESEFNDENYWQCNDKKTDIEETGRGKGRGHGKGGSRGRGGNRGRTGFNNKNKDGDDNNDYEDNDYGNQDNRNDRRKKTFAAREDNDEEEAQKPKEQYIPPELPNDEKSLFENGVEIGINFDKYDNIQVNVSGDNVPQPIESFEAAGLRNIVLDNIKKSGYKKPTPVQKHALPIIMNGRDLMACAQTGSGKTAAFAVPIINTLLERSVDLVVTSTYCEPQVVIVSPTRELTIQIWQQIVKFSLNSILKTVVAYGGTSVMHQRGKLSAGCHILVATPGRLLDFVEKGRVKFSSVQFLVLDEADRMLDMGFLPSIEKMVDHETMVPLGERQTLMFSATFPDEVQHLARRFLNNYLFLAVGIVGGACSDVEQNFYEVARNKKKDLLKEILERENDSGTLGGTLVFVEMKKKADFIAVFLSENNYPTTSIHGDRLQRQREEALADFKSGRMSILVATAVAARGLDIKNVSHVINYDLPKGIDEYVHRIGRTGRVGNRGRATSFFDPEEDAPLRGDLVRILKQANQSVPDWMMGGNANRNFMPGRGISKFGGEDVRESEAFAEEYTEEAYSVAQEPEEEW

SEQ ID NO: 38727 - DNA, 1656 bp, Ustilago maydis 521
  CDS (1)..(1656)
atgacggcttccacctctaatgtttcgtcatcaaattctaagcttaagaagagcaaagcatcgtcgccttccgcatctccggaggtatcaacaccaagcactagcaacagcaatgacgaccaagatggacatgtcagtgaggacatgagcgatgccgaggaaggcgaaagtcaagagcatagtgccagtggaagcgggatcagtgatcatgacgatgacgacgacccttctgccgacaaggactcaccagcagcagacgaggaacaggacgagaaaaaggtagctaccattgccgatgatggcaagaaggttgagttctctgatcttggcgttattccgcaaatcgtcgaagcgtgcaccaacatgggcttcaagcatcccactcccatccaggtcaaggcgatccctgaagcgctccaagcacgcgacgttatcggtctcgcccaaactggttccggaaagaccgccgccttcacgatccccatccttcaagcattgtgggacaatcccaagcctttcttcgcatgcgtgctggcacctacgcgtgagctggcttaccagatatcgcagcaggtcgaagcgctcggctcgacgattggcgtacgttccgccaccatcgtgggtggtatggatatgatgtcgcagtcaatcgcgctctccaagcgtccacatgtgatcgttgccactcctggtcgtctgcaagatcatttggaaaacacaaagggttttagcttgcgtggattgcagtacctcgtcatggacgaagctgatcgattgctcgacatggacttcggacccatcatcgataagctgcttcagtccatcccacgcgagaggaggaccatgctgttcagcgctaccatgaccaccaaagtcgccaaattgcagcgtgcttcgctcaagaatcctgtgcgcgtcgaagtcgacaccaaatacaccaccgtatccacgctcaagcagcactacatgttcatgccgtttgcccacaaagacacgtacctggtgcaccttgccaacgaacaagcaggacactcgatcatcgtcttcacacgtaccgtgcacgattcacagcgactctcgatcctgttgcgtctactcgggtttcctgctatcccgcttcatggtcagctaagccagcaggcgcgtctcggtgcgctcaacaagttcaagactggcggtcgatcgattctcgtcgcaaccgacgtggcttctcgaggtctcgatattcctgcggtcgacttggtcgtcaactacgacatccccaccaactcgaaagactacatccatcgtgtcggtcgtacagcgcgtgccggtcgatcaggtcgttcagtcaccttggtgactcagtacgacgttgagctgcttcaacgcatcgaggctgtcatcggactcaagatgacagagttccccggaggaaacgacaaagaagccgtgatgctactgagcgaacgtgtcgccgaagcacatcgtgcagcggtgagagagttgaaggacaagggcgtaggaagtgcaggtggctcgggcaagcgaaagagaaagatggatggcaagtacggtgacgacatggaccgagacgacgatcaggttcaagctgggttgcccgtctctggaaatggacgacatcagaaccagaacaggaagaagggtcgtcgctga

SEQ ID NO: 38728 - protein, 551 aa, Ustilago maydis 521
MTASTSNVSSSNSKLKKSKASSPSASPEVSTPSTSNSNDDQDGHVSEDMSDAEEGESQEHSASGSGISDHDDDDDPSADKDSPAADEEQDEKKVATIADDGKKVEFSDLGVIPQIVEACTNMGFKHPTPIQVKAIPEALQARDVIGLAQTGSGKTAAFTIPILQALWDNPKPFFACVLAPTRELAYQISQQVEALGSTIGVRSATIVGGMDMMSQSIALSKRPHVIVATPGRLQDHLENTKGFSLRGLQYLVMDEADRLLDMDFGPIIDKLLQSIPRERRTMLFSATMTTKVAKLQRASLKNPVRVEVDTKYTTVSTLKQHYMFMPFAHKDTYLVHLANEQAGHSIIVFTRTVHDSQRLSILLRLLGFPAIPLHGQLSQQARLGALNKFKTGGRSILVATDVASRGLDIPAVDLVVNYDIPTNSKDYIHRVGRTARAGRSGRSVTLVTQYDVELLQRIEAVIGLKMTEFPGGNDKEAVMLLSERVAEAHRAAVRELKDKGVGSAGGSGKRKRKMDGKYGDDMDRDDDQVQAGLPVSGNGRHQNQNRKKGRR

SEQ ID NO: 38729 - DNA, 1194 bp, Ustilago maydis 521
  CDS (1)..(1194)
atgtccggtggtatcaatgcaggcgacagcaagctcgcctttgaaagctctgagcacgtcaaggtcgcaaccactttcgatgccatgggtttaaaggaagatctgcttcgtggcatctatgcgtacaattttgaaaaaccctcggcgatccagcaacgagcgatcctgcccatcattcgaggtcgcgatgtcatcgcacaggctcaatcaggaacgggcaaaaccgccacgttcagcatctcgatgctacaatctatcgacacaaccctcagagaaacacaagccctggtactcagtccaacgcgcgaattggccattcagatccagtcggtcgttcttgctctcggagactacttgaacgttcaatgtcacgcatgcattggcggtaccagcgtaggcgaagacattcgaaaactcgactacggtcaacacattgtctctggtacgcccggtcgagtctatgacatgattcgacgtcgacatttgcgcacaaaaaacatcaagatgctcatccttgacgaatctgacgaactgctcaacatgggcttcaaggatcagatttacgacgtttaccgttacctgccaccttcgacccaagtcgtgctcctctcggccactttaccgcaagatgtgctcgagatgacctccaagttcatgactgatcccgtccgcatcctagtcaaacgtgacgaattgactttggaaggcatcaaacaatttttcgtcgctgtcgaaaaggaagaatggaagttcgacaccctctgtgatctctacgacaccctcaccatcacacaagccgtcatcttttgcaacacgcgacgcaaagtggattggctctcggccaaaatgaaagagaacaactttcaggtgagcagtatgcacggagagatgcagcaaaaggaaagggatgaagttatggccgagttcagacagggcagctccagggtgttgatcaccacggatgtatgggcgagaggtatcgatatcgccaacatctcgttagtcatcaactatgatctgcctaccaacagggaaaattacatccacagaattggtcgaagtggaaggttcggcaggaagggtgtagctatcaatttcgttaccgtggacgacgtcagaaccttgagggatatcgaacagttttactccactcagatcgatgagatgcctgtcaagctggaggacatgttgtga

SEQ ID NO: 38730 - protein, 397 aa, Ustilago maydis 521
MSGGINAGDSKLAFESSEHVKVATTFDAMGLKEDLLRGIYAYNFEKPSAIQQRAILPIIRGRDVIAQAQSGTGKTATFSISMLQSIDTTLRETQALVLSPTRELAIQIQSVVLALGDYLNVQCHACIGGTSVGEDIRKLDYGQHIVSGTPGRVYDMIRRRHLRTKNIKMLILDESDELLNMGFKDQIYDVYRYLPPSTQVVLLSATLPQDVLEMTSKFMTDPVRILVKRDELTLEGIKQFFVAVEKEEWKFDTLCDLYDTLTITQAVIFCNTRRKVDWLSAKMKENNFQVSSMHGEMQQKERDEVMAEFRQGSSRVLITTDVWARGIDIANISLVINYDLPTNRENYIHRIGRSGRFGRKGVAINFVTVDDVRTLRDIEQFYSTQIDEMPVKLEDML

SEQ ID NO: 38731 - DNA, 1266 bp, Aspergillus nidulans FGSC A4
  CDS (1)..(1266)
atgttctccatcaccctccgtttcatctcctgttcgggcaaggatttttttcgcggtctggaggggcggcgggacaggaaaatctttgcactacccacggcgagacacggccagatcgagtctaactacgatgagatcaccgactccttcgactctatggagttgaagcctgagctgcttcgcggtgtctacgcctacggtttcgagcgtccctctgctattcagcagcgtgccatcctgcccatcgtcaagggcaacgatgtcatcgcccaggcccagtccggtactggaaagaccgctactttctccatctccgctttgcaaaagctcgaccccaacgtcaaggcttgccaggctctgattgtcgctcctacccgtgaattggcccagcagatccagaaggtcgtcatcgctatcggtgacttcatgaacatccagtgccacgcctgcattggtggtactgctgtccgtgatgacatgaacgctctccgtgagggccctcagatcgttgtcggtacccccggccgtatccacgacatgatccagcgtcgtgtcctcaagacagaccagatgaagatgttcattctcgacgaggccgatgagatgttgtctcgtggtttcaccgagcaaatctacgacatcttccagctccttccccagtccacccaggttgtcctgctctctgccaccatgccccaggacgttcttgaggtcaccaccaagttcatgcgtgacccagtccgtatcctggtcaagaagcaggaacttaccctcgaaggtatcaagcagttctacatcgctgttgagaaggaggagtggaagcttgacaccctctccgatctctacgagaccgtcaccatcacccaggccgtcatcttctgcaacacccgccgcaaggttgactggctcactgacaagctcactgcccgtgacttcactgtctccgccatgcacggtgacatggagcaggcccagcgtgatgttatcatgaaggagttccgctctggatcctctcgtgtcctcattgccactgaccttctggcccgtggtatcgatgtccagcaggtttccctggtcatcaactacgatctccccgccaaccgtgagaactacattcaccgtatcggtcgtggcggtcgtttcggtcgtaagggtgttgctatcaacttcgtcaccgctgacgatgtccgtatgatgcgtgagattgagcagttctacagcacccagattgaggagatgcccatgaacgttgctgacctcatctaa

SEQ ID NO: 38732 - protein, 421 aa, Aspergillus nidulans FGSC A4
MFSITLRFISCSGKDFFRGLEGRRDRKIFALPTARHGQIESNYDEITDSFDSMELKPELLRGVYAYGFERPSAIQQRAILPIVKGNDVIAQAQSGTGKTATFSISALQKLDPNVKACQALIVAPTRELAQQIQKVVIAIGDFMNIQCHACIGGTAVRDDMNALREGPQIVVGTPGRIHDMIQRRVLKTDQMKMFILDEADEMLSRGFTEQIYDIFQLLPQSTQVVLLSATMPQDVLEVTTKFMRDPVRILVKKQELTLEGIKQFYIAVEKEEWKLDTLSDLYETVTITQAVIFCNTRRKVDWLTDKLTARDFTVSAMHGDMEQAQRDVIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 38733 - DNA, 1398 bp, Aspergillus nidulans FGSC A4
  CDS (1)..(1398)
atgtcagccttgaaaaagcgcaagatcacggagaagcagccagagactaatagcgattctgaagccgagtccgtcagctctcgcggatctgccaaggatgaaacgcaaacctccggcgaagagccagctccagcaaagtccttcaaagagttaggaatcattgaccaactatgcgaggcttgcgagaacatgggctacaaggcaccgactccgattcaatcacaggcgattccgcttgcccttgagggccgtgatgtgattggcctcgcggaaacaggaagtggaaagacagccgctttcgccctcccaatgcttcaagctcttatggaggcgcctcaaacactctttggtctcgttctagcccccacccgagaactcgcataccagatatctcaagcttttgaaacgctcgggtcaacaatcggagttcgctgcgccgtcatcgtcggcggcatggacatggtagcgcaatccatcgcccttggcaaaaaacctcatattatagtcgcaaccccaggtcgattactagatcatctagagaacacaaagggcttctccctccgaaatctcaagtatctcgccatcgacgaagccgacagacttttggacatggactttggtgaatccctcgacaagatcattcgaatcctcccccgcacccgccacacctaccttttctccgcgacaatgagcaccaaagtcgaatccctccagcgtgcctctctttccaaccccgtccgcgtctctgtttccagcaaataccaaaccgtctcaacccttcaatcatcctatatctgtattccccacaagcacaagaatctctacctcgtctacctcctcaacgaatttgcgggtcagtccgcaatcatcttcacgacaactgttcacgaaactcagcgtgtcgcgtttatgctccgcgccttgggctttggcgccatccccctccacggccaattgtcccaatctgctcgtcttggtgccctaggcaagttccgctctcgcagtcgcgatattctcgttgccactgatgtcgctgctcgaggtcttgatatcccgtccgttgacgtcgtctttaactttgacctccccatggacagcaagacatatattcatcgtgttggacgtactgcacgtgcagggaagagtggagtagcaattagcttcgtcacacagtatgacgttgaagtttggcttcgtatcgagcatgcgctgtccaaaaaactgccggagtatcaggttgagaaggacgaggtcatggtcatgtcagagcgggttgcggaggcttcacggcaggctactattgagatgaagagctttgacgaaaagaagggggctagagggaagaagtttggcaaggggaagcgctcaagagatgatatggatcaggaagagggttaa

SEQ ID NO: 38734 - protein, 465 aa, Aspergillus nidulans FGSC A4
MSALKKRKITEKQPETNSDSEAESVSSRGSAKDETQTSGEEPAPAKSFKELGIIDQLCEACENMGYKAPTPIQSQAIPLALEGRDVIGLAETGSGKTAAFALPMLQALMEAPQTLFGLVLAPTRELAYQISQAFETLGSTIGVRCAVIVGGMDMVAQSIALGKKPHIIVATPGRLLDHLENTKGFSLRNLKYLAIDEADRLLDMDFGESLDKIIRILPRTRHTYLFSATMSTKVESLQRASLSNPVRVSVSSKYQTVSTLQSSYICIPHKHKNLYLVYLLNEFAGQSAIIFTTTVHETQRVAFMLRALGFGAIPLHGQLSQSARLGALGKFRSRSRDILVATDVAARGLDIPSVDVVFNFDLPMDSKTYIHRVGRTARAGKSGVAISFVTQYDVEVWLRIEHALSKKLPEYQVEKDEVMVMSERVAEASRQATIEMKSFDEKKGARGKKFGKGKRSRDDMDQEEG

SEQ ID NO: 38735 - DNA, 1497 bp, Aspergillus nidulans FGSC A4
  CDS (1)..(1497)
atggcaaaacgagagcaccaagatcagactggcgatagcagaccaagcaaaaaatctaaaggcacgaaagacacgaaaaaaaacactgaagtttcgccgccttattttcaatcccctgctcttgataatgttcctcaaacagaaattgataaatttctttctgaccattccatcaagataacggatgcctcagcagataaaccgtctctgcgcccaattatctcattttcattcttaccccccagcaataaagacctctacgctccgttagatggtttcgcctcgccgaccgctatccagtcggcaacatggccacttctgtttgcaggccgcgatgtcataggaattgcagagactggaagtgggaagactcttgcatttggtctaccgtgtctaaagaaggtgcttgatttgaagaccaaacaaaaatcatgcagaccacttgcagttgttatctccccgacaagagagctcgcaatgcagatttatgaccaacttgtgaagttcgcggaaaaagtggatattcaagtcgcctgcatatttggcggtgtcaagaaagacgaacagcgtgaagctttgaagtctgcagctgtggttgttgcaactcctggaaggttgaaagaccttcagaatgacggctctttggatttaggcagggtcaaatatcttgtcctagatgaagcagaccgtatgctagataaaggatttgagcaagacatcaaggatatcatctctcctatgccagtgtcaaaacgtcaaactgttatgttcacagcaacctggcctcctattgtcaggaaccttgcctctacatttatgacttctccagtcacggtcaccatcggtggtgacccgtctgcagatccacgtgcaaacagcaggattaaacaggttgtcgaagtggtaaaaccacacgagaaagagcaaagactagtgcaaattctgaacaggcatcagcgtggaactcctgataaagtgctcgccttctgcctttacaagaaggaggctatgcgggtcgagagactccttcgaaccaagggcttcaaggtagcgggtatacacggcgatttaagccagcaagaaagatttagaagcctcgaggcctttaaatcaggtgcggccaccgttctcgttgcaactgatgtcgcggctcgcggccttgacatacctcatgtgaaactggtcgtaaatgtcacttttccgctcactgtggaggactatgttcatcgaattggccgcaccggtcgcgctggggctgatgggcatgctataaccctgtttacggaaactgataaggcccagtctggcgcattgatcaatgttctgaaagcggctaatcaagaggtgcccgaagctctactcaagttcggctccaccgtcaagaagaagcagcatgacgcatatggcgccttcttcaaggatgttgagccgggaaaggcggctaccaagattcctacggatcttcgatcagtgtttgcccttgtgcaagatgattga

SEQ ID NO: 38736 - protein, 498 aa, Aspergillus nidulans FGSC A4
MAKREHQDQTGDSRPSKKSKGTKDTKKNTEVSPPYFQSPALDNVPQTEIDKFLSDHSIKITDASADKPSLRPIISFSFLPPSNKDLYAPLDGFASPTAIQSATWPLLFAGRDVIGIAETGSGKTLAFGLPCLKKVLDLKTKQKSCRPLAVVISPTRELAMQIYDQLVKFAEKVDIQVACIFGGVKKDEQREALKSAAVVVATPGRLKDLQNDGSLDLGRVKYLVLDEADRMLDKGFEQDIKDIISPMPVSKRQTVMFTATWPPIVRNLASTFMTSPVTVTIGGDPSADPRANSRIKQVVEVVKPHEKEQRLVQILNRHQRGTPDKVLAFCLYKKEAMRVERLLRTKGFKVAGIHGDLSQQERFRSLEAFKSGAATVLVATDVAARGLDIPHVKLVVNVTFPLTVEDYVHRIGRTGRAGADGHAITLFTETDKAQSGALINVLKAANQEVPEALLKFGSTVKKKQHDAYGAFFKDVEPGKAATKIPTDLRSVFALVQDD

SEQ ID NO: 38737 - DNA, 1200 bp, Aspergillus nidulans FGSC A4
  CDS (1)..(1200)
atggcggacggaattgacaggcgagccgatgacaaaatggagtttaacacctccaaggaggtcaccgttgctcccactttcgaggatatgcacctgaaggaaagccttctccgtggtatctacgcatacggatacgagtccccatcagctgttcagtcccgcgcgatcgtccagatctgcaaaggtcgcgatacaatcgctcaagcgcagtccggtaccggtaaaacggcgactttctcgatcagcgctctgcaagtcattgatacagttgttcgcgaaactcaagcacttgttctctctcccacccgtgaacttgcgactcagattcagtcggtcatcatggcccttggtgactacatgaacgttcaatgtcacgcttgtattggaggcacaaatatcggtgaagacattcgcaagctcgattacggtcaacacgttgtttctggcacacccggccgtgtcgccgatatgatccggagacgtcacctgcgcacgcgtcatatcaagatgttggtccttgatgaagctgacgaactcctcaaccgcggatttcgagaacagatttacgatgtctaccgttatctccccccagccacgcaagttgttgtcgtatccgctacgctcccctacgatgtgcttgatatgacgaccaaattcatgacagaccccgtccgtgtcctcgtcaagcgtgatgaattgacgctcgaaggcatcaagcaatacttcatcgctgtcgagaaggaagaatggaagttcgatactctatgcgacttgtacgatactttaactatcacacaagccgtcatcttctgcaacacccgtagaaaggtcgactggctcacggacaagatgcgcgaagccaacttcacagtatcaagcatgcatggagagatgccacaaaaggaacgagacagcatcatgcaggacttccgtcagggtaactcgcgagtgcttatctccactgacgtttgggcgcgtggtatagatgtccagcaagtttctcttgtcatcaactacgatctccccaccaaccgtgaaaactacatccaccgcatcggtcgaagcggtcgattcggtcgcaagggtgttgctataaactttgttacgagtgatgacgtgcgtatcctacgcgatattgaattatactactctacgcaaattgacgagatgcctatgaatgttgccgacctcctctcttaa

SEQ ID NO: 38738 - protein, 399 aa, Aspergillus nidulans FGSC A4
MADGIDRRADDKMEFNTSKEVTVAPTFEDMHLKESLLRGIYAYGYESPSAVQSRAIVQICKGRDTIAQAQSGTGKTATFSISALQVIDTVVRETQALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSDDVRILRDIELYYSTQIDEMPMNVADLLS

SEQ ID NO: 38739 - DNA, 2178 bp, Candida glabrata CBS138
  CDS (1)..(2178)
atgagtcttaagatgaaggggaagaagtacactgatttggattttgtgcctaccatcagtgacagtgaggaggatgttcctgatttggacagcgatgaggagaagcctaagcctgagacgaagggcaagaagaagaacaagtctgtggatgaggagagtgctgacatgaacagtgggtttcggttcaacactgatgatggcgagatcaacaccaattttgacgggtgggagtttttaggtgacgagaaggatgaggagaagaaggatgttgatctggacaagattatcaggaagaaaggtggtctaattggtatggctcatgtagacgaagctgagaagagtgagagtgaagagtctgagagtgatgatgaagacctggctatggatgggtttggtatgggtgcccaagagcaacctgaaggtgaagaggaggacgaggatgcatcaaacagtgaacaagagagcaatgacgaagaagaagacgacgacgaggaaacatacgatgtcggtgatgccggtgatgccgaggagaaagttgaagaagacacagctgaagagatgcaagctttctatgcgcctgaaagcgaaagtgaaaacgcaaagaaggaggtgcataagacattcaatgatctagcgttgtcgagacccgttatgaagggtttgagcaacctaggatacgtcaaaccatcgccaattcaaagtgccaccatcccaattgcattactaggtaaggatatcattgcaggtgccgtcacaggttccggtaagactgcagcattcatgattccaattatcgaacgtctactgtacaagccagctaaggttgcttccacgagagttattgtattaacacctacccgtgaattggctattcaagttgcagatgtaggtaaaaaaattggtcaatttgtcagtaatctaacattcggtctggctgttggtggtttgaatttgagacaacaagagcaaatgctgaagactaggccagatatagtcattgctactcctggtagatttatcgatcatatcaggaactccgcaagttttaatgtagactctgtggaagttctagtcattgatgaagctgatagaatgctagaagatggtttccaagatgaattgaatgaaattatgtccttgctacctagtaagagacagactctactattctcagccactatgaactcaagaatcaagcaattgatatctttgtcattgaagagaccagtgagaataatgatcgatcctccgaagcaagctgccactaaacttactcaagagtttgttcgtatccgtaaaagagatcacttaaaaccttcattactgttcaatttaataagaaagctggatccaaatggccagaaaagaattgtggtgtttgttgccagaaaagatatggctcacaaactgagaatcatactgggtctattaggtatggctgttgctgagcttcatggttcgctaacacaagaacaacgtctagactctgtgaataagtttaaatccttacaagtcccagtgttgatctgtaccgatttggcttccagaggtctagatattccaaagattgaagttgtcatcaattatgacatgccaaagagttacgaaatttatttgcatagagttggtagaactgccagagctggtagagaaggtcgttccattacttttgttggtgaagcatcagcagaaagaagtatagtaaaggatgccattagaggtgtcaatgatagtgagatacctggtagtaaagctgtgggtagaaatgtcgattggaaccaagtagaagagacaaacaagatagtagagaacatggaccagacagtccaagatattctagtagaggaaaaggaagagaaggaaattctccgggctgagatggagttgaagaaaggtgaaaaccttctgaaacataaggatgaaatccaatctaggccgaagagaacttggttccaatccgaaaaggagaagaagaactccaagatcatgggagctctttcaaagaccaagaaagaagtcaatagtaaaaagaggaagcgtaacgaagcaatggaagacggtcataagagatcatataagaaaactcaatctgaccgtactgctgatcaagagagaactatgaagaagcaggcaaaggccaatggtaaaaagaaaggtaagtcaaagggtaagagataa

SEQ ID NO: 38740 - protein, 725 aa, Candida glabrata CBS138
MSLKMKGKKYTDLDFVPTISDSEEDVPDLDSDEEKPKPETKGKKKNKSVDEESADMNSGFRFNTDDGEINTNFDGWEFLGDEKDEEKKDVDLDKIIRKKGGLIGMAHVDEAEKSESEESESDDEDLAMDGFGMGAQEQPEGEEEDEDASNSEQESNDEEEDDDEETYDVGDAGDAEEKVEEDTAEEMQAFYAPESESENAKKEVHKTFNDLALSRPVMKGLSNLGYVKPSPIQSATIPIALLGKDIIAGAVTGSGKTAAFMIPIIERLLYKPAKVASTRVIVLTPTRELAIQVADVGKKIGQFVSNLTFGLAVGGLNLRQQEQMLKTRPDIVIATPGRFIDHIRNSASFNVDSVEVLVIDEADRMLEDGFQDELNEIMSLLPSKRQTLLFSATMNSRIKQLISLSLKRPVRIMIDPPKQAATKLTQEFVRIRKRDHLKPSLLFNLIRKLDPNGQKRIVVFVARKDMAHKLRIILGLLGMAVAELHGSLTQEQRLDSVNKFKSLQVPVLICTDLASRGLDIPKIEVVINYDMPKSYEIYLHRVGRTARAGREGRSITFVGEASAERSIVKDAIRGVNDSEIPGSKAVGRNVDWNQVEETNKIVENMDQTVQDILVEEKEEKEILRAEMELKKGENLLKHKDEIQSRPKRTWFQSEKEKKNSKIMGALSKTKKEVNSKKRKRNEAMEDGHKRSYKKTQSDRTADQERTMKKQAKANGKKKGKSKGKR

SEQ ID NO: 38741 - DNA, 1482 bp, Candida glabrata CBS138
  CDS (1)..(1482)
atggcaggcaaagttggtaaagtatcaaagaagagcgatgatgttagttcactagctgctaaaattagggctagagcccttgagaatcaaaagaagatgcaagcggcttccagaaaggactctgaaagcgattccagcgatgaggaagttgagagacccgccaagaaacaagctaaggatgaaaaagtagaagaaccagaggaagaggtcacatttgaatcatttgctcaattgaacttagtacctgagttgattcaagcatgccaaaatttgaatttcactaagccaacacctattcaggccagagccattccaccggctttggctggtagtgatgttattggtttggcacaaacaggttcgggtaaaaccgcagcatttgctattccgatcttaaacaagttatgggaagaccagcagccatactatgcatgtgtactagcacctacaagagaactggctcaacagatcaaggaaacttttgactcattaggttctctgatgggtgtcagaaccacatgtattgttggtggtatgaatatgatggatcaagcaagagatttgatgcgtaaacctcatataattatcgctacacctggtagattaatggatcatttagagaacactaagggattctcgctgaaaaatttgaaattcttagtcatggatgaagccgatagattgttagacatggaatttggtccagtattagatagaattttgaagatcatacctacaaaaggtagaaccacttacctattctctgcgacaatgacttcaaagattgataaactacaaagggcaagtttaacaaacccagtgaaatgtgcagtctcaaataaataccaaactgtggatactttggtgcaaacgcttatggttgtgcctggtggcctaaagaacactttcttgatatatctattaaacgaatttattggtaaaacagttattatttttaccagaacaaaagccaatgcggaaagattatctgggctatgtaatctactagaattcagtgccactgcccttcatggtgacttgaatcaaaatcaaagaactggtgccttggatttgttcaaggcaggcaaaagatcaatattagttgctacggatgttgctgcaagaggtttagatattccatctgtcgatattgtcatcaattatgatattccagttgactctaaatcctatattcatagagtaggtagaacagcaagagctggtagatctggtaaatccatttccttagtttcacaatatgatttagaactgattctgagaatagaagaagtgttgggaaagaagctaccgaaggagagtgttgataaaaacattattttgacactgagggattctgtagataaagctaatggtgaagttgttatggagatgaatagaagaaataaggaaaagcaagctagagggaaaggtagaagaggtagaatgatggccaaagaaaacatggatagagaagaaaaataa

SEQ ID NO: 38742 - protein, 493 aa, Candida glabrata CBS138
MAGKVGKVSKKSDDVSSLAAKIRARALENQKKMQAASRKDSESDSSDEEVERPAKKQAKDEKVEEPEEEVTFESFAQLNLVPELIQACQNLNFTKPTPIQARAIPPALAGSDVIGLAQTGSGKTAAFAIPILNKLWEDQQPYYACVLAPTRELAQQIKETFDSLGSLMGVRTTCIVGGMNMMDQARDLMRKPHIIIATPGRLMDHLENTKGFSLKNLKFLVMDEADRLLDMEFGPVLDRILKIIPTKGRTTYLFSATMTSKIDKLQRASLTNPVKCAVSNKYQTVDTLVQTLMVVPGGLKNTFLIYLLNEFIGKTVIIFTRTKANAERLSGLCNLLEFSATALHGDLNQNQRTGALDLFKAGKRSILVATDVAARGLDIPSVDIVINYDIPVDSKSYIHRVGRTARAGRSGKSISLVSQYDLELILRIEEVLGKKLPKESVDKNIILTLRDSVDKANGEVVMEMNRRNKEKQARGKGRRGRMMAKENMDREEK

SEQ ID NO: 38743 - DNA, 1635 bp, Candida glabrata CBS138
  CDS (1)..(1635)
atgggttacagagacgctttatataacaaaactaactacaactctcgtggtggtgacttccgtggtggtagatcctccgatagaaatgactacaacagagacagaaaccaaggttactcccatggtggtctaagaggtcgtcacgatgatggtccaagagaattaatcaagccagattgggaatccgaacttcctaatctgcctccttttgaaaagaacttttacgttgagcatgaagttgttcgtaacagatctgatcaagaagttgctcaattcagaaaggaatctgaaatgaccattactggtcacgacattccaaagcctatcactacttttgatgaagctggtttcccagactacgttttaaaggaagttaaggctgaaggtttcgacaagccaactagtattcaatgtcaaggttggcctatggctctttctggtagagatatggttggtattgctgctactggttccggtaagactttgtcctactgtttaccaggtattgttcacatcaacgcacagccacttttgagtccaggtgatggtccaattgtcttggttctagctccaaccagagaacttgctgttcaaattcaaaaggaatgttccaagtttggtaagagttctagaattagaaacacatgtgtttacggtggtgttccaagaggtcaacaaatcagagagttgattagaggtgctgaaattgtcattgctaccccaggtagattgattgatatgcttgaagcaggtaagactaacttgaagagagttacttatctggttttggatgaagccgacagaatgttggatatgggttttgaacctcaaatcagaaagattgtagaccaaattagaccagacagacagactttgatgtggtcggctacctggcctaaggaagttcagcaattggctagggactatctaaatgatccaatccaggttcaaattggttctctagaattggctgcttctcacaacattacacaattggttgaagttgtttctgagtttgagaagagagacagattggttaaacatctagacactgcttctcaagacaaggaatccaagattttaatcttcgcttctaccaagagaacttgtgacgaaattacatcttacttgagacaagatggatggccagctcttgccattcatggtgacaaagatcaaagggaaagagactgggttctaaatgaatttagaactggtaactccccaatcatggttgcaacagatgttgctgccagaggtattgatgtcaagggtatcaacttcgttgttaactatgatatgccaggtaacattgaggattatgtgcacagaattggtagaactggtagagctggtgccactggtaccgctatttctttcttcaccgaagataacaaatctctaggtgccagtttgatctcgatcatgagagaagctaagcaaaacattcctgaagaactaatgaagtatgacagaagacctcgtggtcctcacccaagatacggtggtggttacggccgtggtggtcgtggttacggtggtggccgtggtggttacggtggccgtggtggtggtcgtggtggccgcggtggttttaacagatctagagacggtggttggggtaacagaagataa

SEQ ID NO: 38744 - protein, 544 aa, Candida glabrata CBS138
MGYRDALYNKTNYNSRGGDFRGGRSSDRNDYNRDRNQGYSHGGLRGRHDDGPRELIKPDWESELPNLPPFEKNFYVEHEVVRNRSDQEVAQFRKESEMTITGHDIPKPITTFDEAGFPDYVLKEVKAEGFDKPTSIQCQGWPMALSGRDMVGIAATGSGKTLSYCLPGIVHINAQPLLSPGDGPIVLVLAPTRELAVQIQKECSKFGKSSRIRNTCVYGGVPRGQQIRELIRGAEIVIATPGRLIDMLEAGKTNLKRVTYLVLDEADRMLDMGFEPQIRKIVDQIRPDRQTLMWSATWPKEVQQLARDYLNDPIQVQIGSLELAASHNITQLVEVVSEFEKRDRLVKHLDTASQDKESKILIFASTKRTCDEITSYLRQDGWPALAIHGDKDQRERDWVLNEFRTGNSPIMVATDVAARGIDVKGINFVVNYDMPGNIEDYVHRIGRTGRAGATGTAISFFTEDNKSLGASLISIMREAKQNIPEELMKYDRRPRGPHPRYGGGYGRGGRGYGGGRGGYGGRGGGRGGRGGFNRSRDGGWGNRR

SEQ ID NO: 38745 - DNA, 1197 bp, Kluyveromyces lactis NRRL Y-1140
  CDS (1)..(1197)
atgtcgttcaacagagatgatgactcgaagttgaagtttaagacttcaaagaagctcaaggtatctgccacttttgagtcgatgaacttgaaaccggatttgttacgaggcatatatttttacggctttgaatatccatcatccattcagtctagagccatttctcagattatctcaggaaaagatgtgattgcccaggcacagtctggtaccggtaagacggccacatttaccattggattattacaagcaattgattctaagagcaaagagttacaagcattggtcttatcaccaacaagagaactagcgagtcaaagtgaatctgtgatatctaacctaggagactatttgaacgttacagcacatgcgtgcacaggaggtaaggccttacaacaagatatcaagaaagtatcgaaaaattgtcaagtggtcagtggtacaccgggccgtgtactagatatgatcaagagacaagtattgaacgttagaaactgtaagatcttagttctcgatgaagcagatgaactactcggagaaactttggggtttaaacaacaaatctacgacattttcaccaagttaccaccgacgattcaagtcgtggtggtaagtgctacaatgagtaaagatatattagagatcaccaagaagttcatgagtgacccggtgaagatattggttaagcgggatgagatatccttggacgtgataaagcaatattatgtggatgtagaaaaggaagaatggaagtttgatacactctgtgatctatacgattcgttaacgataacacaatgtgtgatattctgtaatacaaggaaaaaagtggattggttatccaggaagttgacacagacgaatttctctgtgtcctcaatgcacggtgacatgaaacaggaagaacgtgatcaagtgatgaatgatttcaggagtggaaaagccagggtgctaatatcgacagacgtgtgggctcgtggtatcgatgtccagcagatctcattggtgataaactacgatataccagataatctagagaactatatccatcgtattggtagatccggacggtttggacgtaaaggtgttgcaataaatttcatcacgaaggaggaaagacccaaattgaaagagatcgaatcgcactatagaattaagatcaaaccaactcctgcaaatttagaagagttgtcgtga

SEQ ID NO: 38746 - protein, 398 aa, Kluyveromyces lactis NRRL Y-1140
MSFNRDDDSKLKFKTSKKLKVSATFESMNLKPDLLRGIYFYGFEYPSSIQSRAISQIISGKDVIAQAQSGTGKTATFTIGLLQAIDSKSKELQALVLSPTRELASQSESVISNLGDYLNVTAHACTGGKALQQDIKKVSKNCQVVSGTPGRVLDMIKRQVLNVRNCKILVLDEADELLGETLGFKQQIYDIFTKLPPTIQVVVVSATMSKDILEITKKFMSDPVKILVKRDEISLDVIKQYYVDVEKEEWKFDTLCDLYDSLTITQCVIFCNTRKKVDWLSRKLTQTNFSVSSMHGDMKQEERDQVMNDFRSGKARVLISTDVWARGIDVQQISLVINYDIPDNLENYIHRIGRSGRFGRKGVAINFITKEERPKLKEIESHYRIKIKPTPANLEELS

SEQ ID NO: 38747 - DNA, 1464 bp, Kluyveromyces lactis NRRL Y-1140
  CDS (1)..(1464)
atggctaaaatcgaaaagaagcaagcagttaaaaacaatcaggtcctttcattagctgagaagatcaagagaaaggcattggagaagcagcagcaagcacatgctaacgaaccttccccatccgacgaagattcagcacaaagtaacagtaaagattctaattccaatgaacaaccagaagaatcagaagaaatcttcgaatcgttcacagagctagatcttgtgcctgagcttattgaagcttgtaaaaaccttaactacaacaagccaacgccaatccaatcaaaggctattcctcccgctttgaaaggtagtgatatcattgggttagcccaaacaggttccggtaaaacagcggcatttgcaattcctatcttgaaccaactatggcacgatcaacaaccttattatgcgtgtattttggctcctactagagaattagcgcaacagattaaggagacgtttgattctttaggatctcttatgggtgttagatcaacttgtattgttggtggtatgagtatgatggaccaagctcgtgatttaatgcggaagccacacatcataattgccacacctggtagattaatggaccatctggaaaatactaaaggtttcaatttacgtaaattgaagtaccttgttatggatgaagctgatagattattagacatggaattcggacctgtgctagaccgtatcttgaatatcattcctacacaaggtagaactacatatttgttctctgcaacaatgacttcgaagattgataaacttcaaagagcatcacttacgaatccagttaaatgtgcagtatccaacaaataccaaacagtggacactttagtccaaactttgatggtggtccctggagggttgaagaacacttttttgatatatcttttgaatgaatttattgggaagtcaaccatcgtgtttactagaactaaggcaaacgctgagagaatatctaacctctgcaatctattggaatttagtgcgacggcattacatggggacttgaatcaaaatcagagaacaggagcattagatttattcaaagctggaaaaaggtcgattctagtagcaacagatgttgctgcaagaggtttagatattccgtctgtggatatcgtcataaattacgacatcccggttgactctaaatcttatatacatcgtgttggtagaactgcgagagctggacgttctggtaaatccatatctttggtctcccaatatgatctagagctaatcttaagaattgaagatgtgttgggtaaaaagttgccgaaggagaatgttgacaaggatgcgattcttgcactcagagattctgttgataaagcaaacggtgaagttgtgatggaattgaatagaagaaacaaagagaaacaagccagaggtaagggaagacgaggcagaatggcaacaagagacaatatggatagagaagaaagatag

SEQ ID NO: 38748 - protein, 487 aa, Kluyveromyces lactis NRRL Y-1140
MAKIEKKQAVKNNQVLSLAEKIKRKALEKQQQAHANEPSPSDEDSAQSNSKDSNSNEQPEESEEIFESFTELDLVPELIEACKNLNYNKPTPIQSKAIPPALKGSDIIGLAQTGSGKTAAFAIPILNQLWHDQQPYYACILAPTRELAQQIKETFDSLGSLMGVRSTCIVGGMSMMDQARDLMRKPHIIIATPGRLMDHLENTKGFNLRKLKYLVMDEADRLLDMEFGPVLDRILNIIPTQGRTTYLFSATMTSKIDKLQRASLTNPVKCAVSNKYQTVDTLVQTLMVVPGGLKNTFLIYLLNEFIGKSTIVFTRTKANAERISNLCNLLEFSATALHGDLNQNQRTGALDLFKAGKRSILVATDVAARGLDIPSVDIVINYDIPVDSKSYIHRVGRTARAGRSGKSISLVSQYDLELILRIEDVLGKKLPKENVDKDAILALRDSVDKANGEVVMELNRRNKEKQARGKGRRGRMATRDNMDREER

SEQ ID NO: 38749 - DNA, 2247 bp, Kluyveromyces lactis NRRL Y-1140
  CDS (1)..(2247)
atggctgttaagaagtttagatcattcgatgattttgttcctacaattagtgatagcgaagaagatgttccagatttagatgcttctgatgacgaaatggaaaagaagccagtgaagtcctcaaaaactaagaacaaatctaaaaagaaggccaagcaacaacagggatctcacttggacgaagatgtccatgaagatttgaatccagaattccaattctccattgacagcggagaagttaccaccaactttgcaggctgggatttccaaggtgatgagaagagtgatgaagttgagaaaaaagatgtcgatctagatgggatcattagaagaaaaggtggtttgattatgatggctgctacaggcagtgatgccgaagaaagcctatcagaagagtccgaagaagaaccagaagaaggagacgaacctggcgagagtgatgatgaagatgaattagctttggatgggttcggtatgggtgtcaagagaaaggcaacagaggaaaatgaagaagatgaagaggatgaagaagaagaggatgacgacgaagatgacgacaaaaagaccgaaatgagtcaggcagatttaggtaagggaaaagacgaagatgaagacattgaagaagacactaaagaagaaatggctgaattttatgctccagaagaggaaagtgcggatgctaaaaagatcgttcataaaactttcaacagcttgtcgttatcccgtcctgtgttgaaagggcttggaagtttaggatacaccagtccttctccaattcaaagtgctgctattcctattgcccttcttggtaaagatatcattgccggtgctgttacaggttctggtaaaacagctgcttttatgattcctatcatcgaacgtttgttgtacaaacctgcacatattgcatcaacaagggttgttgtactaactccaacccgtgaattggctattcaagtggctgatgttggtaaaaatatcggtaagtttgttaacggactaacgtttggtttggccgtcggtggtttgaatttaagacaacaagaacaagcattgaagaccagacctgatatcgtaattgccacaccaggtagatttatcgatcatttaagaaattctgcgagtttcagcgttgattcagttgaaatcttggtcattgacgaagctgatagaatgttagaagaaggtttccaagaggaactacaagaaatcatgtctctcattccaagtaagagacaaactctgttgttttctgctacaatgaactcaaaaattaagcaattaatctcgctatctctaaagaagcctgttaggattatgattgatcctccaaaacaagcagcagataaattgacacaggagttcatccgtatacgtaaaagagatcatctcaaaccggcattattatatcaattgattagaaagttggacaatacaagccagaagagaatagtagtttttgttgctaggaaagaaactgcccataaactgagaatcgtccttgggttattgggtatgcaagttggtgaattgcatggttcgttaacccaagaacaacgtctacagtctgttaataacttcaaatccttacaagtaccagtcttaatctgtaccgatttagcttcgagaggtttagatattccaaaaattgaagtggttatcaatttcgatatgccaaaaacttacgaaatttacttacacagagttggtcgtactgccagagcgggtagagaaggtcgttcagtaacctttgtaggcgaatcatctcaagatagaagtattgtcagaagtgcgatcagatcagtggaagaaaacgctgaaagtggaaaggccttgagtagaaacgttgactggacacaagtcgagcaagtcaacagcttgattggagcaaagggtgatgttgtagaggagattattgaagaagaaaagcaagagaaagagatacttagagctgaaatggaacttcgcaaaggtgaaaacatgctaaaacacaaggaagaaatcagtgcaaggccaagaagaacctggtttcaatcagaagctgagaagaagaactctaaaatgcttcaagttttggcaaaaaacaaaaagccaatcaacagtaagaagagaaaacagcaagaagcattggctgagaatcctcggctatataaaaagacacaaaaagatcgtgtcgaatatcaggaacgtcaatacagcaagaagcaagctgcctacggaaagaagggaaagaagggtaagaaataa

SEQ ID NO: 38750 - protein, 748 aa, Kluyveromyces lactis NRRL Y-1140
MAVKKFRSFDDFVPTISDSEEDVPDLDASDDEMEKKPVKSSKTKNKSKKKAKQQQGSHLDEDVHEDLNPEFQFSIDSGEVTTNFAGWDFQGDEKSDEVEKKDVDLDGIIRRKGGLIMMAATGSDAEESLSEESEEEPEEGDEPGESDDEDELALDGFGMGVKRKATEENEEDEEDEEEEDDDEDDDKKTEMSQADLGKGKDEDEDIEEDTKEEMAEFYAPEEESADAKKIVHKTFNSLSLSRPVLKGLGSLGYTSPSPIQSAAIPIALLGKDIIAGAVTGSGKTAAFMIPIIERLLYKPAHIASTRVVVLTPTRELAIQVADVGKNIGKFVNGLTFGLAVGGLNLRQQEQALKTRPDIVIATPGRFIDHLRNSASFSVDSVEILVIDEADRMLEEGFQEELQEIMSLIPSKRQTLLFSATMNSKIKQLISLSLKKPVRIMIDPPKQAADKLTQEFIRIRKRDHLKPALLYQLIRKLDNTSQKRIVVFVARKETAHKLRIVLGLLGMQVGELHGSLTQEQRLQSVNNFKSLQVPVLICTDLASRGLDIPKIEVVINFDMPKTYEIYLHRVGRTARAGREGRSVTFVGESSQDRSIVRSAIRSVEENAESGKALSRNVDWTQVEQVNSLIGAKGDVVEEIIEEEKQEKEILRAEMELRKGENMLKHKEEISARPRRTWFQSEAEKKNSKMLQVLAKNKKPINSKKRKQQEALAENPRLYKKTQKDRVEYQERQYSKKQAAYGKKGKKGKK

SEQ ID NO: 38751 - DNA, 1665 bp, Kluyveromyces lactis NRRL Y-1140
  CDS (1)..(1665)
atgagtttcggcggtggaagagatcatcaatttaacagaaacaacatgggcagcactcatggtgacttccgtggtagcagaggttctgacagaaacagctacaacagaggtaatgacttccgcggtggccgtagctttggtcgtggtccatctcgtgataccagagttgatttggtcgctccaaactgggacgaagaactaccaaatttgccagttttcgaaaagaatttttaccaagaacatccagatgttgctcaaatgagtgaaagtgaagttatcgaatttagaaaggaaaacgaaatgaccatttctggtcatgacgttccaaaacctatcagaagttttgatgaagctggtttcccatcttatgtcttggatgaagttaagcaagaaggtttcgccaaaccaactggtattcaatgccaaggttggcctatggctttgtctggtagagatatgattggtgtcgctgcgaccggttccggtaagaccttatcatactgtttaccaggtatcgttcatattaatgctcaacctttgctatctccaggtgatggtccaattgttttggtattggctccaaccagagaattagctgttcaaattcaaaaagaatgttccaaatttggtgcttcctctagaattagaaacacttgtgtctatggtggtgttccaaagtctcaacaaatcagagatttacagagaggtgtagaaatcctgattgctactccaggtagattgattgacatgttggaaattggtaagacaaacttgaaaagagtcacttaccttgtcttggatgaagctgatagaatgttggatatgggtttcgaacctcaaatcagaaaaattgtcgatcaaattagacctgatagacaaactttgatgtggtccgctacttggccaaaggaagttaaacaattggcaagtgactatttgcatgatccaattcaagttcaaattggttctttggaattgtctgcatcccacacaatcactcagatcgtcgaagtccttactgatttcgaaaagagagatagattggccaagcatttggaaaccgcttctcaagatcaagactccaagatcatcatttttgcttccactaagagaacttgtgatgagatcacttcttatttgagaactgaaggctggccagctttggccattcacggtgacaaggctcagaacgagcgtgattgggttttggctgagtttaggtccggtagatctcctatcatggtagcaactgatgttgctgctagaggtattgacgtcaagggtattaattacgttatcaattacgatatgccaggcaacatcgaagattatgtgcatagaattggtagaactggtagagccggttctactggtactgccatctccttcttcactgaaggcaataaatctctgggtgctgctttgatcaagattatgagagaagctaaacaagatattccagaagaactaagaagatacgacaggggtcaatacggccaacatccaagatatggtggcggccgtggtggtcgtggctttggtggtggccgtggtggccgtggctttggtggccgtggtgatggtggttacggtggtggtggttacggtggtggccgtggcggcttcggtggaaacagatccagagaccaaggctggagacgttag

SEQ ID NO: 38752 - protein, 554 aa, Kluyveromyces lactis NRRL Y-1140
MSFGGGRDHQFNRNNMGSTHGDFRGSRGSDRNSYNRGNDFRGGRSFGRGPSRDTRVDLVAPNWDEELPNLPVFEKNFYQEHPDVAQMSESEVIEFRKENEMTISGHDVPKPIRSFDEAGFPSYVLDEVKQEGFAKPTGIQCQGWPMALSGRDMIGVAATGSGKTLSYCLPGIVHINAQPLLSPGDGPIVLVLAPTRELAVQIQKECSKFGASSRIRNTCVYGGVPKSQQIRDLQRGVEILIATPGRLIDMLEIGKTNLKRVTYLVLDEADRMLDMGFEPQIRKIVDQIRPDRQTLMWSATWPKEVKQLASDYLHDPIQVQIGSLELSASHTITQIVEVLTDFEKRDRLAKHLETASQDQDSKIIIFASTKRTCDEITSYLRTEGWPALAIHGDKAQNERDWVLAEFRSGRSPIMVATDVAARGIDVKGINYVINYDMPGNIEDYVHRIGRTGRAGSTGTAISFFTEGNKSLGAALIKIMREAKQDIPEELRRYDRGQYGQHPRYGGGRGGRGFGGGRGGRGFGGRGDGGYGGGGYGGGRGGFGGNRSRDQGWRR

SEQ ID NO: 38753 - DNA, 1611 bp, Debaryomyces hansenii CBS767
  CDS (1)..(1611)
atgtcatacaacaacaacagtgatagctacggtggtggttacaattcatatggtggtaactcatatggtggtggtggttacggtggtggccgtggcggtggccgtggtggattcggtggccgtggtggtggccgttacgatgaaagagtagaattaaacacccctgagtgggatattgattcattgccaaaattcgaaaagaacttctataacgaacatccagatgtgactgctcgttccgttcaagatgtcaacgcctttagaaaggaacatgacatgaaatgtgatggtactgacattccaaagccaattactagctttgacgaagctggattcccagactacgttttaaaggaagttaagcaacaaggatttccaaagccaacctcgattcaatgtcaagggtggcctatggctttaagtggtagagatatggttggtattgcttctaccggttccggtaagactttatcgtactgtttaccatctattgttcacatcaacgcccaaccattgttgagtcctggtgatggtcctattgtattggttttggctccaaccagagaattggcggttcaaattcaacaagaatgttccaagtttggttcttcttctagaattagaaacacctgtgtctacggtggtgctccaaagggtcaacaaatcagagatttagccagaggtgttgaaatttgtattgctactcctggtagattgattgatatgttggaaactggcaagactaacttgagaagagtcacctacttagttttagatgaagctgatagaatgttagatatggggttcgaacctcaaatcagaaagattgtcgatcaaattagacctgatagacaaactttgatgtggtctgctacttggccaaaggaagttcaagccttaactagagattacttgaacgatccaattcaggtcaccgttggttcattagagttagctgcttcccacacaattactcaattagttgaagttgttactgaatttgaaaagcgtgacagattaatcaagcatttggaaacggctactgctgatccagaagctaagtgtttaattttcgcttctactaagagaacttgtgatgaaatcactaactacttaagagccgatggatggcctgcattagccattcatggtgacaaacaacaaggtgaaagagactgggtcttaaaggaattcaagaccggtaaatctccaattatggttgcaaccgatgttgcagcccgtggtattgatgtcaagggtatctcttacgtcattaacttagatatgcctggtaatatcgaggattacgtccatcgtattggtagaaccggtagagccggttctaccggtactgcggtttccttcttcaccgataacaactctaagttaggtggtgatttatgtaaaatcatgagagaagctaaccaaaccattcctcctgaattaatgagattcgatagaagaagtttcggtagtcacataagatacggtagaggtggtggccgtggtggtttcagaggtggccgtggtcgcggtggtttcagaggtggccgtggaggttaccaatctggttccaacagtgctccactcggtaacgcccgtcgttactaa

SEQ ID NO: 38754 - protein, 536 aa, Debaryomyces hansenii CBS767
MSYNNNSDSYGGGYNSYGGNSYGGGGYGGGRGGGRGGFGGRGGGRYDERVELNTPEWDIDSLPKFEKNFYNEHPDVTARSVQDVNAFRKEHDMKCDGTDIPKPITSFDEAGFPDYVLKEVKQQGFPKPTSIQCQGWPMALSGRDMVGIASTGSGKTLSYCLPSIVHINAQPLLSPGDGPIVLVLAPTRELAVQIQQECSKFGSSSRIRNTCVYGGAPKGQQIRDLARGVEICIATPGRLIDMLETGKTNLRRVTYLVLDEADRMLDMGFEPQIRKIVDQIRPDRQTLMWSATWPKEVQALTRDYLNDPIQVTVGSLELAASHTITQLVEVVTEFEKRDRLIKHLETATADPEAKCLIFASTKRTCDEITNYLRADGWPALAIHGDKQQGERDWVLKEFKTGKSPIMVATDVAARGIDVKGISYVINLDMPGNIEDYVHRIGRTGRAGSTGTAVSFFTDNNSKLGGDLCKIMREANQTIPPELMRFDRRSFGSHIRYGRGGGRGGFRGGRGRGGFRGGRGGYQSGSNSAPLGNARRY

SEQ ID NO: 38755 - DNA, 1917 bp, Oryza sativa (japonica cultivar-group)
  CDS (1)..(1917)
atgcgatcttcatgggctgactcagctgcgaacgccgaggaatcggcgcccgcggctgctgctaaccacggcaactcgcgcctcccgcgcagctcatacgttcccccgcacctccgcggccaagcggctcctgcagcgccggcgcaagctggcgcgctgccctcggccgccgccgccgcgcagccttctgttggccagcctggtgtggttggtggccctcgctgggcgggcattgtgaatggtggtggtggtggtggtggtgggagcgtaggtggttctcgccagggctttggtgctggtggccgcggtggaggaggtggtggtggcggtggtgcatggaactcccgccctgggggttgggaccgaagagaccgtgaaccggatccttttgccaatagtgaggctgcggaagttgactttgagggcgagaacactggcatcaattttgaagcctatgaagacatccctgttgagacaagtggccatgatgtgcccccaccagccaatacatttgcggagattgatttgggtgacgcgctgaatgagaatatcagaaggtgcaaatatgtgaagccgacaccagtgcagcgttatgccatcccaatctccattgcaggacgggatctcatggcctgtgcacaaacaggatctggaaagacagcagccttttgtttccctatcatcagtggaatcatgaggtcaaggccaccccccaggtcacggggttccaggaccgcatatcctcttgcactaatcctatctcccactcgtgagctttcggtccaaatccatgaagaagcaaggaagtttgcataccagactggtgttaaagtggtcgttgcatacggaggagcgccaattactcagcagctgagggagttagaaagaggtgttgaaatccttgtggcaactcctggccgcttaatggatttgttggagagggctagagtctcactgcagatgataaagtatttagctcttgatgaagctgatcgaatgcttgatatgggatttgagccccagatacgtaaaatagttgagcagatggacatgcctccacgtggagagaggcagacgatgttgtttagtgctacatttccaaaggagatacagagaatggcttcagatttcctcgccgattacatatttcttgctgtcgggagagttggttcaagtactgatttaattgtccagagggttgagtttgtccttgatgctgacaaaagaagctacctcatggaccttcttcatgcacaaagggcaaatggtacacatgggaagcaagctcttaccttggtctttgtggagacaaagaggggagctgatgccctggagaactggctttataacaatgggttcccagcaactagcattcatggagacagaacacaacaggaaagagagtatgccctgagatccttcaagagtggagcaactcccatcctcgtggcaactgatgttgctgctcgtggactggatatacctcatgttgcccacgtcattaattttgacctcccaaatgatatagacgactatgtccatcggataggaaggacagggcgtgcagggaaatctggtctggcaactgcatttttcaacgagagcaacaccccactggcaaggccgctgagtgagctcatgcaggaggctaaccaggaggttcctcaatggcttgagaggtatgctgcccgttcatcgtttggaggcggcggcgggagaaaccgcaggtcaggtggtggtgctaggtttggtggccgggacttccgacgagacagaggcagtggtggtggagggtatggtggtggaggtggaggttatggaggtggcggatatggtggtggtggcggtggaggcggctatggtggcggtagcagctacggaggtggcgggcaaggtttttctagtgcttgggactga

SEQ ID NO: 38756 - protein, 638 aa, Oryza sativa (japonica cultivar-group)
MRSSWADSAANAEESAPAAAANHGNSRLPRSSYVPPHLRGQAAPAAPAQAGALPSAAAAAQPSVGQPGVVGGPRWAGIVNGGGGGGGGSVGGSRQGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 38757 - DNA, 1443 bp, Yarrowia lipolytica CLIB99
  CDS (1)..(1443)
atggccaaggcgacggaaaaacgagtgaagcgagcaaagaaggaggagagcgggtccgagtccgaggacaacgatgccatcgcgcaggaaatcctcgacaccaccaagtccgacaacgaggaagaagagcccaagaagagctccaagaactacacctcggtggaggtggatgagagtgaggagcaaaccaagaccttcaaggatctgggcgtgattgactccatctgtgagacctgcgaggagctcaaattcaccaaacccacacccattcaggcccagagtatcccgtacgccctcgagggacgagacatcatcggtttggcccagactggttccggtaagacggccgcctttgccatccccgttctgcagagtctgtacgagaacccccagccgctgtactgtgtggtgctagcccccactcgagagctggcgtaccagatcagcgagacgtttgaggcgttgggctctgccatgggtctgcgaaccgctgtggttgtgggaggtatgaacatgatgacacaggcggtggcgctgtccaagaagcctcatgtgattgtcgcaacccctggacgtctggtggaccatctggagaacacaaagggattttcgctgcgaaccctcaagttcctggtcatggacgaagccgaccgactgttggatatggagtttggaccttctctggacaagattctcaaggtcatcccccgacaacgaaacacatatctcttctctgccaccatgacctccaaggtcgagaagctgcagcgagcctctctggtggaccctgtccgagtggccgtttccacaaagtaccagactgcagacaacctgttgcagtacatggtcttctgtcccttcaagcacaaggacacacatctggtctacctcgtgtccgagaacgcgggcaactcgatgattatctttgcccgaaccaagtccgacacccagcgaatttctctgctgctgcgaaaccttggatacggcgctattcctctgcatggagatctgagtcagaccgcgcgacttggagctctcaacaagttcaaaagtggatctcgaaacattctgatcgccaccgacgttgcctctcgaggtcttgatatccccgccgtggacctggtcatcaactacgacatccccagcgactccaagtcgtatatccatcgagttggacgaactgcccgagctggtcgggccggcaaatctgtggctctggtttcgcagtacgatctcgagctttatctgcgaatcgagggcgctctaggcaagaagctggactcgtatcctctggagtccgaggctgtcatgctcttttctgagcgagtggccgaggcttctcgagctgccattcaggagatgaagggcgaggatggaactaagaagcgaagcaagtttgacaagaagagacgacgagacgagatggacattggagagcagtag

SEQ ID NO: 38758 - protein, 480 aa, Yarrowia lipolytica CLIB99
MAKATEKRVKRAKKEESGSESEDNDAIAQEILDTTKSDNEEEEPKKSSKNYTSVEVDESEEQTKTFKDLGVIDSICETCEELKFTKPTPIQAQSIPYALEGRDIIGLAQTGSGKTAAFAIPVLQSLYENPQPLYCVVLAPTRELAYQISETFEALGSAMGLRTAVVVGGMNMMTQAVALSKKPHVIVATPGRLVDHLENTKGFSLRTLKFLVMDEADRLLDMEFGPSLDKILKVIPRQRNTYLFSATMTSKVEKLQRASLVDPVRVAVSTKYQTADNLLQYMVFCPFKHKDTHLVYLVSENAGNSMIIFARTKSDTQRISLLLRNLGYGAIPLHGDLSQTARLGALNKFKSGSRNILIATDVASRGLDIPAVDLVINYDIPSDSKSYIHRVGRTARAGRAGKSVALVSQYDLELYLRIEGALGKKLDSYPLESEAVMLFSERVAEASRAAIQEMKGEDGTKKRSKFDKKRRRDEMDIGEQ

SEQ ID NO: 38759 - DNA, 1188 bp, Yarrowia lipolytica CLIB99
  CDS (1)..(1188)
atggccgacggactcaccgacatcgattcttcccagatcaccaccaactacgacgaggttgttacctctttcgacgaccttggactcaaggacgagctgctccgaggtatctacggttacggttttgagaacccttcctccattcagcagcgagccatcctgcccgtcatcaagggtaacgatgtccttgcccaggcccagtctggtactggtaagactgccaccttctctatctctgctctgcagaacattgacgagaagattaagaagccccaggctctgatcattgcccccactcgagagctggcccaccagatccagaaggttgtccttgcctttggcgagtacatgaagattgagtgccacgcctgcattggtggtacctccgtcgccgaggacatccgagtcatccaggagggtgtccacgtcattgtcggaacccccggtcgaatccacgatatgattgagcgacgaatcctcaagaccgacctcatcaagatgttcatccttgatgaggccgatgagatgctttctcgagagttcaaggaccccatctacgatatcttcaccaccctccccgagaccacccagaccgttctgctgtctgccaccatgcccgctgaggtcctcgacatcaccggcaagttcatgcgagaccccgtccgaattcttgtcaagaaggatgagctgacccttgaaggtatcaagcagttctacattgatgttgagcaggagtcctacaagtttgaggttctgtgcgatctctacgagaccatcaacgtttctcaggccgtcattttctgcaacacccgacgaaaggtcgactacctgacccaggctctgaccgaggctgacttcaccgtctcctccatgcacggtgagaccgagcagtctcagcgagatgtcattatgaaggctttccgaaccggttcttctcgaatcctcatcactaccgatctgcttgcccgaggtatcgatgtccagcaggtttctctggtcatcaacttcgacctgccctccaaccgagagaactacatccatcgaattggtcgaggtggacgattcggccgaaagggtgttgccatcaacttcgtcacctccgaggaccacggtatgctcaaggagctcgagcgattctactccactgagatcgttgagatgcccaccaacattgccgatcttatttaa

SEQ ID NO: 38760 - protein, 395 aa, Yarrowia lipolytica CLIB99
MADGLTDIDSSQITTNYDEVVTSFDDLGLKDELLRGIYGYGFENPSSIQQRAILPVIKGNDVLAQAQSGTGKTATFSISALQNIDEKIKKPQALIIAPTRELAHQIQKVVLAFGEYMKIECHACIGGTSVAEDIRVIQEGVHVIVGTPGRIHDMIERRILKTDLIKMFILDEADEMLSREFKDPIYDIFTTLPETTQTVLLSATMPAEVLDITGKFMRDPVRILVKKDELTLEGIKQFYIDVEQESYKFEVLCDLYETINVSQAVIFCNTRRKVDYLTQALTEADFTVSSMHGETEQSQRDVIMKAFRTGSSRILITTDLLARGIDVQQVSLVINFDLPSNRENYIHRIGRGGRFGRKGVAINFVTSEDHGMLKELERFYSTEIVEMPTNIADLI

SEQ ID NO: 38761 - DNA, 1659 bp, Yarrowia lipolytica CLIB99
  CDS (1)..(1659)
atgtcttacggtgacgattacaacaacaacgaccgaggctacggcggcggacgaggcttcggcggaggccgaggtggccgaggtggttcccgaggcggtcgaggcggcttcggtggcgatcgaggtttcggaggtgaccgaggcggctacggcggcggaggctaccaggacaacgactttggcaacctgcccaagcaggactgggaccttgagaagctccctcagtttgagaagaacttctacaaggaggaccctgctgtcactgagcgaaccgacgaggaggtcactgccttccgaaaggagaaccagatgaccctgcacggagacggtatccctaagcccgtgaccaactttgacgaggctggtttccccccttacgtcctcaaggaggtcaagcagcagggtttcgagaagcccactgccattcagtgccagggatggcccatggccctgaccggacgagatgtcattggtatcgcttccaccggttccggtaagactctgtcttactgcctgcccgccattgtccacatcaacgcccagcccatgctgtcccacggtgacggacccatcgtcctggtcctcgcccccacccgagagctggctgttcagattcagcaggagtgctccaagttcggcaagtcttccaagattcgaaacacctgtgtctacggaggtgttccccgaggccagcagattcgagaccttgcccgaggtgtggagattgtcattgccactcccggccgacttctcgatatgctcgagtccggaaagactaaccttcgacgagtgacctacctggttctcgatgaggccgaccgaatgctcgatatgggtttcgagcctcaaattcgaaagattgtcgaccagattcgacccgaccgacagaccctcatgtggtctgctacctggcccaaggaggtccagcgactggcccacgactacctcaaggaccagattcaggtcaacattggttctctggagttgtctgcctctcacaacatcacccaggttgtggaggtctgcaccgagtacgagaagcgagaccgacttgtcaagcacctcgagaccgtcatggagaacaaggagtccaagtgtctgattttcaccggcaccaagcgtgtcgctgacgacattaccaagttcctgcgacaggacggctggcctgctctcgccattcacggtgacaagcagcagcaggagcgagactgggttctcaacgagttccgacagggcaagagccccatcatggttgccaccgacgtggcttcccgtggtattgatgtcaagggtatcaacttcgttatcaactacgactacccctccaactccgaggactatgtccaccgaatcggtcgaactggtcgagccggcaccaagggtaccgcttacacctacttcaccgaggacaaccgaaagcaggcccgagaccttctcgtcatcctgcgagaggccaagcagcatatcgaccccaagctggaggagatgggcggtggccgaggtggccgaggaggctggggaggccgaggcggtcgaggcggccgtggcggccgtggtggttaccgacgaggtggctacggcggcggtggctatggtggaggacgaggttccgacatcaccggctccaactccgctcctctttccaactcccgatggtag

SEQ ID NO: 38762 - protein, 552 aa, Yarrowia lipolytica CLIB99
MSYGDDYNNNDRGYGGGRGFGGGRGGRGGSRGGRGGFGGDRGFGGDRGGYGGGGYQDNDFGNLPKQDWDLEKLPQFEKNFYKEDPAVTERTDEEVTAFRKENQMTLHGDGIPKPVTNFDEAGFPPYVLKEVKQQGFEKPTAIQCQGWPMALTGRDVIGIASTGSGKTLSYCLPAIVHINAQPMLSHGDGPIVLVLAPTRELAVQIQQECSKFGKSSKIRNTCVYGGVPRGQQIRDLARGVEIVIATPGRLLDMLESGKTNLRRVTYLVLDEADRMLDMGFEPQIRKIVDQIRPDRQTLMWSATWPKEVQRLAHDYLKDQIQVNIGSLELSASHNITQVVEVCTEYEKRDRLVKHLETVMENKESKCLIFTGTKRVADDITKFLRQDGWPALAIHGDKQQQERDWVLNEFRQGKSPIMVATDVASRGIDVKGINFVINYDYPSNSEDYVHRIGRTGRAGTKGTAYTYFTEDNRKQARDLLVILREAKQHIDPKLEEMGGGRGGRGGWGGRGGRGGRGGRGGYRRGGYGGGGYGGGRGSDITGSNSAPLSNSRW

SEQ ID NO: 38763 - DNA, 1194 bp, Yarrowia lipolytica CLIB99
  CDS (1)..(1194)
atggccgagtttgatagagatctcgatgacgagctggagttcaagacgtccaaggacgtggacgtgacgcccaccttcgagtcgatggatctcaaggacgaccttctgcggggaatctacgcgtacggcttcgaggctccctctgccatccagtctcgagccatcacacagatcatcaagggtcgagataccattgcacaggcacagtccggaacgggaaagacagccactttctctatttcgatgttggaggtgattgacaccaagcatcgggaaacacaggccatggttctttctccgacacgagaactggccacccagatccagagcgtcattctggctctgggcgactacatgaatgtccagtgccatgcttgcattggtggaacgtcgttgtcggtggacatgaagaagctggaggctggtcagcaggtggtttctggaacccccggacggtgtctggatatgatcaagaagggctgtcttcgaaccaagaacctcaagatgttgattctcgatgaggccgacgagctactaaacaagggctttcaggagcagatctacgacatttacagatacctgcctgcagccactcaggtagtggttgtcagtgctactttgcctcactctgttctcgagatgacctccaagttcatgactgatccggtccgaattctggttaagcgagacgagctgacgctggagggactcaagcagtactttattgctgttgagcaagaagagtggaagtttgacacgctgtgcgacctgtacgacacactgactattactcaggccgtcatcttctgcaacacgaaaaagaaggtggactggctgacacagcagatgaaagacaacaacttcaccgtgtgttcgatgcacggagatatggctcagaaggaccgagactcgatcatgaacgagttccgaagcggcaggagccgggtactcatctccactgacgtttgggcccgaggtatcgatgttcagcaggtgtcgctggtcatcaattatgacctgcctcccaaccgagagaattacatccatcgaatcggtcgatccggtcgatttggccgaaagggtgtggcgatcaactttgctactaacgatgatatcaccactctgagagatatcgagcagtattatagtactcagatcgatgagatgccggtgaacgtgacggatatgatgtaa

SEQ ID NO: 38764 - protein, 397 aa, Yarrowia lipolytica CLIB99
MAEFDRDLDDELEFKTSKDVDVTPTFESMDLKDDLLRGIYAYGFEAPSAIQSRAITQIIKGRDTIAQAQSGTGKTATFSISMLEVIDTKHRETQAMVLSPTRELATQIQSVILALGDYMNVQCHACIGGTSLSVDMKKLEAGQQVVSGTPGRCLDMIKKGCLRTKNLKMLILDEADELLNKGFQEQIYDIYRYLPAATQVVVVSATLPHSVLEMTSKFMTDPVRILVKRDELTLEGLKQYFIAVEQEEWKFDTLCDLYDTLTITQAVIFCNTKKKVDWLTQQMKDNNFTVCSMHGDMAQKDRDSIMNEFRSGRSRVLISTDVWARGIDVQQVSLVINYDLPPNRENYIHRIGRSGRFGRKGVAINFATNDDITTLRDIEQYYSTQIDEMPVNVTDMM

SEQ ID NO: 38765 - DNA, 2256 bp, Pan troglodytes
  CDS (1)..(2256)
atggtacttgcgcaaagacgacgaggaggctgcgaaaagttaagggccggaccgcacgctgtgctcgcttccggaagtggcttctgcgacaacatgcttgcggacctcggcttaatcgggaccataggcgaggatgacgaggtgccggtggagcccgagtctgactccggggacgaggaagaggaggggcccattgtgctgggcagacgacaaaaagccttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggagaaggagaaagaagcaaaggaaggctctgaaccaaaggagcaggaagaccttcaagagaatgatgaggaaggctcagaagatgaagcctcggagaccgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttacaaaccccgccaggctccagtcacccgcgtgctggtgctagtgcccacccgagaactgggcatccaggtgcactctgtcaccagacagctggcccagttctgcaacatcaccacctgcctggctgtgggcggcttagatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctcccttcctgcggcaggagttcatccggatccggcctaatcgtgaaggagaccgggaagccattgtggcagctttgttgacgaggaccttcactgaccatgtgatgctgttcacgcaaaccaagaagcaggcccaccgcatgcacatcctcctggggctcatggggctgcaggtgggcgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcggaagcccagatcaatacagcaaagcggctcctggagaaggggaaggaggcagtggtccaagagcctgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagtgaccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccaggtga

SEQ ID NO: 38766 - protein, 751 aa, Pan troglodytes
MVLAQRRRGGCEKLRAGPHAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTVTKKQKQGKKSVFDEELTNTSKKALKQYRAGPSFEERKQLGLPHQRRGGNFKSKSR

SEQ ID NO: 38767 - DNA, 2127 bp, Oryza sativa (japonica cultivar-group)
  CDS (1)..(2127)
atggcgtcggcggcggcggcggcggcgacggcgagggggccgcggtacgcgccgccagatccgacgctgcccaagccgtggagggggctcatcgacggcaacaccgggtacctctacttctggaacccggagaccaaggccgtgcagtacgaccgccccacggcgccgccgccctcctcccccccggcgcagcagcctccggagaggcctaggaacagcgatcctgctgagtcgcaggcgcaggctggagcgagccgaacgcagaatgctgctcctgctgatgatagggcaaggaatgatcatttgaatgatcatttcgagcggcgcacggaagcggcgggaagtcatgcgcagaacgtgcctttcactgagcaaaatactaggagcaacccttcttcgcagccgtgctctgcagctggagtataccctgcacagaatgtattttcagaggctgccagtggagaccgcacctcaccagaagcgtatcgtgctaagcacgagatcactattgtcggaaatgaggctccagctccattcatgacatttcagtccacaggtttccctccagagattctaagggaggtacagcaagcgggattctctgcaccaactcctatccaagctcaatcatggccaattgctcttaggaatcgtgatattgtagctgtggcgaagacaggttccggaaaaacactgggttatctcattccagggtttatccttcttaagcgccttcaacataattcaagggatggtccaacggtattagtgctttctccaacaagggaattggcaacacaaatccaagatgaagcgaaaaagtttgggagatcgtcaagaatatcgtctgtttgtttatatggaggtgctcctaaaggtcctcagctaagagatctagagcgtggtgcagacattgtggttgcaactcctggaagattgaatgacattttagaaatgcgaagagtgagcctacatcaagtatcttatcttgttcttgatgaggctgaccgcatgcttgatatgggttttgagccacaaataagaaaaattgtgaaacaagtacaacccaaacgacagactcttatgttcactgccacttggccaaaagaggtgaggaaaatagcctcagatttgctgtccaatccagtccaagttaacattgggaacactgatcaactggttgccaataagtcaatcactcagtatgtggatgttatcacacctccggagaaatcgaggcggcttgatcaaatcctaaggtcacaggaacctggatcgaaaatcataatattttgctccacaaagaggatgtgtgatcagctggctcgaaacctagcacggcagtatggtgcttctgctattcatggtgataaatcacaagccgagagggattctgtgttgagtgaatttcgaagtggcagatgccctattcttgttgctactgatgtggctgcccgaggcttggacataaaggatatcagagttgtggtcaactacgatttcccaacaggtgttgaggattacgtccatagaattgggagaacaggacgggctggagcgactggagttgcctatacattcttctgtgatcaggattcaaagtatgcttcagatctcgtgaagattttggagggtgcaaaccagtctgtttcgcaacagttgagagatatggtctcccgtggagggtatggtggaaggtcacggcgctgggcatcttcagatgactcttatggtggtcgaggatatgattcaggctatacttcaaggtcgactgacaactataacagtggttatggcagtcagtctgggaatggttctagctttcatagtagcttccataacagcaacagtggcaatcagtttggcgatacttctggcttccaaaccagctttcataacagcagcagcaacaatcaaaccagtgacaatccaagctttcatgccagcagcaacaacgatcaacctggtgatggtctcagctttcatgccaggttctatagctcttctcgaggcagcgatcagagcagaacaaacaatgctggctttcgtgatagaagtaggagtcctccaagcaatcgcaaccatgaagatcctgggtccaaggctgttggtgtctccaactggtaa

SEQ ID NO: 38768 - protein, 708 aa, Oryza sativa (japonica cultivar-group)
MASAAAAAATARGPRYAPPDPTLPKPWRGLIDGNTGYLYFWNPETKAVQYDRPTAPPPSSPPAQQPPERPRNSDPAESQAQAGASRTQNAAPADDRARNDHLNDHFERRTEAAGSHAQNVPFTEQNTRSNPSSQPCSAAGVYPAQNVFSEAASGDRTSPEAYRAKHEITIVGNEAPAPFMTFQSTGFPPEILREVQQAGFSAPTPIQAQSWPIALRNRDIVAVAKTGSGKTLGYLIPGFILLKRLQHNSRDGPTVLVLSPTRELATQIQDEAKKFGRSSRISSVCLYGGAPKGPQLRDLERGADIVVATPGRLNDILEMRRVSLHQVSYLVLDEADRMLDMGFEPQIRKIVKQVQPKRQTLMFTATWPKEVRKIASDLLSNPVQVNIGNTDQLVANKSITQYVDVITPPEKSRRLDQILRSQEPGSKIIIFCSTKRMCDQLARNLARQYGASAIHGDKSQAERDSVLSEFRSGRCPILVATDVAARGLDIKDIRVVVNYDFPTGVEDYVHRIGRTGRAGATGVAYTFFCDQDSKYASDLVKILEGANQSVSQQLRDMVSRGGYGGRSRRWASSDDSYGGRGYDSGYTSRSTDNYNSGYGSQSGNGSSFHSSFHNSNSGNQFGDTSGFQTSFHNSSSNNQTSDNPSFHASSNNDQPGDGLSFHARFYSSSRGSDQSRTNNAGFRDRSRSPPSNRNHEDPGSKAVGVSNW

SEQ ID NO: 38769 - DNA, 2280 bp, Oryza sativa (japonica cultivar-group)
  CDS (1)..(2280)
atggcgtcggcggcggcggcggcggcgacggcgagggggccgcggtacgcgccgccagatccgacgctgcccaagccgtggagggggctcatcgacggcaacaccgggtacctctacttctggaacccggagaccaaggccgtgcagtacgaccgccccacggcgccgccgccctcctcccccccggcgcagcagcctccggagaggcctaggaacagcgatcctgctgagtcgcaggcgcaggctggagcgagccgaacgcagaatgctgctcctgctgatgatagggcaaggaatgatcatttgaatgatcatttcgagcggcgcacggaagcggcgggaagtcatgcgcagaacgtgcctttcactgagcaaaatactaggagcaacccttcttcgcagccgtgctctgcagctggagtataccctgcacagaatgtattttcagaggctgccagtggagaccgcacctcaccagaagcgtatcgtgctaagcacgagatcactattgtcggaaatgaggctccagctccattcatgacatttcagtccacaggtttccctccagagattctaagggaggtaagtgcacacaatttacatgactatttaatgcattttcttgtatccttctcgaaagaaattaggaggtcattgtgcgttcatactacgtatgtgataactacgctggatgttcatctcagcaggctcttcaagtcaacaatctatgtcaaggtacagcaagcgggattctctgcaccaactcctatccaagctcaatcatggccaattgctcttaggaatcgtgatattgtagctgtggcgaagacaggttccggaaaaacactgggttatctcattccagggtttatccttcttaagcgccttcaacataattcaagggatggtccaacggtattagtgctttctccaacaagggaattggcaacacaaatccaagatgaagcgaaaaagtttgggagatcgtcaagaatatcgtctgtttgtttatatggaggtgctcctaaaggtcctcagctaagagatctagagcgtggtgcagacattgtggttgcaactcctggaagattgaatgacattttagaaatgcgaagagtgagcctacatcaagtatcttatcttgttcttgatgaggctgaccgcatgcttgatatgggttttgagccacaaataagaaaaattgtgaaacaagtacaacccaaacgacagactcttatgttcactgccacttggccaaaagaggtgaggaaaatagcctcagatttgctgtccaatccagtccaagttaacattgggaacactgatcaactggttgccaataagtcaatcactcagtatgtggatgttatcacacctccggagaaatcgaggcggcttgatcaaatcctaaggtcacaggaacctggatcgaaaatcataatattttgctccacaaagaggatgtgtgatcagctggctcgaaacctagcacggcagtatggtgcttctgctattcatggtgataaatcacaagccgagagggattctgtgttgagtgaatttcgaagtggcagatgccctattcttgttgctactgatgtggctgcccgaggcttggacataaaggatatcagagttgtggtcaactacgatttcccaacaggtgttgaggattacgtccatagaattgggagaacaggacgggctggagcgactggagttgcctatacattcttctgtgatcaggattcaaagtatgcttcagatctcgtgaagattttggagggtgcaaaccagtctgtttcgcaacagttgagagatatggtctcccgtggagggtatggtggaaggtcacggcgctgggcatcttcagatgactcttatggtggtcgaggatatgattcaggctatacttcaaggtcgactgacaactataacagtggttatggcagtcagtctgggaatggttctagctttcatagtagcttccataacagcaacagtggcaatcagtttggcgatacttctggcttccaaaccagctttcataacagcagcagcaacaatcaaaccagtgacaatccaagctttcatgccagcagcaacaacgatcaacctggtgatggtctcagctttcatgccaggttctatagctcttctcgaggcagcgatcagagcagaacaaacaatgctggctttcgtgatagaagtaggagtcctccaagcaatcgcaaccatgaagatcctgggtccaaggctgttggtgtctccaactggtaa

SEQ ID NO: 38770 - protein, 759 aa, Oryza sativa (japonica cultivar-group)
MASAAAAAATARGPRYAPPDPTLPKPWRGLIDGNTGYLYFWNPETKAVQYDRPTAPPPSSPPAQQPPERPRNSDPAESQAQAGASRTQNAAPADDRARNDHLNDHFERRTEAAGSHAQNVPFTEQNTRSNPSSQPCSAAGVYPAQNVFSEAASGDRTSPEAYRAKHEITIVGNEAPAPFMTFQSTGFPPEILREVSAHNLHDYLMHFLVSFSKEIRRSLCVHTTYVITTLDVHLSRLFKSTIYVKVQQAGFSAPTPIQAQSWPIALRNRDIVAVAKTGSGKTLGYLIPGFILLKRLQHNSRDGPTVLVLSPTRELATQIQDEAKKFGRSSRISSVCLYGGAPKGPQLRDLERGADIVVATPGRLNDILEMRRVSLHQVSYLVLDEADRMLDMGFEPQIRKIVKQVQPKRQTLMFTATWPKEVRKIASDLLSNPVQVNIGNTDQLVANKSITQYVDVITPPEKSRRLDQILRSQEPGSKIIIFCSTKRMCDQLARNLARQYGASAIHGDKSQAERDSVLSEFRSGRCPILVATDVAARGLDIKDIRVVVNYDFPTGVEDYVHRIGRTGRAGATGVAYTFFCDQDSKYASDLVKILEGANQSVSQQLRDMVSRGGYGGRSRRWASSDDSYGGRGYDSGYTSRSTDNYNSGYGSQSGNGSSFHSSFHNSNSGNQFGDTSGFQTSFHNSSSNNQTSDNPSFHASSNNDQPGDGLSFHARFYSSSRGSDQSRTNNAGFRDRSRSPPSNRNHEDPGSKAVGVSNW

SEQ ID NO: 38771 - DNA, 1554 bp, Thermus thermophilus HB27
  CDS (1)..(1554)
gtgggcccggaaaggcagagcatggagtttaaagactttcccctgaagccagagatcctggaagccctccacgggcgcggcctcaccacccccacccccatccaggcggcggcgctccccttggccctggagggcaaggacctcatcggccaggcccgcacgggcaccggcaagaccctggccttcgccctgcccatcgccgaaaggcttgcgccaagccaggagagggggcggaagccccgggccctcgtcctcacccccacgcgggagctcgccctccaggtggcctccgagctcaccgccgtggctccccacctgaaggtggtggccgtctacgggggcaccgggtacggcaagcagaaggaggccctcctccggggggcggacgcggtggtggccaccccggggcgggccctggactacctgcggcagggggtcttggacctctcccgggtggaggtcgccgtcttggacgaggcggacgagatgctctccatgggctttgaggaggaggtggaggccctcctttccgccacgcccccttcccgccagaccctcctcttctccgccaccctcccctcctgggcgaaaaggctcgccgagcgctacatgaaaaaccccgtcctcatcaacgtcatcaaggacgagcccgtcacctacgaggaggaagcggtcccggccccggtgcgggggcggcttgaggtcctctccgaccttctttacgtggcctcccccgaccgggccatggtcttcacccggaccaaggcagagacggaggaaatcgcccaaggccttttgcgcttgggccacccggcccaggccctccacggggacctctcccagggcgagcgggaacgggtcctgggggccttccgccaaggggaggttcgggtcctggtggccacggacgtggccgcccgcggcctggacatcccccaggtggacctggtggtgcactaccgcctgcccgaccgggcggaggcctaccagcaccgctcgggccgcacgggccgggcgggccggggagggcgggtcgtcctcctctacgggcccagggagcgccgggacgtggaggccttggagcgggcggtggggcgccgcttcaagcgggtgaacccccctaccccggaggaggtcctcgaggccaagtggcgccaccttttggcccgcctcgcccgggtgccggagaaggactaccgcctttatcaggacttcgcgggccgcctcttcgccgagggccgggtggaggtggtggccgccctcctcgccctcctcctgggcggggcgcccgcggagcggagcctcctcaccggggaggaggggtggcgcacctacaaggccacggggccgaggctctccctgccccggctcgtggccctcttgaaggggcagggcctcgaggtgggcaaggtggccgaggccgaggggggcttctacgtggacctccgccccgaggcccggccggaggtggccggcctccggctggagcctgccaggagggtggagggcctcttggagatcccttcccgcacgaggcgcccggccagggcgtag

SEQ ID NO: 38772 - protein, 517 aa, Thermus thermophilus HB27
MGPERQSMEFKDFPLKPEILEALHGRGLTTPTPIQAAALPLALEGKDLIGQARTGTGKTLAFALPIAERLAPSQERGRKPRALVLTPTRELALQVASELTAVAPHLKVVAVYGGTGYGKQKEALLRGADAVVATPGRALDYLRQGVLDLSRVEVAVLDEADEMLSMGFEEEVEALLSATPPSRQTLLFSATLPSWAKRLAERYMKNPVLINVIKDEPVTYEEEAVPAPVRGRLEVLSDLLYVASPDRAMVFTRTKAETEEIAQGLLRLGHPAQALHGDLSQGERERVLGAFRQGEVRVLVATDVAARGLDIPQVDLVVHYRLPDRAEAYQHRSGRTGRAGRGGRVVLLYGPRERRDVEALERAVGRRFKRVNPPTPEEVLEAKWRHLLARLARVPEKDYRLYQDFAGRLFAEGRVEVVAALLALLLGGAPAERSLLTGEEGWRTYKATGPRLSLPRLVALLKGQGLEVGKVAEAEGGFYVDLRPEARPEVAGLRLEPARRVEGLLEIPSRTRRPARA

SEQ ID NO: 38773 - DNA, 1548 bp, Parachlamydia sp. UWE25
  CDS (1)..(1548)
atgacccaagattcaattattgagcaagatttagcttttgagcaatttggtttaaaagcccccattttacaagcattgcaagaagctggttttaaaatagcaagtcctattcaaaaacaagcaattcccgtcgtattagcagggcatgatgtagttgctcaggcgcacacaggaacaggaaaaacagctgcatttggtttgccagctttacacctaatccatgataacccaggctctcaacttttagtattaacccccacgcgtgaattagccagtcaagtaagtgatgagttatttcgtttagggaggcatttaggaattcgtacagcaacaatttgtggcggtaaatcctttagacctcaaattgaagctttacagcgcggggttcaagttattgtggctacacccggtcgattacaagatcttttagaatctgatagcttacctgattttcggcccgctattgtcgttttagatgaagcggatgaaatgttagacatgggatttttagaagcaatccaaagaatcttcacttttttaccagcaaagagacaaactttacttttttcggcgacaatgccctcagctatccaaaaattagctcaccaaatattaaaaaagcctattttcatcagcgtcacgcaaaaagagacgacaaataaagatatcaagcaagtttattatgttattcgtgaagatgaacgcgacgatgcaattttacgtttgttagacagtgaagaacctgctaaatcaattattttttgccgaacaaaaaaagatgttgatcgtttatcaacaacgttagtggctaatggctatcatgctcgaggtttacatggtgatatggaacaaccacaacgagaagaggttattcgccattttcgttctgaacaaattcgtgttttagtcgcaactgacgtggctgctagaggtttaagtgtttcagacgtttctcatgtctttaattaccatctcccttttgatcctgccagctatgttcatagaattgggcgtacaggtagagcgggaaataaaggggtggcgagtaccttcgtcacacttagagaatggcgagaatttcaaagatatgaaaaagtgactggtgctcctattaatcgagaaattattccaactcttgaagatgtaaaaaagttaaagagacaaaaacttgtaagtcgaattcaaaatcaaccccttcatcaagaaactgaattagttttagaattgatgaaagaagtcgatcattcaactttggtctctaagtttatttcatttgttttggagcaagagactattcaaggtccagatcgaattggtgtagagccaaggggtcaagaaagggatacgagagggcaacgcactgacaaatttaatgatgagcgtcgccgagctaatcgaccccaacaaaaatttgggaaagctaacgggttcaaaaaagagcatgataaaggctttaaaaaaacttttgggcaaaaaaatcgtgcaagtcacccaagtaaagtacccagttcagcagctggttttaaagaacgtacacgttctatttaa

SEQ ID NO: 38774 - protein, 515 aa, Parachlamydia sp. UWE25
MTQDSIIEQDLAFEQFGLKAPILQALQEAGFKIASPIQKQAIPVVLAGHDVVAQAHTGTGKTAAFGLPALHLIHDNPGSQLLVLTPTRELASQVSDELFRLGRHLGIRTATICGGKSFRPQIEALQRGVQVIVATPGRLQDLLESDSLPDFRPAIVVLDEADEMLDMGFLEAIQRIFTFLPAKRQTLLFSATMPSAIQKLAHQILKKPIFISVTQKETTNKDIKQVYYVIREDERDDAILRLLDSEEPAKSIIFCRTKKDVDRLSTTLVANGYHARGLHGDMEQPQREEVIRHFRSEQIRVLVATDVAARGLSVSDVSHVFNYHLPFDPASYVHRIGRTGRAGNKGVASTFVTLREWREFQRYEKVTGAPINREIIPTLEDVKKLKRQKLVSRIQNQPLHQETELVLELMKEVDHSTLVSKFISFVLEQETIQGPDRIGVEPRGQERDTRGQRTDKFNDERRRANRPQQKFGKANGFKKEHDKGFKKTFGQKNRASHPSKVPSSAAGFKERTRSI

SEQ ID NO: 38775 - DNA, 1734 bp, Desulfovibrio vulgaris subsp. vulgaris str. Hildenborough
  CDS (1)..(1734)
atgacccaagaaccgaacatgcccgaagacgccgtcgcgcccgaagaagacagggccgcgcgcgtcgcggcagagataaccggtatcgacgagcccgaagacgccctgccttcagtacagtttgccgacctcgcgccgcggctgcaggaggcctgcatccgcgcgggctggcagagtctcatgcccgttcaggcccacgccctgccctatctcttcgacggacgcgacctcatggtgcagtcgcgcaccggcagcggcaagacaggggcctttctgcttccccttctcgaacgtctcgaccccgccgaagcctccacacaggcactggtgctggtgcccacccgcgaactcgcccttcaggtcgaacacgaggcccgcaccctcttcgagggcacgggactgcgcgttgccgccgtctatggcggcgtcggctacggcaaacagaatgacgcactgcgcgaaggcgcccacttcgtggtcggcacaccgggtcgcgtactcgaccacctgctgcgtcgtaccatgcagctggacaggctgcgcgccctgacgttcgacgaagccgacaggatgctctccatcggcttctatcctgacatgaaggagatacagcggtacctgcccaagcggcgcatcgccacctgcctgttctccgccacgtacccgccgcacgtcctgaaccttgccggtgagttcctgcgcgaaccgcagatgctgagcctcagccactcgcaggtgcatgtggcgcagacgcagcacatgttctgcgaatcgaagccgatggacaaggacagggccctcatccgcctgctggagatagagaatccctcttccgccatcatcttctgcaacaccaaggccaacgtccactacatcacggcggtgcttcagggcttcggctacaacgccgatgagctttcggcagacctttcgcagtcgaagcgcgagcaggtgctcgaacgccttcgcaacaacgaggtgcgcttcctcgtggcgacagatgtagcggcgcgcggcatcgacatacccgccctttcgcacgtcatcctctacgaaccgcccgaagaccgcgaatcatacatccaccgtgccggtcgcacgggtcgcgcgggtgccgtgggcacggtcatatccctcgtcgacatcatgcagaagctcgaactgcaacgcatcgcacggcattaccgcatggacatcgcccatcggcccacgccgcaggacgaggacgtggcgcgcgtggtgggcgacaggctgacagccctccttgaaggggcctaccgccagtgcaccgggttgcagcgtgagcgcatccagcgcttcaccgacgtggcacgcaccctcgccgccgacgaggagcaggtcgtgctgctcgccatgctgcttgacgagaagtaccagcagagcctccacgccatgccaccgcgccccagaccgcagcgtgcatcggcaagccgcgccgttgacagcgaaagcgatacggccccaagacgccgcagcaggggcaggagagacgacgaaggcagcaccggaggcgacgagcggaaaaccgcgccccggacggcaccctcccgcaccacggcaggggcagagggcgcatccgcccacgaggacaccggtgcaggcaacatgcagaccgcacaggatggcgacgaacagcgcacgccccgcaaacggcggcgtccgcgcaggcgcaagcctaccggtggcgacaacggcacctcccatgacgcctga

SEQ ID NO: 38776 - protein, 577 aa, Desulfovibrio vulgaris subsp. vulgaris str. Hildenborough
MTQEPNMPEDAVAPEEDRAARVAAEITGIDEPEDALPSVQFADLAPRLQEACIRAGWQSLMPVQAHALPYLFDGRDLMVQSRTGSGKTGAFLLPLLERLDPAEASTQALVLVPTRELALQVEHEARTLFEGTGLRVAAVYGGVGYGKQNDALREGAHFVVGTPGRVLDHLLRRTMQLDRLRALTFDEADRMLSIGFYPDMKEIQRYLPKRRIATCLFSATYPPHVLNLAGEFLREPQMLSLSHSQVHVAQTQHMFCESKPMDKDRALIRLLEIENPSSAIIFCNTKANVHYITAVLQGFGYNADELSADLSQSKREQVLERLRNNEVRFLVATDVAARGIDIPALSHVILYEPPEDRESYIHRAGRTGRAGAVGTVISLVDIMQKLELQRIARHYRMDIAHRPTPQDEDVARVVGDRLTALLEGAYRQCTGLQRERIQRFTDVARTLAADEEQVVLLAMLLDEKYQQSLHAMPPRPRPQRASASRAVDSESDTAPRRRSRGRRDDEGSTGGDERKTAPRTAPSRTTAGAEGASAHEDTGAGNMQTAQDGDEQRTPRKRRRPRRRKPTGGDNGTSHDA

SEQ ID NO: 38777 - DNA, 1599 bp, Desulfovibrio vulgaris subsp. vulgaris str. Hildenborough
  CDS (1)..(1599)
atggaatccgtagaatcgttcaaggacctccccctcgaagaggaactgctcaaggccatcgaagaactcggcttcaccgagccctcgcccatccagtccatcgccatcccccgcctgcttgaaggccgcgacgtgataggtcaggcccagaccggcaccggcaagaccgccgccttcggtctgcccctgcttcagcgcatcgacgccgccgaccgctcggtacaggccctcgtgctctgtcccacccgtgaactggccctgcaggtggccaatggcctcaccgccctcgccaagcatctgcgcggggtacgcatcctctccgtgtacggcggccagcccatcgaaccgcaggcctccgccctgcgccgtggcgcacaggtcgtcgtgggtacgcccgggcgcatcctcgaccatatcaaccgcggcaccctgcaactcggcgtcgtgcgcatgaccgtgctcgacgaagccgacgaaatgctcgacatgggctttcgcgaggacatcgaacgcatcctcagcgaaatgcccgaatgggtgcagtctgcgttcttctccgccaccatgcccgacggcatcctcgaactcgcccgccgcttcctgcgcgaacccgagttgctgcgcgtgacgcgccgccagcttaccgtcgccaatacggaacaggcatggttcgaagtgcggcccttccgccgcgtggacgccgtatgccgaattttcgacgcctacattccgcgcaaggccatcgtcttccgcgccaccaagcagggcgtcgatgaactggccgccgcactccagcagcgcggcatcctcgccgacgccctgcacggcgacctcaaccagacccagcgcgaacgtgtcatgtcccgcttccgcgccgggggcatctccgtgctggtcgccaccgacgtggcagcccgtggtctggacgttgacgacgtggacaccgtcatcaacttcgacctgcccaacgaccccgagacctacgtgcaccgcataggccgcactggccgtgcaggccgcaccggcagggccttctcgttcgccgcaggtcgcgacgtgtacaagttgcgcgacatccagcgcgtgaccgggtcgcgcatcgaccgccgcgccatgcccaccgccgccgacgcctcccgcgcccgcaccgggcagttgcttgaggaagtcgccgccgggcttgccagcgccgagacctcggcctgcctgcctgtggtggagaagctcatcgccgaaggcgccgacccgacccagcttgccgccacgctgctgcgcatgatcatgcagcgcgaccgcatcgacctgccgggtgcccgccagaccgatgacatcggcaccgggcgcgtgcgcctgttcttcaacgtggggcgccgtatgcgcatcaccccgcgtgacctcgtgggcgccatcgccggtgagacgggcatctccggccgttccatcggttccatcgaaatccacgaccgcttctcgttcgtggaagtggatgcctccatcgcccccgaagtggtgtcggtgatgcacggcaaccagattcgcggcttccgcctcgccgtggaacaggcaagcccccgtgagggtcaggaccgcgccgcttaa

SEQ ID NO: 38778 - protein, 532 aa, Desulfovibrio vulgaris subsp. vulgaris str. Hildenborough
MESVESFKDLPLEEELLKAIEELGFTEPSPIQSIAIPRLLEGRDVIGQAQTGTGKTAAFGLPLLQRIDAADRSVQALVLCPTRELALQVANGLTALAKHLRGVRILSVYGGQPIEPQASALRRGAQVVVGTPGRILDHINRGTLQLGVVRMTVLDEADEMLDMGFREDIERILSEMPEWVQSAFFSATMPDGILELARRFLREPELLRVTRRQLTVANTEQAWFEVRPFRRVDAVCRIFDAYIPRKAIVFRATKQGVDELAAALQQRGILADALHGDLNQTQRERVMSRFRAGGISVLVATDVAARGLDVDDVDTVINFDLPNDPETYVHRIGRTGRAGRTGRAFSFAAGRDVYKLRDIQRVTGSRIDRRAMPTAADASRARTGQLLEEVAAGLASAETSACLPVVEKLIAEGADPTQLAATLLRMIMQRDRIDLPGARQTDDIGTGRVRLFFNVGRRMRITPRDLVGAIAGETGISGRSIGSIEIHDRFSFVEVDASIAPEVVSVMHGNQIRGFRLAVEQASPREGQDRAA

SEQ ID NO: 38779 - DNA, 1404 bp, Bartonella quintana str. Toulouse
  CDS (1)..(1404)
atgataccacctttaaacagttttgatgatttaggtctttccgaaaaggttattaaagcagtaaagtcagcgggatatacagctccaacgcctattcagagtggaacaattccctatgtacttcaaagaaaagatgttctaggaatcgcccagacagggactggaaaaacggcctctttcgttttgcctatgctcacactacttgaaaaaggacgtgcaagagcgcgaatgccccgtacgctcatactagaaccaacacgagaacttgcagcccaagttgaagaaaatttcgacaaatacggaataaatcatcgtttaaatgttgcacttctcattggtggcgtttcttttgaacaccaagatcgtaaacttgaacggggggcagatgttcttatagcaacaccaggacgccttcttgatcatttcgaacgcggtaaattgctcctgatgggggttgaaattctcgttattgatgaagctgatcgtatgttagatatgggttttattcctgatattgaacgcatctgtaaactgaccccttttacgcgtcaaactttattcttttccgcaacaatggcaccggaaattacaaaattaacaaagcaatttttacattttccggtaactgttgaagttacaaaagcatcctcaacagccactacaattacacagcagctcgtcaaatctggaaataaatcatgggataaaagagctgttttgcgagaacttatccacaatgaaggcgatgaactcaaaaatgccattattttctgtaatcgaaagagagatatctctgaactttttagatcgctcgtcagacataattttagtgtaggcgcacttcatggcgatatggatcaatattcgcgcatgagcacattagccgatttcaaagacaataaactcacacttcttgtcgcctctgatgttgccgcacgtggacttgatattccggctgtaagtcatgtcttcaactatgacgttcctacacatgctgaagactacattcatcgaattggtcgtacaggacgtgcaaatcggagcggaaaagcttttacgatcgtcacaaaagctgatcaaaagtatatcagtgccattgaagaaatgagcaatgaaaaaattgaatggctcaatggagatctctcgacattaacgaccgatgatcaaacagatgatatccttggaaagagacagtctcccaaattgtcaaagaaaatttctcaaaaagggcgtgctattcacactaaaaagcccttgaaagatgataaagttggttacataaaaaccactaataataatgcaaatccccctgaacaacatcatcatcgaaaaaataagagttacatccctcctggatttggcgatgatatcccggcatttatgctcataaaaatgcgcacttaa

SEQ ID NO: 38780 - protein, 467 aa, Bartonella quintana str. Toulouse
MIPPLNSFDDLGLSEKVIKAVKSAGYTAPTPIQSGTIPYVLQRKDVLGIAQTGTGKTASFVLPMLTLLEKGRARARMPRTLILEPTRELAAQVEENFDKYGINHRLNVALLIGGVSFEHQDRKLERGADVLIATPGRLLDHFERGKLLLMGVEILVIDEADRMLDMGFIPDIERICKLTPFTRQTLFFSATMAPEITKLTKQFLHFPVTVEVTKASSTATTITQQLVKSGNKSWDKRAVLRELIHNEGDELKNAIIFCNRKRDISELFRSLVRHNFSVGALHGDMDQYSRMSTLADFKDNKLTLLVASDVAARGLDIPAVSHVFNYDVPTHAEDYIHRIGRTGRANRSGKAFTIVTKADQKYISAIEEMSNEKIEWLNGDLSTLTTDDQTDDILGKRQSPKLSKKISQKGRAIHTKKPLKDDKVGYIKTTNNNANPPEQHHHRKNKSYIPPGFGDDIPAFMLIKMRT

SEQ ID NO: 38781 - DNA, 1521 bp, Staphylococcus aureus subsp. aureus MRSA252
  CDS (1)..(1521)
ttgcaaaattttaaagaactagggatttcggataatacggttcagtcacttgaatcaatgggatttaaagagccgacacctatccaaaaagacagtatcccttatgcgttacaaggaattgatatccttgggcaagctcaaaccggtacaggtaaaacaggagcattcggtattcctttaattgagaaagtagtagggaaacaaggggttcaatcgttgattttagcacctacaagagaattggcaatgcaggtagctgaacaattaagagaatttagccgtggacaaggtgtccaagttgttactgtattcggtggtatgcctatcgaacgccaaattaaagccttgaaaaaaggcccacaaatcgtagtcggaacacctgggcgtgttatcgaccatttaaatcgtcgcacattaaaaacggacggaattcatactttgattttagatgaagctgatgaaatgatgaatatgggattcatcgatgatatgagatttattatggataaaattccagcagtacaacgtcaaacaatgttgttctcagctacaatgcctaaagcaatccaagctttagtacaacaatttatgaaatcaccaaaaatcattaagacaatgaataatgaaatgtctgatccacaaatcgaagaattctatacaattgttaaagaattagagaaatttgatacatttacaaatttcctagatgttcatcaacctgaattagcaatcgtattcggacgtacaaaacgtcgtgttgatgaattaacaagtgctttgatttctaaaggatataaagctgaaggcttacatggtgatattacacaagcgaaacgtttagaagtattaaagaaatttaaaaatgaccaaattaatattttagtcgctactgatgtagcagcaagaggactagatatttctggtgtgagtcatgtttataactttgatatacctcaagatactgaaagctatacacaccgtattggtcgtacgggtcgtgctggtaaagaaggtatcgcggtaacatttgtaaatccaattgaaatggattacattagacaaattgaagatgctaatggtagaaaaatgagcgcacttcgtccaccacatcgtaaagaagtacttcaagcacgtgaagatgacatcaaagaaaaagttgaaaactggatgtctaaagagtcagaatcacgcttgaaacgcatttctacagagttgttaaatgaatataacgatgttgatttagttgctgcacttttacaagagttaatagaagcgaacgatgaagttgaagttcaattaacttttgaaaaaccattatctcgcaaaggccgtaacggtaaaccaagtggttctcgtaacagaaatagtaagcgtggtaatcctaaatttgacagtaagagtaaacgttcaaaaggatactcaagtaagaagaaaagtacaaaaaaattcgaccgtaaagagaagagtagcggtggaagcagacctatgaaaggtcgcacatttgctgaccatcaaaaataa

SEQ ID NO: 38782 - protein, 506 aa, Staphylococcus aureus subsp. aureus MRSA252
MQNFKELGISDNTVQSLESMGFKEPTPIQKDSIPYALQGIDILGQAQTGTGKTGAFGIPLIEKVVGKQGVQSLILAPTRELAMQVAEQLREFSRGQGVQVVTVFGGMPIERQIKALKKGPQIVVGTPGRVIDHLNRRTLKTDGIHTLILDEADEMMNMGFIDDMRFIMDKIPAVQRQTMLFSATMPKAIQALVQQFMKSPKIIKTMNNEMSDPQIEEFYTIVKELEKFDTFTNFLDVHQPELAIVFGRTKRRVDELTSALISKGYKAEGLHGDITQAKRLEVLKKFKNDQINILVATDVAARGLDISGVSHVYNFDIPQDTESYTHRIGRTGRAGKEGIAVTFVNPIEMDYIRQIEDANGRKMSALRPPHRKEVLQAREDDIKEKVENWMSKESESRLKRISTELLNEYNDVDLVAALLQELIEANDEVEVQLTFEKPLSRKGRNGKPSGSRNRNSKRGNPKFDSKSKRSKGYSSKKKSTKKFDRKEKSSGGSRPMKGRTFADHQK

SEQ ID NO: 38783 - DNA, 1152 bp, Acinetobacter sp. ADP1
  CDS (1)..(1152)
atggcatctggttttggaaccttgaatttacatccgcaacttaaacaagcgattgatgcattagggtttacacaaatgaccccaattcagcaaaaggttttaaaatatacactcgcaggacatgacgcgattgggcgagcacaaaccggaacaggtaaaacagcagccttcctcattagcgtaatcaatgatttactcaataatcctattcaagaacaacgctatcgtggtgaagtgcgtgcgctgattttagcacctacaagagagttggctctacaaattgagagtgatgcacgagagttaactcgatttacagatcttaatgtgttaacacttgtgggtggagtagattttgataaacagaaaaaaccgctgaatgaaaagtttatcgacattttggttgcaacacctggacgtctgattgattttgttgagcagaaagaagtctggttagatcaaattgagtttctggtcattgacgaagcagaccgtttgctcgatatgggatttattccctcagtaaaacgaattgttcggttttcaccgcgcaaagaacaacgtcagacgctcatgttttctgctacatttagttatgatgtgcttaacttggcaagacaatggttgtttgagccagtaacggttgaaatcgaaccagagcaaaaaaccaacaatgacgttgagcagcgtgtgtacatggttgcaaaacaagacaaatatcgtcttttacaagacattcttagagatgaaccgattgataaggtgatgatttttgcgaatcgtcgcgatcaggttcgtcgtctttatgatcatttgaaaaaagatggttataaagtaggaatgttatctggtgaaattgcacaagataaacgacttaaaatgcttgagcagtttaagcagggtaaaaacaacatcatgatcgcgaccgatgttgctggtcgtggcattcatgtagacggcgtttcgcatgttgtgaattttactttgccagaacagtcagatgattatgtgcatcggattggtcgtactgggcgtgcaggtacacaaggcgttagtattagctttttgtctgaagatgatgcgttttacttgcctgaaattgaaaaagcgattgggaaaaaacttcctttaacgcgtttggaaggttactgttaa

SEQ ID NO: 38784 - protein, 383 aa, Acinetobacter sp. ADP1
MASGFGTLNLHPQLKQAIDALGFTQMTPIQQKVLKYTLAGHDAIGRAQTGTGKTAAFLISVINDLLNNPIQEQRYRGEVRALILAPTRELALQIESDARELTRFTDLNVLTLVGGVDFDKQKKPLNEKFIDILVATPGRLIDFVEQKEVWLDQIEFLVIDEADRLLDMGFIPSVKRIVRFSPRKEQRQTLMFSATFSYDVLNLARQWLFEPVTVEIEPEQKTNNDVEQRVYMVAKQDKYRLLQDILRDEPIDKVMIFANRRDQVRRLYDHLKKDGYKVGMLSGEIAQDKRLKMLEQFKQGKNNIMIATDVAGRGIHVDGVSHVVNFTLPEQSDDYVHRIGRTGRAGTQGVSISFLSEDDAFYLPEIEKAIGKKLPLTRLEGYC

SEQ ID NO: 38785 - DNA, 1923 bp, Acinetobacter sp. ADP1
  CDS (1)..(1923)
gtgaaactctctatgagcaaaaattttgccgatttctctctacatgaatctttacaacaagcactacaggatcttggttttactagcccaacacctgttcaagaacaagcgattcctgcagctttagaaggtaaagaccttttagtttcaagccaaactggttctggtaaaactgcagctttcttgctgccaacattacattcacttgctggtcaagacacgttccttccatttaaagaacgtatgcgtgcagtgactcaaccgaatattcttgtcatttcaccaacgcgtgaattggctcagcaagtgagtcaggacgcgattgcacttgtacgtcacatgaaaggtgttcgtattgctgcaattatgggtggtatgccatttgcaaaacagatccagcaattaaaaggcgctcaggttgttgttgcaaccccaggtcgtttacttgatttggtcaatcgtcgtcaaattaaattagataaagttgatgctttaatcgtagacgaagcagaccgtatgctggatcttggtttctctgaagatcttgaagcgattagcgagttggctgccaaccgtaaacaaactttgatgttctctgcaacatttgcagatcgtattattcgtcttgcagaatgcatgatgcaagatccaatgcgtattgccattgaaacaggtcattcaaccaacactgacatcacccagactttacactggactgatggttttgagcacaagaaaaaattgctgactcattggttaagtgatgaaagcatggatcaagcagtggtgtttgcaagcacacaagaagatacagatatgctcgctgaagagcttgctgaagctggtcattcagtggttgcactacatggtgcgatgccacaaactgtacgtaaccgtcgtttacgcagtattcgtgaaggtaaagctaaaatcctggttgcaactgacgttgcagcacgtggtctagatgtaccaaccatttctcacgtgatcaactttggcttgccaatgaaacacgaagactatgtacaccgtattggtcgtactggtcgtgcaggccgtactggtcaagcgattacactagcaacttatcgtgagcgcggtaaaattcgtgcgcttgaagactatttagaagcacgtttaagcgtatctgaaattgaaggtcttgagccatctccacctcctgcacgttctggtcgtgatggtggtggtcgtggtcgcggtggtaatggtggtggtcgtcgtgacggtggtcgcggtggtttcggtggtggtcgtcgttttgaaggcgaaagtaatttcaaacgtcgtgatggtggtcgtgatgaccgtccaaaacgtagtttcgatgataaaccacgtggtgaacgtcctgcattcggtggcgaagatcgtccacgtcgcgagtttaattctgatcgcccacgtcgtgaaggtggttttgaagaccgtccaaaacgtagctttggtggtgaagaccgtccgcgtcgcgagtttaattcagaccgcccacgtcgtgaaggtggctttgaagaccatccaaaacgtgattttggtgatcgtccagcacgtcgtgaaggtggtttcaatgataagccacgtttcgattctaatgacgacaaccgtggtaatcgtgtagattacaaaccacgtcgtgaaggtagcttcggtgatcgtccaaaacgtgatttcggtgatcgtccagcgccacgtcgtgaaggtagcttcggtgatcgtccaaaacgtgatttcggtgatcgtccagcacgtcgtgaaggtggctttggtgatcgtccacaacgttcttttggcgatgaccgtccaaagcgtagctttggtggcgaagatcgtccacgtcgcgcgacacaagaagaatttttcaatcgtgagtctggcgaccgtcgccgtaagaacgatcgttaa

SEQ ID NO: 38786 - protein, 640 aa, Acinetobacter sp. ADP1
MKLSMSKNFADFSLHESLQQALQDLGFTSPTPVQEQAIPAALEGKDLLVSSQTGSGKTAAFLLPTLHSLAGQDTFLPFKERMRAVTQPNILVISPTRELAQQVSQDAIALVRHMKGVRIAAIMGGMPFAKQIQQLKGAQVVVATPGRLLDLVNRRQIKLDKVDALIVDEADRMLDLGFSEDLEAISELAANRKQTLMFSATFADRIIRLAECMMQDPMRIAIETGHSTNTDITQTLHWTDGFEHKKKLLTHWLSDESMDQAVVFASTQEDTDMLAEELAEAGHSVVALHGAMPQTVRNRRLRSIREGKAKILVATDVAARGLDVPTISHVINFGLPMKHEDYVHRIGRTGRAGRTGQAITLATYRERGKIRALEDYLEARLSVSEIEGLEPSPPPARSGRDGGGRGRGGNGGGRRDGGRGGFGGGRRFEGESNFKRRDGGRDDRPKRSFDDKPRGERPAFGGEDRPRREFNSDRPRREGGFEDRPKRSFGGEDRPRREFNSDRPRREGGFEDHPKRDFGDRPARREGGFNDKPRFDSNDDNRGNRVDYKPRREGSFGDRPKRDFGDRPAPRREGSFGDRPKRDFGDRPARREGGFGDRPQRSFGDDRPKRSFGGEDRPRRATQEEFFNRESGDRRRKNDR

SEQ ID NO: 38787 - DNA, 1914 bp, Erwinia carotovora subsp. atroseptica SCRI1043
  CDS (1)..(1914)
atgactgatttatttacttctttttccgatttggggctgtctgctcctattattaatgccctgaccgatctgggctatgaaaaaccatcgccgattcaggctgaatgtattcctcacctgctgaacggtcgcgatgtgctgggtatggcacagaccggcagtggtaaaactgcggcttttgctctgccattactcaataatttaaaacctgagttaaaagcgccgcagatgttggtgttggccccaacccgtgaactggctgttcaggttgctgaagcctgtagtgattttgccaaacatatgcacggcgttaacgttgttgccctgtacggcggccagcgttatgacgttcaactgcgcgctttgcgtggtggagcacagattgttgttggtactccaggtcgtctgctggaccacctgaaacgcggtacgctggatctgtccaacctgagtggtctggtactggatgaagctgatgaaatgctgcgtatgggcttcatcgaagatgttgaaaacatcatggctcagatccctgctacgcatcaaactgcactgttctctgcaaccatgccagaagcgattcgccgcattacgcgtcgtttcatgaaagatccacaggaagttcgcatccaatcaagcgtgactacgcgtccagacatcagccagagctactggacggtgcagggtatgcgtaaaaatgaagcgctggttcgtttccttgaagctgaagattttgatgcggcgattattttcgttcgtaccaagaatgctacgctggaagtggccgaagcgttggagcgtagcggttataacagtgccgcgctaaacggtgacatgaaccaggcgctgcgtgagcaaacgctggagcgcctgaaagatggtcgtctggatatcctgattgcgaccgacgttgcggcgcgtggtctggacgttgagcgtatcagcctggtagtcaactacgatatcccaatggactccgagtcttacgtccaccgtattggtcgtaccggtcgtgctggtcgtgctggtcgcgcattgctgtttgtagaaaaccgcgagcgtcgcctgctgcgcaacgttgaacgcacaatgaagctggcgattcctgaagtggaattgccaaatgcggaattgctggggcaacgccgtctggctaaatttgctgccaaagtacagctacagctggaaagcagcgacttggatatgtaccgcgctctgctgacgaagatgcaaccgcaggaagagctggatatcgaaacgctggctgctgcgctgctgaaaatggcgcagggtgaacgtcctctgatcctgccgccggaaccggcattccgtcctcgccgcgaattccgcgatcgtgatgagtctcgtagtgattcacgtggcgatcgtcgccgtgaaccccgcgatgctcgcgattcccgtgaaccccgtgacggtgaccgtccacaacgccgtgagcgtcgtgagtcgggtgaaatggaactgtatcgtatcgaagtgggtcgtgatgacggtgttgaagtacgtcacattgttggtgctatcgccaacgaaggtgatatcagcagccgctacatcggtaacatcaagctgttcgggtctcattcgacgatcgaactgccgaaaggtatgccgggcgacctgttatcacactttacccgcacgcgtattctgaacaaaccaatgaatatgcaattgctgggtgatgcagtagcacagccagaacgtcgtggcggtggccgtcctgctggtgctggtacgggtggtgaacgtcgtgatggcgcagctccacgtcgctctttcggcggtggtgaacgccgtgaaggtaacgctaacggcggtgagcgtcgtgaacgctctgtcaaccgtgatgcggcaccgcgtgctccacgtcgtcgtcctgctgacgcgtaa

SEQ ID NO: 38788 - protein, 637 aa, Erwinia carotovora subsp. atroseptica SCRI1043
MTDLFTSFSDLGLSAPIINALTDLGYEKPSPIQAECIPHLLNGRDVLGMAQTGSGKTAAFALPLLNNLKPELKAPQMLVLAPTRELAVQVAEACSDFAKHMHGVNVVALYGGQRYDVQLRALRGGAQIVVGTPGRLLDHLKRGTLDLSNLSGLVLDEADEMLRMGFIEDVENIMAQIPATHQTALFSATMPEAIRRITRRFMKDPQEVRIQSSVTTRPDISQSYWTVQGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNVERTMKLAIPEVELPNAELLGQRRLAKFAAKVQLQLESSDLDMYRALLTKMQPQEELDIETLAAALLKMAQGERPLILPPEPAFRPRREFRDRDESRSDSRGDRRREPRDARDSREPRDGDRPQRRERRESGEMELYRIEVGRDDGVEVRHIVGAIANEGDISSRYIGNIKLFGSHSTIELPKGMPGDLLSHFTRTRILNKPMNMQLLGDAVAQPERRGGGRPAGAGTGGERRDGAAPRRSFGGGERREGNANGGERRERSVNRDAAPRAPRRRPADA

SEQ ID NO: 38789 - DNA, 1383 bp, Erwinia carotovora subsp. atroseptica SCRI1043
  CDS (1)..(1383)
atgagtacaacctctttttcttccctcgcgctgccggcagagcagttatccaatcttaatgaactgggctataccgaaatgacgccagtccaggcggcgacgctgccagccgttctgagcggcgcagacgtgcgggccaaggcgaaaaccggtagtggcaaaacggcggcatttgggattgggttgctagatcgtattgtcgtcagcgattttaccacgcaggcgctggtgctatgtccgacgcgtgaactggccgatcaggtcagcaaagaactgcgccgtctggcgcgttttgcgcaaaacattaagattttgacactgtgcggcggtcagccgatggggcagcagctcgattcactggtccacgcaccgcacattgttgtcggtacgccggggcgtattcaggatcatttacgcaagcagtctctggctttagatagcctgaaagtgttggtgctggatgaagcggatcgcatgctggacatgggctttactgacgccattgatgatgtgatttcctatacgccgtccgatcgtcaaacactgctgttttccgctacgtacccgcaagagatcgaacagatcagcgcacgggttcagcgtcagccgcaacgtttcgaaatagcagatgacgtggaagagtcggccattgaacaacgtttctatgagacaacgaaagatcagcgcctgccgctgttgattgccattctgagccattatcagccagcatcctgcgtggtgttttgcaacacgaaacgtgattgccagagcgtatttgaggcactggagatgcgcgggattagcgtatcggcattgcatggcgatttggaacagcgcgaccgcgatcaggttctggtgcgtttctctaaccgtagctgtcgcgtgttggtagcaacggatgttgcggctcgcggtcttgatatcaaagagttggcgctggtggtgaattttgagctggctttcgatcctgaagttcacgttcatcgcattggcagaacaggccgcgcggggacgcagggtctggctgtgagcctgtgtacgccacaggaaatgaaccgcgctaacctgattgaagactatatcggtatgcgaattaaatggacatcggcggatgagattagccgcagtggtgatgttgcgctcgaacctgagatgatgacgctgtgcattgatggtggcagaaaggccaaaatccgtcccggcgatattcttggcgcgttaactggcgatgtaggattaacggcagcggaagtcgggaaaattgatatgttccctctacatgcttatgtcgcaatccgtaaagacagtgctaaacgtgcgctgcaacagctccagaaaggcaaaatcaaaggaaaaagctgtaaggccagattgttaaagtaa

SEQ ID NO: 38790 - protein, 460 aa, Erwinia carotovora subsp. atroseptica SCRI1043
MSTTSFSSLALPAEQLSNLNELGYTEMTPVQAATLPAVLSGADVRAKAKTGSGKTAAFGIGLLDRIVVSDFTTQALVLCPTRELADQVSKELRRLARFAQNIKILTLCGGQPMGQQLDSLVHAPHIVVGTPGRIQDHLRKQSLALDSLKVLVLDEADRMLDMGFTDAIDDVISYTPSDRQTLLFSATYPQEIEQISARVQRQPQRFEIADDVEESAIEQRFYETTKDQRLPLLIAILSHYQPASCVVFCNTKRDCQSVFEALEMRGISVSALHGDLEQRDRDQVLVRFSNRSCRVLVATDVAARGLDIKELALVVNFELAFDPEVHVHRIGRTGRAGTQGLAVSLCTPQEMNRANLIEDYIGMRIKWTSADEISRSGDVALEPEMMTLCIDGGRKAKIRPGDILGALTGDVGLTAAEVGKIDMFPLHAYVAIRKDSAKRALQQLQKGKIKGKSCKARLLK

SEQ ID NO: 38791 - DNA, 2001 bp, Mesoplasma florum L1
  CDS (1)..(2001)
atgacatttaaagaattacaattaagcgacaaagtattagtcgcactggaaaaagctaattttaacgaagctacagaaattcaagctagagcaataccacttttcctagaaggaaaaaacatttttggtaaatcaagcactggtacaggtaaaacagcatcatttgtattaccaatcttagaaaaaatagaaccaaacaaaagaagagttcaagccgttataatggcaccaacaagagaattagcaatgcaaattgttaaccaaattagaatatttggatcaagaatagaaaatctagtaatagcaccattaatcggtggagctgatatgcgagatcaaattaaaagactgaaagactcacaaatagttgtgggaactccaggaagggttaatgaccacttaaatagaaaaaccttaaaattagatgatgttagaacaatcattttagatgaagctgatgaaatgctaaaaatgggatttaaaaacgaaattgatgctttatttgaaagagtttcaccagatgttcaaattggtttattttcagctacaacatcaccaaaagtaatgcaaattgctaatgattatatgaatgaatatgacgttattgaaattgaaaatcaaatagaagttaatgctaatattacaaatacttttattttcacaaaaggttttagcaaagaagatttaattgttaaagtatttaaaaaacacaaacctaaaagagctatagtgttttcaaacacaaaaaatcatacagataaaattgcagataatttagaagcagcaggaattagagctatagttattaatggtgataaaagacaatcacaaagatcaagagctattgcaaaatttagaaacaatgaaatatcagttttagttgcaactgatgttgttgctcgtggaattgatattacaggtgttgactacgtaattaactatgatgtatcaatggaagacgaacattttgttcatagaattggtagaacaggaagaaataatacaaaaggtgattcaattacttttgtacaaaatcaaaatgttttaagacaaataaaaggaatagaaaaaaactttaatttaattattgatgaaatgcaaatttctgaatatggtgaagtagacaagcaagaaggaagagggaactcaaatagaagttcacgtggagatagaagagattcaggtcgtggagatagaagagattcaaatcgtggagatagaagagattcaggtcgcaatgaaagaagagattcaaatcgtggtcgtgatgacagaagaaatgctggacacaatgatagaagagactttgctcatggcgaaagaaaaagaacaagtgaaagactagatagcagaagtagcgcttgaacttctcaatcatgagaagaaagaatgctatctttatcaccagaagaaaaagaatttgctaaaaaagctttatctttagttgatgattattcagtgaatgaaaatcaagatagcaatcaaaatgtttttgaaagaaatgacagaagagattcaggtcgaggagacagaagaagttcaggtcgtggtcgtggagacagaagtggttcaaaccgtggccgtgatgacagaagaagttcaggtcgtggtcgcgatgacagaagagattcaaaccgtggtcgtgatgaaagaagaaactcaaaccgtggtcgtgatgacagaagaacagatggtcaagaaagagataataaaaaatttgaaggtactagacattcttcatgagatgttaaaactgattattctaaacaagattcaggccgttgagaaagagttacaggaaaagaaaaaagaccagattcatttaataaaaaagacgggtttaattcaaataatgaaagagacgaaagaagaaacagaagaagttctggtcgtggagaatgagttcattcaggtccaagagaaaacaagggatcaggaacacgtaacagaagaaattcttcttcaaatagttcttcaagaaaaccaaaaaataaatgataa

SEQ ID NO: 38792 - protein, 666 aa, Mesoplasma florum L1
MTFKELQLSDKVLVALEKANFNEATEIQARAIPLFLEGKNIFGKSSTGTGKTASFVLPILEKIEPNKRRVQAVIMAPTRELAMQIVNQIRIFGSRIENLVIAPLIGGADMRDQIKRLKDSQIVVGTPGRVNDHLNRKTLKLDDVRTIILDEADEMLKMGFKNEIDALFERVSPDVQIGLFSATTSPKVMQIANDYMNEYDVIEIENQIEVNANITNTFIFTKGFSKEDLIVKVFKKHKPKRAIVFSNTKNHTDKIADNLEAAGIRAIVINGDKRQSQRSRAIAKFRNNEISVLVATDVVARGIDITGVDYVINYDVSMEDEHFVHRIGRTGRNNTKGDSITFVQNQNVLRQIKGIEKNFNLIIDEMQISEYGEVDKQEGRGNSNRSSRGDRRDSGRGDRRDSNRGDRRDSGRNERRDSNRGRDDRRNAGHNDRRDFAHGERKRTSERLDSRSSAWTSQSWEERMLSLSPEEKEFAKKALSLVDDYSVNENQDSNQNVFERNDRRDSGRGDRRSSGRGRGDRSGSNRGRDDRRSSGRGRDDRRDSNRGRDERRNSNRGRDDRRTDGQERDNKKFEGTRHSSWDVKTDYSKQDSGRWERVTGKEKRPDSFNKKDGFNSNNERDERRNRRSSGRGEWVHSGPRENKGSGTRNRRNSSSNSSSRKPKNKW

SEQ ID NO: 38793 - DNA, 1686 bp, Propionibacterium acnes KPA171202
  CDS (1)..(1686)
atgagaggtaaagtgattgatggtgtgtcgaacgcgtatcttcgctggtccacaccagacgtggcattaaacgacgtcacaagaacgacaccgggccttgacgggcccacgcacgaagaggccaagacactgaccgagactactgtttccgttcccacctccttcgccgacctcggcgtccgagaagatatctgccaggcgttggaaggggtgggaattgtctccccgttcccgatccaggccatgtcgatcccgattgccgtcgagggcacggatctcattgggcaggcgcgtactggcactggcaaaacactcgccttcggcatcaccatcttgctgcgcatcaccctgcccggtgacgaaggttgggaagaactcaccaccaaaggcaagccccaagcactcgtgatgtgccctacccgggagctggctctccaagtgtctaaagacatctccactgccgcttctgtccgcggcgcacgtgtccttaccgtctacggtggggttggttatgagtcgcagattgacgcacttaaagcgggggtcgatgttgtcgtcggtactcctggacgccttcttgacctatcccagcgcaaggacctcgatctgtcccatgtgcgcatcgtcgttcttgacgaggccgacgagatgcttgatctcggcttcttgcctgacgtcgagaatctcatcggacgcactccggcctctcgccagacgatgctgttttcggccactatgccggccccgattatggccctagcccggtcccaactacatcgtccggtgcacgtccgcgccgaaggagccgacacccaggccacggtccccgacacccagcagtttgtataccaggcccatcccctcgacaagattgagatcattggacgcattctgcaggccaacgacgtcgagaaggtcatcatcttctgccgcaccaagcgtgcatgccagcggctttctgacgacctcgacgaccgcggtttcaaaacccgcgccatccacggtgatctcacgcaggtcgcgcgcgaaaaagcgctcaagaaattccgtcatggcgatgcgaccatcctggtggcgaccgatgtcgctgcccgtggcattgacgtcaccggggtgtcccacgtcatcaaccatgaatgtcccgaagacgagaaaacatacgtccaccgcattggtcgcaccggccgcgcgggtgccaagggcgtcgccgtcaccctcgtagattgggctgacgtcacccgctggaagctcatcaacaaggccctcaacctcgagctgtccgagccggtcgaaacttattccacctccccccacctctacaccgatctcgacatacccgaggacgctcagggccagatcatcgaccttgagaaggccgcttccgagaagaaacggcgacagcatcgccacggccatgatggctcccaccatgagaaggccacacggcggcgctctcgtgatgcttccaaggatggagataaagcgcggcgaaagcgcattcgtcgccgcaacggcaaagtggtcaggggctcctcactcaaccccgcacctcaccagaaagcagaccagaaccgacacgcagcaaacagccaccatcacgatatagtcgccggcccgcgcgaggcgcggccgagacaccgacgcgcccggaatgccctgcacaaccgaccatcaaacaggctgtaa

SEQ ID NO: 38794 - protein, 561 aa, Propionibacterium acnes KPA171202
MRGKVIDGVSNAYLRWSTPDVALNDVTRTTPGLDGPTHEEAKTLTETTVSVPTSFADLGVREDICQALEGVGIVSPFPIQAMSIPIAVEGTDLIGQARTGTGKTLAFGITILLRITLPGDEGWEELTTKGKPQALVMCPTRELALQVSKDISTAASVRGARVLTVYGGVGYESQIDALKAGVDVVVGTPGRLLDLSQRKDLDLSHVRIVVLDEADEMLDLGFLPDVENLIGRTPASRQTMLFSATMPAPIMALARSQLHRPVHVRAEGADTQATVPDTQQFVYQAHPLDKIEIIGRILQANDVEKVIIFCRTKRACQRLSDDLDDRGFKTRAIHGDLTQVAREKALKKFRHGDATILVATDVAARGIDVTGVSHVINHECPEDEKTYVHRIGRTGRAGAKGVAVTLVDWADVTRWKLINKALNLELSEPVETYSTSPHLYTDLDIPEDAQGQIIDLEKAASEKKRRQHRHGHDGSHHEKATRRRSRDASKDGDKARRKRIRRRNGKVVRGSSLNPAPHQKADQNRHAANSHHHDIVAGPREARPRHRRARNALHNRPSNRL

SEQ ID NO: 38795 - DNA, 1476 bp, Leifsonia xyli subsp. xyli str. CTCB07
  CDS (1)..(1476)
gtgactttctccgaactgaacatcgaccaggacatggtggacgccctcgcggccaagggcatcaccgagccgttccccatccagacgcagacgatcccgctcgccctcaccggccaggacatcatcggccaggcgaagaccggaaccggcaagaccttcggtttcggcctgccgatcatccagcggctcggcgccgacccggagcccggtgtgcaggctctggtggtcgtgccgacccgtgagctcgccgtccaggtgtacgaggacctcgagcaggccgcctccaaccgtcccacctcgatcgcagcgatctacggcggcaaagcgtacgaggggcagatcgcccagctgaaggcgggcgcgcaggtcgtggtcggcacccccggccgtctgctcgacctcgccggccagcgtctgctgaacctcagcacggtgcgggagatggtgctcgacgaggccgacaagatgctcgacctcggcttcctgtccgatatcgagaaactgttcgcgcagactcccgccacccgtcacaccatgctgttctcggcgaccatgccgggcccgatcgtcgccctggcgcgccgtttcatgacccggcccatccacatccgggcgaccgaccccgacgagggccagatccaggcgaacatcaagcacctcgtctaccgggcgcactcgctcgacaaggacgaggtcgtcgcgcgcatcctgcagtccgagggccgtggcaagacggtgatcttcacgcgcaccaagcgcagcgccgccaaactcatggaagagttgaacgaccgaggcttcaacgccgccgccgttcacggcgacctcaaccaggagcagcgggagcgcgcgatggccgcattcaaggcgggcaagaaggacgtgctcatcgccaccgatgtcgccgcccgcggcatcgacgtggacgacgtcactcatgtgatcaaccacaccatcccggacgacgagaaaacctacctgcaccgcgccggacgcaccggccgcgcgggcaagtccggtatcgccgtgacgttcgtggactgggaggacctgcacaagtgggcgctgatcaaccgcgccctcgagttcggccagcccgagcccacggagacgtactcgtcgtcgccgcacctcttcatcgatctgggtatccccgagggagccaaaggccggctcaagtccacaccggctgtcaaagcgccggagagccggccgaacgaccgcggtccggccggcggaggcagcgaccggcagcgccggcgcacacgcggcgggcaaggggcccgggccgccgcgaaaagctcgggaaccgtggacaaagagcccgcgggcgacgaagcgatgtccgcgtcgggcacgcacgacggcggtggctcccagcaccgcgacggaaacagcacgccgcgacgccgacgccttcgttcgcacggtggcagcggaggcggggcgtccgccccgcaggcgacgggcaactga

SEQ ID NO: 38796 - protein, 491 aa, Leifsonia xyli subsp. xyli str. CTCB07
MTFSELNIDQDMVDALAAKGITEPFPIQTQTIPLALTGQDIIGQAKTGTGKTFGFGLPIIQRLGADPEPGVQALVVVPTRELAVQVYEDLEQAASNRPTSIAAIYGGKAYEGQIAQLKAGAQVVVGTPGRLLDLAGQRLLNLSTVREMVLDEADKMLDLGFLSDIEKLFAQTPATRHTMLFSATMPGPIVALARRFMTRPIHIRATDPDEGQIQANIKHLVYRAHSLDKDEVVARILQSEGRGKTVIFTRTKRSAAKLMEELNDRGFNAAAVHGDLNQEQRERAMAAFKAGKKDVLIATDVAARGIDVDDVTHVINHTIPDDEKTYLHRAGRTGRAGKSGIAVTFVDWEDLHKWALINRALEFGQPEPTETYSSSPHLFIDLGIPEGAKGRLKSTPAVKAPESRPNDRGPAGGGSDRQRRRTRGGQGARAAAKSSGTVDKEPAGDEAMSASGTHDGGGSQHRDGNSTPRRRRLRSHGGSGGGASAPQATGN

SEQ ID NO: 38797 - DNA, 1770 bp, Leifsonia xyli subsp. xyli str. CTCB07
  CDS (1)..(1770)
atgatgcctgcaaccgggagcggcgaggcggagaccgccgccgacgcactgaccttcgccgatctcggtctggaccgggctgtgctcgccgtcctgaaggatgtcggctacgagacgccgtccgccatccaggcggcgacgatcccgctgctgctcgaggggagggacgtggtcgggctcgcccagaccgggaccgggaagacggcggccttcgcccttcccatcctgtcccgcctcgacctgtcgcagaagagcccgcaggcgctcgtgctcgcccccacccgcgagctggcgctgcaggtggcggaggcgttcgagagctatgcgacgcatctgaaaggcgttcatctgctgccggtgtacggcggccagggttacggagtgcagctctccgcgctgcgccgaggcgtgcatatcgtggtgggcacgcccggccgcatcatggatcacctcgacaaggggacgctcgacctctccgggctcaagcacctcgtgctcgacgaagcggacgagatgctgaagatgggtttcgccgaggacgtggagaagattctcgccgacacgcccgatgacaagcaggtcgcgctgttctccgccacgatgccggcgcagatccgccgcatttcgaagaagtacctgcacgatcccgaagaggtcaccgtcaaggccaggacgacgacgtcggccaacacaacgcagcgctatctcgtcgtttcgtactcgcagaaggttgacgcgctcacccgcatcctcgaggtcgagaacttcgaggcgatgatcgtcttcgtccggacgaagaacgagacggagacgctcgcggagcggctccgggcccgcggttactcggcggcggcgatcagcggcgacgtcgcgcaggcccagcgggagcgcacggtcggccagctgaaatcgggcaagctcgacatcctggtggccacggacgtggcggcgcgcgggctcgacgtcgaccgcatcagccatgtcgtcaacttcgacatccccgtggacaccgaatcgtatgtgcatcgcatcggacggaccggccgcgccgggcgcagcggcgcggcgatcagcttcgtcaccacgcgtgagcgccggctcctcaccgccatcgagaaagccacccgtcagccgttgaccccgatgccgctcccgagcgtcgacgacgtcaacgtcacccgcctcgcccgcttcgacgacgcgatcacgtccgccctcgcccagcaggaccgcatctcgcggttccgcgacatcatcgcccactacgtggcccatcatgacgtgcccgaggcggatgtggcggctgcgctcgctgtcgtcgcccagggcgaggagccactgctgctctccgccgacgatgcgctcacccagcgcatcgagcgggacgcacgcgacgaccggctggcccgggccggtcgtgacgaccgtggccggggcgagcgcccggtgcgccgcgatcgcggctacaggccgatggcaccctatcgcatcgaggtcggcaaacggcagcgggtggaaccgcgccagatcgtcggagcgctcgcgaacgagggcgggctgagccgcgacgacttcggccacatccggatcatgcccgacttctcgatcgtggagttgccggcggatctccccggtgacaccctcgcgcggctgaccggaacgcgcatcagcggcaagctgatcgaactgcggccggaccgcggcgcgggagcgcggcgcaaaccggacgaacgcggggaacgtccgccgcgcaagccgcggcgtcgctga

SEQ ID NO: 38798 - protein, 589 aa, Leifsonia xyli subsp. xyli str. CTCB07
MMPATGSGEAETAADALTFADLGLDRAVLAVLKDVGYETPSAIQAATIPLLLEGRDVVGLAQTGTGKTAAFALPILSRLDLSQKSPQALVLAPTRELALQVAEAFESYATHLKGVHLLPVYGGQGYGVQLSALRRGVHIVVGTPGRIMDHLDKGTLDLSGLKHLVLDEADEMLKMGFAEDVEKILADTPDDKQVALFSATMPAQIRRISKKYLHDPEEVTVKARTTTSANTTQRYLVVSYSQKVDALTRILEVENFEAMIVFVRTKNETETLAERLRARGYSAAAISGDVAQAQRERTVGQLKSGKLDILVATDVAARGLDVDRISHVVNFDIPVDTESYVHRIGRTGRAGRSGAAISFVTTRERRLLTAIEKATRQPLTPMPLPSVDDVNVTRLARFDDAITSALAQQDRISRFRDIIAHYVAHHDVPEADVAAALAVVAQGEEPLLLSADDALTQRIERDARDDRLARAGRDDRGRGERPVRRDRGYRPMAPYRIEVGKRQRVEPRQIVGALANEGGLSRDDFGHIRIMPDFSIVELPADLPGDTLARLTGTRISGKLIELRPDRGAGARRKPDERGERPPRKPRRR

SEQ ID NO: 38799 - DNA, 1275 bp, Desulfotalea psychrophila LSv54
  CDS (1)..(1275)
atgtcatttgccattttaggcttgtgtgatgaacttttgcaaaccgtcgcagagcaaggatacaccactccatcacagatacaaacggaagctattccagtggtgctgaatcagcgtgatgttatggcggtggcacacactggcacgggaaaaacggctggctttaccttacctatggtacagttattgtctggtggcgatagtccacagccatgcacagtacgtgcgcttgttattacaccaacccgtgagcttgcagctcaagttgccgaaagtgttcaaacctatggcagcatgatgaatattcgcactggcgcagcatttggtggagtaagaattgagccacagatagccaaactacaggctggtctagatgtgcttgttgcaacacctggccgtttgcttgatctttataatcaacaggcagtgagctttgacgcacttaaaatattggtactcgatgaagcagatcgtatgttggatttaggctttatcgacgatatccgtcacatccaaacattacttccagccaagcgtcaaactttgatgttctcagctacattttcagaagagatcaagtcacttgcagggggcatgctacatgatcctgttttgattgaagtggataccgataaaaatattgtcgattccattaagcagaaaatgcatcctgtagatcaggaacgaaagagtgcattattgattcacctaattaaaaagtacaattggcagcaacttttggtctttagtcgtaccaagcgtggagccgacaccttagttactcagctcaaagaagctggcattaatgccgaatcaattcatgccaacagaacccaatatgcacggacacgtgccttagatggttttaaaaacgggagtgttgtggtattggtcgcaacagatattgcctctcggggcattgatgttcatcaactaccgtgcgtgattaactttgatctcccctatgtagcagaagactatgtgcatcgcattggtcgtaccggccgtgctggtacctctggcttagcggtttcatttttcagtgaagatgaagctcagcaactcgcctctattgagaagctgattggccgtaaatttgaacgtgatatcgtccaaggttttgcgccgagcaagaagccagcagtagtgttatcagatgaagatgaggagtatggtaattttgaacctgatccacctcggcgtaaaggtaaatctaaggggcaggcaggaaaacccgcaaaaacaaaacgcaagcactggaaagaatatctttaa

SEQ ID NO: 38800 - protein, 424 aa, Desulfotalea psychrophila LSv54
MSFAILGLCDELLQTVAEQGYTTPSQIQTEAIPVVLNQRDVMAVAHTGTGKTAGFTLPMVQLLSGGDSPQPCTVRALVITPTRELAAQVAESVQTYGSMMNIRTGAAFGGVRIEPQIAKLQAGLDVLVATPGRLLDLYNQQAVSFDALKILVLDEADRMLDLGFIDDIRHIQTLLPAKRQTLMFSATFSEEIKSLAGGMLHDPVLIEVDTDKNIVDSIKQKMHPVDQERKSALLIHLIKKYNWQQLLVFSRTKRGADTLVTQLKEAGINAESIHANRTQYARTRALDGFKNGSVVVLVATDIASRGIDVHQLPCVINFDLPYVAEDYVHRIGRTGRAGTSGLAVSFFSEDEAQQLASIEKLIGRKFERDIVQGFAPSKKPAVVLSDEDEEYGNFEPDPPRRKGKSKGQAGKPAKTKRKHWKEYL

SEQ ID NO: 38801 - DNA, 1410 bp, Desulfotalea psychrophila LSv54
  CDS (1)..(1410)
atgagcgcatttactacactggccttaagcaaagcaatgaccgataatctagagatcatgggttaccatgaaatgactcctatccaggcagagagtctgccccatgtgctggagggcgaggatctgctagcacaggccaagacaggatcaggcaaaacagcagccttcggtatcggcctcctccacaatctggatgtaagcctctttcgagtccaaactctggtgatgtgcccaacccgtgagctggcggagcaggtagcaggcgagctacgtcgtattgcccgcttcaagcacaatatcaaaattaccaccctctgtggcggcatgcccatcaagcctcaactggcctctctggaacatcaggcccatattgtggtcggcaccccgggccgtattgaacagcatttaaagcgagaaagtctcaatcttgaccacgtcaccaccctggtcctcgatgaagcggatcgcatgctggacatcggctttgccgatacccttgatgccattataagctatctcccccggcgtcgtcagaccctactcttctctgccaccttccccgatgagatcctccgtctgagtgaacaatttcagtataaggcccaaagggtcatagtcgacgtagagcacgaggaaaactcaattcagcaagagttctttgagtgcaaatgggataaaaaagcagctattgtcagcagaattttggccactcataagcctgagtccaccctgatcttctgtaatactaaagcgaactgcagggatatagccgaggccttagaggccaaaggattttcggccctggccattcacggagaccttgaccagagagaacggacagaagttctggtacgtttctccaacggcagtagtcctatcatggtggccaccgatgtggcagcccgaggacttgatatcaatgggctcagcgcagtaatcaacgtcgatcttccctttgagtccgaggtctatatccatcgtatcgggcggacgggtcgagccgggaaagagggtctggccttttcccttatggagcctggcgaagagttcaggttggaggagattaatcgtctgatgggcactgactttaagatttccgatgtcgaggcgcttgctccggcaggcaaaggcgtaacagccctgccaccgatggtgaccctctctatcaacggtggacgaaagaccaagctcaggcccggagatattttgggagccctgactaaagatgcgggcattgccggaagcaaggtgggcaagatcaactgttttgatttttactcctatgtcgccattgaacgttccgtagcagacgaggccgaaagggcactttccaccaaaaagatcaagggacgacgctttattatctatcgtcatgagggggagggagtcaaatcctcctttgagtattaa

SEQ ID NO: 38802 - protein, 469 aa, Desulfotalea psychrophila LSv54
MSAFTTLALSKAMTDNLEIMGYHEMTPIQAESLPHVLEGEDLLAQAKTGSGKTAAFGIGLLHNLDVSLFRVQTLVMCPTRELAEQVAGELRRIARFKHNIKITTLCGGMPIKPQLASLEHQAHIVVGTPGRIEQHLKRESLNLDHVTTLVLDEADRMLDIGFADTLDAIISYLPRRRQTLLFSATFPDEILRLSEQFQYKAQRVIVDVEHEENSIQQEFFECKWDKKAAIVSRILATHKPESTLIFCNTKANCRDIAEALEAKGFSALAIHGDLDQRERTEVLVRFSNGSSPIMVATDVAARGLDINGLSAVINVDLPFESEVYIHRIGRTGRAGKEGLAFSLMEPGEEFRLEEINRLMGTDFKISDVEALAPAGKGVTALPPMVTLSINGGRKTKLRPGDILGALTKDAGIAGSKVGKINCFDFYSYVAIERSVADEAERALSTKKIKGRRFIIYRHEGEGVKSSFEY

SEQ ID NO: 38803 - DNA, 1383 bp, Yersinia pseudotuberculosis IP 32953
  CDS (1)..(1383)
gtgagcacaacttccttttcttccctgacactgcctgctgagcagttgtccaatcttaatgaacttggctataccgagatgaccccggtacaagctgcggtgttacccgcaatcctcaacgggcaggatgtccgggcgaaggccaaaaccggcagcggtaaaacagccgcatttggcattggtttgctggacaaaatagcggtaggggaatttgttacccaagcgctggtattgtgcccaacccgagaattagcagaccaggtcagtaaagagctgcgccgtttagcacggtttacacaaaatattaaaattctgaccctgtgtggcggccaaccgatgggccaccaattagattctctggtccatgcaccgcacattgtcgtgggtacgccagggcgtattcaggaacatctgcgcaagaaaacgctggtacttgatgagttgaaaacgctggtgttggatgaagctgatcgcatgttggatatgggtttttccgatgccattgatgacgtgattgcgtatacccctccacagcggcaaaccttgttgttctctgccacctacccatcaggtattgagcagatcagtgcacgagttcagcgccaaccattgaatgttgaagtgggtgataccgatgaagagcccgctattgaacaggtgttttttgaaacgactcgtgagaaacggctgccactgctgatctcagttctgagctattaccagccggcctcttgtgtggtgttctgtaacaccaaaaaagattgtcagagcgtttatgagtcactggaatcacgtggtatcagtgtcttggctttgcacggggatttagaacagcgtgatcgtgatcaggttctggtgcgttttgccaatcgtagctgccgtgtgttggtggcgaccgatgttgctgctcgtggtttagatatcaaggatctggagctggtcattaactttgaattggcgtttgatcccgaaattcacgtacaccgcattggccgtaccgggcgcgcagggatgagcggcctggccgttagcctatgtacgccacaggaaatggtacgtgcccataccatcgaagattatctgcaaataaaattgaaatggacacctgcggaacaggttagccgtagcaccaacatcatgctggaaccagaaatggtgacgttatgcattgacggggggcgcaaagctaaaattcgccctggtgacattctcggggcattaaccggtgatgcagggttaaccgccgcagatgtgggtaagattgatatgttcccggttcatgcctatgtggctatccgtaaagccagtgccaagcgtgcgttgcaacaattgcagcaaggcaaaatcaaaggtaaaaactgtaaagcccgtctattaaaataa

SEQ ID NO: 38804 - protein, 460 aa, Yersinia pseudotuberculosis IP 32953
MSTTSFSSLTLPAEQLSNLNELGYTEMTPVQAAVLPAILNGQDVRAKAKTGSGKTAAFGIGLLDKIAVGEFVTQALVLCPTRELADQVSKELRRLARFTQNIKILTLCGGQPMGHQLDSLVHAPHIVVGTPGRIQEHLRKKTLVLDELKTLVLDEADRMLDMGFSDAIDDVIAYTPPQRQTLLFSATYPSGIEQISARVQRQPLNVEVGDTDEEPAIEQVFFETTREKRLPLLISVLSYYQPASCVVFCNTKKDCQSVYESLESRGISVLALHGDLEQRDRDQVLVRFANRSCRVLVATDVAARGLDIKDLELVINFELAFDPEIHVHRIGRTGRAGMSGLAVSLCTPQEMVRAHTIEDYLQIKLKWTPAEQVSRSTNIMLEPEMVTLCIDGGRKAKIRPGDILGALTGDAGLTAADVGKIDMFPVHAYVAIRKASAKRALQQLQQGKIKGKNCKARLLK

SEQ ID NO: 38805 - DNA, 1581 bp, Symbiobacterium thermophilum IAM 14863
  CDS (1)..(1581)
atgacggaaacgaagttgacatttcgtgatttagcgttgtccgagaaggtgctgaaggcactggacgatatggggtttgaggagccctcgccgattcaggcgcaggcgattcccgcactgctgcagggcaaggacgtgatcgggcaggcgcagaccggcacgggcaagaccgcggccttcggcgtgcccatcgtcgagcggctggttcccggtcagcgggccgtgcaggcgctggtcctcaccccgacccgtgagctggcgatccaggtcgcggaggagatcaccaagatcgggcgccacgcgcgcgtgaagaccatcgccatctacggcggccagtccatcgagcggcagatccgctcgctccggttcggggtggacgtggtcatcggcacgccgggccggatcctggatcacctcggccggagcaccctggacctgtcccaggtgcggatggtggtcctggacgaggccgacgagatgctggacatgggctttatcgaggacatcgagaagatcctgcagaacacgcccgcggagcggcagacgctgctcttctccgcgaccatgccgccggagatccggcgtctggccgggcggtacatgcgggacccgatcacgatctcggtgacgccccagcagctcaccgtcccgcagatcgaccagtacttctgcgaggtgcggccgtcgttcaagaccgaggcgctcacccgcatcctggacatcgagaacgtggagcgggggatctgcttctgccgcaccaagaagggcgtcgacgagctggtggaggctctgcaggcccggggctaccaggccgagggcatccacggcgacatgaaccaggcgcagcgcaaccgcgtgatgagccggttcaaggagggctatatcgagctgctggtcgcgacggacgtcgccgcccgcgggctggacatctccgacgtgacccacgtcttcaactacgacatcccgcaggacccggagagctacgtgcaccgcatcggccgcaccgggcgcgccgggcgcaccgggaccgccatcacgctggtgacgccccgggagttcccgcagctccggctgatcgagcgggtgatcaaggcccggctgcagcgccggcccgtgccgaccctgagcgacgtggcggagaagcagcgggagcagctgaaggagcggctgatcaagatcctcgaggaggataagctcggcgagttcagggagctggccgaggacctcctggccgagtacgaccccagcgacctggtggccgccgccctgaagctggtctcgggcgagggcaagcccgcccagcaggcgcagatggagttcggcgacaccggcgccgaggcggggatggtccgcttattcctgaacgtcggccgcgctcaggcgatccagccggcggacatcgtgcggaccatcgcgcaggaggccaacattccgggctcgtccatcggcatcatcaacatctatgaccggttcacgttcgtggaggtgcccaaggaggtcgccgcccaggtgatgcaggcgatgcagggcgccacgatccgcgggtaccaggtcaacatggagcccgcaaagccgcgctag

SEQ ID NO: 38806 - protein, 526 aa, Symbiobacterium thermophilum IAM 14863
MTETKLTFRDLALSEKVLKALDDMGFEEPSPIQAQAIPALLQGKDVIGQAQTGTGKTAAFGVPIVERLVPGQRAVQALVLTPTRELAIQVAEEITKIGRHARVKTIAIYGGQSIERQIRSLRFGVDVVIGTPGRILDHLGRSTLDLSQVRMVVLDEADEMLDMGFIEDIEKILQNTPAERQTLLFSATMPPEIRRLAGRYMRDPITISVTPQQLTVPQIDQYFCEVRPSFKTEALTRILDIENVERGICFCRTKKGVDELVEALQARGYQAEGIHGDMNQAQRNRVMSRFKEGYIELLVATDVAARGLDISDVTHVFNYDIPQDPESYVHRIGRTGRAGRTGTAITLVTPREFPQLRLIERVIKARLQRRPVPTLSDVAEKQREQLKERLIKILEEDKLGEFRELAEDLLAEYDPSDLVAAALKLVSGEGKPAQQAQMEFGDTGAEAGMVRLFLNVGRAQAIQPADIVRTIAQEANIPGSSIGIINIYDRFTFVEVPKEVAAQVMQAMQGATIRGYQVNMEPAKPR

SEQ ID NO: 38807 - DNA, 1587 bp, Bacillus cereus ZK
  CDS (1)..(1587)
ttgacaacatttcgagaattaggattaagtgattctttactgcaatctgttgaaagtatgggctttgaagaggctacgccaattcaagctgaaacaattccacatgcattgcaaggtaaggatattattgggcaagcacaaacaggtacagggaaaacagcagcattcggattaccactattagataaagtggatacacataaagaatcggttcaaggtattgttatcgcgccaacgcgtgaattagcaattcaagttggagaagagctatacaaaattggtaaacataaacgcgttcgtatcttaccaatttacggtggtcaagatattaaccgccaaattcgtgctctaaaaaaacacccacacattattgttggtacgccgggtcgtattttagatcatattaaccgtaaaacacttcgcttacaaaacgtagagacagttgttcttgacgaagcggatgaaatgttaaacatgggcttcattgaagatattgaagcaattttaacagatgtgccagaaacacatcaaacattactattctcagcgacaatgccggacccaattcgtcgtattgctgagcgtttcatgactgagcctcaacacattaaagtaaaagcaaaagaagtaacaatgccaaacattcagcagttctatttagaagtgcaagaaaagaaaaagtttgacgtgctaacacgcttactagatattcaatctccagagcttgcgattgtgttcggtcgtacaaagcgtcgtgttgatgaattatcagaggcattaaacttacgtggttatgctgcagaaggtatccatggtgatttaactcaggcgaaacgtatgtctgtattacgtaaattcaaagaaggttctattgaagttcttgttgcaacagacgttgctgcacgtggtcttgatatttcaggcgtaacacacgtatataacttcgatattccgcaagacccagaatcatatgttcaccgtattggccgtactggtcgtgcaggtaaaaaaggtattgcaatgctatttgtaacaccacgtgaatctggacaattaaaaaatatcgagcgtacaacaaaacgtaaaatggaccgcatggatgcaccgacacttgacgaggcactagaaggtcaacaacgtttaatcgctgaaaaacttcaaagcacaattgaaaatgaaaacttagcatactacaagcgtattgcagaagaaatgttagaagagaacgactctgtaacagtagtagctgctgctttaaaaatgatgacaaaagagccggatacaactccaatcgctttaacatcagaaccaccagttgttgcaagaggtggcggttctaaaaaacgcggcggtaacggaggcggataccgtgatggtaaccgtaatcgtagtcgtgatggacgcggtggcgatggtcgtaaccgtgaccgtaatcgtgatggtcgcaatcgtgacggtaaccgtgatcgcaatcgtgaaggtagccgtgatggtaaccgtggtcgtcgtggcgaaggtcaaggacgcccaggatcttcaaacggacgcggcgaaagaaaacaccatagccgtaagccacaagcttaa

SEQ ID NO: 38808 - protein, 528 aa, Bacillus cereus ZK
MTTFRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVARGGGSKKRGGNGGGYRDGNRNRSRDGRGGDGRNRDRNRDGRNRDGNRDRNREGSRDGNRGRRGEGQGRPGSSNGRGERKHHSRKPQA

SEQ ID NO: 38809 - DNA, 1842 bp, Mannheimia succiniciproducens MBEL55E
  CDS (1)..(1842)
atgactgaaactaaaatcacttttggggatttaggcctgcctgaattcattctttctgctgtttccgacatggggtttgaaacgccttcaccaattcaacaagcatgtattccgcatttattaaacggtcgtgacgtgttaggtatggcgcaaaccggtagcggtaaaacggcggcattctcacttccattgttagcgcaaattgatatagaagaaaaacatccgcaaatgctggtgatggcgccaacccgtgagcttgcaattcaggtagcggaagcttgtgaactatttactaaaaatgcaaaaggcgttcacattgcgacactttatggcggtcaacgctatgacatccaattacgcgcattacgccagggcgcacaggttgtagtcggaacaccgggccgtattttagatcatatccgccgcggcaccttaaatctttccgagttaaagttcatcgtattggatgaagcggacgaaatgctgcgtatgggctttattgatgatgtggaaaccgtgatggcggaattgccggcacaacatcaaaccgcgcttttctcggcaaccatgccggaaccgattcgccgtataaccaaacgttttatgacggatccgcaagaggtaaaaattcaatctactcaacgcactaatccggatattgcgcaaagttgttggtatgtgcgcggttatcgtaaaaatgaagccttgttgcgttttcttgaggtggaagattttgatggagccattatctttacccgcactaagaccggtactttagacgttaccgaactattggaaaaacacggtttccgtgccgccgcattaaacggcgatatgactcagcaactgcgcgaacagactttagatcgcttacgtaacggtagcctggatattttagtggcaacagatgttgcagctcgcggtttggacgttgaacgtattagtttggtggttaattatgatattccgttagatgcggaatcttacgttcaccgcatcggtcgtaccggtcgcgcgggtcgttccggtagcgcaattttgtttgtagagccgcgcgaacgccgtttgttaagtaatatcgagcgtttaatgaaaaaaccgattgaagaagtggacgtaccgaatcacgaagcgttacaggctcgccgtcgtgaaaaattcaaagcgaaaattaccaaacaattggaacatcatgatttagaacaatatcgtttattattagaaggtctgtttactccggatcaggatcaggaagacattgcggccgcaatgttgatgttattacaaggcaaacagaaattaattcttccgcctgagccgccgatggaaaaacgcggtcgtcgcgaacgtgatgatcgtcgcggagagcgaggtgatcgtcgtgaacgtcgtccggaagagcgccgcggttacggcaatcctcaaccgatggatttataccgtattgaagtcggtcgtgcggacggtgttgatgttcgtcatattgtcggtgcgattgccaatgaaggcgatattaacagccgtaatatcggtcatattaaactttatgatgaatattcaacggtagaattaccacaaggtatgccgaaagaattattacaggttttcggtaaggctcgtgtgttaaacaaacaaatgcgtatgacatttgtaagtgaagccggtgaaaccgtaggtcgtgaacgtcatgaaggtcgccgtaatgatcgtcgtgataacggttttagacgtgaagaacgtcgctttaatgacagaggaaaccgctcttttaatgagcgggcgcctcgcagagagttcagagaacgtaatgatcgcagagaccgtagggatcgtcgcagttaa

SEQ ID NO: 38810 - protein, 613 aa, Mannheimia succiniciproducens MBEL55E
MTETKITFGDLGLPEFILSAVSDMGFETPSPIQQACIPHLLNGRDVLGMAQTGSGKTAAFSLPLLAQIDIEEKHPQMLVMAPTRELAIQVAEACELFTKNAKGVHIATLYGGQRYDIQLRALRQGAQVVVGTPGRILDHIRRGTLNLSELKFIVLDEADEMLRMGFIDDVETVMAELPAQHQTALFSATMPEPIRRITKRFMTDPQEVKIQSTQRTNPDIAQSCWYVRGYRKNEALLRFLEVEDFDGAIIFTRTKTGTLDVTELLEKHGFRAAALNGDMTQQLREQTLDRLRNGSLDILVATDVAARGLDVERISLVVNYDIPLDAESYVHRIGRTGRAGRSGSAILFVEPRERRLLSNIERLMKKPIEEVDVPNHEALQARRREKFKAKITKQLEHHDLEQYRLLLEGLFTPDQDQEDIAAAMLMLLQGKQKLILPPEPPMEKRGRRERDDRRGERGDRRERRPEERRGYGNPQPMDLYRIEVGRADGVDVRHIVGAIANEGDINSRNIGHIKLYDEYSTVELPQGMPKELLQVFGKARVLNKQMRMTFVSEAGETVGRERHEGRRNDRRDNGFRREERRFNDRGNRSFNERAPRREFRERNDRRDRRDRRS

SEQ ID NO: 38811 - DNA, 1254 bp, Mannheimia succiniciproducens MBEL55E
  CDS (1)..(1254)
atgtctttagatcatttaagccaacagcgtttcgccgatttaccccttaatgccaaagtattggaagccttagaaagtaacggcttcgaatattgtacgccgattcaggcgctttctttgcctatttcattggcgggtaaagatgttgccgggcaggcgcaaaccggtaccggcaaaaccatggcgtttttaaccgcaactttccaccatttattagaacatcccgttaaaacgaatcatccgcgggcgttgattatggcgccgaccagagaacttgcggtacaaatcgctcatgatgcggaacgtatggtgaaaaccaccggtttaaaaaccgcacttgcctatggcggtgacggttatgacaaacagctgaaagccattgaagcgggtgcggatattattatcggcactaccggacgcattattgattatgtgaaacaaaatattattgctttatcgcatattcaggtggtggtgctggatgaagcggatcgcatgttcgatctcggttttattaaagatattcgctatttaatgcgcaaatgcccttcacctaagcagcgccttactttgctgttttccgcaaccctttcttacaaagtgcgggagctggcgtttgaagatatgaatgatcccgaatatgtggaagtggaaccgctgcaaaaaaccggtcaccgcattaaagaggaattattttatccttccaatgaagataaaatgccgttgcttatcactttattagaagaagaatggccggagcgttgcattatttttgccaataccaaacatcaatgcgagaaaatctggggttatttagccgccgacggtcatcgtgtgggtttgctgaccggtgatgtcgcgcagaaaaaacgtttatctctgctgaaacagtttaccgacggcgctttggatattttagtggcgacggatgtggcggcgcgcggcttgcatattccggatgttactcacgtatttaattatgatttgccggacgaccgggaagattacgtgcaccgtatcgggcgaaccggtcgagcgggggaaagcggcgtttccattagtttcgcctgcgaagaatatgcgatgaatctgcctgccatcgaagaatatatcgggcaccatattgcggtaagtcaatatgattccgactcgttaattcgcgatttggcaaaaccttaccgtttaaaaccgagtctgccggcaagcaatcgtcataatcgaaacggggcaaagcctttcaaaaaacgtttttaa

SEQ ID NO: 38812 - protein, 417 aa, Mannheimia succiniciproducens MBEL55E
MSLDHLSQQRFADLPLNAKVLEALESNGFEYCTPIQALSLPISLAGKDVAGQAQTGTGKTMAFLTATFHHLLEHPVKTNHPRALIMAPTRELAVQIAHDAERMVKTTGLKTALAYGGDGYDKQLKAIEAGADIIIGTTGRIIDYVKQNIIALSHIQVVVLDEADRMFDLGFIKDIRYLMRKCPSPKQRLTLLFSATLSYKVRELAFEDMNDPEYVEVEPLQKTGHRIKEELFYPSNEDKMPLLITLLEEEWPERCIIFANTKHQCEKIWGYLAADGHRVGLLTGDVAQKKRLSLLKQFTDGALDILVATDVAARGLHIPDVTHVFNYDLPDDREDYVHRIGRTGRAGESGVSISFACEEYAMNLPAIEEYIGHHIAVSQYDSDSLIRDLAKPYRLKPSLPASNRHNRNGAKPFKKRF

SEQ ID NO: 38813 - DNA, 1446 bp, Bacillus licheniformis ATCC 14580
  CDS (1)..(1446)
atgagcaaagccagttttagagactatgcattaagcggcgatattacgaaagcgctcgatcacttaggatataaggagccgactgcggtgcagagcgaagtgattcccgcggtgcttaaaaagcgggatgttgtggtgaaatcgcggacggggagcgggaagacggccgcgttcggaattccgctttgcgagctgaccgaatgggaagagaacaaaccacaagccttggttttgacaccgacgcgcgagcttgccgctcaggttaaggaggatttgacgaacatcggccgctataaaagaataaaagcagcggctgtttacgggaagtcatcctttgaacggcaaaaaacggagctcaagcaaaaatgccatatcgttgtcgggccgccgggccgcgtattggatcacattgaaaaaggaacccttccattagaaaaactgaaataccttgtcatcgatgaggccgatgaaatgctgaatatgggatttatcgatcaagtgggagcaatcatccgccatttgcctgaagaacggctgacaatgctgttttcagcaacttttccggaggatgtggagcatctatcccttcaatatatgaaagaccctttgaaaatcgagattaaagcaggcggtacgacaaccgcagacatcgagcatcaactgatcattgtaaacgaaaatgatccattttcgcttttagtggatctgttcattgttgaaaacccggacagctgcatcgtcttttgccgcacacaggagcaagtgaatgagttgcagtggcgcctatccgttttgggttatccgtgcgagaaaattcacggcggcatgcctcaggaggatcgttttgccgtgatgaaccgtttcagacggggagcgttccgctatttaatcgcgacagatgtggcggcaagaggcatcgacattgagaacatcacacatgtcatcaactatgagctgccattagatcaagaaagctatgtgcatcgtaccggaagaacaggccgagccggcagccggggaaaagcgattactcttgccagtgcgcgtgaaaagaggatgattgctgacattgaagactatatcggttttcatattcctattattgaggagccgtcaaaagaagaaattgcacgggcaaaagcggcgtttcaaaagaaaatcaataggaagccggagcttaaacaggacaagagcgaatcgttaaataaggaaatcatgaggctctactttaacgggggaaaaaagaagaagcttagagctgttgatttcgtcggaacgattgctaaaattgacggcgtctccgccgaggatatcgggattatcacgatccaggagcaaggttcattcgttgaaattttaaacggcaaaggtccgctcgtcttagatgcgatgaaaaacacgacagtgaaagggaaattgctgaaagtgcataaagcgaggaaataa

SEQ ID NO: 38814 - protein, 481 aa, Bacillus licheniformis ATCC 14580
MSKASFRDYALSGDITKALDHLGYKEPTAVQSEVIPAVLKKRDVVVKSRTGSGKTAAFGIPLCELTEWEENKPQALVLTPTRELAAQVKEDLTNIGRYKRIKAAAVYGKSSFERQKTELKQKCHIVVGPPGRVLDHIEKGTLPLEKLKYLVIDEADEMLNMGFIDQVGAIIRHLPEERLTMLFSATFPEDVEHLSLQYMKDPLKIEIKAGGTTTADIEHQLIIVNENDPFSLLVDLFIVENPDSCIVFCRTQEQVNELQWRLSVLGYPCEKIHGGMPQEDRFAVMNRFRRGAFRYLIATDVAARGIDIENITHVINYELPLDQESYVHRTGRTGRAGSRGKAITLASAREKRMIADIEDYIGFHIPIIEEPSKEEIARAKAAFQKKINRKPELKQDKSESLNKEIMRLYFNGGKKKKLRAVDFVGTIAKIDGVSAEDIGIITIQEQGSFVEILNGKGPLVLDAMKNTTVKGKLLKVHKARK

SEQ ID NO: 38815 - DNA, 1911 bp, Bacteroides fragilis YCH46
  CDS (1)..(1911)
atgaagacatttgaagagcttggcgtttctccggagatacgtaaagctattgaagagatgggatacgagaatcccatgccggtacaggaggaagtgattccatacctattaggagagaataatgatgtagtagctcttgcacagacagggacgggtaagaccgcagcgtttggcttgcccctcatccagaaaattaacgtaaaaaacagaatacctcaatcactcgttctttgccccacacgcgagctttgcctccagatagcaggcgacctgaacgactattccaaatacatcgacgggctgaaagtattgcccgtatacggcggttcatccatcgacagccagatacgcagcctgaaacggggtgtgcatatcattgttgccacaccggggcgactcctcgacttgatggaacgcaaaacggtatctcttgccactgtcacaaacgtagtgatggacgaagcggacgaaatgctcaatatgggctttacggacagtatcaatgccatcctggcagatgttccacaagaacgtaacacactgcttttctcggccactatgagcccggaaatagcccgtatttcgaagaactaccttcacaatgcaaaagagatcaccatcggacgcaagaacgaaagtacgagcaacgtgaagcatgtggtctataccgtacatgcaaaagataaatacgccgctctgaaacgcatcgtagactattatccgcagatttacggtatcatcttctgccgtacccgcaaagagacacaggagattgccgataaactgatgcaggaaggttataacgctgactcgttgcacggagaactctcacaggcacagcgtgacacggtgatgcagaagttccgcatccgcaacatccagatcctggtagccaccgatgtagccgcgcgcggactggacgtagacgacctgacacacgtcatcaactacggattgccggacgatacggaaagttatacgcaccgtagcggacgtacaggacgtgccggaaagacaggtacatccatcgccatcatcaatttgcgtgaaaaaggaaagatgcgcgaaatagaacgcatcatcggtaagaaattcattgccggtgaaatgcctaccggtaagcagatctgcgagaaacagcttctcaaagtgatagacgatcttgaaaaagtaaaggtaaacgaggaggatatcaatgatttcatgcctgagatttaccgtaaactggagtggctgagtaaagaagacctcatcaagcgcatggtatcgcatgagttcaaccggtttgtcgactattatcgcaaccgcgaagaaatagaggtgccgactgatagccgcagcgaacgcgccgggaaaagccgtgaaggaaaaagcagccgccaggcagaaccgggttacacccgccttttcatcaatctgggtaagatggataacttcttccctcacgaactgatcaccttgctcaacaataacacacgaggaagagtagaattgggacgcatcgacctgatgaaaaatttctcgttcttcgaagtggaagagaaacaagcacaaaacgtcgtaaaggcgctgaaccggacaaactggaacggacgtaaagtcacagtagaggtagccggagaagaggcatctacagagcacaaaggacgtggaaagcggaatgaaggtaacgatcagggtggcagaggaagaagcagcgctccatctgccgaccgcaaagagagaggcaaaggcagcaaagacagcaaacaagccgacagccggaaaggcaaaaagccaagccgtgaggaacggggatattccgcagcccgcggccccaaaggcaaagatgaatggaaacagttctttaaagatgccgaacccgacttcagcgaagaaggatgggcaagaagaaagcctaaaaagagctaa

SEQ ID NO: 38816 - protein, 636 aa, Bacteroides fragilis YCH46
MKTFEELGVSPEIRKAIEEMGYENPMPVQEEVIPYLLGENNDVVALAQTGTGKTAAFGLPLIQKINVKNRIPQSLVLCPTRELCLQIAGDLNDYSKYIDGLKVLPVYGGSSIDSQIRSLKRGVHIIVATPGRLLDLMERKTVSLATVTNVVMDEADEMLNMGFTDSINAILADVPQERNTLLFSATMSPEIARISKNYLHNAKEITIGRKNESTSNVKHVVYTVHAKDKYAALKRIVDYYPQIYGIIFCRTRKETQEIADKLMQEGYNADSLHGELSQAQRDTVMQKFRIRNIQILVATDVAARGLDVDDLTHVINYGLPDDTESYTHRSGRTGRAGKTGTSIAIINLREKGKMREIERIIGKKFIAGEMPTGKQICEKQLLKVIDDLEKVKVNEEDINDFMPEIYRKLEWLSKEDLIKRMVSHEFNRFVDYYRNREEIEVPTDSRSERAGKSREGKSSRQAEPGYTRLFINLGKMDNFFPHELITLLNNNTRGRVELGRIDLMKNFSFFEVEEKQAQNVVKALNRTNWNGRKVTVEVAGEEASTEHKGRGKRNEGNDQGGRGRSSAPSADRKERGKGSKDSKQADSRKGKKPSREERGYSAARGPKGKDEWKQFFKDAEPDFSEEGWARRKPKKS

SEQ ID NO: 38817 - DNA, 1284 bp, Bacteroides fragilis YCH46
  CDS (1)..(1284)
atgacatttgaaaatttgaatttgatagagcctatcttaaaggctttaagacaagagggttacacctctcccaccccaatacaagaacagtcaatccccattttacttcaaggaaaagatttattaggttgtgctcaaacaggtaccggtaaaacagctgctttttctatccctatcttgcaaaaattgtataaaaccgaccatcgtaaaggtatcaaggcacttgtgctgacgccaacccgggaacttgcaattcagataggtgaaagtttcgaagcatacggacggtataccggtctgaaacatgccgtaatctttggaggagtaggacagaaaccacagactgacgctctacggagcggtattcagatactggttgccactcccggcagattattggatttgatatcacagggatttatctccctgagttcacttgatttttttgtattagacgaagcagaccgtatgctggacatgggatttatccatgacatcaaacgcatcctgaaactgctaccggcccgaagacaaactttgtttttttcggcgaccatgccaccggaaatagaaacgttggcaaattcgatgttgactaaaccggagaaagtggaagtgaccccggcctcttcgactgtggacatcatctcacagcaggtctatttcgtcgagaaaaaagaaaaaaaggacttgctgatccatctgttgaaagatacatcaatcgagtcggtacttatctttacgcgtacaaaatacggagccgacaaattggcacgtgtactgactaaagccggtatcggagctgaagcgatacatggtaacaaaactcaaaatgcacgccagcgtgctttgaccaattttaagaaccatacccttcgcgccttgatagcaaccgacattgctgcacgcggcatcgatgtagaccaattatcacacgtaatcaattacgagttgcccaatgttccggaaacttacgtgcaccgcatcggtcgtaccggacgtgccggacatgaaggagtggccatctctttctgcgaatcagaagaactgccctacttaaaagatatccaaaagttgatagggaaaaacatcccggtggtaaaagaccacccgtttgtcacgaccgaaggtatcaaggcccaggaagaaaagcaggaagaaatcaaggttaaagccaaagccaacaaaacataccgcgggagccgggctaatggcgacttctggagacggaaaaagcaaaaaaccaatcaaccgtcttccaccaaacaggaaaaaaggaaatag

SEQ ID NO: 38818 - protein, 427 aa, Bacteroides fragilis YCH46
MTFENLNLIEPILKALRQEGYTSPTPIQEQSIPILLQGKDLLGCAQTGTGKTAAFSIPILQKLYKTDHRKGIKALVLTPTRELAIQIGESFEAYGRYTGLKHAVIFGGVGQKPQTDALRSGIQILVATPGRLLDLISQGFISLSSLDFFVLDEADRMLDMGFIHDIKRILKLLPARRQTLFFSATMPPEIETLANSMLTKPEKVEVTPASSTVDIISQQVYFVEKKEKKDLLIHLLKDTSIESVLIFTRTKYGADKLARVLTKAGIGAEAIHGNKTQNARQRALTNFKNHTLRALIATDIAARGIDVDQLSHVINYELPNVPETYVHRIGRTGRAGHEGVAISFCESEELPYLKDIQKLIGKNIPVVKDHPFVTTEGIKAQEEKQEEIKVKAKANKTYRGSRANGDFWRRKKQKTNQPSSTKQEKRK

SEQ ID NO: 38819 - DNA, 1362 bp, Methylococcus capsulatus str. Bath
  CDS (1)..(1362)
atgtcatcagattcgaattctgccggcccggcgtttgccgatctcgggctggctcagccccttttgcgcgccgtttccgaagccggttacgtccatcccacacccatccaggcccaggcgatcccgcttctgctcgccggcggcgatctgctggcggcggcccagaccggaaccggcaagaccgcaggcttcaccttgccgattctgcacaggctgctggagaaacaagctccgcgccggccgaggcgcccgcgctgtctcattctcgcgcccacccgcgagctggcggcgcaggtcctggaatcggtcgaaggctacggcaagtacgtccccctgaaagccacggtcatgtttggcggggtggggctcaacccccaggtccgtgctctcgcggccggcgtcgatatcctcgtcgccacgccgggccgcctgctcgatcattgcggacagaacaccgtcgatctttccgccgtggaaatcttcgtactggacgaggcggaccgcatgctggacatggggttcatccgcgacatccggcggattctgggactgctgccgaagcagcggcagaacatgctgttttcggccacgttttcggatgaaatccgcacgctcgccgacggcttgctgaacaatccgggctacgtcgaggtggcgcgccgcaacgcggcttccgatctggtggaccagaccgtccatctggtcgcccaggaacacaagcgcgatctgcttacccacttgatccgccggcacgactggcgtcaggtgctggtattcacccggaccaaacacggcgcgaaccggctggcggagaaactggccgaggatggcattcctgccgcggcgattcacggcaacaaaagccagtcggcgcgtacccgggcgctggcggatttcaaggacggcacggtgccggtgctggtggctacggacatcgcggcacgcggtctggacatcgaccagcttccccacgtggtgaacttcgaattaccgaacgtgccggaggactacgtccatcggatcggccgcaccgggcgtgccgggcgcgccggctctgccgtgtcgctggtagcgaaagaggaactgaagctgctgggcagcatcgagcgtctgatcaaacgcccgatccagcggggaacggtggaaggtttcaacccgccgtcccgcccgcggatcgagcgtcgggacgaccgctcacggcggccgcaggaggtgcgggatggcggtggccgacagtctcctccgggccagcccaaggcgcgggcaggtctggggtcccgcagcgctgcccggcatgcgcagaagccgcaacagcggcaggcgggcaaccggctgcgcagccagggcggcaagcgcggataa

SEQ ID NO: 38820 - protein, 453 aa, Methylococcus capsulatus str. Bath
MSSDSNSAGPAFADLGLAQPLLRAVSEAGYVHPTPIQAQAIPLLLAGGDLLAAAQTGTGKTAGFTLPILHRLLEKQAPRRPRRPRCLILAPTRELAAQVLESVEGYGKYVPLKATVMFGGVGLNPQVRALAAGVDILVATPGRLLDHCGQNTVDLSAVEIFVLDEADRMLDMGFIRDIRRILGLLPKQRQNMLFSATFSDEIRTLADGLLNNPGYVEVARRNAASDLVDQTVHLVAQEHKRDLLTHLIRRHDWRQVLVFTRTKHGANRLAEKLAEDGIPAAAIHGNKSQSARTRALADFKDGTVPVLVATDIAARGLDIDQLPHVVNFELPNVPEDYVHRIGRTGRAGRAGSAVSLVAKEELKLLGSIERLIKRPIQRGTVEGFNPPSRPRIERRDDRSRRPQEVRDGGGRQSPPGQPKARAGLGSRSAARHAQKPQQRQAGNRLRSQGGKRG

SEQ ID NO: 38821 - DNA, 1809 bp, Nocardia farcinica IFM 10152
  CDS (1)..(1809)
atgagcaccaatcaggtcgacagcgttcctggcgacgacgacagggactcgggcggagccgaatccggttccggctcggccggcccgtccttcgccgacttgggcatcgatgaccgcatcctgcgggcgattgccgatgtcggttacgaatccccctcgccgatccaggcggcgaccattcccccactgctcgacggcgccgacgtcgtcggcctggcgcagaccggcaccggtaagaccgccgcgttcgccatccccatcctgatgggcctcgaagtgaccggcaggcagccgcgcgcgctcgtgctcgcaccgacccgggaactggccatccaggtcgccgaggcgttcggccgctacgccgcgcacatgcccggcctgcatgtgctgccgatctacggcggccagagctacggcgtgcagctgtccgggctgcgccgcggcgcgcacgtcgtggtcggtacgcccggccgggtgatcgaccacctggagaagggcaccctcgacctgtcccagctgcagtacctggtgctggacgaggccgacgagatgctgaagatgggcttccaggaagacgtcgagcgcatcctcgccgacaccccgcgcgagaagcaggtggccctgttctcggccaccatgcccgcggcgatccggaagatctccaagcagtacctgcgcgagccggtcgagatcaccgtcaaggccaagacccagaccaacaccaacatcacccagcgctgggtgcaggtgtcgcatcagcggaaactcgacgcgctcacccgggtgctcgaggtggagccgttcgaggcgatgatcatcttcgtccgcaccaagcagggcaccgaggaactcgccgagaagctgcgcgcccgcggattctccgcggcggccatcaacggcgacatcgcgcagaaccagcgcgagcgcaccatcggccagctcaagtccggcgcgctggacatcctggtcgccaccgacgtcgccgcgcgcggcctggacgtcgaccgcatctcgcacgtggtcaactacgacatcccgcacgacaccgagtcctacgtgcaccgcatcggccgcaccggccgggccgggcgcagcgggcaggcgttgctgttcgtcgccccgcgcgagcggcatctgctcaaggccatcgagcgcgccacccggcatccgctcgaggagatgcagctgcccagcgtggaggacgtgaacgcgcagcgggtcagcaagttcggcgacgccatcaccgagaatctgtcctcggcgaacctgccgctgttccgcaagctcatcgaggactacgagcgcgagcacaacattccgctcgtcgacatcgcggccgcgctggccgtgggctcctacgacggcgacaacttcttcatggaggccgagccggaacccgaacggcgcgaacgtgttccgcgggagcggccggcccggcggttcgacgaggaacgcggcggcggttcgcaccatcgggccaccggcaccgaactggccacctaccggatcagcgtcggcaagcggcaccgggtggtgccgggcgcgatcgtcggcgccatcgccaacgagggtggcctgcggcgcagcgatttcgggcacatcagcatccggcccgaccacagcctggtcgagctgcccgcgcagctgcccgccgaaacgctggaggcgttgcggcgcaccaggatcagcggcgtgctcatccagttgcagctggaccagggaccgcccgcgcagcgcgcgttcagccgcgggccgcggcgcgaccgggacgcgggcaaacgaccggagcggcgcaagccccgatcctga

SEQ ID NO: 38822 - protein, 602 aa, Nocardia farcinica IFM 10152
MSTNQVDSVPGDDDRDSGGAESGSGSAGPSFADLGIDDRILRAIADVGYESPSPIQAATIPPLLDGADVVGLAQTGTGKTAAFAIPILMGLEVTGRQPRALVLAPTRELAIQVAEAFGRYAAHMPGLHVLPIYGGQSYGVQLSGLRRGAHVVVGTPGRVIDHLEKGTLDLSQLQYLVLDEADEMLKMGFQEDVERILADTPREKQVALFSATMPAAIRKISKQYLREPVEITVKAKTQTNTNITQRWVQVSHQRKLDALTRVLEVEPFEAMIIFVRTKQGTEELAEKLRARGFSAAAINGDIAQNQRERTIGQLKSGALDILVATDVAARGLDVDRISHVVNYDIPHDTESYVHRIGRTGRAGRSGQALLFVAPRERHLLKAIERATRHPLEEMQLPSVEDVNAQRVSKFGDAITENLSSANLPLFRKLIEDYEREHNIPLVDIAAALAVGSYDGDNFFMEAEPEPERRERVPRERPARRFDEERGGGSHHRATGTELATYRISVGKRHRVVPGAIVGAIANEGGLRRSDFGHISIRPDHSLVELPAQLPAETLEALRRTRISGVLIQLQLDQGPPAQRAFSRGPRRDRDAGKRPERRKPRS

SEQ ID NO: 38823 - DNA, 1770 bp, Legionella pneumophila str. Paris
  CDS (1)..(1770)
atgaatcaagaaatatcaaacttctctacttttaatttttctagtgctttaaataaagcgttagaagatatgaagtttattacgccatcgcctatccaggctcaaaccattcctttgatattggaaggtcgtgatgccattgctcttgcgcaaactggtacaggtaaaacagcagcttttgcattaccaattttgcaaaatctgtctcctgagatatctaccactcaggctttgattttagcccctactcgtgaattggcaatccaggttgcagagcagtttgaattattaagcaagtaccaacgcaatgtgacgattgctgttctttgcggtgggcaagaatatggtcgtcaattaaaacaattgcgtagtggtgcgcaagtggttgttggaacgccaggacgtattctggaccatatcgataaaggcactttgctcttaaataatctgaagacatttattcttgacgaagcagatgaaatgttgcgtatgggtttcatcgaagatgtagaaaccattttagaaaaactgcctgaaaaaaagcaaatggcattgttttcagcaaccatgccctatcgaattcgtcaaatagccaatacttatttgaatgaccctgcctcaattgaaatccgtatggaaactgcgacggtcaagtctattgagcaacggtttttatttgcttccgttcatcaaaaaccggatgcgttaatccgggtcttggaagtggaggattatcaaggggttatcgtttttgtacgcactaaaagcagtactgaggaagtagcagaactattgcaacaacatggattaagagcaatggcaattcatggtgatattactcagtctttgcgtgagcggattattgcccaatttaaacaaggagcgattgatattctggtggcgacggatgtcgctgcaagaggtttggatgtcgagcgagttactcatgtgattaattatgatatgccacatgacaatgaaacttatgttcacagaattggcagaacagggagggctggccgttctggtgttacgattttatttgtaactcccaaggagtcgcgtttaatttccagcattgaacgccataccaggcaacgaattgagaaagttcaagttcctaatgaccatatgatacagatggctcgtcaacaaagattcatgtctaacattactactcgactgaatcatgagcatgtgtattcctacaaaaggattgtggaagaatacattaaagagcatgacgtatcagcagtagatgttgcggctgctcttgctttattgctgcataaagatatgccttggagaaaagaattaaatatgcctaaagcagcttcagcattcaaagaagaaagagctcgggtaggagaaaaaggattggatttacgtggtcgatttaaggaagatagaaaaagctcttttgctgatcggaaaggtgcgcgaggaagcaagaaagattttgccaaagatttttctaatgaaaggaaaaaatttaatgatggcaggaaggccgttaatcaagaatcagtagcccaggatttatttcgcattgatgtaggcaaaattcatggagtcaaacctggcaacatagtaggggctattgctaatgaggctggcttgcaaagccgatatattactgggcttaaaattcatgaagatcactccactgttcgtttaccaaaaggtatgcctaaagaagtgatgaaggacttaaccaaggcttgggtttgcggccgccaactcaatttaacattaattggtagtgcctga

SEQ ID NO: 38824 - protein, 589 aa, Legionella pneumophila str. Paris
MNQEISNFSTFNFSSALNKALEDMKFITPSPIQAQTIPLILEGRDAIALAQTGTGKTAAFALPILQNLSPEISTTQALILAPTRELAIQVAEQFELLSKYQRNVTIAVLCGGQEYGRQLKQLRSGAQVVVGTPGRILDHIDKGTLLLNNLKTFILDEADEMLRMGFIEDVETILEKLPEKKQMALFSATMPYRIRQIANTYLNDPASIEIRMETATVKSIEQRFLFASVHQKPDALIRVLEVEDYQGVIVFVRTKSSTEEVAELLQQHGLRAMAIHGDITQSLRERIIAQFKQGAIDILVATDVAARGLDVERVTHVINYDMPHDNETYVHRIGRTGRAGRSGVTILFVTPKESRLISSIERHTRQRIEKVQVPNDHMIQMARQQRFMSNITTRLNHEHVYSYKRIVEEYIKEHDVSAVDVAAALALLLHKDMPWRKELNMPKAASAFKEERARVGEKGLDLRGRFKEDRKSSFADRKGARGSKKDFAKDFSNERKKFNDGRKAVNQESVAQDLFRIDVGKIHGVKPGNIVGAIANEAGLQSRYITGLKIHEDHSTVRLPKGMPKEVMKDLTKAWVCGRQLNLTLIGSA

SEQ ID NO: 38825 - DNA, 1407 bp, Legionella pneumophila str. Lens
  CDS (1)..(1407)
atgattcaatcagaacacaacgaccaacacctatcattctctcaattcccccttcgtcaagaattaataaaaagtcttgcttcttcaaattatgaaaatatgacccctatccaaatgcaaagcctgcccataattcttagaaatgaagatctgatagcacaagcaaaaacagggagtggaaagaccgctgcttttgctttgtctttattaaataatttaaaaatttctttttttgcagtacaagccttggttctttgccctacccgtgaactcgcggaacaagtaagccaggctatccgtcgattagcctgttttatgcctaatgtcaaaattattaatttatctggtggtataccaatgcagcctcagcttgattcattacggcatggagctcatattattgtaggaacaccggggagaatacttaagcatttaaaaaacacctctttagacttatctcaggtaaaagctttaattttagatgaggcagacagaatgctggatatgggtttttttgatgacattaaaaacattatttcggtttgtcccaaacaacgacaaaccctgcttttttctgcgacctatcctgaagaaatcaaacggctttcaaaacaatttatgaaggaccctaaagaagttcatgtggtaactcctcctgaagaaattgatattgaacaacatttttatgaagtctcgagacatgctcagaaatttcccttattaaaatcattactgttgcactatcaacccgtttcagtgttaatcttctgtaataccaagcaacaaacaatagaagtcacagaccagctcatcaatgaaggcttcagtgccatcgctttaaatggtgatatggaacaaatcgagcgtgatcttgctgtcttgcgttttgccaacaaaagttgttctattcttgtcgccactgatgttgcagctcgaggacttgatataaaagaactttccgcagtgattaattttgatctcgcttttgatcacgacgtccatattcatcgtattggtcgaacaggacgagctgggagtaaaggcattgccttaagcattgtaacgcctgcagatgcacaacgaatttgcgccattgaagataactacccgcaccccattcattggggaaacattaatgaattagaaaatcacaacactgctcgcttagtgccagaaatggttacactctgtattgcttccggtaaaaaagataaaattcgccctggtgacatccttggggcattaaccaaagatgcaggattagcaggcaacacaattggcaaaattaacatcaccgctatgtactcctatgttgcaattcaccgcagccaagcagataaagcctaccaatatttacaaagtggaaaattaaaaggacgtaaagttaatgtacgtaaaataaattga

SEQ ID NO: 38826 - protein, 468 aa, Legionella pneumophila str. Lens
MIQSEHNDQHLSFSQFPLRQELIKSLASSNYENMTPIQMQSLPIILRNEDLIAQAKTGSGKTAAFALSLLNNLKISFFAVQALVLCPTRELAEQVSQAIRRLACFMPNVKIINLSGGIPMQPQLDSLRHGAHIIVGTPGRILKHLKNTSLDLSQVKALILDEADRMLDMGFFDDIKNIISVCPKQRQTLLFSATYPEEIKRLSKQFMKDPKEVHVVTPPEEIDIEQHFYEVSRHAQKFPLLKSLLLHYQPVSVLIFCNTKQQTIEVTDQLINEGFSAIALNGDMEQIERDLAVLRFANKSCSILVATDVAARGLDIKELSAVINFDLAFDHDVHIHRIGRTGRAGSKGIALSIVTPADAQRICAIEDNYPHPIHWGNINELENHNTARLVPEMVTLCIASGKKDKIRPGDILGALTKDAGLAGNTIGKINITAMYSYVAIHRSQADKAYQYLQSGKLKGRKVNVRKIN

SEQ ID NO: 38827 - DNA, 1368 bp, Photobacterium profundum SS9
  CDS (1)..(1368)
ttgatcgatatcactaacttaacggggcataaatacgctaaaatagcgcgctattatcttagctctgagccctttatattaatgactactgccacaacgccagccaactttacagaacttggccttatttcacctctattagctagattaactgagctggaatatcaacagccaacgcctattcaagcgcaagtgatcccaagcgtattagcaggacgtgacttaattgcaggggcaaatactggttcaggtaaaactgccgcttttgcactgcctatgttgcagcacctttttctgcaacagcacttgagtagcaaaagcagtaaagggaactatgttactagactgattttggtacctacccgtgaactggctaagcaagttgctgacagcattaaatcttatgccgtgcattttaacggtgcgattaaaacggttgctgtttttggtggtgtatcagcgaatactcaaatgctcgcattacgtggcggcactgatattttggttgcaacacctggtcgattactcgatttgatttcaagtaatgccattaagctcgatagggttaaaaccttagtgcttgatgaagccgatcgaatgttaagtctaggctttactgacgagctatctgcattgttgggtttattgccaaaaaataagcagacgttattattttcagcgacctttcctgaacaagtacagacgttaacccaagaattgcttaacgatcctgttgaaattcaattgcaaagtgcagatgccagcactttagttcagcgtgtttttaccgttaacaaaggtgaaaaaaccgcgttattagcacatttgatcaaacaaaatgaatggcgacaagcacttattttcgttaatgctaaaaacagctgtgagcacttagctgacaaactctctaaacgtggtattaccgcagaagtgtttcatggcgataaaggccagggcgctcgtactcgtgtgcttgacgcgtttaaagccggtgagattgaagtgttaattgcgactgatattgcggcccgtggtctagacattgaaaaactgccggtggtgatcaattttgacttaccaagaagtccatcagactacatgcaccgtattggtcgaagtggccgtgctggtgaagtgggcttagcgttatcgcttatcgatcatgacgattatcatcatttcaaagtcatcgaaaagaagaacaagatccgacttgaacgtgagcaagtagaaggctttgaagctgatgaagtgaatgaagcgtttttaattgcaaataagccgatggcaaaacctgaaggcagcggtaagaaaaaacgtaaaaataaagcatctttgaatgaagacatctggctggacaatttttaa

SEQ ID NO: 38828 - protein, 455 aa, Photobacterium profundum SS9
MIDITNLTGHKYAKIARYYLSSEPFILMTTATTPANFTELGLISPLLARLTELEYQQPTPIQAQVIPSVLAGRDLIAGANTGSGKTAAFALPMLQHLFLQQHLSSKSSKGNYVTRLILVPTRELAKQVADSIKSYAVHFNGAIKTVAVFGGVSANTQMLALRGGTDILVATPGRLLDLISSNAIKLDRVKTLVLDEADRMLSLGFTDELSALLGLLPKNKQTLLFSATFPEQVQTLTQELLNDPVEIQLQSADASTLVQRVFTVNKGEKTALLAHLIKQNEWRQALIFVNAKNSCEHLADKLSKRGITAEVFHGDKGQGARTRVLDAFKAGEIEVLIATDIAARGLDIEKLPVVINFDLPRSPSDYMHRIGRSGRAGEVGLALSLIDHDDYHHFKVIEKKNKIRLEREQVEGFEADEVNEAFLIANKPMAKPEGSGKKKRKNKASLNEDIWLDNF

SEQ ID NO: 38829 - DNA, 1389 bp, Photobacterium profundum SS9
  CDS (1)..(1389)
ttgagccaaacagctttttctactctaaacctgcacgcggatttgctaaaaaatctgacttctcttggttacgagtcaatgactcctattcaagcgctgagcttaccgcatatcttggcgggcgaagatgttatcgctcaaggtaaaacgggctcaggcaaaacagcagcctttggtcttggtctattagaaaaattgaacgtgaaacgttttcgtgttcagtctttagtactttgtcctacgcgtgaacttgctgatcaagtagcaaaagaaatccgtaaacttgcacgtactattcataacatcaaagtattgacgttatgtggtggtatgccgtttggtccacaaattggttcgctagagcatggcgcacacattattgtgggtacaccgggtcgtattgaagagcacgtacgtaaaggcacgttgaaccttgatgatctagaaatacttattctagatgaagctgaccgtatgttagagatgggtttccaagattcattagatgaaattattgatgcagcccctcagcgtcgtcaaacattactattcagtgcgacatatccacctcagattaagtctgttgctgatcgtattatgcacaagcctgtgatggcgaaagttgaatcaacgcatgatgaaagcactattcagcagcatttctataaagtagatggtaacgagcaacgtttaacggctttacgtttattactgttaaagcaccgtccagaatcgacagtggtattctgtaacactaaacgtgaagcgcaagaagtatcagacgatttagtggattatggtttcagctcaattgccctacacggcgatttggagcaacgtgaacgtgaccaagcattggttctttttgctaacaaaagtacatcagtattagttgcaacagatgttgcggctcgtggtctagacattgattcacttgatgccgtgattaactaccaccttgctcgtgatacagaagtacacgttcaccgtattggtcgtacaggccgtgcgggtagtaaaggtattgcatgttctttaattagtgataaagaacactacaaagtagccatgcttgaagattaccttgatagagcaatcagtggcgagccattaccttcaatggatctgcttgatcagccaacattccgccctgcaatgacaacactgcaaattgatggcggtaagcgtcaaaagattcgccctggtgatattcttggtgctctaacaggtgaaagcggtattgctggtgcccaagttggtaaaattcaaatttttgataactttgcgtatgttgctgtgaaaagtgaatcagtacgtgcggcaatgaagaaattagaagacggtaagctgaaaggtcgttctttccgcgttcgtcagattcgcggttaa

SEQ ID NO: 38830 - protein, 462 aa, Photobacterium profundum SS9
MSQTAFSTLNLHADLLKNLTSLGYESMTPIQALSLPHILAGEDVIAQGKTGSGKTAAFGLGLLEKLNVKRFRVQSLVLCPTRELADQVAKEIRKLARTIHNIKVLTLCGGMPFGPQIGSLEHGAHIIVGTPGRIEEHVRKGTLNLDDLEILILDEADRMLEMGFQDSLDEIIDAAPQRRQTLLFSATYPPQIKSVADRIMHKPVMAKVESTHDESTIQQHFYKVDGNEQRLTALRLLLLKHRPESTVVFCNTKREAQEVSDDLVDYGFSSIALHGDLEQRERDQALVLFANKSTSVLVATDVAARGLDIDSLDAVINYHLARDTEVHVHRIGRTGRAGSKGIACSLISDKEHYKVAMLEDYLDRAISGEPLPSMDLLDQPTFRPAMTTLQIDGGKRQKIRPGDILGALTGESGIAGAQVGKIQIFDNFAYVAVKSESVRAAMKKLEDGKLKGRSFRVRQIRG

SEQ ID NO: 38831 - DNA, 1872 bp, Photobacterium profundum SS9
  CDS (1)..(1872)
atgctagaatctgttacagaatttcgccaattagatttggctgacacacttttatctgctcttgactcaatgggcttcgtttcgccaactcctattcaggcggcgtcaattcctctacttcttactggtgttgatgcacttggtaaggcacagactggtactggtaaaacggctgcgttttcactacctgttctaaataaagtagacctttctcagcataagcctcaggctatcgtaatggctcctacacgtgagcttgcgattcaggttgctgcagaaatcaaagtccttggtcagaacattaaaggtcttaaagttttagagatttacggtggtgcttctatcgttgatcaaatgcgtgcacttaaaaatggtgctcacattgttgttggtactccaggtcgtgttaaagaccttatttcacgtgatcgtctgcaccttgatgaagttagtacgtttgtactagatgaagctgacgaaatgttgaaaatgggttttgttgatgacgttacttggatcatggaacaagctccagcatcggcacaacgcgtattgttctcggctactatgcctccaatcgttaagcaaattgttgaccgtttcctacgtaacccagagcgcattgacgtagctggcgaaaaccgtactgtatctcaagtttcacagcagttctggatcgttaaaggcgtagaaaaagacgaagcaatgattcgtatgcttgaaactgaagagaacatcgatgcgtcaatcgtattcgttcgtactcgtcaagatactgagcgtctagctgattggttatctgcacgtggctgtaaagcagcagctctacacggtgatattcctcagtctttacgtgagcgtactgttgaccatattaaacgtggtgtaatcgacgttcttgttgcaactgacgttgttgctcgtggccttgatattcagcgtattacacacgtatttaactacgacattccgttcgatgtagaatcttacatccaccgtattggtcgtactggtcgtgctggtcgttctggtaaagcgatcctattggttcgtacaaaccaaattcgtatgctacgcactatcgagcgtgtaactaaatctcgtatggaagaaattcaacttcctaaccgtgatgccgttgccgctgctcgcttgactcgtttaggtcaagaactagaatcacagaaagaacaagcaacgcttgaagcttttgttgaactagtgggtaaattacaagaaacaatcgatgttgatgcaacaacgcttgcagcgatgcttcttcagcgtcaacaaggtaaccgtcctttattctataaaggtccggacccaatgattgcagctattgatcgtgaacagcaacgtcgtgagcgtcgtggtaacgatgatcgtggtactcgcaacgaacgtggcggtgaacgtcgttcaaacaacagcgctgattgggatacttaccaattacaagttggccgtgagcaaggcattcaggttaaagatatcgttggcgcaattgcaaacgaacttggcctaagcaaagagttcattggtgctattaaactagctccttcacatacttttgttcagcttccgaagaagatgtcagcagaagtttcagcacaacttaagaagctacgcattcgtcaaaacgatgtaaaagctgttgttgttgaaggtgaagttcttcgcgaacaccgtccacgtaacagtggtagccgtgatggcggccgtggtggataccgtggtaaccgtgatagcaacggtggcgagcgtcgtttcgaccgcaaccgtggtagtgacaaccgtggtggaaaccgtggcagcgcgaacagcgaccgtccacgtcgtccaagcggtgagcgtagcaacaacgcttaa

SEQ ID NO: 38832 - protein, 623 aa, Photobacterium profundum SS9
MLESVTEFRQLDLADTLLSALDSMGFVSPTPIQAASIPLLLTGVDALGKAQTGTGKTAAFSLPVLNKVDLSQHKPQAIVMAPTRELAIQVAAEIKVLGQNIKGLKVLEIYGGASIVDQMRALKNGAHIVVGTPGRVKDLISRDRLHLDEVSTFVLDEADEMLKMGFVDDVTWIMEQAPASAQRVLFSATMPPIVKQIVDRFLRNPERIDVAGENRTVSQVSQQFWIVKGVEKDEAMIRMLETEENIDASIVFVRTRQDTERLADWLSARGCKAAALHGDIPQSLRERTVDHIKRGVIDVLVATDVVARGLDIQRITHVFNYDIPFDVESYIHRIGRTGRAGRSGKAILLVRTNQIRMLRTIERVTKSRMEEIQLPNRDAVAAARLTRLGQELESQKEQATLEAFVELVGKLQETIDVDATTLAAMLLQRQQGNRPLFYKGPDPMIAAIDREQQRRERRGNDDRGTRNERGGERRSNNSADWDTYQLQVGREQGIQVKDIVGAIANELGLSKEFIGAIKLAPSHTFVQLPKKMSAEVSAQLKKLRIRQNDVKAVVVEGEVLREHRPRNSGSRDGGRGGYRGNRDSNGGERRFDRNRGSDNRGGNRGSANSDRPRRPSGERSNNA

SEQ ID NO: 38833 - DNA, 1587 bp, Streptococcus thermophilus LMG 18311
  CDS (1)..(1587)
ttgaaatttacagatttaaacctatcagaagacatccaatcagctgttgtagctgccggttttgaacaaccatcacctatccaagagttgacaattccacttgctcttgaaggtaaggatgtcattggtcaggcacaaactggtactggtaaaacagctgcctttggtttgcctaccctagataaaattcatacagaagaaaatacaattcaagccctggttattgccccaacacgtgagttggcagtgcaatctcaagaagagcttttccgttttggccgtgataagggcgttaaggttcgctcagtatacggtggttctagcatcgagaaacaaatcaaggccctccgttcaggtgcccacattgtagtagggacaccaggtcgtctcctagaccttatcaaacgtaaagcccttaaacttaacaatatcgagactttgattttggatgaagctgatgaaatgcttaacatgggcttcctagaagacattgaagcaattatcagtcgagtaccagaggaacgtcaaacccttctcttctcagcaactatgcctgatgccatcaaacgtattggtgttcagttcatgaaagatcctgagcatgtgaaaatcaaggctaaggaattgaccaatgttaacgttgatcaatactttatccgagtgaaggaacaagagaagtttgatactatgactcgtcttatggatgttgaccaacctgaattgtcaatcgtctttggacgtaccaaacgtcgtgtggacgagttaacacgtggtttgaaacttcgtggtttccgtgcagaaggtatccacggagaccttgaccaaaacaaacgtcttcgtattatccgtgacttcaagaacggccaaatcgatatcttggttgcaacagatgttgcggcgcgtggtcttgacatttcaggtgttactcacgtctacaactacgatattccacaagacccagaaagctacgttcatcgtattggacgtacaggccgtgcaggccaatcaggtcaatcgattacgttcgtttctccaaacgaaatgggttacttgggcatcatcgaaaatttgactaagaaacgcatgaaaggccttaagccaccaacagctcaagaagccttccaatctaagaagaaagttgcccttaagaaaattgaacgtgactttgcggatgaagctatccatgctaactttgacaagtttaaggacgatgctgttaaattggctcaagaattcacacctgaagaattggcgctttatatcttgagcttgaccgttcaagatccagagacaatgccagaagtggaaattgcgcgtgaaaaaccattgccatttaaaccatcaggtggtggctttggtggtaaaggtggcaaaggtggccgtggtaaccgtggtcgcgataacaaccgtcgtggtggataccgtggcgaccgtaaccgtgatgatcgagacggtggccgtcgagacttcaaacgcaagtctaagaataacagtcgtgacttcgaaaatcgtggcaacaaacgcccacaccgtgcttcaagcgaaaagaaaaatggctttgttatccgtaacaagggtgataagtaa

SEQ ID NO: 38834 - protein, 528 aa, Streptococcus thermophilus LMG 18311
MKFTDLNLSEDIQSAVVAAGFEQPSPIQELTIPLALEGKDVIGQAQTGTGKTAAFGLPTLDKIHTEENTIQALVIAPTRELAVQSQEELFRFGRDKGVKVRSVYGGSSIEKQIKALRSGAHIVVGTPGRLLDLIKRKALKLNNIETLILDEADEMLNMGFLEDIEAIISRVPEERQTLLFSATMPDAIKRIGVQFMKDPEHVKIKAKELTNVNVDQYFIRVKEQEKFDTMTRLMDVDQPELSIVFGRTKRRVDELTRGLKLRGFRAEGIHGDLDQNKRLRIIRDFKNGQIDILVATDVAARGLDISGVTHVYNYDIPQDPESYVHRIGRTGRAGQSGQSITFVSPNEMGYLGIIENLTKKRMKGLKPPTAQEAFQSKKKVALKKIERDFADEAIHANFDKFKDDAVKLAQEFTPEELALYILSLTVQDPETMPEVEIAREKPLPFKPSGGGFGGKGGKGGRGNRGRDNNRRGGYRGDRNRDDRDGGRRDFKRKSKNNSRDFENRGNKRPHRASSEKKNGFVIRNKGDK

SEQ ID NO: 38835 - DNA, 1554 bp, Thermus thermophilus HB8
  CDS (1)..(1554)
gtgggcccggaaaggcagagcatggagtttaaagactttcccctgaagccagaaatcctggaagccctccacgggcgcggcctcaccacccccacccccatccaggcggcggcgctccccttggccctggagggcaaggacctcatcggccaggcccgcaccggcaccggcaagaccctggccttcgccctccccatcgccgaaaggcttgcgccaagccaggagagggggcggaagccccgggccctcgtcctcacccccacgcgggagctcgccctccaggtggcctccgagctcaccgccgtggccccccacctgaaggtggtggccgtctacgggggcaccgggtacggcaagcagaaggaggccctcctccggggggcggacgcggtggtggccaccccggggcgggccctggactacctgcggcagggggtcttggacctctcccgggtggaggtcgccgtcttggacgaggcggacgagatgctctccatgggctttgaggaggaggtggaggccctcctttccgccacgcccccttcccgccagaccctcctcttctccgctaccctcccctcctgggccaagaggctcgccgagcgctacatgaaaaaccccgtcctcatcaacgtcatcaaggacgagcccgtcacctacgaggaggaagcggtcccggccccggtgcgggggcggcttgaggtcctctccgaccttctttacgtggcctcccccgatcgggccatggtcttcacccggaccaaggcggagacggaggagatcgcccaaggccttttgcgcttgggccacctggcccaggccctccacggggacctctcccagggcgagcgggaacgggtcctgggggccttccgccaaggggaggtgcgggtcctggtggccacggacgtggccgcccgcggcctggacatcccccaggtggacctggtggtgcactaccgcctgcccgaccgggcggaggcctaccagcaccgctcgggccgcacgggccgggcgggccggggagggcgggtcgtcctcctctacgggcccagggagcgccgggacgtggaggccttggagcgggcggtggggcgccgcttcaagcgggtgaacccccctaccccggaggaggtcctcgaggccaagtggcgccaccttttggcccgcctcgcccgggtgccggagaaggactaccggctccacctggactttgcgggccgcctcttcagcgaggggcgggtggaggtggtggccgccctcctcgccctcctcctgggcggggcgcccaaggagaagagcctcctcaccggggaggaggggtggcgcacctacaaggccacggggccgaggctctccctgccccggctcgtggccctcttgaaggggcagggcctcgaggtgggcaagatcgctgaggccgaagggggcctgtacgtggacctccgccccgaggcccggccggaggtggccggcctccggctggagcccgccaggagggtggagggcctcttggagatcccttcccgcacgaggcgcccggccagggcgtag

SEQ ID NO: 38836 - protein, 517 aa, Thermus thermophilus HB8
MGPERQSMEFKDFPLKPEILEALHGRGLTTPTPIQAAALPLALEGKDLIGQARTGTGKTLAFALPIAERLAPSQERGRKPRALVLTPTRELALQVASELTAVAPHLKVVAVYGGTGYGKQKEALLRGADAVVATPGRALDYLRQGVLDLSRVEVAVLDEADEMLSMGFEEEVEALLSATPPSRQTLLFSATLPSWAKRLAERYMKNPVLINVIKDEPVTYEEEAVPAPVRGRLEVLSDLLYVASPDRAMVFTRTKAETEEIAQGLLRLGHLAQALHGDLSQGERERVLGAFRQGEVRVLVATDVAARGLDIPQVDLVVHYRLPDRAEAYQHRSGRTGRAGRGGRVVLLYGPRERRDVEALERAVGRRFKRVNPPTPEEVLEAKWRHLLARLARVPEKDYRLHLDFAGRLFSEGRVEVVAALLALLLGGAPKEKSLLTGEEGWRTYKATGPRLSLPRLVALLKGQGLEVGKIAEAEGGLYVDLRPEARPEVAGLRLEPARRVEGLLEIPSRTRRPARA

SEQ ID NO: 38837 - DNA, 1404 bp, Geobacillus kaustophilus HTA426
  CDS (1)..(1404)
ttgacgacatttcaagaattaggattaagccaagaagtgatgaaagcgatcgagcggatggggtttgaagagacgactccgattcaagcaaagacgattccgctcagtctgcaaaataaagacgtaatcggtcaagcgcaaaccggaacggggaaaacggcggcgtttggcattccgatcgttgagaaagtgaatgtgaaaaacagcgctgttcaagcgctcgttgtcgcgccgacgcgtgagctcgccatccaagtatcagaagagctgtacaaaatcggcgccgtcaagcgcgtgcgcgttttgccgatttacggcggtcaagatatcgagcggcaaatccgtgctttgaaaaaacatccgcacgtgatcgtcgggacgccgggccgtattatcgaccatatcaaccgcgggacgctccgccttgagcatgtgcatacggtcgttctcgatgaggcggatgaaatgctcaatatgggctttatcgaagatattgaggcgattttaagccatgtgccggccgagcggcagacgttgctgttctcggcgacgatgccggatccgattcgccgcattgccgagcgcttcatgaacgagccggaacttgtcaaagtgaaggcaaaggaaatgaccgtgccgaacattcaacagtactacttagaagtgcacgagaaaaagaaatttgacattttgacgcggcttcttgatattcaggcgccggagctcgcgatcgtgttcggccgcacgaagcgtcgtgtcgatgagctggcggaggcgctcaacttgcgaggctatgcagcggaaggcattcacggtgatttaagccaagcgaaacggctgtcggtgctgcgcaagtttaaggaaggtgcgattgaaattttagtggcgacggatgttgcggcgcgcggcttggatatttccggcgtaacgcacgtgtacaactttgatattccgcaagacccggaaagctatgtccaccggattgggcgcaccgggcgcgccggcaagacaggggtggcgatgacgtttgtcactccaagggagatcggccagcttcaccatattgagcggacgacgaagcggaaaatggagcggatgaagccgccgacacttgatgaggcgctcgaaggccaacagcgtatcgcgatcgaaaagcttctcaacgtcgtggagaccgaaaacctgtcattttacaaacgggcagcggaagaattgcttgaagagcacgattcggtaacgattgtcgctgcctgcttgaaaatgttgacgcgcgagccggatacgacgccggtgcaattgacggaagaaccgcctttagcggtcaagcgggagaaaaaacggggcggccgcccggacggctcagctcgcagccggacgaagaaacggcggattacggcgcattaa

SEQ ID NO: 38838 - protein, 467 aa, Geobacillus kaustophilus HTA426
MTTFQELGLSQEVMKAIERMGFEETTPIQAKTIPLSLQNKDVIGQAQTGTGKTAAFGIPIVEKVNVKNSAVQALVVAPTRELAIQVSEELYKIGAVKRVRVLPIYGGQDIERQIRALKKHPHVIVGTPGRIIDHINRGTLRLEHVHTVVLDEADEMLNMGFIEDIEAILSHVPAERQTLLFSATMPDPIRRIAERFMNEPELVKVKAKEMTVPNIQQYYLEVHEKKKFDILTRLLDIQAPELAIVFGRTKRRVDELAEALNLRGYAAEGIHGDLSQAKRLSVLRKFKEGAIEILVATDVAARGLDISGVTHVYNFDIPQDPESYVHRIGRTGRAGKTGVAMTFVTPREIGQLHHIERTTKRKMERMKPPTLDEALEGQQRIAIEKLLNVVETENLSFYKRAAEELLEEHDSVTIVAACLKMLTREPDTTPVQLTEEPPLAVKREKKRGGRPDGSARSRTKKRRITAH

SEQ ID NO: 38839 - DNA, 1425 bp, Idiomarina loihiensis L2TR
  CDS (1)..(1425)
atgcctataaatacgcctgaaaatatctcggataacacttctgagacttcacctgaactccttcactttaatcaactgaacctgccgccagcgttactgacacggcttgatgaaattggttaccaacaaatgacaccggtgcagtccttaagcttgccggtcattttaaataacaccgacgccgttgttcgcgctgataccggttcaggaaaaaccaccgcttttgcgctgactttgctggcaaagctggaggcaaaaagcttttcgccacaggcgttggtattgtgccctactcgtgaactcgcccatcaggttgctgacgaggttcgtaagctggctaagtcaatgcttaatatcaaaatactgaccctgtgcggtggcgagccatcacgtattcagaccaactcgcttgagcatggcgctcatgttttagttggcacacccgggcgggtacttgatcatcttgagcagcgcaatgttgatttgtctatgttgacgactctggttcttgatgaagccgaccgaatgttagaaatgggatttcaggacagcctgaacgccatcgttaaacacattccaaaaacacgacagacactattattcagtgccacctaccctaaaaatatcgctgccttagcagaacaggtgacaactaaggctagaaatattgaggccattcaagagcaggcaaagccgcaaattgagcagctcttttatgccatgaataatgaagacagcgcacagctggtaatgaatttactgggcgatcatcaacccgaaaactgtctggttttctgcaacaccaagaacgaagtaaaagacatttttaacacacttcgggccaataaattcagcgtattggctctgcatggtgagcttgaacaaaaagatcgcgatcaggcgattatacaatttagtaatggcagtgctcgcgtactcattgcaaccgatgtcgcttcccgtgggctggatatcgccgaacttgatttagtgattagcgttaatatggctcatgatttagacactcatacccaccgcataggtcgtactggacgcgcgggcaaagaaggcgtcgcaataaccttaattgcggaaaaagatgattataaaatgcgcttgcttgaggatacttttgccgaacccattcaggtaaaacctgcgccagcgctgtctaacaatagaccgttgaaagccaatatgtcgaccatacaagtcagtggcgggaaaaaggacaagttgagaccgggtgacattgttggcgccctaacgaaggataacgttttaagtgctgacgacattggaaaaataaagctggaaagtacctttggttttgttgcggtaaactcccgtttggctaagcacgctttagggcttatcaataataataaaataaaaggtaagaagtttcgggcaaaagtactttaa

SEQ ID NO: 38840 - protein, 474 aa, Idiomarina loihiensis L2TR
MPINTPENISDNTSETSPELLHFNQLNLPPALLTRLDEIGYQQMTPVQSLSLPVILNNTDAVVRADTGSGKTTAFALTLLAKLEAKSFSPQALVLCPTRELAHQVADEVRKLAKSMLNIKILTLCGGEPSRIQTNSLEHGAHVLVGTPGRVLDHLEQRNVDLSMLTTLVLDEADRMLEMGFQDSLNAIVKHIPKTRQTLLFSATYPKNIAALAEQVTTKARNIEAIQEQAKPQIEQLFYAMNNEDSAQLVMNLLGDHQPENCLVFCNTKNEVKDIFNTLRANKFSVLALHGELEQKDRDQAIIQFSNGSARVLIATDVASRGLDIAELDLVISVNMAHDLDTHTHRIGRTGRAGKEGVAITLIAEKDDYKMRLLEDTFAEPIQVKPAPALSNNRPLKANMSTIQVSGGKKDKLRPGDIVGALTKDNVLSADDIGKIKLESTFGFVAVNSRLAKHALGLINNNKIKGKKFRAKVL

SEQ ID NO: 38841 - DNA, 1251 bp, Idiomarina loihiensis L2TR
  CDS (1)..(1251)
atgtccacagaacaaaacccatcctcattccagtcactcggattgagcgacgatattttacgagccgttactgaatgcggttacaccaccccaacaccaattcaacagcaagccattccgaccgttatggccggccacgacttattagccgccgcgcaaacgggtaccggtaagacagctggttttacgctacctttgctgcacaaattgtcgcagacaaagaccgacggaaagcctgttattaaggcgttaatccttacgccaaccagagagctggcagcacaggttgaagacaatttgaatacctatgcaaaatataccggtctcaagtctctggtgatttttggtggtgttggtattaacccacaaattagtgccttgcgtcgtggtgttgacattcttgttgcaacacccggccgtttgctggatcacagtcgtcagggaaccgttgatttaagtaaaattgacgtactgattctggacgaagctgaccgcatgctggatatgggatttattcatgacattaaaaaggtcatgaagctcattcctgaaaaacgccagacactgctgttttcagcgactttttctagtgaaattaaagcactgtctcagcagtttatgcagcaacccaagctgattgaagttgcgcgtcagaatgccgcagctgataccattgagcaacgtgtttatccggtggataaaaaacgtaaaagagagctactcagttacttaattggcagccgtaactggcgacaagtgctggtctttacgcgtaccaagcatggtgctaacagactggcaacacagttaactgatgatggcctccccgctatggcaatccacggtaacaaaagtcagggcgcaagaaccaaggctttagcacagtttaaagccggtaaattacgagtattggttgcaacggatatcgctgcacgcggtattgatattgatgaattgccacacgttattaactttgaactgcctcaggtcgctgaagactatgtacaccgtattggccgtacaggccgtgcaggaagtgaaggtgaagccgcgtctttagtctgtgttgatgagcataaattgctgcgcgatatagaaaagctaactaaaaatgagatacccagggaagttattccgggttttgaaccagaccccagcataaagccggagccgattcagaagcctcgtacggggcgtcctcaaaactctcgtcgtgcgcctcgccagaagcgcccggacacacgacgttaa

SEQ ID NO: 38842 - protein, 416 aa, Idiomarina loihiensis L2TR
MSTEQNPSSFQSLGLSDDILRAVTECGYTTPTPIQQQAIPTVMAGHDLLAAAQTGTGKTAGFTLPLLHKLSQTKTDGKPVIKALILTPTRELAAQVEDNLNTYAKYTGLKSLVIFGGVGINPQISALRRGVDILVATPGRLLDHSRQGTVDLSKIDVLILDEADRMLDMGFIHDIKKVMKLIPEKRQTLLFSATFSSEIKALSQQFMQQPKLIEVARQNAAADTIEQRVYPVDKKRKRELLSYLIGSRNWRQVLVFTRTKHGANRLATQLTDDGLPAMAIHGNKSQGARTKALAQFKAGKLRVLVATDIAARGIDIDELPHVINFELPQVAEDYVHRIGRTGRAGSEGEAASLVCVDEHKLLRDIEKLTKNEIPREVIPGFEPDPSIKPEPIQKPRTGRPQNSRRAPRQKRPDTRR

SEQ ID NO: 38843 - DNA, 1785 bp, Idiomarina loihiensis L2TR
  CDS (1)..(1785)
atgtcaaatactcaaacgggtctgtcgtttaacgacatggccttacctagtgctgtgcttgaacaattaaacgcaatgcagtttttaactccgactcctattcagctacaggctattcctgcattgctggaagggcaagacgtgctgggcgaagctcagaccggtaccggtaaaactgctgcattcggtctgcctgcactggcaaaaattgatgcgtcggttaagcaaactcaagtattagtcgtaactccaactcgtgagctggctattcaggtagctgaagcgcttgaaggctttgctgcgaaaatgcgtggcgttggcgtagcaaccgtttacggtggcgctccatttggtcctcaggttaaagccctgaagcagggaaccgctattgttgttggtaccccgggtcgtcttatcgacttattgaataaaaacgtcctgcaactagatggtttgaaagtgggcgttctggatgaagctgatgaaatgcttaacatgggtttcattgaagacatcgagacgattctaaaagctgtaccgaatacggcgcaacgcgcgttattctcagcaactatgccgaatgcaattcgcaaactggcaaaaactttcctgaaagatccgctgaacattcagattgaagctattgcccgcgaaaaagcgacgattaagcagaaagcatggaaagttcagggcatgacgaaaatgaccgctctgactcgattgttagaagtgactccgtatcagcgcgcactgattttcgtacgtacccgtcaggatacgatggatgtggctgaattattgcaacgcaacggatttaaagcggcgccattaagcggtgacttgaaccaggctcagcgtgagcagactgtcagtcagttacgtagtggacacatcgaaattctggtagggaccgacgttgttgctcgtggcttagacgttcctgaaattacgcacgttattaactatgacttaccaagcgatactgaatcttatgttcaccgtattggacgtactggtcgtgcgggccgtaccggtgaagcgattcttttcttccgtgcaaaagaacgtcatttgttgcgtcactatgagcgcttaaccaatgcaccggttgagttctttgaagtaccaaacgcaaatgaactgagcaagtaccgtcagcaacaattgttagagaagttgcaggcgtcactggctcctgaaactgcaagcgccgataagcctaagctagagaaactgttaggcgagtggctggaacagtcagagttaagtgctgaagaaattgctttagcgttattggctcagcataatgagcagcgcccgttgttcctgaaagaagaccgtccggtacgtgaagcacgcaacgagcgtagcgaacgctcaggtcgcaatgaacgcagtgaccgtggcgataagcgtaaacctcgtgccgaacgtggtggtcgtgcagcggatgtcgattttgaaacctacaaaattcaggtaggccgtgagcacggcgctcgtcctggtgacatcgttggtgctattgctaacgaagcatcaatggacagcaagtatattgggcaaattcagttgtttgataatcattctttagtgcagctaccaaaaggtatgccaaaagacattatgcacgtactgaaaaaagctcgtgtgcgtcaacagcctatgggtcttgagctaagtgatgagcaagttaaacgtgcgccacgcccaccgcgtgaccgcgatgctcgtggcggacctaagcgcaactccggtaagggtgctgcgcgtcgttttagttaa

SEQ ID NO: 38844 - protein, 594 aa, Idiomarina loihiensis L2TR
MSNTQTGLSFNDMALPSAVLEQLNAMQFLTPTPIQLQAIPALLEGQDVLGEAQTGTGKTAAFGLPALAKIDASVKQTQVLVVTPTRELAIQVAEALEGFAAKMRGVGVATVYGGAPFGPQVKALKQGTAIVVGTPGRLIDLLNKNVLQLDGLKVGVLDEADEMLNMGFIEDIETILKAVPNTAQRALFSATMPNAIRKLAKTFLKDPLNIQIEAIAREKATIKQKAWKVQGMTKMTALTRLLEVTPYQRALIFVRTRQDTMDVAELLQRNGFKAAPLSGDLNQAQREQTVSQLRSGHIEILVGTDVVARGLDVPEITHVINYDLPSDTESYVHRIGRTGRAGRTGEAILFFRAKERHLLRHYERLTNAPVEFFEVPNANELSKYRQQQLLEKLQASLAPETASADKPKLEKLLGEWLEQSELSAEEIALALLAQHNEQRPLFLKEDRPVREARNERSERSGRNERSDRGDKRKPRAERGGRAADVDFETYKIQVGREHGARPGDIVGAIANEASMDSKYIGQIQLFDNHSLVQLPKGMPKDIMHVLKKARVRQQPMGLELSDEQVKRAPRPPRDRDARGGPKRNSGKGAARRFS

SEQ ID NO: 38845 - DNA, 1392 bp, Azoarcus sp. EbN1
  CDS (1)..(1392)
atgacgttccaggaactcggcctccacgaagccctgcttcaagccatcgcaaccaccggttacacggtcccgacttcggtccaggagcaggcgatcccggccgcgctcgccggtgccgacctgatggtgtcctcgcataccggcagcggcaagaccgccgctttcacgcttccgagcctgcaccgcctgatcgaccgcaagcccgcgcccggcgccggtccgcgcgtgctggtgctgactccgacgcgcgagctcgcgcagcaggtcgaaaaagcggtcaagacttacgcccgtaacctgcgttacctgaatactgcgtgcctcgtcggcggcgcgccgttcttcgcccaggcgaagctgctgtcgcgccccgtcgacgtcgtcgtcgcgactccgggccgcctcatcgatcacctcaatcgccgcaagctcaagctgtcggacatcgaagtgctggtgctcgacgaagccgaccgcatgctcgacatggggttcgtcgaggacatcgagaccatcgtcgcggcgacgccggcgagccgtcagacgctgctgttctcggcaaccctcgacggcgtggtcggcaacctcgcgcgcaagatgacgcgcaatccgcagcgcatcgagatcgccgcgacggtcgagaaccgcgcgaacatcgagcagcgtctgctgatggccgacaacatcgtgcacaagaaccgcctgctcgaatcgctgctcggcggcgatgacctgcagcaggccgtcgtcttcacggcgaccaagcgcggtgccgaggaagtgtcgctgaacctgcaggaaaaaggcttttcggccgctgcgctgcatggcgacatgcaccagacggcgcgcaaccgcacgctggacaagctgcgccagggccgcatcggcgtgctcgtcgcgactgatgtcgcagcacgcggcatcgacgtcgccggcatcagccacgtgatcaacttcgacgcgccccgtcaggtcgaagactacgtgcaccgcatcggccgtaccggtcgtgccggccgcgacggcatcgcgatcacgttctcggggccgcgcgagatgggcatcatccgcgcgatcgagcgcttcaccggcaaaccgctcgcggtgcatgtgatcgaaggcctcgagccgacgcaacgcccgtcgtcgccccgtcgcgcgccgagcggtggcaagccgggcttcggcggtcgttcgggcgggtcgtcgtacggccgtgaaagccgtgacagtcgtccgggggccggcaaaggctggtcgtcggagtcgccatccgggaaccggggcggctatggtcgtgacggtggcgccggtcgcagcgaagggagccgcttcggcggcgaccgtccggagggcgcccgccgcccgcgcccgacggcgcgcggctga

SEQ ID NO: 38846 - protein, 463 aa, Azoarcus sp. EbN1
MTFQELGLHEALLQAIATTGYTVPTSVQEQAIPAALAGADLMVSSHTGSGKTAAFTLPSLHRLIDRKPAPGAGPRVLVLTPTRELAQQVEKAVKTYARNLRYLNTACLVGGAPFFAQAKLLSRPVDVVVATPGRLIDHLNRRKLKLSDIEVLVLDEADRMLDMGFVEDIETIVAATPASRQTLLFSATLDGVVGNLARKMTRNPQRIEIAATVENRANIEQRLLMADNIVHKNRLLESLLGGDDLQQAVVFTATKRGAEEVSLNLQEKGFSAAALHGDMHQTARNRTLDKLRQGRIGVLVATDVAARGIDVAGISHVINFDAPRQVEDYVHRIGRTGRAGRDGIAITFSGPREMGIIRAIERFTGKPLAVHVIEGLEPTQRPSSPRRAPSGGKPGFGGRSGGSSYGRESRDSRPGAGKGWSSESPSGNRGGYGRDGGAGRSEGSRFGGDRPEGARRPRPTARG

SEQ ID NO: 38847 - DNA, 1527 bp, Azoarcus sp. EbN1
  CDS (1)..(1527)
atgacatcagaagcaaactttgccggtctcggactggccgaaccgctgctgcgcgcaatttccgaatccggctacacgacgccgacgccgatccaggcacaggcgatcccgctcgtgctcgccggcggcgatcttctcgccgccgcccagaccggcaccggcaagactgccggcttcacgctgccggtgctgcaccgcctgtccgccgccccggcagcgaacccgaaggccggccgcccgcgctgcctgatcctgactccgacgcgtgaactcgcggcgcaggtcgaggaatcggtccggacctacggcaagcacctgccgacgacgtcgatggtgatgttcggcggcgtcggcatcaacccgcagatccaggcgctgaaaaaacgcgtcgacatcctcgtcgcgaccccgggccggctgctcgaccacgtcggccagaagacgctcgacctgtcgggcgtcgagatcctgatcctcgacgaagcggaccgcatgctcgacatgggcttcatccgcgacatccgcaaaatcctcgcgctgctgccgaagcagcgccagaacctgctgttttcagcgactttctcggacgagatccgcagcctcgcgaacggactgctgcacaatccgggctgcgtcgaagtcgcgcggcgcaacaccgcgtccgaactcgtgcagcagtcagtctattcggtcgcgcagaagcaaaagcgcgacctcctggtgcatctcgtcaagcagaacgactggcatcaggtgctggtgttcacccgcaccaagcacggcgccaacaagctcgcggaatacctcgccaagcacggcatcccgtcggcggcgatccacggcaacaagagccagtcggcgcgtactcgcgcgctggccgaattcaaggacggctcgctgccggtgctggtggcgacggacatcgccgcgcgcggactggacatcgaccagttgccgcatgtcgtgaacttcgaactgccgaacgttcccgaagactacgtccaccgcatcggtcgcaccggccgcgcaggctcgagcggcgccgcggtgtcgttcgtcgactccgaagagcgccagcacctgacggcgatcgagcggctgatcaagcgcacgatcgaccgcgaagcgctgccggctttcgcgatcgcgccggtcgacccgaacgagagcgacgcgcgtcccccgcggcaaccgcgccagccgtcgcgacacaacaacgcgaacgcgccgcgccaggcgcggaccgatcgcccggccggcaggcaggcgacccctccgtctccttcccgtgcccccgtccggtcacgcgacgccgacaatttcggcaatcgcgccccgcgcagcgaggtcgaagccaagcgcggacaccccgacgcggacggcaaccgggcgctgcgcaacgccgggccgaacggcgcgccacgcagcagtgacagcgcccgcgcggcgccgcgccccgacggcaaccgtcgcccgcaatcgcgtccggcactgttcaacgccaagacggacgatcgcaaccgttga

SEQ ID NO: 38848 - protein, 508 aa, Azoarcus sp. EbN1
MTSEANFAGLGLAEPLLRAISESGYTTPTPIQAQAIPLVLAGGDLLAAAQTGTGKTAGFTLPVLHRLSAAPAANPKAGRPRCLILTPTRELAAQVEESVRTYGKHLPTTSMVMFGGVGINPQIQALKKRVDILVATPGRLLDHVGQKTLDLSGVEILILDEADRMLDMGFIRDIRKILALLPKQRQNLLFSATFSDEIRSLANGLLHNPGCVEVARRNTASELVQQSVYSVAQKQKRDLLVHLVKQNDWHQVLVFTRTKHGANKLAEYLAKHGIPSAAIHGNKSQSARTRALAEFKDGSLPVLVATDIAARGLDIDQLPHVVNFELPNVPEDYVHRIGRTGRAGSSGAAVSFVDSEERQHLTAIERLIKRTIDREALPAFAIAPVDPNESDARPPRQPRQPSRHNNANAPRQARTDRPAGRQATPPSPSRAPVRSRDADNFGNRAPRSEVEAKRGHPDADGNRALRNAGPNGAPRSSDSARAAPRPDGNRRPQSRPALFNAKTDDRNR

SEQ ID NO: 38849 - DNA, 1977 bp, Azoarcus sp. EbN1
  CDS (1)..(1977)
ttgagccaagcggcaccggcaggatttcggtacgatgcgcttcattcgctaagcgccccgttactctcgacggatcggcgccttttccctttccgctgcccgcaccagaatcccatgacttcccccatcgaaagcttcgcccaactcgatctccgtgcaccgctgctcgatgcgctgtccgaaatcggctatgaaacgccgtcgccgatccaggcgatatgcatcccgcatctgctcgccggccacgacctgctcggggaagcgcagaccggtaccggcaagactgccgcgttcgcgctgccgctgctcgaccggctcgacctcgcagtcaaaaatccgcaggtgctcgtactcgcgccgacccgcgaactcgcgatccaggtcgccgaggctttccagcgttacgcgaagaacctgccgggtttccacgtgctgccggtgtatggcggccagagcatggtcgtgcaactgcgccagctcgcccgcggcgcacatgtcatcgtcggcaccccgggccgcgtcatggaccacatcgagcgcaagagcctcaatctcgacagcctgacgacattggtgctcgacgaagccgacgagatgctgcgcatggggttcatcgacgacgtcgaatggatcctgcagcacacgccggccgagcggcagacggcgctgttctcggcgacgatgcccgacgcgatccgccgcgtcgcgcaccgttacctgcgcgagccgcgcgaggtcaagatcaaggccagcacgacgacggtgtcgacgacgcgtcagcgctactgccagatcagcgtcgcgcacaagctcgacgcgctgacgcgcatcctcgaagtcgaggaggatttcgacgccgcgatcatcttcgtccgcaccaagaccgcgaccgtcgagctcgccgacaagctcgaggcgcgcggctactcggccgccgcgctgaacggcgacatgacgcagcagctgcgcgagcgcgtcatcgaacagctcaagggcggacagctcgacatcgtcgtcgccaccgatgtcgctgcgcgcggcctcgacgtgtcgcgcatcagccacgtcatcaactacgacatcccgtacgacaccgaagcgtatgtgcatcgcatcggacgcaccgggcgcgcgggtcgcaccggcagcgcgatcctgtttgtcgcgccgcgcgagatgcggatgctgaaagtcatcgagcgcgcgacccgccagccgatcgaggcgctgcaactgccgtcgcgcgaggccgtcgcggacaagcgggtcgccgcgttccgccagcaagtcgccaccgtgctcgaatccgaagacctcgcatttttccgcgacgtcgtcgccggcatggaatcgacgcacgaagccgaactccacgacatcgccgccgccctcgccttcctcgcgcagcgcgagcgcccgctgcagttgccggagtcgaaaggccccgacatcgcccgcctgcccgaaccgcggcgcgaaccaggcgccgagcgcgccccgcgcgaaaaccgcgacaaaatactcgaacgccgacgcgagttttccgagggcaatctgcagcgctaccgcatcgaagtcggccgcaaccagcaggcgacgccgaaggatatcgtcggcgcgatcgccaacgaggccggcatcgaaagccgctatatcgggcagatcaacctctacgaggactacagcaccgtcgaactgccgagcgccctcccgcacgacgtgctcgacatcctgcgccgcgtgcgcgtacgccagcaccagctgaacatccgcccgctcgacgcggaggaagcgaagcgcgacgcggcccgcgtgcgcccgggagcccctcgtccgggcgcggcgccgcgtcacgcggctcaccctggaagcaaacccgctcatccgggaagggtcggcccgagatccttcagcagcgaaaagcgcacgccgtcccccggcttcaaaccgggcaagaaaaaaccgcacgatcgctga

SEQ ID NO: 38850 - protein, 658 aa, Azoarcus sp. EbN1
MSQAAPAGFRYDALHSLSAPLLSTDRRLFPFRCPHQNPMTSPIESFAQLDLRAPLLDALSEIGYETPSPIQAICIPHLLAGHDLLGEAQTGTGKTAAFALPLLDRLDLAVKNPQVLVLAPTRELAIQVAEAFQRYAKNLPGFHVLPVYGGQSMVVQLRQLARGAHVIVGTPGRVMDHIERKSLNLDSLTTLVLDEADEMLRMGFIDDVEWILQHTPAERQTALFSATMPDAIRRVAHRYLREPREVKIKASTTTVSTTRQRYCQISVAHKLDALTRILEVEEDFDAAIIFVRTKTATVELADKLEARGYSAAALNGDMTQQLRERVIEQLKGGQLDIVVATDVAARGLDVSRISHVINYDIPYDTEAYVHRIGRTGRAGRTGSAILFVAPREMRMLKVIERATRQPIEALQLPSREAVADKRVAAFRQQVATVLESEDLAFFRDVVAGMESTHEAELHDIAAALAFLAQRERPLQLPESKGPDIARLPEPRREPGAERAPRENRDKILERRREFSEGNLQRYRIEVGRNQQATPKDIVGAIANEAGIESRYIGQINLYEDYSTVELPSALPHDVLDILRRVRVRQHQLNIRPLDAEEAKRDAARVRPGAPRPGAAPRHAAHPGSKPAHPGRVGPRSFSSEKRTPSPGFKPGKKKPHDR

SEQ ID NO: 38851 - DNA, 1479 bp, Zymomonas mobilis subsp. mobilis ZM4
  CDS (1)..(1479)
atgagctttgccgatctaggcctttcaaaagaactactgcaagcagttgccgaattgggatatgaagaacccacccctgttcaggcagcggctatcccgtctgttttgatgatgcgtgacctgatcgcggttgcccaaaccggcaccggcaaaacggctagttttgttctgccgatgattgatattttggcgcatgggcgttgtcgcgcaagaatgccgcgttccctgattttggaaccaacgcgggaattggccgctcaagtcgccgaaaatttcgagaaatacggaaaatatcataaattatcgatgtctttgctaatcgggggtgtcccgatggcagaacagcaagctgcccttgaaaaaggggtggatgttctgattgcaacccccggacgtttgcttgatttgttcgagcgggggaaaatcctgctttcaagctgtgaaatgctggtcattgatgaggctgaccggatgctcgatatgggatttattcccgatattgaaaccatttgcacgaaattgccaaccagtcgtcagactttgcttttttcagcgacgatgccgcctgcgattaaaaagctggctgatcgtttcttgtccaacccgaaacaaattgaaatcagtcgtcctgcaacggccaataccctgattgaccagcgtttgattgaagtatcgccccgctcgaagaaaaagaagctgtgcgatatgctgcgggcggaaaaagaccatacggcgattatcttttgtaaccgtaaaacgaccgtgagacagttggcaacaactttggagcagcaaggcttttccgtcggtcagattcacggcgatatgagccagccagagcgtggcagtgagcttgagcgcttcaaaaatggtcagatcagcgttctggtcgcttccgatatcgccgcaagaggattggatgttaaagggatcagtcatgtctttaattttgacgtgccgacccatcctgatgactatatccatcgcattggccgcaccggacgcggcggcgctagtggagaggctttgacctttgttacccctgctgatgaagaggcgataaccgcgattgaaaaattgatgggcgtcgagattccgcgattggggaacagaaagaaaaacacctatccgtctaaaagcgaagaaacggttagccccaaacaggcaaagcctgcgcaagagaaatcagccacgcctagcccaaggaaagccccaagaaagaccgaaactccgaaaaaattaccggaggatcggctggatagtgtggaaagtgactttcctaaaaaccaagccccaagaaatacggcttcgcgtcctgttagcaaggcgcggactcaggaacgggcattgcggcctgaaaatttacggcgtgtgaagcctgttgctttggaaacggcaattgattggaacggcccgattccgccgtttttgaactattccgtgccgaaaacaaccgcgagaaacgtcaagaaagactaa

SEQ ID NO: 38852 - protein, 492 aa, Zymomonas mobilis subsp. mobilis ZM4
MSFADLGLSKELLQAVAELGYEEPTPVQAAAIPSVLMMRDLIAVAQTGTGKTASFVLPMIDILAHGRCRARMPRSLILEPTRELAAQVAENFEKYGKYHKLSMSLLIGGVPMAEQQAALEKGVDVLIATPGRLLDLFERGKILLSSCEMLVIDEADRMLDMGFIPDIETICTKLPTSRQTLLFSATMPPAIKKLADRFLSNPKQIEISRPATANTLIDQRLIEVSPRSKKKKLCDMLRAEKDHTAIIFCNRKTTVRQLATTLEQQGFSVGQIHGDMSQPERGSELERFKNGQISVLVASDIAARGLDVKGISHVFNFDVPTHPDDYIHRIGRTGRGGASGEALTFVTPADEEAITAIEKLMGVEIPRLGNRKKNTYPSKSEETVSPKQAKPAQEKSATPSPRKAPRKTETPKKLPEDRLDSVESDFPKNQAPRNTASRPVSKARTQERALRPENLRRVKPVALETAIDWNGPIPPFLNYSVPKTTARNVKKD

SEQ ID NO: 38853 - DNA, 1416 bp, Silicibacter pomeroyi DSS-3
  CDS (1)..(1416)
atgacaaaattttctgaactgaatctcaaccccaaagttctcaaggccattgaagaggccggctatgaaacgccgactccgatccaggcaggcgccatcccgcccgcgctcgaaggccgagacgtgctgggcatcgcccagacaggcaccggcaagaccgccagtttcaccctgccgatgatcacccttctggcccgcggccgcgcccgcgcacggatgccgcgcagcctggtgctgtgcccgacgcgggaactggccgcccaggtggccgagaatttcgacacctataccaagcacctgaaactgaccaaggcgctgctcattggcggtgtcagcttcaaggagcaggatgcgctgatcgaccgtggtgtcgacgtgctgatcgccaccccgggccggctgctggatcatttcgagcgcggcaagcttctgttgaccggcgtgcagatcatggtggtggacgaggccgaccggatgctcgacatgggtttcatccccgatatcgagcgcatcttcagcctgacgccctttacccggcagaccctgttcttctcggccaccatggcgcccgagatcgagcggatcaccaacaccttcctcagcgcgcccgcgcgcatcgaggtggcccgccaggccaccgcgtccgagaccatcgaacagggcgtggtgctgttcaagggctcgcgccgcgaccgcgaggccagcgagaaacgcgccgttctgcgggcgctgatcgacgccgagggcgagaaatgcaccaacgcgatcatcttctgcaaccgcaagacggatgtggatatcgtcgcgaaatcgctgcagaaatacggctatgacgcggcgccgatccatggcgatctggaccagagccagcgcacccgtacgctggacggcttccgcgaaggcaaactgcgcctgctggtggcctcggacgtggccgcgcgcgggctggatgtgccctcggtcagccatgtgttcaacttcgacgtccccggccaccccgaggattacgtgcaccggatcggccgcaccggccgcgccggccgcgacggcaaggcgatcacgctgtgcatcccgcgcgacgaaaaggcgctcgatgcgatcgagaagctgatccagaaggatatcccgcgattggaaaacccggcccggaccgaggaaaagcccgaggcgaagccccgccgcgaggagaaaccggcccgcgccgacaaacccgcccgcagcgacgcggacaagcgtgaacccgtcaaacgcgaggcggacaagcgcgacccggtcaagcgtgaggcggacaagcgcgaccgcaagggtggcgagcgccgcgaccgcaaggacgaccgcggcgccagggtggtgggcatgggcgatcatctgcccagcttcatcgccctcagcttcgaggaacgccgcgccagctga

SEQ ID NO: 38854 - protein, 471 aa, Silicibacter pomeroyi DSS-3
MTKFSELNLNPKVLKAIEEAGYETPTPIQAGAIPPALEGRDVLGIAQTGTGKTASFTLPMITLLARGRARARMPRSLVLCPTRELAAQVAENFDTYTKHLKLTKALLIGGVSFKEQDALIDRGVDVLIATPGRLLDHFERGKLLLTGVQIMVVDEADRMLDMGFIPDIERIFSLTPFTRQTLFFSATMAPEIERITNTFLSAPARIEVARQATASETIEQGVVLFKGSRRDREASEKRAVLRALIDAEGEKCTNAIIFCNRKTDVDIVAKSLQKYGYDAAPIHGDLDQSQRTRTLDGFREGKLRLLVASDVAARGLDVPSVSHVFNFDVPGHPEDYVHRIGRTGRAGRDGKAITLCIPRDEKALDAIEKLIQKDIPRLENPARTEEKPEAKPRREEKPARADKPARSDADKREPVKREADKRDPVKREADKRDRKGGERRDRKDDRGARVVGMGDHLPSFIALSFEERRAS

SEQ ID NO: 38855 - DNA, 1326 bp, Francisella tularensis subsp. tularensis Schu 4
  CDS (1)..(1326)
atgaaattctcagatttaggtttaaattccttaatatgtagcgctttagaaaagaagggttatacaaaaccaactcctattcaagcacaagcgataccaatagttctaaagggtaatgatgttatggcatcagctcaaacaggaacaggaaaaacagcaggctttacattaccaattatccaaagacttcttgatcaacccaaagctcaagcaaataggatcaaaacattaatcctaactcctacaagagagttagcagcacaaatacaagaacaaattcaaatatatgccgcaaatacacatattcgttcagcagtaatatttggtggagtgagtattaatcctcaaatgatgaaattacgtaaaggtgtcgagattttgatagctactcctggaagattacttgacttatatagtcaaaatgctgtcaagtttgatagtttaaatacctttgttttagatgaagcagacagaatgttagatatgggtttcattaatgatttaaaaaaaatccataaccttttaccgaaaaagttacaaacactaatgttctcagcaacattttcatcagagataaaaaatcttgctaatgaatttctaaataatccccagtttgtatcagccgatgttgtaaatacgacggtcaaaaagattactcagaaaatttatacattagataaatcaaataaaattaatgcgctaatctcactaataaaagatcagaatctacatcaagtactagttttctcgcggactaaaaatggagcaaataaaatctcggaaaagttaaataatgctggcattagtagtagtgctattcatggtaataaaagtcaaactgctcgtactaaagctttagctgattttaaatataatgatataaatgtcttagttgctactgatattgcagctcgtggaattgatattgcccaacttccttgtgtgataaatcttgatttatcaaatgtcgctgaagactatgtccatagaataggtagaactggcagatcaggacaagagggtttagcaatttctcttgtaagtgctgatgaagtcgaatctttatcaaacattgaacatctgatcgggcatcttttaccacgagaagaactagaaggctttgaggcaactcataatgtacctataacaagtatgtcacacaaaaccaaagctaagaaaatcgatgaagttaagataatagctgcaaaaagagcaaaaaagaacaataacaacaaaaaaccttctaataagaatgattttgctaaaaaaattagacaaaaaatacatcaaaataaaaatgttagaaaaccaaaggcaaaagattaa

SEQ ID NO: 38856 - protein, 441 aa, Francisella tularensis subsp. tularensis Schu 4
MKFSDLGLNSLICSALEKKGYTKPTPIQAQAIPIVLKGNDVMASAQTGTGKTAGFTLPIIQRLLDQPKAQANRIKTLILTPTRELAAQIQEQIQIYAANTHIRSAVIFGGVSINPQMMKLRKGVEILIATPGRLLDLYSQNAVKFDSLNTFVLDEADRMLDMGFINDLKKIHNLLPKKLQTLMFSATFSSEIKNLANEFLNNPQFVSADVVNTTVKKITQKIYTLDKSNKINALISLIKDQNLHQVLVFSRTKNGANKISEKLNNAGISSSAIHGNKSQTARTKALADFKYNDINVLVATDIAARGIDIAQLPCVINLDLSNVAEDYVHRIGRTGRSGQEGLAISLVSADEVESLSNIEHLIGHLLPREELEGFEATHNVPITSMSHKTKAKKIDEVKIIAAKRAKKNNNNKKPSNKNDFAKKIRQKIHQNKNVRKPKAKD

SEQ ID NO: 38857 - DNA, 1710 bp, Francisella tularensis subsp. tularensis Schu 4
  CDS (1)..(1710)
atgaattctgaaactaaaaaagattttagtcagcttgggctgaatcaagatattgtagatactgttattaaactaggatatgaaaatccaacacctatccaacagtatgctattccatatatcttatcgggtagagatgtgctaggtcaagcacaaacgggtacgggcaaaacagcagcttttgcattacctctaataaataacatggacttggcatctagagatagagctccacaagttttggtactagcacctacaagagagttagctatacaagtggcggagcagtttgaagcttttgctaaaaatgtacctaatttagatgttgcttgtatttatggtggtcaagaatatggttctcaaataagagcacttaagcaaggtgtaaaagttgtagttggtacaactggtcgagtaatggatcatattgagaaaggtacattacagcttgataatcttagagcattagtattagatgaagcagatgagatgctcagaatgggctttattgatgatgttaaatttgtcttaagtcatgtttctgaacaatgccaaagattacttttctcagcaacaattcctactgatattgctgatattatcgaagaatatctaagaaatccttgtaagatacaagtgaaagcgaaaacaaaaactgctaatacagtgacacaaaaatttatcgtcattaaaggctttagaaagatagatgctttagataggttgcttgagaccgaagaaactgacggtgttattatctttgttaagactaagacaagtactatagaagtagcagataatttaaaagctcttggctataaagtagcagctataaatggcgatatgcaacaatcacagcgtgagtatattgttgatcaattcagaagtgctaaatccgatatcctcgttgctacagatgtagtagctaggggtatagatcttgaacgtattagtcatgtgattaactatgatatgcctaatgatactgatacatatgtacatagaattgggcgtacaggtagagcagggcgtgaaggcacgtcaatttctttagtacctcttaaagagatgagatttttacgtactttagagagatttacaggttcaccaatgcaagaagtatttatgccaagtgctaaagagttagctcaaagcagggtagaacactttaaagctagaataatctcagcattggataaaaataagtctttagataagtataaagaaattattacaagtattcgtgatgaattacagttagactcagaagagcttttagctggacttacattactagctcaaggtaagaaaactttcttcccaaaagaaattcaagctaaagaagaaaaaccagctcgtgataatagaaattctagagatggtagaagaaatgaaagatttgagcgtagaaatgatcaaggtgatagaactaaacgttttgataaagcagatagaaagccacgtcgtgctgtaaatatcgatctaactacttataagttagatgttggtcgtgataatgatgttcaagcacgaaatattgttggtgctatagctaatgagggtaatatcgatagtaaacatatctgtaatatctctattcaaaaagattatacattagttgatttaccagcaaatctttcaccaaaagtgataaatcatctaaaaaaagtttgggttgctgggaagaagttaaatcttactgctcagtaa

SEQ ID NO: 38858 - protein, 569 aa, Francisella tularensis subsp. tularensis Schu 4
MNSETKKDFSQLGLNQDIVDTVIKLGYENPTPIQQYAIPYILSGRDVLGQAQTGTGKTAAFALPLINNMDLASRDRAPQVLVLAPTRELAIQVAEQFEAFAKNVPNLDVACIYGGQEYGSQIRALKQGVKVVVGTTGRVMDHIEKGTLQLDNLRALVLDEADEMLRMGFIDDVKFVLSHVSEQCQRLLFSATIPTDIADIIEEYLRNPCKIQVKAKTKTANTVTQKFIVIKGFRKIDALDRLLETEETDGVIIFVKTKTSTIEVADNLKALGYKVAAINGDMQQSQREYIVDQFRSAKSDILVATDVVARGIDLERISHVINYDMPNDTDTYVHRIGRTGRAGREGTSISLVPLKEMRFLRTLERFTGSPMQEVFMPSAKELAQSRVEHFKARIISALDKNKSLDKYKEIITSIRDELQLDSEELLAGLTLLAQGKKTFFPKEIQAKEEKPARDNRNSRDGRRNERFERRNDQGDRTKRFDKADRKPRRAVNIDLTTYKLDVGRDNDVQARNIVGAIANEGNIDSKHICNISIQKDYTLVDLPANLSPKVINHLKKVWVAGKKLNLTAQ

SEQ ID NO: 38859 - DNA, 1614 bp, Bacillus clausii KSM-K16
  CDS (1)..(1614)
atgacctattttacagactttgatatttcggaccaagtgaaacaagcaatccaggatatggggtttgaagaaccatcccctatccaagaaaaagcgattcctgccattttgacaggtggcgatgtaattggccaagcgcaaacagggactggaaaaacagctgcttttgggataccggttgtcgataaagtgactgaagagcgttacattcaagcgttaattttgacgccaacaagggaactggccattcaagtttctggagaactgcaaaagctatcggctcataaacggattcggacgttgccgatttacggcgggcaatcgatcggccaccaaatcaaagcgttgcgccaaggagtgcaagtagtgattggtaccccagggcggatgcttgaccatttgcgccgtggaacgctcaaacttaattcggtccataccgttgtccttgacgaagccgacgaaatgctcgatatgggctttgtcgatgacatcgaagcgattttaaaggaagtcaatcaagtgcgacaaacgttgttgttttctgctacaatgccgcctgcgatccgcaagctgtcacgaaaatacatgaacgatccgaaaacagtgacgattaataagggcgaagtgacggcgccttcgatcaaccaagtttattataaagtattggagcggaataaaattgactccctttgccgcatcattgatagcgatgacgtggagctcggcattttgttttgccgcacgaaaaaaggtgtcgctgaactgacagaagcacttcaagctcggggctatctcgttgatggtctccatggagacttgacacaatctcagcgtgatgttgtcatgaaaaaattccgcgactcatcgatcgagttcctcattgctacagacgtagctgctcggggcatcgatgtggaaaatgtcacccatgtcatcaactacgatattccacaagaccctgaaagctatgtgcaccggattggccgtacagggcgagcgggccggacaggcgcagcgattacgttggttacgcctcgggaaatgaagcatctccgctctattgaaaaagaaatcaagatgcacattccgtcagcgagtgtaccgacgattgaagaagtagttgaaaaacagcaaagttcttggaaaaacttaattcaggatacaattgagcaaggcggcaaagaaatggagttgttcttgccccttgtcgatgaaattcttgctgagcaagaccctaaacaagtggttgcggcactattgaaattaaagttttctacagagacggcaaccgaagatgctggctacagctttggggacacaggcggtgctaaaggaatggtccgcttcttcatcaatgttggacgaaatgtcaatttgacgccgaaaattttaggcgaagaaatcggccgccttgtcggcattcctgtcaaatcgattggccgcatcgacatctttgaaaacttctcctttgtggacgtaccagaagaggcggcgccatttgtgtatgaaggcttgcgctattcccgtattaatggagcgcgcgtcaaccttgaacctgctaagcctcgcccgaaacgggagcggcgcacgccagcagggtcgcgccgttcatag

SEQ ID NO: 38860 - protein, 537 aa, Bacillus clausii KSM-K16
MTYFTDFDISDQVKQAIQDMGFEEPSPIQEKAIPAILTGGDVIGQAQTGTGKTAAFGIPVVDKVTEERYIQALILTPTRELAIQVSGELQKLSAHKRIRTLPIYGGQSIGHQIKALRQGVQVVIGTPGRMLDHLRRGTLKLNSVHTVVLDEADEMLDMGFVDDIEAILKEVNQVRQTLLFSATMPPAIRKLSRKYMNDPKTVTINKGEVTAPSINQVYYKVLERNKIDSLCRIIDSDDVELGILFCRTKKGVAELTEALQARGYLVDGLHGDLTQSQRDVVMKKFRDSSIEFLIATDVAARGIDVENVTHVINYDIPQDPESYVHRIGRTGRAGRTGAAITLVTPREMKHLRSIEKEIKMHIPSASVPTIEEVVEKQQSSWKNLIQDTIEQGGKEMELFLPLVDEILAEQDPKQVVAALLKLKFSTETATEDAGYSFGDTGGAKGMVRFFINVGRNVNLTPKILGEEIGRLVGIPVKSIGRIDIFENFSFVDVPEEAAPFVYEGLRYSRINGARVNLEPAKPRPKRERRTPAGSRRS

SEQ ID NO: 38861 - DNA, 1683 bp, Dehalococcoides ethenogenes 195
  CDS (1)..(1683)
atgtctttcgaatctttcaattttgctccggctgttatggccggggtcagggcttgcggttatcaagagcccacccccattcaggcccaggctattccccctattttagaggggcatgatgttattggtctggcccaaacaggtactggcaaaaccgcggcttatgctttacccgttatccagaaaatgctttctacccccagggggcgggtacgtactttggtgctggcgcctaccagagagctggcctgccagattgctgagagcttccgctcgctgggtcagcgcgcccgcatccgggagtgctctatctacggcggggttaatatggaccagcaaatccgccgcttacggagcggggtagatgtggtagtggcttgccccggcaggcttttagaccatatctggcggggaactattgatatttgcggggtggagaccctgattatagacgaggctgaccgcatgtttgatatgggtttccagccggatatccagagtattttgaaatgtctggttcagccgcatcagacccttttattttcagccaccatgccgccggaagtccgcaagctgaccttggaaacccagactaatccggtaactatccagattggtactcaggctccggcaagcagtgtcagccacagtgtttatccggtgaaaaaccatcagaaaacccctttgctgattgaaattctgaaaacaacggaaaccaagtctgttttgatatttgcccgcaccaagtacggggcggaaaacctggctgatgaaatatccagagccggttttactactgcatctttgcagggcaatctttcccaaaaccgccgccatgccgtcatggaaggcttccgccgggggaattttaaaattctggtggctaccgatattgccgccaggggtctggatattgaccatatttcccacgtgataaattatgatatgccggatacccctgaagattatactcaccgtatcggacggaccgggcgttttgaccgcaccgggcaggccctcagcctggtgaccgggcgtgatggtgatatggtaagggatattcaaaaactgataaacagcccaatccagcgcctccgggttgatgggtttgattatgccaccacccgtaatgacgggcagaaccattcgcagcgccggggctttgctccccgccggggttattcggctgagggttataaccgctctgaaatgcctgcagctgaaacttcaccaaatagtcttacggctgaaatgccctcaggcaatgtcaggccgtttagtcaggctgtccgttccggacgcccggctgattccgccccccgtttccgccgggaagggtactctgccccccgctttgggggacgcccttcgtttgaggatgcccctatggcagctaagcctgtagccaggtttaatgcccgtcctgctttcaggaaagaggatgatgctcaagctgcggctaaagcctacccttcatttggcagggaaaccggagtgacttcggctgaaaatacccggtctgtttctgaaaacccggagcagttttcaagccgccgtccggcccgctttaacggcaaagcttcttttgcaaaccgcccggcccggccggggaataaagtgggaaaaccgcccttcttcaggcgttcaaaaccgcctgtttcagagaacaacccaacttattag

SEQ ID NO: 38862 - protein, 560 aa, Dehalococcoides ethenogenes 195
MSFESFNFAPAVMAGVRACGYQEPTPIQAQAIPPILEGHDVIGLAQTGTGKTAAYALPVIQKMLSTPRGRVRTLVLAPTRELACQIAESFRSLGQRARIRECSIYGGVNMDQQIRRLRSGVDVVVACPGRLLDHIWRGTIDICGVETLIIDEADRMFDMGFQPDIQSILKCLVQPHQTLLFSATMPPEVRKLTLETQTNPVTIQIGTQAPASSVSHSVYPVKNHQKTPLLIEILKTTETKSVLIFARTKYGAENLADEISRAGFTTASLQGNLSQNRRHAVMEGFRRGNFKILVATDIAARGLDIDHISHVINYDMPDTPEDYTHRIGRTGRFDRTGQALSLVTGRDGDMVRDIQKLINSPIQRLRVDGFDYATTRNDGQNHSQRRGFAPRRGYSAEGYNRSEMPAAETSPNSLTAEMPSGNVRPFSQAVRSGRPADSAPRFRREGYSAPRFGGRPSFEDAPMAAKPVARFNARPAFRKEDDAQAAAKAYPSFGRETGVTSAENTRSVSENPEQFSSRRPARFNGKASFANRPARPGNKVGKPPFFRRSKPPVSENNPTY

SEQ ID NO: 38863 - DNA, 1362 bp, Rhodobacter sphaeroides 2.4.1
  CDS (1)..(1362)
atggctgatttcagcaccctcgggctgtccgagcgactcatgcagggcctggccaaggcccagttcacccaaccgacgccgatccaggtcgaggcgatcccctacgtcatgcagggccgcgacctgatgggcctcgcccagaccggcaccggcaagacgctggccttcgggctgccgctcctgcaccggctgctcggcgtgggccatccgccgccgccgcgcaccatccgcgccctgatcctcgcccccacgcgcgagctcgtgacccagatcgcgaccaacctcgagctcttcactaagggcacgccggtcaaggtcgtcaccatcaccggcggcgcctcgatcaaccgccagaccgagcggctcgcccgcggcgccgacatcatggtggccacccccggccgcctgatcgacctgctcgaccgcaatgcggtggtgctcgaccacaccggctatctggtgctggacgaggccgaccagatgctcgacatgggcttcatccacagcctgcggaagatcgcccgcttcctgccgctgaagcggcagacgctgctcttctcggccacgatgccgaagctgatcgaggagctggcccacacctacctgcgcgagccggtgaaggtgcaggtggccccgcccggcaagccggtcgagaagattgcgcagggggtgcatttcaccccgcagggcgacaaggcgaagctgctcgagagctatctccagaagcatccgggcgagcaggcgctggtcttcggccgcaccaagcacgggtcggaaaagctgatgaagctgctggtcagctggggcttcaaggcgggctcgatccacggcaacaagagccagaaccagcgcgaccgcacgctgaccgagttccgcgacggctcgctcgacgtactggtggccaccgacgtggccgcccgcggcatcgacattcccggcgtgagacatgtctacaactacgacatgcccaacgtgcccgagaactacgtccaccgcatcggccgcaccgcgcgcgccggcgccgagggcagcgccgtggccttcgtggccccggccgagatggaggagttccgcgcggtcgagaaacttctcaagcagcccattccggtgatcggcggcgcaccctgggccgcggacatcgtggcggcggcgccccgtcccggccagaagccgcggcagggcggacggccgaagaccggcgccaagccgcagggcaagccccaggccaaggcgcagccgaagccgcagggcgccgccaaggcccatccgcgggccgggcgcccggcgggcgcccccggcggccatgcggccccgaagcgcgcggcccgcggcccgcggcgcggagatgccgcccgcggctga

SEQ ID NO: 38864 - protein, 453 aa, Rhodobacter sphaeroides 2.4.1
MADFSTLGLSERLMQGLAKAQFTQPTPIQVEAIPYVMQGRDLMGLAQTGTGKTLAFGLPLLHRLLGVGHPPPPRTIRALILAPTRELVTQIATNLELFTKGTPVKVVTITGGASINRQTERLARGADIMVATPGRLIDLLDRNAVVLDHTGYLVLDEADQMLDMGFIHSLRKIARFLPLKRQTLLFSATMPKLIEELAHTYLREPVKVQVAPPGKPVEKIAQGVHFTPQGDKAKLLESYLQKHPGEQALVFGRTKHGSEKLMKLLVSWGFKAGSIHGNKSQNQRDRTLTEFRDGSLDVLVATDVAARGIDIPGVRHVYNYDMPNVPENYVHRIGRTARAGAEGSAVAFVAPAEMEEFRAVEKLLKQPIPVIGGAPWAADIVAAAPRPGQKPRQGGRPKTGAKPQGKPQAKAQPKPQGAAKAHPRAGRPAGAPGGHAAPKRAARGPRRGDAARG

SEQ ID NO: 38865 - DNA, 1830 bp, Xylella fastidiosa Dixon
  CDS (1)..(1830)
atgtcaaatccatcttctacaccgctgctgtttgcagatctcggcctctccgatgctgtgatgcaagccgtcacaaaaatcggctacgaaactccgtcgcccatccaggcggcgaccatcccagccttgcttgctgggcgcgatgtgctgggccaagcccagaccggcactgggaagactgccgcattcgcgctaccgttgctcacacgcaccgttctgaaccaggtcaagccgcaagtgctcgtactggcacccacccgcgaactggctatccaagttgccgaagcattccagcgctatgctgcctcgatctctggcttccgtgtcctacccgtgtacggcggccaatcctatggccaacaactggccgcactgaaacgcggtgtccatgtgatcgtcggtaccccgggccgggtgattgatcacctagagcgcggcaccctggatctatcggaattaaaaacgctggtcctcgacgaagccgacgaaatgctgcgtatgggtttcattgaggacgttgaagaagtcctacggaagttgcccgcttcacgccaggtcgctctgttctcggcaaccatgccaccacagatccgccgtatcgcacaaacctatctacaagatccgattgaagtcaccatcgccaccaaaaccacgaccgcagccaacatccgccaacgttactggtgggtcagcggcctccacaagctagatgcactcacacgcattcttgaggtggaaaccttcgacgcaatgattatcttcgtgcgcaccaaagctgccaccgaagaattggccgagaaattgcaggcacgtggcctgaccgccgcagcgatcaatggcgatatgcaacaagcgcaacgcgaacgcaccattcaccaactcaaagatggcaagctggatatcctcgttgccaccgacgtcgccgcacgtggtttggacgtagaacgtatcagccacgtgctgaactacgacatcccttacgacgttgagagctacgtccaccgtatcggacgcactgggcgtgccggtcgcagcggcgaagcaatcctctttgtgactccgcgcgaaaaaggcatgctgcgccagattgaacgtgccactcaccaaccgatcgaagccatgcaactgcccagtgtggatgcagtcaacgacacgcgcgtgaccaaatttttcggacgcatcagcaatgctctggtggtcggcgctgaaatcgacttctaccgcaaactgctacaacgtttcgagagcgagcacaatgtccctgccattgagatcgctgctgccctggcacgactccttcagggggatagccccttcctgctgagtgtcccgacgcgcccccaacgcgagcgcagcgagctggcatccgagcatcatgtcaaacgcccctcatccttcaagcagacagagcgtccaaacaacactgaacaccccaagcgcccccaacgcaacgcacctgcccgcaatgtcccagagttcggtatggagtcttaccgcatcgaagtcggccgcatgcacggtgtgaagccagccaatatcgtcggcgctatcgccaacgaagctggattagagagccgctacattggccggattgacatccgtgacgatcactcggttctggatctccccgcagaaatgccacacgagatcctgcaacacctaaaaaaggtctgggtatcaggacagcaactacaaatgcatcggatcgacacaaccgaaacaaccgcacctgcacgggaatttaagtcaaaaccgggtggcgctggcaaattcccgccgaaaccgcatcacaacaaatcaaccaaaccaaaaccaccatacagcggttga

SEQ ID NO: 38866 - protein, 609 aa, Xylella fastidiosa Dixon
MSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMHRIDTTETTAPAREFKSKPGGAGKFPPKPHHNKSTKPKPPYSG

SEQ ID NO: 38867 - DNA, 1656 bp, Magnetospirillum magnetotacticum MS-1
  CDS (1)..(1656)
atgcaccccaggctgctccatcacgcgggccgcctcccggaccgtcggacccatcatattcccgtgcgagtcgtctcgccggccttcgggttccgctgcctcgaaagtaacgacttgacccagtttaccgatttcggcctcgccgagcccatcctgcgcgcgcttggcgaggctggctacgtgtcgccgacgccgatccagacgcaggccctgccgccggcgatggaggggcgcgacctctgcggcatcgcccagaccggcaccggcaagaccgccgccttcgctttgccgatcctgcaccgcctctcgctcgagaaccgccgggcgccgcgccgcggttgccgcgtgctcgtgctctcgccgacccgtgagctggcgagccagatcgccgagagcttctcggattacggccggcacctgccctataccagcaccgtcgtgttcggcggcgtgaacatcagccgccaggagcgcgcgatcgcgccgggcgtcgacatcctcgtcgccactcccggccggttgatcgacctcgtcgaccgccgggcgctgacgctggagggcgtcgagatcctcgtcctcgacgaggccgaccagatgctcgacctcggcttcatccacgcgctgaagcgcatcgtgaagatgctgccggcgcggcgccagagcctgttcttctcggccaccatgccgaagaacatcgccggcctcgccgaccagtatctctccaacccggtgcaggtcgcggtgactccggtggccactaccgccgagcgcgtcgatcagcaggtcatcttctgccataccggtgccaagcaggcgctgctcaaccacgtcctgcgcgatccgaagatcgagcgcgtcctcgtcttcacccgcaccaagcatggggcggaccgggtggtgcgcggcctcgacaaggtcggcatcgtcggcgcggcgatccacggcaacaagagccagccgcagcgtgagcgggcgctggccgccttccgcgacggctcctgccgcgtgctcgtggcgaccgatatcgcggcgcgcggtatcgacgtcgagggcgtcacccatgtggtgaactacgacctgccgaacgtgccggaatcctacgtccaccgcatcggccgcacggcccgcgccggcgcggaggggcaggcgatctcgttctgcaacgacgaggagcgcgcctacctgcgcgacatcgagcggaccacgcgccagaaggtcccggtggtcggcttccccgagggcttccagccgccgagccgccaggaggcgcaggagaccgccgccgaggaggcgcgccgcccgccgcgtcagccgcagggtcgtccgggccagcgccagggccgtccgggcggtcgtggccaggaaggtcgcggcgagggtcgcggcgagcaccgcgcccacgaggcccgcggcggtcgccccggcggccagccgggccatcgccaggaccagcgtcaggacagccgtgggccgcgtcccgatggccagcgctccgaccagcgccgcccggagcgggccggcgagggccggccgcagggcgcgcgtccccagggcgggcgcccgaatgacggtcgtcgcggtgatgcacggcccgcccgctccggcgccgagggcggccgggcgatcggctggctcgaccgttccccgcgttcctga

SEQ ID NO: 38868 - protein, 551 aa, Magnetospirillum magnetotacticum MS-1
MHPRLLHHAGRLPDRRTHHIPVRVVSPAFGFRCLESNDLTQFTDFGLAEPILRALGEAGYVSPTPIQTQALPPAMEGRDLCGIAQTGTGKTAAFALPILHRLSLENRRAPRRGCRVLVLSPTRELASQIAESFSDYGRHLPYTSTVVFGGVNISRQERAIAPGVDILVATPGRLIDLVDRRALTLEGVEILVLDEADQMLDLGFIHALKRIVKMLPARRQSLFFSATMPKNIAGLADQYLSNPVQVAVTPVATTAERVDQQVIFCHTGAKQALLNHVLRDPKIERVLVFTRTKHGADRVVRGLDKVGIVGAAIHGNKSQPQRERALAAFRDGSCRVLVATDIAARGIDVEGVTHVVNYDLPNVPESYVHRIGRTARAGAEGQAISFCNDEERAYLRDIERTTRQKVPVVGFPEGFQPPSRQEAQETAAEEARRPPRQPQGRPGQRQGRPGGRGQEGRGEGRGEHRAHEARGGRPGGQPGHRQDQRQDSRGPRPDGQRSDQRRPERAGEGRPQGARPQGGRPNDGRRGDARPARSGAEGGRAIGWLDRSPRS

SEQ ID NO: 38869 - DNA, 1623 bp, Leuconostoc mesenteroides subsp. mesenteroides ATCC 8293
  CDS (1)..(1623)
atggcaaacgcgcacaaagcgcaaggagaaaaaattttgaaatttagtgaattaggtttgtcacaagacattttggatgctattacaacgcatggatatgttgaagctacaccaatccaagaaaagacaattccattaacattagcaggacgtgatgtaattggacaagcacaaacaggaactggtaaaacagcagcatttggtttgccaatcttggagcacattgatttaaataataaaaacattcaagcattgattgtatcaccaacgcgtgaattagcaattcaaacagctgaagaattaaaaaagttgggacgcgacaagcgagttgatgtacaggttgtctttggtggtgctgatattcgccgtcagatccaaaatttgaagtcacatccacaaatcctagttggtacacctggtcgtttacttgatcacattaaccgtaagactgtaaaaattgataatgttcgtacattagtattggatgaagctgatgaaatgttaaatatgggcttcttagacgatattgaggcaattatttcaaagacaccagcagagcgtcaaacactgttgttctcagcaacaatgccaccagcaattaagcgtattggtgtcaagttcatgacgaaccctgaacatattcaaatcgaagcaaaagaattaacaactgatttggttgatcaatactttgttcgtatgcgcgaaaacgaaaagtttgatactatgacgcgtatctttgatgtgcaggcaccaaaattggcgatcgtcttcggtcgtacaaagcgtcgcgttgaagaattatcacgaggattagaagcacgtggttaccacgctgctggtttgcatggtgatttaacacaacaaatgcgttcacgtgtgttggctcaatttaagtcacatgaaattaatattttagttgcaacagacgttgctgcacgtggtttggatgtgaaggacgtatctcacgtttataactttgatattccgcaagatccagaatcttatgttcaccgtattggacgtactggtcgtgctggagctaagggtgtatctgtcactttcgttgcaccaaacgaaatggattacttacgtgctgttgaagatttgactaagaagcgcatgacgcctcttgaaccagcatctctaaaggacgctcgtattggaaagattaacaatgctgctggtgaagttgctaagttaattgatacaactgaggtttcagaaattcaatctcaggtagatgcgttgacagcaaagtatagtgctgaacaattagctgctgctgtattatctagcgttgctgatttagaaaagcaaaatacaccagttgaaattactcgtgaacgtccattaccacgtcgtaagggtggtaatggtggctcacgcggtggttcacgtaatggcggcggacgtcgtaatggtggtggcggtggttaccgtggcaatcgcgaacgtcgtggtaatggtgacacccgcggtaatgatcgccgtcgaggcagtggcgctgcttctagcgaacgccgttttggagattacaagcgtcgtgacggtcgctcaactgaaagtcgtcgcaacagtagtggcggatcacgtcgcgaatttactgtacgtgaaaaagattaa

SEQ ID NO: 38870 - protein, 540 aa, Leuconostoc mesenteroides subsp. mesenteroides ATCC 8293
MANAHKAQGEKILKFSELGLSQDILDAITTHGYVEATPIQEKTIPLTLAGRDVIGQAQTGTGKTAAFGLPILEHIDLNNKNIQALIVSPTRELAIQTAEELKKLGRDKRVDVQVVFGGADIRRQIQNLKSHPQILVGTPGRLLDHINRKTVKIDNVRTLVLDEADEMLNMGFLDDIEAIISKTPAERQTLLFSATMPPAIKRIGVKFMTNPEHIQIEAKELTTDLVDQYFVRMRENEKFDTMTRIFDVQAPKLAIVFGRTKRRVEELSRGLEARGYHAAGLHGDLTQQMRSRVLAQFKSHEINILVATDVAARGLDVKDVSHVYNFDIPQDPESYVHRIGRTGRAGAKGVSVTFVAPNEMDYLRAVEDLTKKRMTPLEPASLKDARIGKINNAAGEVAKLIDTTEVSEIQSQVDALTAKYSAEQLAAAVLSSVADLEKQNTPVEITRERPLPRRKGGNGGSRGGSRNGGGRRNGGGGGYRGNRERRGNGDTRGNDRRRGSGAASSERRFGDYKRRDGRSTESRRNSSGGSRREFTVREKD

SEQ ID NO: 38871 - DNA, 1260 bp, Azotobacter vinelandii
  CDS (1)..(1260)
ttgcccgtactcggttacatcctgcccacgccggtgcagcgccaggcgattcccgcgttgttggccggccgcgacctgctggtggcggcgcagaccggcagcggcaagaccgccggcttcgccctgccggtactgcagcggctgaccctggagggatcgccggccgccgccaactcggtgcgtgcgctggtgctggtgccgacccgcgaactggccgagcaggtccatgggaccatccgtgcctgcggcatggagctgccgttgcggaccgcggtggcctacggcggggtgagcatcaatccgcagatgatgctgctgcgtccggggatcgacgtgctggtggccacgcccggccggctgctcgacctgtaccggcagaacgccgtacgcttcgaccagttgcagatcctcgtgctggacgaggccgatcgcatgctcgacctgggcttctcccgcgagctggaagaactgttcgtcctgctgccggcgcagcgccagaccctgctgtgttcggccaccttctccgaggagatccgccagatcgccaccggcctgctgcgcgacccgctgaccatcgagatcagcgcgcccaactcggcggcgccgagcgtcgcccagtggatgatcccggtggacaagaagcgcaaggccgagctgttcctgcatctgctggagcgcgagcgctgggagcaggtgctggtgttctcgcgcacccgcaagggcgtcgagcggctggccgaggaactgcagcagcgcggctaccgggccggcgcgatccacggcgacctgccgcagccggcgcgcctgcgcgccctggagcagttcaaggccgacgagctgcaggtgctggtggccaccgacgtggctgcccgcgggctggacatccagggcctgccgctggtggtcaacctcgatctgccggtcgcccccgaatactacgtgcaccgcatcggccgtaccggccgtgccggtgccagcggcgaggcgatctcgctggtctgcgccgacgaggtcgaacaattggccgccatcgaggcgctgatccgccagttgctgccgcgccgcgaggagcccgacttcagccccgagcaccgggtgccggaaaccgccctgggtggcgtcatcctgagcaagccgaagcagcccaggcagaaaccggcccccaaattcggcgaccggctcgacgacaaggcccggccggcagtggaagcggtacgccagatgcccaatctgagtacgccgccggacaggaagaagtag

SEQ ID NO: 38872 - protein, 419 aa, Azotobacter vinelandii
MPVLGYILPTPVQRQAIPALLAGRDLLVAAQTGSGKTAGFALPVLQRLTLEGSPAAANSVRALVLVPTRELAEQVHGTIRACGMELPLRTAVAYGGVSINPQMMLLRPGIDVLVATPGRLLDLYRQNAVRFDQLQILVLDEADRMLDLGFSRELEELFVLLPAQRQTLLCSATFSEEIRQIATGLLRDPLTIEISAPNSAAPSVAQWMIPVDKKRKAELFLHLLERERWEQVLVFSRTRKGVERLAEELQQRGYRAGAIHGDLPQPARLRALEQFKADELQVLVATDVAARGLDIQGLPLVVNLDLPVAPEYYVHRIGRTGRAGASGEAISLVCADEVEQLAAIEALIRQLLPRREEPDFSPEHRVPETALGGVILSKPKQPRQKPAPKFGDRLDDKARPAVEAVRQMPNLSTPPDRKK

SEQ ID NO: 38873 - DNA, 1452 bp, Azotobacter vinelandii
  CDS (1)..(1452)
atgggcgaacaggcacaaccgcctgtcgccgccgacatgccagctcccgccacccgctccaccgctcccgccgctccatccaagccgccccggcagaaaaccaagcccccccgcagcgaaggcaagcccgccggcaggaaaatcgtcgccgacaagcccgtcggcgaacgcaagggcgccggcaagccccaggtcggacggccacggcgcgagccaccgccggacaagccggcggcggagtggaagctggaggacttcgtggtcgaacccgtgccgggcaagacccgtttccacgacttcgacctcgacccgcggctgatgcacgccatccacgacgtcggcttcccctactgcacgccgatccaggcccaggtgctcggctacaccctcaagggccgggacgccatcggccgcgcccagaccggcaccggcaagaccgcggccttcctgatctcgatcatcagccagttgctgcagaccccgccgcccaaggagcgctacatgggcgagccgcgcgcgctgatcatcgcgccgacccgcgagctggtggtgcagatcgccaaggatgccctggcgctgacccgctacaccggcctcaacgtgatgagcttcgtcggcggcatggacttcgacaagcagctcaagcaactggaggagaagttctgcgacatcctggtggccacccccggccgcctgctggacttcaaccagcgcggcgaggtgcatctggacatggtcgaggtgctggtgctggacgaggccgaccgcatgctcgacatgggcttcattccgcaggtgcggcagatcatccgccagaccccgtacaagggcgaacggcagaccctgctgttctcggcgaccttcaccgaggacgtgatgaacctggccaagcagtggacggtcgatccggcgatcgtcgagatcgaaccggagcatgtcgccagcgacagcgtcgagcagcacgtctacgcggtggccggcagcgacaagtaccggctgctgtacaacctggtgacccgcaacaactgggaacgggtgatggtgttcgccaaccgcaaggacgaggtgcggcgcatcgaggagcgcctgaccaaggacggcatcagcgccgcgcagatgtccggcgacgtgccgcagcacaagcgcatcaaggtcctggaaggcttccgcgagggccgcatccgcgtgttggtggccaccgacgtggccggccgcggcatccatgtcgagggtgtcagccacgtgatcaactacaccctgccggaagatccggacgactacgtgcaccgcatcggccgcaccggccgggccggctccaaaggcacctcgatcagcttcgccggcgaggacgacgccttcgccctgccaccgatcgaggcgctgctcgggcgcaagatcgactgcgagatcccgcccgccgaactgctccagccggtgccgcggcgctcctga

SEQ ID NO: 38874 - protein, 483 aa, Azotobacter vinelandii
MGEQAQPPVAADMPAPATRSTAPAAPSKPPRQKTKPPRSEGKPAGRKIVADKPVGERKGAGKPQVGRPRREPPPDKPAAEWKLEDFVVEPVPGKTRFHDFDLDPRLMHAIHDVGFPYCTPIQAQVLGYTLKGRDAIGRAQTGTGKTAAFLISIISQLLQTPPPKERYMGEPRALIIAPTRELVVQIAKDALALTRYTGLNVMSFVGGMDFDKQLKQLEEKFCDILVATPGRLLDFNQRGEVHLDMVEVLVLDEADRMLDMGFIPQVRQIIRQTPYKGERQTLLFSATFTEDVMNLAKQWTVDPAIVEIEPEHVASDSVEQHVYAVAGSDKYRLLYNLVTRNNWERVMVFANRKDEVRRIEERLTKDGISAAQMSGDVPQHKRIKVLEGFREGRIRVLVATDVAGRGIHVEGVSHVINYTLPEDPDDYVHRIGRTGRAGSKGTSISFAGEDDAFALPPIEALLGRKIDCEIPPAELLQPVPRRS

SEQ ID NO: 38875 - DNA, 1677 bp, Azotobacter vinelandii
  CDS (1)..(1677)
atgacccaggagaccggcggcttcgccgcactcggtattcatcccgctgtactcgccgccatcaccgcggtgggctacgaagaaccgtcccccatccaggcccaggcgatcccggtgatccttgccggccacgacatgatcggccaggctcagaccggcaccggcaagaccgccgccttcgccctgccgatgctctcgcgcatcgacccggcgcgccgcgagccgcagctgctgatcctcgcgccgacccgcgagctggccctgcaggtggccaccgccttcgagacctatgccagccaactgcccggtgtcggcgtggtggcggtctacggcggcgcgccgatgggcccgcagttgaaggcgctgcgccagggcgcgcagattctggtggccactcccggtcgtctgtgcgaccacctgcgccgcgacgagcaactgctgtccaccgtgaagcacctggtcctcgacgaggccgacgagatgctcaagctcggcttcatggaggatctcgaagtgatcttcgcggccctgccggaaagccgccagacggtgctgttctccgcgaccctgccgcactcgatccgcgagatcgccgagaagcacctgcacgagccgcagcacgtcaagatcgccgccaagacccagaccgtggcgcgtatcgaccaggcccacctgatggtccacgccgaccagaagaccgccgccgtgctgcgcctgctggaagtcgaggaattcgacgcgctgatcgccttcgtgcgcaccaagcaggccaccctcgacctcgctggtgcccttgaagccaagggctacaaggccgccgcactgaacggcgacatcgcccagaaccagcgcgagcgggtcatcgagtcgctcaaggatggccgcctggacatcgtcgtcgccaccgacgtggccgcccgtggtatcgacgtgccgcgcatcacccacgtgttcaacgtcgacatgccctacgatccggaatcctacgtgcaccgcatcggtcgtaccggccgggccggccgcgacggtcgtgccctgctgctggtgaccccgcgcgagcggcgcatgttgcaggtgatcgagcgggtcaccgggcagaaggtcgccgaggtgcacctgcctggtgcccagcaggtgctggatgcgcgcatccgcaagctgaccgccgctctgcagccgctgctggccgagtccgagtccagccacggcgaactgctcgaccgcctgaccgccggcctcggctgcagtccgcgcgccctggccgcggccctgctgcgcaaggccaccaacggccaggcgctgaccctgtccgaggtcgagcgcgaacagcctccggtgccgagcgtttcggcgccgcgcgaacgtcgcgagcgcagcgatcgctccatggagcgcggcgtgcaccgcgagcggcgtgcacccatgcccctgccggagggccgggtccgctgccgcgccgccttgggcgcgcgcgacgggatcgccgcgaagaacctgctgggcgccatcctcaacgaaggcggtctggcccgcgacgccatcggtcgcatccaggttcgcgacagcttcagcctgatcgagttgccggaggacggcctcgagcgtctgctcggcaagctgcgcgacacccgcgtcgccggcaagcaactgaagctgcgccgctatcgcgaagactga

SEQ ID NO: 38876 - protein, 558 aa, Azotobacter vinelandii
MTQETGGFAALGIHPAVLAAITAVGYEEPSPIQAQAIPVILAGHDMIGQAQTGTGKTAAFALPMLSRIDPARREPQLLILAPTRELALQVATAFETYASQLPGVGVVAVYGGAPMGPQLKALRQGAQILVATPGRLCDHLRRDEQLLSTVKHLVLDEADEMLKLGFMEDLEVIFAALPESRQTVLFSATLPHSIREIAEKHLHEPQHVKIAAKTQTVARIDQAHLMVHADQKTAAVLRLLEVEEFDALIAFVRTKQATLDLAGALEAKGYKAAALNGDIAQNQRERVIESLKDGRLDIVVATDVAARGIDVPRITHVFNVDMPYDPESYVHRIGRTGRAGRDGRALLLVTPRERRMLQVIERVTGQKVAEVHLPGAQQVLDARIRKLTAALQPLLAESESSHGELLDRLTAGLGCSPRALAAALLRKATNGQALTLSEVEREQPPVPSVSAPRERRERSDRSMERGVHRERRAPMPLPEGRVRCRAALGARDGIAAKNLLGAILNEGGLARDAIGRIQVRDSFSLIELPEDGLERLLGKLRDTRVAGKQLKLRRYRED

SEQ ID NO: 38877 - DNA, 1470 bp, Desulfitobacterium hafniense DCB-2
  CDS (1)..(1470)
atggatggtgtggatttaatcggccaggcccaaaccggtacaggaaaaactgccgcctttgggattcccatctgtgaaaaagtcaaccctaagtttcaggcagttcaagccttgattctgacaccaacccgcgaactggccgttcaggtgtcggaagagatcagcaagatcgggaaatatcgccatattaaacccttgcccatttacggaggccaatccatcgaccgtcagatccgggcattgcgcttcggcagccaggtggtggtaggaactccgggtcgtatccttgatcatttaaatcgcggaaccctaaaattgcagtatgtaaaaatggtggttctggacgaagccgatgaaatgctggatatgggctttgttgaggatatagaaacgattcttaagcaagttcccaaagaagagcgccaggtgatgcttttctcggctaccatgccgccggaaattaagaaactggctcagaattatatgcaccagcctaaatccgtagccgtaagccgtgatgagctcactgtgcctttgattgagcaagtcttttatgaagccagagacaaaatcaaagtggatgccctctgtcggattattgatatggaagatatcggtcaagccattatcttctgtcggaccaaaagaggggttgatgagcttgtggccgctctggaggcaagagggtattttgcagatgccctgcatggtgatttaagccaacagcagagagaccgggtcatgaagaagttccgtgacggcaaggttgagttgcttgtggctacggacgtggcagcccggggactggatatcgataacgtaacccatgttattaacttcgacattccccaggatcctgaatcttatgttcatcggatcgggcgtaccggcagagccgggagaaaaggccaggctattaccttggtttcttcccgggaataccgtcaactccgcttgatcgaacgtttgatcaagacccggatcatacgcaaagagttaccgaccctggccgatgtcagtgaacggcaagcggaaaatctcaagaatcagctggttaagattttgcagcgaagccacttgggaacctatcgctccatcgtgggatctttgctggaagagtatgattctatggatgtagcggcagcagccttgaaatttgctgttgagggtgttgaggagcgaagtgaagaggaagatgatattgcttttggcaatactggagcagcccctggtatggtccgcctctttatgaatattggccgtcttcaacaggttcgccctcaggacatcgtccgttggatagctgacgaaagcggaattcccggcaacattatcgggatgatcaacatctatgataaatttacctttgtggaaatccctgaacaacatgccagccgggttctcagctgcatgcatcagaacatgattaaaggccgtaaggtcaacgtggaaccggctaaagccagataa

SEQ ID NO: 38878 - protein, 489 aa, Desulfitobacterium hafniense DCB-2
MDGVDLIGQAQTGTGKTAAFGIPICEKVNPKFQAVQALILTPTRELAVQVSEEISKIGKYRHIKPLPIYGGQSIDRQIRALRFGSQVVVGTPGRILDHLNRGTLKLQYVKMVVLDEADEMLDMGFVEDIETILKQVPKEERQVMLFSATMPPEIKKLAQNYMHQPKSVAVSRDELTVPLIEQVFYEARDKIKVDALCRIIDMEDIGQAIIFCRTKRGVDELVAALEARGYFADALHGDLSQQQRDRVMKKFRDGKVELLVATDVAARGLDIDNVTHVINFDIPQDPESYVHRIGRTGRAGRKGQAITLVSSREYRQLRLIERLIKTRIIRKELPTLADVSERQAENLKNQLVKILQRSHLGTYRSIVGSLLEEYDSMDVAAAALKFAVEGVEERSEEEDDIAFGNTGAAPGMVRLFMNIGRLQQVRPQDIVRWIADESGIPGNIIGMINIYDKFTFVEIPEQHASRVLSCMHQNMIKGRKVNVEPAKAR

SEQ ID NO: 38879 - DNA, 1530 bp, Nostoc punctiforme PCC 73102
  CDS (1)..(1530)
atgactctttcattccaagaattaggcatttcccaagaacgtgtcgcacaactagaaaaaatcggttttaccgaaccaactaacattcaagtccaagcaattccccaattgctgggtggtcgtgatgtagtaggtcaatctcaaactggaacaggcaaaaccgcagcgttttcactgcctattttagagcggctagatattaatcaaaaagccgtacaagccatagttttaacaccaactcgtgaattagcaatgcaagttcacgatgcgatcgcccaattcatcggtgatgaaggattgcgggtgttagcaatctatggtggtcaatcaattgaccgccagatgctacaactcagacgtggcgttcacatggttgtgggcacaccaggacgggtgatcgatttactcgatcgcggctgtttaaagctcgatcaagtgaagtggtttgtgttggatgaagcagatgaaatgttgagcatgggctttatcgacgatgtgataaaaatcctctcgcaagcgcccgtagatcgccaaacagctttattctcggcaacaatgccaccatcgattcggatgttggtgaataagttcttgcgatcgcctgcaactgtcaccgtcgagcagccaaaagccgctcccaacaagattaatcaggtagcttacttgatcccccgccactggacaaaagctaaagctttacagccgattctggaaatggaagatccagaaacagctttaatctttgtccgtaccagacgtacagccgcagaactcaccagtcagttacaaggggctggtcacagtgttgatgaataccacggtgacttgtctcaacaagcacgggaacggttattagtcagattccgtaaccgtcaagtccgttgggtagtagcaactgatattgcagcacgagggttagatgtcgatcaactctcccatgtaatcaacttcgacttacccgatagcgtagaaacctacgtccaccgtattggtcgtactggtcgtgctggtaaagaaggaacagcaatttctttagtacaaccatttgagcggcgcaagcagcaaacatttgaacgtcataaccgtcaaagctggcaattactctcaattccaacacgcgcacaaattgaagcgcggcacatactaaaactgcaagaacaggtgcgggaagctttgacaggtgagcgtttagcttcattcttgccaattgttagcgaactaattgaagaatacgatgctcaagcgatcgccgcagccgcattgcaaatcgcttacgatcaaactcgtccggcttggttgagttcagatgtggaaataccccaagaggaatcttctgctcccaaaccaagattgggcaagcgtcgtgaatcttccagcgatcgcccccgttctgcgtggaaatcagatagtaacaatggtgaagaaagacattcttctcccaagccaaaactgcggacaagtgggcacgagtcttctgcatcccctagtaaaaagataggttcacctacagctagagaatcagcttcttag

SEQ ID NO: 38880 - protein, 509 aa, Nostoc punctiforme PCC 73102
MTLSFQELGISQERVAQLEKIGFTEPTNIQVQAIPQLLGGRDVVGQSQTGTGKTAAFSLPILERLDINQKAVQAIVLTPTRELAMQVHDAIAQFIGDEGLRVLAIYGGQSIDRQMLQLRRGVHMVVGTPGRVIDLLDRGCLKLDQVKWFVLDEADEMLSMGFIDDVIKILSQAPVDRQTALFSATMPPSIRMLVNKFLRSPATVTVEQPKAAPNKINQVAYLIPRHWTKAKALQPILEMEDPETALIFVRTRRTAAELTSQLQGAGHSVDEYHGDLSQQARERLLVRFRNRQVRWVVATDIAARGLDVDQLSHVINFDLPDSVETYVHRIGRTGRAGKEGTAISLVQPFERRKQQTFERHNRQSWQLLSIPTRAQIEARHILKLQEQVREALTGERLASFLPIVSELIEEYDAQAIAAAALQIAYDQTRPAWLSSDVEIPQEESSAPKPRLGKRRESSSDRPRSAWKSDSNNGEERHSSPKPKLRTSGHESSASPSKKIGSPTARESAS

SEQ ID NO: 38881 - DNA, 1674 bp, Pseudomonas syringae pv. syringae B728a
  CDS (1)..(1674)
atgacccaggaaatcggcggcttcgccgctctcgaacttcatccaaatatcgttgcagcagtcgtcgccactggctacgaagagccttcggccattcagcagcaatcgatcccgattattctcgccggtcacgacatgattggtcaggcgcaaaccggtacgggtaaaaccgccgcgttcgcactgcctatcctgcatcggatcgacccgagcaagcgcgagccgcaagcactgatcctggccccgacccgcgaactggcacttcaggttgccaccgcgttcgagacctacgcaaaacaaatgccgggcgtgaccgttgtagcggtctacggcggcgcgccgatgggccctcagctcaaggctatccgcaacggcgcacagatcgtcgtcgctaccccgggccgtctctgcgaccacctgcgtcgtgacgagaaagtcctggcgaccgtgaaccacctggttctcgacgaagcggacgaaatgctcaagctgggcttcatggacgacctcgaagtcatcttcaaggccatgcctgaaacccgccagaccgtactgttctcggccacgctgccacagtcgatccgtgccatcgccgaacgccatctgcgcgatccgaagcacgtcaagatccagaccaagacccagaccgttaccgcgatcgagcaggctcacctgctggttcacgctgaccagaagacctcggccgtactgagcctgctggaagtcgaagacttcgacgccctgatcatgttcgtccgcaccaagcaggcgaccctggatctggccagtgctcttgaagccaaaggctacaaggctgccgcactgaacggcgacatcgcccagaaccagcgcgagcgcgttatcgaatccctcaaggatggccgtctggacatcgttgtggcgaccgacgttgctgcccgtggtcttgacgttccgcgtatcacccacgtcttcaacgtggacatgccttacgatccggagtcctacgttcaccgtatcggccgtaccggtcgtgccggtcgcgaaggtcgcgcactgctgctggtgacgcctcgtgagcgccgcatgctgcaagtgatcgagcgtgttaccggtcagaaggttgcggaagtccgcctgccggatgcccaggccgttctggatgcgcgcatcaagaaactgaccaacagcctgtcgccgctggtcgctgatgccgaatcgactcacggtgatctgctcgatcgtctgactgccgacatcggctgcagccctcgcgcgcttgccgctgcactgctgcgcaaggctaccaacggtcaggcactgaccctggcagccatcgagcgcgagcgtccactggttccgaacaacgccccgcgcggtgatcgtccagagcgcagcagcgaccgtggtgatcgtcctgagcgtgagcgtcgtgcgccggttccattggccgaaggccgtgctcgttgccgtaccgcgctgggtgcgcgtgatggtatcgctgccaagaacctgctgggtgccattctcaacgaaggcggcctggcccgcgaagcgatcggccgtatccaggtccgtgacagcttcagcctggtcgaactgccggaagatggtcttgagcgtctgctgaccaagctcaaggacacccgtgttgctggcaagcagctcaagctgcgtcgctatcgcgaagactga

SEQ ID NO: 38882 - protein, 557 aa, Pseudomonas syringae pv. syringae B728a
MTQEIGGFAALELHPNIVAAVVATGYEEPSAIQQQSIPIILAGHDMIGQAQTGTGKTAAFALPILHRIDPSKREPQALILAPTRELALQVATAFETYAKQMPGVTVVAVYGGAPMGPQLKAIRNGAQIVVATPGRLCDHLRRDEKVLATVNHLVLDEADEMLKLGFMDDLEVIFKAMPETRQTVLFSATLPQSIRAIAERHLRDPKHVKIQTKTQTVTAIEQAHLLVHADQKTSAVLSLLEVEDFDALIMFVRTKQATLDLASALEAKGYKAAALNGDIAQNQRERVIESLKDGRLDIVVATDVAARGLDVPRITHVFNVDMPYDPESYVHRIGRTGRAGREGRALLLVTPRERRMLQVIERVTGQKVAEVRLPDAQAVLDARIKKLTNSLSPLVADAESTHGDLLDRLTADIGCSPRALAAALLRKATNGQALTLAAIERERPLVPNNAPRGDRPERSSDRGDRPERERRAPVPLAEGRARCRTALGARDGIAAKNLLGAILNEGGLAREAIGRIQVRDSFSLVELPEDGLERLLTKLKDTRVAGKQLKLRRYRED

SEQ ID NO: 38883 - DNA, 1860 bp, Actinobacillus pleuropneumoniae serovar 1 str. 4074
  CDS (1)..(1860)
atgacaactaattctttaactttcgcagaccttggtcttcctcaatctattcttgatgctgtaaacgacatggggtttgtgacgccttctcctattcaacaagaaacgattcctcatttattagccggccgtgacgtactcggtatggcacaaaccggtagcggtaaaacggcggcattctctttacctttattagcgcaaatcgatccgactaaacgtcatccgcaaatgttggtgatggcgccgacccgtgaactcgcgattcaagtcgcggatgcttgcgaacaatttactaaaaatatgaaaggcgttaatgtggttaccgtttacggcggtcagcgttacgacattcaattacgtgctttaaaacaaggctcgcaagtggtggtcggtacgccggggcgtattcttgaccatattcgtcgcggtacgttagacctctctgcgctacaatccatcgtattggatgaagcggacgaaatgcttcgtatgggctttattgacgacgttgaaaccgtgatggcggaattaccggaaaatcaccaaacggcgttattctccgcaacgatgccggagccgattcgtcgtattactcgtcgctttatgcaagatccgcaagaagtcaaaattcaagcgacgcaacgttccgcaccggatattacccaaagttattggttagtaaacggcttccgtaaaaacgatgcgttattgcgtttcttagaagtcgaagaatttgatgcggcaatcatctttactcgtaccaaaaccggcacgattgatattaccgaattatgtgagcgtaacggctatcgcacggcggcgttaaacggcgatatgacccaacaagcgcgtgaacaaacgttagataaattaaaatcgggtcgtttagatattttagtggcgaccgacgttgccgctcgcggcatcgatatcgaacgcatcagccttgtagtaaactttgatattccgttagatgcggaatcttatgttcaccgtatcggtcgtaccggtcgtgcaggacgttcggggcgtgccttattattcgtcgaaccgcgtgaacgccgtttactgcgtaacatcgaacacttaatgaaaaaaccgatcgatgaagtggcgattcctaatcacgaaattctaatggcaaaacgtcgcgagaaattcaaagcgcgtgtttctaaacaattagagcatcacgatttagaaaaataccgcgagttgcttgaagatttattcactgccgaccaagatcacgaagaattagcggcggcaatgatgatgatgcttcaagagaaacaaaaactcattcttccgccggatccggaaattcgtgcggcacgcggcgaacgcggtcgcagagatcgtgatgatcgtcgcggcggacgcgatgaacgccgaggcggccgtgaacaccgtgagaataacggtgtagcaatggatttatatcgtatcgaattaggccgtgaagacggtgtggaagtgcgtcatatcgttggcgctatcgctaacgaaggcgatattagcagccgctatatcggtcatatcaaattacacgatacttattctacgattgaattaccgcagggtatgccgaatcatatcgtgcaacactttgcacaaaaagcgcgcgtactaaacaaacaaatgcaaatgtctttattaggccctgccggtggtgtaaacagccaaccgtttgaagaacgtcgcggcggcggtcgtcgtaacgatagaaacgaccgcaatgatcgtcgtagtgatcgcggcggacgttctgaccgtcgtgaaggcggctttaacgaccgtaaaaaaggcggttttaaagaaaaacgttttaatgacaaaggtcgtggtcgtcgcgactaa

SEQ ID NO: 38884 - protein, 619 aa, Actinobacillus pleuropneumoniae serovar 1 str. 4074
MTTNSLTFADLGLPQSILDAVNDMGFVTPSPIQQETIPHLLAGRDVLGMAQTGSGKTAAFSLPLLAQIDPTKRHPQMLVMAPTRELAIQVADACEQFTKNMKGVNVVTVYGGQRYDIQLRALKQGSQVVVGTPGRILDHIRRGTLDLSALQSIVLDEADEMLRMGFIDDVETVMAELPENHQTALFSATMPEPIRRITRRFMQDPQEVKIQATQRSAPDITQSYWLVNGFRKNDALLRFLEVEEFDAAIIFTRTKTGTIDITELCERNGYRTAALNGDMTQQAREQTLDKLKSGRLDILVATDVAARGIDIERISLVVNFDIPLDAESYVHRIGRTGRAGRSGRALLFVEPRERRLLRNIEHLMKKPIDEVAIPNHEILMAKRREKFKARVSKQLEHHDLEKYRELLEDLFTADQDHEELAAAMMMMLQEKQKLILPPDPEIRAARGERGRRDRDDRRGGRDERRGGREHRENNGVAMDLYRIELGREDGVEVRHIVGAIANEGDISSRYIGHIKLHDTYSTIELPQGMPNHIVQHFAQKARVLNKQMQMSLLGPAGGVNSQPFEERRGGGRRNDRNDRNDRRSDRGGRSDRREGGFNDRKKGGFKEKRFNDKGRGRRD

SEQ ID NO: 38885 - DNA, 1671 bp, Pseudomonas aeruginosa UCBPP-PA14
  CDS (1)..(1671)
atgactcaggaaaccgtcggcttcgccgcgctcggtattcaccccaatgtgctcgcggcaatcgtcgccgtaggctacgaagagccttcgcctatccaggctcaatcgattccgctgatcctcgaaggccacgacatgatcggccaggcgcagaccggtaccggcaagaccgccgcgttcgccctgccgctgctgtcgcgcatcgacccgagccgtcgcgagccgcagatgctggtgctggtgccgacccgcgagctggccctgcaggtcgccaccgcctgcgaaacctattccaagcaattgccgggcgtcggcgtggtcgccgtctacggcggcgcgcccatggggccgcaactgaaggccctgcgccagggcgcacagatcctcgtcgctacccccggccgcctgtgcgaccacctgcgccgcgacgagaagctgctggccaccgtccagcgcctggtgctcgacgaagccgacgagatgctcaagctcggcttcatggacgacctggaagtgatcttcgaggcgcttcccgaatcgcgccagaccgtgctcttctcggcgaccctgccggcgtccatccgtggcatcgccgagcgccacctgaagcagcccaagcacgtcaagatcgccgccaagacccagaccgtggcgcgcatcgagcaggtccacctgatggtccatgccgaccagaaggccggttcgatccagcgcctgctggaagtcgagcagttcgacgcgctgatcgccttcgtccgcaccaagcaggccaccctcgactacgccgaattgctcgagcgccagggctaccgcgccgccgcgctcaacggcgacatgccgcaggcccagcgcgagcgggtcatcgagtcgctgaaggacggttcgctggacatcgtcatcgccaccgacgttgctgcccggggcctggacgtaccgcgcatcacccacgtgctgaacatcgatatgccctacgaccccgagtcctacgtgcaccgcatcggccgtaccggccgtgccggtcgggaagggcgcgcgctgttgctggtgactccgcgcgagcggcgcatgctgcaggtgatcgagcgggtcaccgggcagaaggtcggcgaagtccgcctgccggatgccgagaccgtactggaggcccgcctggcgcgcctggccgcgagcctgacgcccttgctcgacagcgccgtcgagcagcgcggcgcggtgcgcgacgagctgtgccgtcgcctcggctgcgatgccgagaccctggccgccgcactgctggcgcgcctgaccgccggcaaggcgctggacctggagtcggtgcgccgcgaacagccgctgaccccatcggcaccgcgcgagcgtgccgaccgtggcgaacgcggcgagcgtccggagcgcagcggcgagcgtcgtccgatggcgccgccgagcgaaggccgtgcccgctgccgcaccgccctcggcgcgcgcgacggggtcgcggcgaagaacctgctgggcgcgatcctcaacgagggcggcctgtcccgcgaggacatcggccgcatccagattcgcgataccttcagcctgatcgaactacccgaggccaacctcgagcgcctgctgaccaagctcaaggacacccgcgtcgccggcaaggccctgcgcctgcgccgctatcgcgaggactga

SEQ ID NO: 38886 - protein, 556 aa, Pseudomonas aeruginosa UCBPP-PA14
MTQETVGFAALGIHPNVLAAIVAVGYEEPSPIQAQSIPLILEGHDMIGQAQTGTGKTAAFALPLLSRIDPSRREPQMLVLVPTRELALQVATACETYSKQLPGVGVVAVYGGAPMGPQLKALRQGAQILVATPGRLCDHLRRDEKLLATVQRLVLDEADEMLKLGFMDDLEVIFEALPESRQTVLFSATLPASIRGIAERHLKQPKHVKIAAKTQTVARIEQVHLMVHADQKAGSIQRLLEVEQFDALIAFVRTKQATLDYAELLERQGYRAAALNGDMPQAQRERVIESLKDGSLDIVIATDVAARGLDVPRITHVLNIDMPYDPESYVHRIGRTGRAGREGRALLLVTPRERRMLQVIERVTGQKVGEVRLPDAETVLEARLARLAASLTPLLDSAVEQRGAVRDELCRRLGCDAETLAAALLARLTAGKALDLESVRREQPLTPSAPRERADRGERGERPERSGERRPMAPPSEGRARCRTALGARDGVAAKNLLGAILNEGGLSREDIGRIQIRDTFSLIELPEANLERLLTKLKDTRVAGKALRLRRYRED

SEQ ID NO: 38887 - DNA, 1377 bp, Pseudomonas aeruginosa UCBPP-PA14
  CDS (1)..(1377)
atgacctccaccgctttctcctcgctgccgctttccgcggacctcctggccaatctcgactccctcggttaccgggagatgacgccgatccaggcgcagagcctgccgctgatcctccagggccacgacctgatcgcccaggccaagaccggcagcggcaagaccgcggctttcggcctcgccctgctcagcccgctgaacccgcgctacttcggctgccaggcgctggtgctgtgcccgacccgcgaactggccgaccaggtcgccaaggagatccgccggctggcccgcgccgccgacaacatcaaggtcctgaccctctgcggcggcgtcccctacggcccgcaggtggcttcgctggagcacggcgcgcacgtggtggtcggcaccccggggcgcatccaggagcacctgcgcaagggcaccctggtcctcgacgggctcaataccctggtcctcgacgaagccgaccggatgctcgacatgggcttctacgacagcatcgccgagatcatcggccagctccccgagcgccggcagaccctgctgttctccgccacctacccggacggcatcgagaagctggcgaagaccttcatgcgcgatccgcgacaggtgaaggtcgagtcgctgcacgccgacagccagatcgagcagcgcttcttcgagatcgatccgaagcagcgcatggacgccgtggtacgcctgctccagcatttccggccgcagtcctgcgtggccttctgccagacccgccagcagtgccaggagctggccgacgcactgaaggcgcagcggatttccgccctggccctgcacggcgacctggagcagcgcgagcgcgaccaggtcctgacggtgttcgccaaccgcagttgcaacgtactggtggccaccgacgtggccgcccgcgggctggacatcgccgccctggaaacggtgatcaacgtcgagctggcgcgcgacccggaggtccacatccatcgcatcggacgcagcggtcgcgccggcgagaaaggcctggccctgtcgctggtggcgccggccgaggccagccgtgcgcaggccatcgaggacctgcagaagcagccgctggcctggtacgccctcggccagttgaaggccagcccggagccattgctgccgccgatgagcaccctgtgcatcgccggcggacgcaaggacaaggtgcgccccggcgacctgctcggtgccctcaccggcgacgccgggctgcccggcagcgcggtgggcaagatcgccatcttcgacttccaggccttcgtcgccatcgagcgcggcctcgcccaccaggccctcaagcgcctgagcgaaggcaagatcaaggggcgctcgttcaaggtccgcctgctgtag

SEQ ID NO: 38888 - protein, 458 aa, Pseudomonas aeruginosa UCBPP-PA14
MTSTAFSSLPLSADLLANLDSLGYREMTPIQAQSLPLILQGHDLIAQAKTGSGKTAAFGLALLSPLNPRYFGCQALVLCPTRELADQVAKEIRRLARAADNIKVLTLCGGVPYGPQVASLEHGAHVVVGTPGRIQEHLRKGTLVLDGLNTLVLDEADRMLDMGFYDSIAEIIGQLPERRQTLLFSATYPDGIEKLAKTFMRDPRQVKVESLHADSQIEQRFFEIDPKQRMDAVVRLLQHFRPQSCVAFCQTRQQCQELADALKAQRISALALHGDLEQRERDQVLTVFANRSCNVLVATDVAARGLDIAALETVINVELARDPEVHIHRIGRSGRAGEKGLALSLVAPAEASRAQAIEDLQKQPLAWYALGQLKASPEPLLPPMSTLCIAGGRKDKVRPGDLLGALTGDAGLPGSAVGKIAIFDFQAFVAIERGLAHQALKRLSEGKIKGRSFKVRLL

SEQ ID NO: 38889 - DNA, 1587 bp, Fusobacterium nucleatum subsp. vincentii ATCC 49256
  CDS (1)..(1587)
atggaacaattagaaaaattaaaagaatttagagaattagggcttagtgaaaaggtattaaaagtattatcaaaaaaaggatatgaatctcctactcctatacaaagattaacaatacctgcacttttaaaaaatgataaagacataataggacaagcacaaactggaacaggtaagactgctgctttttctttaccaataatagagaactttgaaaacttagaacatatacaagcaatcgttttaacaccaacgagagaattagctttacaagttgccgaagaaatgaatagtttaagtacaagtaaaaagatgaaagtaattcctgtctatggtggacaatcaatagacatacaaagaaaacttatcaaaactggtgtagatgtggttgtgggtacacctggtagagttatagatttaattgaaagaaaattattgaaattaaattcattaaaatatttcattttagatgaagcagatgaaatgcttaatatgggttttgttgaagatatagaaaaaatattaacttttacaaatgaagataaaaggatgttatttttctctgcaactatgcctgatgaaattatgaaagtcgctaaaaatcatatgaaagaatatgaagttttagctgttaaaagtagagaacttacaacagatttaactgaacaaatatattttgaagtaaatgaaagagataagtttgaagcactatgtagaattatagatttaacaaaagaattttatggaattattttttgtagaacaaagactgatgtaaatgaaattgttggaagattaaatgacagaggttatgatgctgaaggtctacatggagatataggtcaaaattatagagaagttactttaaaaagatttaaaactaagaaaataaatattcttgttgcaacagatgtggctgcaagaggtatagatatcaacgatttaagccatgttataaactatgctattccacaagaagttgaaagttatgtacatagaataggtagaacagggcgtgctggtaaagaaggtactgctataacttttataaccccacaagagtatagaagacttttacaaattcaaaaagcagttaaaaaagaaattaaaaaagaaaaattacctgatgttaaagatgttattcaagctaaaaaatttaggataatagatgatattggacaaattttaatagacaatgactatgataaatttaaaaaattagccaaagatttacttaaaatggaagatgcagaaaatattgttgcctctcttttaaaattatcatatagtgatgttttagatgaaagtaactacaatgaaatctctcctgttaaaatggaagatactggtaaaacaaggctatttattgctatgggtagaaaagatggcatgacacctaaaaaattagttgaatttattgtcaaaaaagcaaaagtaaaacaaagctatattaaaaatgcagaagtctatgaaggtttctcttttgtttctgtaccttttaaagaagctgaaataatagttgaagcttttgctaaaaatagaaaaggaaagaagccattaatagaaaaagcaaagtctaagaagtaa

SEQ ID NO: 38890 - protein, 528 aa, Fusobacterium nucleatum subsp. vincentii ATCC 49256
MEQLEKLKEFRELGLSEKVLKVLSKKGYESPTPIQRLTIPALLKNDKDIIGQAQTGTGKTAAFSLPIIENFENLEHIQAIVLTPTRELALQVAEEMNSLSTSKKMKVIPVYGGQSIDIQRKLIKTGVDVVVGTPGRVIDLIERKLLKLNSLKYFILDEADEMLNMGFVEDIEKILTFTNEDKRMLFFSATMPDEIMKVAKNHMKEYEVLAVKSRELTTDLTEQIYFEVNERDKFEALCRIIDLTKEFYGIIFCRTKTDVNEIVGRLNDRGYDAEGLHGDIGQNYREVTLKRFKTKKINILVATDVAARGIDINDLSHVINYAIPQEVESYVHRIGRTGRAGKEGTAITFITPQEYRRLLQIQKAVKKEIKKEKLPDVKDVIQAKKFRIIDDIGQILIDNDYDKFKKLAKDLLKMEDAENIVASLLKLSYSDVLDESNYNEISPVKMEDTGKTRLFIAMGRKDGMTPKKLVEFIVKKAKVKQSYIKNAEVYEGFSFVSVPFKEAEIIVEAFAKNRKGKKPLIEKAKSKK

SEQ ID NO: 38891 - DNA, 1704 bp, Psychrobacter sp. 273-4
  CDS (1)..(1704)
atgactgacatcttatctgcaatcgctgctgaaaacggcattatcgaaagcactgacaccccaaacactactgcaaataccgatactaataatgaagcggctacgactgacgctactgacgaaaataaagttacctttactgacctaaatattgccaagccaattcttagcgcgcttgagcgtagtggttatactcacccaacacctattcaagcagaagccattccttttgcattacaaggtcgtgaccttttgttatctgcgcaaacgggtagtggtaaaacagctgcattcgttatcccagtacttgatcgcttgagccgtgcaaccagcttcgacaaattgaccaaagctcttattctaacgccaacgcgtgaacttgctcagcaagtacatgatagcgtacgtacgtattctaaagatatgcgtggtctattctgcgtgcctttagttggcggcgcaccatacaacggtcagattactgctttgaaaaaaggcgtacaagttatcgttgcaaccccaggtcgtttacttgaccatatcaatgcgggtcgcgttgacttatcaagccttgaaatcttggtacttgatgaagctgaccgtatgctagatatgggttttgctgacgatatcagcgacatactacgtgcagcaccgattgatcgtcaaacgattatgtgttcagcaacttgggacggtcctgtcggcaaaatcgctgccagcttcaccaaaaaccctgagcgtgtatcaatcaaagttgaatctgcgcacatcgaagaaaaagtgtattactgtgatgattttgatcacaaaaaccgtttgcttgacaaaatcgtttgccacaaagatatggaacaaatcattatctttgctgccactaaacgtagtactgaaaaattagcaaaacagctacaagaagccggtcataaagcaagcttcctacatggcgatttgccacaaagcaagcgtaaccgcattgttcaagacctacgtaatggtaaatgcaaaatcttagttgcgaccgacgtagcggctcgtggtctagacgttccagcactatcgcacgtcattaactatgacttaccgcgtcaaacggaagattacgtccatcgtatcggtcgttgtggtcgtgcaggccgtactggtgttgctataagcttatgtagcatggatgaccgtccacagcttaacgctattaaccgttatttagatcgtaaaatggaagcctctgttatcgaaggcatggagcctaagaaaacttacgttcctagcgaaaacaaaggcaatggtcgtggtcgtggccgtggtcgttcaaacggcggtggtaatggtaatggtcaaggtcgtggtcgttcagcgggtggttatgctggttctggcgctagtaaacctagtggtcaaggccgtggtcgcccatcaggtgatagcagcaacgctactggtcaacgcgcaagcaatgacagcggttatcaaggtaagccacgtgattcatctggcaagccaaatgagcgttcaggtggcaagccttaccaaggtaagcgtactggtgctcctagccgcggcgatagcactggcgttccacgtggtgagcgtgctgcaacgggtcgtggtcgtccaagtggtagccaaggtcgcccagcagctcgttcagacagccgtggtcaaggtcgtccaactggcggcaaccgtggtaacaactcgtaa

SEQ ID NO: 38892 - protein, 567 aa, Psychrobacter sp. 273-4
MTDILSAIAAENGIIESTDTPNTTANTDTNNEAATTDATDENKVTFTDLNIAKPILSALERSGYTHPTPIQAEAIPFALQGRDLLLSAQTGSGKTAAFVIPVLDRLSRATSFDKLTKALILTPTRELAQQVHDSVRTYSKDMRGLFCVPLVGGAPYNGQITALKKGVQVIVATPGRLLDHINAGRVDLSSLEILVLDEADRMLDMGFADDISDILRAAPIDRQTIMCSATWDGPVGKIAASFTKNPERVSIKVESAHIEEKVYYCDDFDHKNRLLDKIVCHKDMEQIIIFAATKRSTEKLAKQLQEAGHKASFLHGDLPQSKRNRIVQDLRNGKCKILVATDVAARGLDVPALSHVINYDLPRQTEDYVHRIGRCGRAGRTGVAISLCSMDDRPQLNAINRYLDRKMEASVIEGMEPKKTYVPSENKGNGRGRGRGRSNGGGNGNGQGRGRSAGGYAGSGASKPSGQGRGRPSGDSSNATGQRASNDSGYQGKPRDSSGKPNERSGGKPYQGKRTGAPSRGDSTGVPRGERAATGRGRPSGSQGRPAARSDSRGQGRPTGGNRGNNS

SEQ ID NO: 38893 - DNA, 1569 bp, Methanococcoides burtonii DSM 6242
  CDS (1)..(1569)
atggaatcattcaaaaaattaggtatcgaggatgcgatcttaagatcgatagaggacaagaaatttgaagagcctactgaaattcagaaaatggctattcctctaatccttgaaggaaaagacataataggtggagccgctaccggatcaggtaagacgctcgcatttggatgcggaatcatccagaagatagaaaaaggaaatggaattagagcactggtccttacaccaacaagagagttggctgagcaggttcagaactcattaaaggaattttccagacataaacaattgagagtagcaccaatatacggcggtgtagctatcaacccacagattcgccaactggaaagagcagatgttgttgttgcaaccccaggaagattattagaccatattgaaagaggaacaatcgacctcggagatgttgagattctggtccttgatgaagcggacagaatgcttgacatgggattcattgatgatgttgaagagatcatcgacgaatgtccttctgacagacagacaatgatgttctcagcaactgtttccaaagacatccagtacctctcaagcaaatacatgaataatccttcaaaggtatttgcgaaggcatatgttgattcagataaactaaagcaggtatatattgacgtccctaagaagatgaagttctcacttcttgtacatctcctgaagagtgaaaaatcaggacttgttatggtattctgtaatacgagaagcaatgttgatttcgtacaaaagaacctgagaaagaacgacattgatgcaatagctattcatggcggacatacgcaggcaaagagaaagagcacactgagcaaattccattccagcaatgcacatgcacttgtgtgcaccgatgtagctgccagaggactggatattcctcatgtgtcacatgtttacaatttcgacatccctgatgaccccagtgaatatgttcacaggataggaagaacagcaagagctggaagagaaggaaaggtcatcaatgtggtcgcagatgtggataagggcggctttaccaggctctctaaaatgcaccgcaatttcaagatcgagcgggaagacttaccggaattcgaaagggtgctcatcaaaagtgaagacagtggcggaagacctacccgtggcagaagagaagaccgcaagggtggcagaagagaagaccgcaaaagtgcctatggcggaagaagcagtggtggcagcagcggcggaagaagcagcgaccgtagcagtggtggaagcagcggcggaagaagcagcgaccgtagcagtggtggaagcagcggcggaagaagcagcgaccgtagcagtggtggaagcagcggcggaagaagcagcgaccgtagcagtggtggaagcagcggcggaagaagcagcgaccgtagcagtggtggaagcagcggcggaagaagcagcgaccgtagcagtggtggaagcagcggcggaagaagcagcgaccgtagcagtggcggcagcagcggcgacaaagcacgcaccggttttaagaaaaggacaggtgttcaaaggaagagagaataa

SEQ ID NO: 38894 - protein, 522 aa, Methanococcoides burtonii DSM 6242
MESFKKLGIEDAILRSIEDKKFEEPTEIQKMAIPLILEGKDIIGGAATGSGKTLAFGCGIIQKIEKGNGIRALVLTPTRELAEQVQNSLKEFSRHKQLRVAPIYGGVAINPQIRQLERADVVVATPGRLLDHIERGTIDLGDVEILVLDEADRMLDMGFIDDVEEIIDECPSDRQTMMFSATVSKDIQYLSSKYMNNPSKVFAKAYVDSDKLKQVYIDVPKKMKFSLLVHLLKSEKSGLVMVFCNTRSNVDFVQKNLRKNDIDAIAIHGGHTQAKRKSTLSKFHSSNAHALVCTDVAARGLDIPHVSHVYNFDIPDDPSEYVHRIGRTARAGREGKVINVVADVDKGGFTRLSKMHRNFKIEREDLPEFERVLIKSEDSGGRPTRGRREDRKGGRREDRKSAYGGRSSGGSSGGRSSDRSSGGSSGGRSSDRSSGGSSGGRSSDRSSGGSSGGRSSDRSSGGSSGGRSSDRSSGGSSGGRSSDRSSGGSSGGRSSDRSSGGSSGDKARTGFKKRTGVQRKRE

SEQ ID NO: 38895 - DNA, 1821 bp, Dechloromonas aromatica RCB
  CDS (1)..(1821)
atgtcgacacctgtcgaaagctttgccgatctcggtttaagcgaaacgcttctgcaaactctcacccaaatcggctacgaaaccccgtcgcccattcaggctcaatgtatccctgttctgctcgaaggtcatgacctgatcggcatggcccagaccggcaccggcaagaccgccgcctttgcgctgccgctgatggaacagatcgacgtcaagctgaccaagccgcaggcgctgatcctgacgccgacgcgcgaactggccatccaggtcgccgaagccctgcagacctacgccaagaacctgcccggcttccacgtgctgccgatctacggtggccagagctacaccatccagctcaagcagttgtcgcgcggcgctcacgtcatcgtcggcaccccgggtcgcgtcatggaccacctcgagcgcaagacgctcaacctcgaccacctgaagaccatggtgctcgacgaagccgacgaaatgctgcgcatgggcttcattgacgacgtcgagtggattctcgaacgtacgccagcccagcaccagaccgcgctgttctcggccaccatgccggaacagattcgccgcgtcgcccagaaatatctggtcgagccgcgcgaaatcaagatcaagtcagctaccgctaccgtcgctgccatccgtcaggtttactggcaggtttccggcatgcacaagctggatgccctgacccgcatcctcgaagttgaagaagacttcgacgcggccatcatcttcgtgcgcaccaagacggccaccgtcgagctggccgacaagctgtcagcccgtggttacgccgccgccgcgctgaacggcgacctcaaccagcagatgcgcgaacgcgtcatcgagcagttgaagtcgggcgccctggacatcgtcattgcgaccgacgttgccgcccgcggtatcgacgtaccgcgcgtcagccacgtcgttaactacgatattccatacgacaccgaagcctacgtgcaccggatcggccgtaccggccgcgctggccgcaccggcaacgccatcctgttcgtcgcgccgcgcgaaatccgcatgctgcgtacaatcgagcgcgccacccgttcgccgatcgccccgctgaccctgccgagccgcgccgatgtgaccaacaagcgcgttgccgacttcaagagcaaggttgttgaagtgctcaacgccgaaggcctggatttcttctcgaacatcgtctcgcaaattgccgaagagcaaaatgtcggcgccgaggaagtggctgctgcgctggccatgatggctcaagaaggcaagccgctgcagatcgccggtgaagatccgcgtccggcaccggcgccccgcccgggcagctttggcgaaagcgatcgcaagccgcgttttgaagatcgtggcgatcgtccacgcttcgaagatcgcggggaacggccgcgtcgcgaagaccgcccggctcgccaggctccggccggcgacatggtgcgctaccgcattgacgtgggtcgtgaccacggcgtcgaagtacgcgacatcgtcggcgccatcgccaacgaagccggcatcgaaagccgtttcatcggccgcatcggtctctacgaagactccagtaccgttgaactgcctgcaggcatgccggccgaagcctccaacgccctgaagcgcacccgcattcgcggcgtgccgatcaacctgcgtccggatgaaggtcgtccgggtgccggcggcgcgggtggcggcgaacgcaagttcggcggcggtgatcgcaagcctgaaggtgatcgcggcggcttcaagaagaagaagttcggcgaccgctaa

SEQ ID NO: 38896 - protein, 606 aa, Dechloromonas aromatica RCB
MSTPVESFADLGLSETLLQTLTQIGYETPSPIQAQCIPVLLEGHDLIGMAQTGTGKTAAFALPLMEQIDVKLTKPQALILTPTRELAIQVAEALQTYAKNLPGFHVLPIYGGQSYTIQLKQLSRGAHVIVGTPGRVMDHLERKTLNLDHLKTMVLDEADEMLRMGFIDDVEWILERTPAQHQTALFSATMPEQIRRVAQKYLVEPREIKIKSATATVAAIRQVYWQVSGMHKLDALTRILEVEEDFDAAIIFVRTKTATVELADKLSARGYAAAALNGDLNQQMRERVIEQLKSGALDIVIATDVAARGIDVPRVSHVVNYDIPYDTEAYVHRIGRTGRAGRTGNAILFVAPREIRMLRTIERATRSPIAPLTLPSRADVTNKRVADFKSKVVEVLNAEGLDFFSNIVSQIAEEQNVGAEEVAAALAMMAQEGKPLQIAGEDPRPAPAPRPGSFGESDRKPRFEDRGDRPRFEDRGERPRREDRPARQAPAGDMVRYRIDVGRDHGVEVRDIVGAIANEAGIESRFIGRIGLYEDSSTVELPAGMPAEASNALKRTRIRGVPINLRPDEGRPGAGGAGGGERKFGGGDRKPEGDRGGFKKKKFGDR

SEQ ID NO: 38897 - DNA, 1524 bp, Dechloromonas aromatica RCB
  CDS (1)..(1524)
atgtctgaaatcaataccttagctggcgagaacgccatcatcatcgctgccgacgcagtgcctgaaatcacctttgccgacctcggcctggcgcctgaactcctgcgcgccgtgctcgacgagggctatacgaagccgacgccgattcaggcccaggccatccccctcgtcatttccggcaaggacatcatgggcggcgcccagaccggcaccggcaagacagcggccttcacgttgcccatcctgcagcgcatcctgccctttgccagcagcagcccgtcgccggccaagcatccagtgcgagccctgatcctggcgccgacccgcgaactggccatgcaggtcttcgagtcggtcaagacctacagcaagcacacgccgatccgtgcgatgtgcgcctatggcggcgtcgatatccggccacagatcgccgaactgaaaaagggcgtcgaaattctcgtcgccacccccggccgcctgcttgatcacgtcgaaaacaagagcgtcagcttcaattccgttcaggccctggtcctcgacgaagccgaccgcatgctcgacatgggcttcgtcccggacgtcacgcgcatcctcaacatgctgccggcccagcgccagagcctgctgttctctgccaccttctcggaagaaatcaagaagctggccgacaccatgctgaagtcgccgatcctgatcgaggtcgctcggcgcaatcaggtctccgacaccatcacccaccgcgtccatccggtctccgaatacggcaagcgcggcctgctgaccaagctgctgaagtctggcgaaatccgccagtgcatcgtcttctgtcgcaccaagcagggctgctcgcgcctgacccgcgaactgcaacgcgccggcatcaaggccgatgccatccacggtgacaagagccagcttgaacgcatcaaggcgctcgaagccttcaagggcggcgaaaccgatgccctgatcgccaccgatgtcgcggcccgtggcctggacgttgacgacctgccctacgtcatcaattacgaactgccgcacaccccggaagactacgtgcaccgcatcggccgcactggccgcgccggcaagaagggcaatgccatttcgctggtcagcgcgcacgaggtctgctacctggtcgatattgaaaaactgatcaagcgcccgatcgaacaggttgaagttgccggtttcgaaccggagccggaatacgaataccctccgggcaacaagcgcaagcgttcggcggcaccgccggcaaaggcccccgttgcccaccgcccagaacgtccggaacgctccgagcgctccgaacggccggatcggggtgatcgtgaccgccgcccgccgcgccgtaatccgatgattgccgccgatggtttcgacttcagcaagccctacgaagacaactcgccacgcggtgaagtgcctgactcaccgcaagccccctcgaaggtcgatccgcacaagccgaagcgggtcgttgccgcgctgcttggcgggcttgggcgcaagtaa

SEQ ID NO: 38898 - protein, 507 aa, Dechloromonas aromatica RCB
MSEINTLAGENAIIIAADAVPEITFADLGLAPELLRAVLDEGYTKPTPIQAQAIPLVISGKDIMGGAQTGTGKTAAFTLPILQRILPFASSSPSPAKHPVRALILAPTRELAMQVFESVKTYSKHTPIRAMCAYGGVDIRPQIAELKKGVEILVATPGRLLDHVENKSVSFNSVQALVLDEADRMLDMGFVPDVTRILNMLPAQRQSLLFSATFSEEIKKLADTMLKSPILIEVARRNQVSDTITHRVHPVSEYGKRGLLTKLLKSGEIRQCIVFCRTKQGCSRLTRELQRAGIKADAIHGDKSQLERIKALEAFKGGETDALIATDVAARGLDVDDLPYVINYELPHTPEDYVHRIGRTGRAGKKGNAISLVSAHEVCYLVDIEKLIKRPIEQVEVAGFEPEPEYEYPPGNKRKRSAAPPAKAPVAHRPERPERSERSERPDRGDRDRRPPRRNPMIAADGFDFSKPYEDNSPRGEVPDSPQAPSKVDPHKPKRVVAALLGGLGRK

SEQ ID NO: 38899 - DNA, 1401 bp, Dechloromonas aromatica RCB
  CDS (1)..(1401)
atgagcgaagacaccaccgcaggccaaagttttgacacgctaccgctgtcgccggccatgctggccaatctggcgcagcttgaatacttgagcatgacgcctatccaggcggccagcctgcccctggcgctggccggcaatgatctgatcgcccaagccaagactggtagcggcaagaccgccgcctttggtcttgccttgctcaatcgcctgaacaccagtcgtttcgccgtgcaggccatggtgctgtgcccgacccgtgaactggccgatcaggtgacgcaggaaatccggcgtctggcccgttttgaagagaacatcaaggtgttgtcgctggttggtggctcaacgctgcgcaatcaggcgaacagcctggaaaaaggcgtccacatagtcgttggcacgccaggtcgcatcatggaccacatggagcgcggctacctgaagctcgacgaattgaacacgctggtccttgacgaagccgaccgcatgctcgacatgggcttccatgatgacattgcttacgtcgccaagcggtgcccggcgcagcgccagacgctgttgttctcggcgacctatccggaaggcatcgccctgctggccaggcagtttttgcgtcagcccaaggaagtcaaactccttgagctgcatgaggaaaccaagattcgccagcgcttttacgaggtcaaggacgacgagcgcctcgatgccgtggtgcgcctgctcaagcattaccgtccggtcagcacgctggcgttctgcaataccaagcagcagtgtcgtgatctggtcaatgtcctgcgccacgccggcattcatgcgctgacgctgaatggcgatctggagcaacgcgagcgcgatcaggtgctgatccagttcgccaaccgcagttgctcggtgctggtggcgaccgacgttgcggcgcgcggcctggatatcgatcagcttgaagcggtgatcaatgttgatgtgacacccgatccggaaatccacatccaccgtatcggccggaccggccgtggtgatgaagagggctgggcgttgagtctgtgcagttccggcgaccgccgccgggtggcgacgatcgccgagatgatgaagtgcaagctcgacgtgcttgatctgaaaaccgtggaagtcaccgacgattcgccgctggtgccgccgatgtcgacattgctgatgctcggcgggcgcaaggacaagattcgtcccggcgacgtgatgggcgcgctggctggcgaggctggcctgacccgcgagcaggtcggcaagatcacggtaactgaccagagcacctatgtggccgtagcgcgtgctgtggccaaggagacggtgcgcaagctgtcggccggcaaggtcaagggcaagacggtcaaggttcgcatcctgaccaattga

SEQ ID NO: 38900 - protein, 466 aa, Dechloromonas aromatica RCB
MSEDTTAGQSFDTLPLSPAMLANLAQLEYLSMTPIQAASLPLALAGNDLIAQAKTGSGKTAAFGLALLNRLNTSRFAVQAMVLCPTRELADQVTQEIRRLARFEENIKVLSLVGGSTLRNQANSLEKGVHIVVGTPGRIMDHMERGYLKLDELNTLVLDEADRMLDMGFHDDIAYVAKRCPAQRQTLLFSATYPEGIALLARQFLRQPKEVKLLELHEETKIRQRFYEVKDDERLDAVVRLLKHYRPVSTLAFCNTKQQCRDLVNVLRHAGIHALTLNGDLEQRERDQVLIQFANRSCSVLVATDVAARGLDIDQLEAVINVDVTPDPEIHIHRIGRTGRGDEEGWALSLCSSGDRRRVATIAEMMKCKLDVLDLKTVEVTDDSPLVPPMSTLLMLGGRKDKIRPGDVMGALAGEAGLTREQVGKITVTDQSTYVAVARAVAKETVRKLSAGKVKGKTVKVRILTN

SEQ ID NO: 38901 - DNA, 1233 bp, Rickettsia rickettsii
  CDS (1)..(1233)
atgaaaaattttaatttatctgaagaattaattattgctctcgagacaatgaatataactgagccgactgaaatacaaaagcaatcgattccggttgcaatggcgggatcggacatactcgcttctagccaaacaggttcaggcaaaactcttgcttatttattgccgttaattgattcatttattaaaaataaaactactgctttaattcttgttccgactagagaattagcaacgcaaatacacagtactttaaataaagtaactacatcctataaaattaatagtgcagttttgataggcggtgaaccgatgcctaaacaatttatgcaattaaaaaagaatccaaaagtgattatcggtacgccggggcgtattatcgatcacttaaataggggaagtctaaaaattgatcgtataggcataaccgtacttgacgaaatggatagaatgcttgatatggggatgaaagaacaattagaagaaatcaataaatttttaccggaaaaaagacaagttttaatgttttctgctactatgccaaaacatattattgctgtttctcaaaaatatctaaacaatccggtacgtattacggtaggtgctactaataaagcagctgcagaaataaaacaggaatcaatgcatgtttctgataaagaaaaatttagtgcattaactaaacaacttggtcatagggaaggatcggtcattatttttgtgaagactaaacgctctgccgatcaattagctaaaatgttaaaatatgaaaatcatacagcagaagctatacacggtgatttaagtcagcgtcaacgtgaaagagtaattttatcatttcgtaagtcaaaccatagaataatggtagcaactgatgtagcggctcgtgggcttgatattcctcatacacagcatgtgattaattatgatttacctatgtgtcctgaagattatttacataggataggtagaacgggtagagcaggggctactggacatgcgttgtcttttatttctcctgatgatgttattagatggcgtgcaatcgatcgtttagtaaataaaggagaatctacgccacgtagtgagtttagaagtgataaaaataatcgtaaaagatcattcggtaaaagagccggcggtgacggtaaaaagtttaatgcttttgatagtagccgtaaaagaacctttgatggtaacagctacggtaataaaagaaagaaagtatcgtaa

SEQ ID NO: 38902 - protein, 410 aa, Rickettsia rickettsii
MKNFNLSEELIIALETMNITEPTEIQKQSIPVAMAGSDILASSQTGSGKTLAYLLPLIDSFIKNKTTALILVPTRELATQIHSTLNKVTTSYKINSAVLIGGEPMPKQFMQLKKNPKVIIGTPGRIIDHLNRGSLKIDRIGITVLDEMDRMLDMGMKEQLEEINKFLPEKRQVLMFSATMPKHIIAVSQKYLNNPVRITVGATNKAAAEIKQESMHVSDKEKFSALTKQLGHREGSVIIFVKTKRSADQLAKMLKYENHTAEAIHGDLSQRQRERVILSFRKSNHRIMVATDVAARGLDIPHTQHVINYDLPMCPEDYLHRIGRTGRAGATGHALSFISPDDVIRWRAIDRLVNKGESTPRSEFRSDKNNRKRSFGKRAGGDGKKFNAFDSSRKRTFDGNSYGNKRKKVS

SEQ ID NO: 38903 - DNA, 1842 bp, Haemophilus influenzae R2846
  CDS (1)..(1842)
atgactgacaaaattacttttaatgacttaggcttacctgagttcatcttaaaagctgtttctgacttaggttttgaaacaccttctccaattcaacaatcttgtatcccgcatttgctcaatggcaatgatgtgctaggtatggcacaaacaggtagtggtaaaaccgctgcctttgcactgcctttactcgcgcaaattgatccaagtgaaaaacatccacaaatgttagtgatggcacccactcgcgaacttgctattcaagttgccgatgcgtgcgaacaatttgttaaatatgcacagggcactcgcattgttaccttatatggtggccaacgttatgacatccaacttcgtgcattaaaacaaggcgcacaagtgattgtgggtacaccaggtcgtattcttgatcatattcgtcgcggaacattaaatctttctgaacttcgttttatcgtattagatgaagccgatgaaatgctacgcatgggtttcattgatgatgtagaaaccgtcatggctgaattaccagaaaatcatcaaactgcgttattctctgcaacaatgcctgaaccgatccgtcgtattacgaaacgttttatgaatgatccacaagaagtgaagatcaaggttaataacgaaaatgccccagatattgagcaaagttgttggtatgtgcacggcgtgcgtaaaaatgaagcgcttcttcgtttcttagaagtggaagattttgatgctgcgattatttttgctcgcactaaaacaggtactttagatattacagaactacttgaaaaaaatggtttccgttctgccgcacttaatggtgatatgacacaacaattacgcgaacaaaccctcgatcgcttacgtaacggcagtttagatattgttgtggcaaccgatgtggccgcacgcggtattgatattgaacgtatcagccttgtggtgaactacgacattccgcttgatgcagaatcttatgtacaccgaattggccgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagagcaatatcgtagtttattagaagacttattcacagccgatcaggatcaagaaaatattgctgcagcaatgttgatgctgcttcaaggcaaacaaaaactcattcttccacctgatccaccaatggaaaaacgtcgtcgtgaacgtaatgatcgcggtgatcgccgtgaaaatccacgttcagctgaacgtcgtggcgaatgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgattacactaccgttgaattgccacaaggtatgccgaaagaattattgcaacaattcggaaaaacacgagtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgcggcaatgataatcgtggaaatcgtaaatttaatgaaaaaagtaaccgcacttttagcgataaaccacgccgtgatcgtagatcatcattctaa

SEQ ID NO: 38904 - protein, 613 aa, Haemophilus influenzae R2846
MTDKITFNDLGLPEFILKAVSDLGFETPSPIQQSCIPHLLNGNDVLGMAQTGSGKTAAFALPLLAQIDPSEKHPQMLVMAPTRELAIQVADACEQFVKYAQGTRIVTLYGGQRYDIQLRALKQGAQVIVGTPGRILDHIRRGTLNLSELRFIVLDEADEMLRMGFIDDVETVMAELPENHQTALFSATMPEPIRRITKRFMNDPQEVKIKVNNENAPDIEQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQENIAAAMLMLLQGKQKLILPPDPPMEKRRRERNDRGDRRENPRSAERRGECKGYGNPQPMDLYRIEVGRADGVEVRHIVGAIANEGDINSRYIGHIKLYDDYTTVELPQGMPKELLQQFGKTRVLNKQMQMSFLGAVKSDNSRGSDDFNGKRKGRGGDFRGERGRERGNDNRGNRKFNEKSNRTFSDKPRRDRRSSF

SEQ ID NO: 38905 - DNA, 1842 bp, Haemophilus influenzae R2866
  CDS (1)..(1842)
atgactgacaaaattacttttaatgacttaggcttacctgagttcatcttaaaagctgtttctgacttaggttttgaaacaccttctccaattcaacaatcttgtatccctcatttgctcagtggcaatgatgtgctaggtatggcacaaacgggtagtggtaaaactgctgcctttgcactgcctttactcgcgcaaattgatccaagtgaaaaacatccacaaatgttagtgatggcacctacacgcgaacttgctattcaagttgccgatgcgtgcgaactatttgttaaatatgcacagggcactcgcattgttaccttatatggtggccaacgttatgacatccaacttcgtgcattaaaacaaggtgcacaagtggttgtgggtacaccaggtcgtattcttgaccatattcgtcgcggaacattaaatctttctgaacttcgttttatcgtattagatgaagccgatgaaatgctacgcatgggttttattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgtactaaaactggcacgttagacattacagaactacttgaaaaaaatggtttccgttctgccgcacttaatggcgatatgacacaacaattacgcgaacaaaccctcgatcgcttacgtaacggcagtttagatattgttgtggcaacagatgtggctgcacgcggtattgatattgaacgtatcagccttgtggtgaactacgacattccgctggatgcagaatcttatgtacatcgaattggccgtactggtcgtgcaggtcgttctggtcgtgctttattattcgttgaacctcgtgagcgtcgtttacttcgtaatattgaacacctaatgaaaaaaggtatcaatgaagtagaattgccaaatcatcttgtgttacaagaatgccgccgcaaaaaattcgttgcaaaaattacgaaacaactcgagcatcacgatttagagcaatatcgtagtttattagaagacttattcacagccgatcaagatcaagaggatattgctgctgcaatgttgatgctgcttcaaggcaaacaaaaactcattcttcctcctgatccgccaatggagaaacgtcgtcgtgaacataatgaacgaggcgatcgccgtgaaaatccacgttcagctgaacgtcgtggcgaacgtaaaggctacggaaatccacgaccaatggatttatatcgtatcgaagtcggtcgtgcagatggtgtagaagttcgccatatcgttggtgcaattgctaacgaaggcgatattaacagccgttatattggtcatattaaactttatgatgattacactaccgttgaattgccacaaggtatgccgaaagaattattgcaacaattcggtaaaacacgcgtattgaataaacaaatgcaaatgtctttcttaggtgcagtaaaatctgataattcccgtggcggcgatgattttaacggtaaacgtaaaggtcgtggtggcgatttccgtggagaacgaggacgtgaacgcggcaatgataatcgtggaaatcgtaaatttaatgaaaaaagtaaccgcacttttagcgacaaaccacgccgtgatcgtagatcatcattctaa

SEQ ID NO: 38906 - protein, 613 aa, Haemophilus influenzae R2866
MTDKITFNDLGLPEFILKAVSDLGFETPSPIQQSCIPHLLSGNDVLGMAQTGSGKTAAFALPLLAQIDPSEKHPQMLVMAPTRELAIQVADACELFVKYAQGTRIVTLYGGQRYDIQLRALKQGAQVVVGTPGRILDHIRRGTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRREHNERGDRRENPRSAERRGERKGYGNPRPMDLYRIEVGRADGVEVRHIVGAIANEGDINSRYIGHIKLYDDYTTVELPQGMPKELLQQFGKTRVLNKQMQMSFLGAVKSDNSRGGDDFNGKRKGRGGDFRGERGRERGNDNRGNRKFNEKSNRTFSDKPRRDRRSSF

SEQ ID NO: 38907 - DNA, 1248 bp, Haemophilus influenzae R2866
  CDS (1)..(1248)
atgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaactggtacaggcaagacaatggcttttttaacggctacttttcaccatcttttaactcaccaagatcctaatcttgaatatcctcacccaagagctttgattttagcacctactcgagaattagcggtgcagattagtaatgacgcagaatttcttgcaaaagcgagtggattaaagaccgcacttgcctatggtggcgatggttatgataaacaactacaagtgattgagcgtggcgtcgatattttgattggtacgacggggcgagtcattgattatgtaaaacaaggtgtgattggtttagatgaaattcaagttgtcgtgctagatgaggcggatcgaatgttcgatcttggatttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaattgaaccagaacaaaaaacaggccaccgaatcaaagaagaacttttttatccatctaatcaggataaaatggcacttctcttaaccttaatggaagatgaatggcctgagcgctgtattgtatttgcgaatacgaaacatcgttgtgaagaaatttggggttatttggcggctgatggacatcgtgttggtttactgactggcgatgtagcacagaaaaaacgtttgtcgttattgaaacaatttaccgacggtgatctagatattttagtagcaacagatgtggctgctcgtggcttgcatatttctgatgtgacgcatgttttcaattatgatttacccgatgatcgagaagattatgttcaccgaatcggccgtactggacgagcaggggaaagtggcgtttcgattagttttgcttgcgaagaatatgcgatgaatttacccgctattgaagaatatattggccattctatccctgtgagccaatatgaaacagaagccttgcttgaactgccgaaaccgtatcggttaaaacgtacggtgccaccgcaaggacatacaagacatcgttcttatcacacaaaatag

SEQ ID NO: 38908 - protein, 415 aa, Haemophilus influenzae R2866
MQQDYLSQQRFSALPLHPIVRGALAKKGFDFCTPIQALSLPISLNGRDVAGQAQTGTGKTMAFLTATFHHLLTHQDPNLEYPHPRALILAPTRELAVQISNDAEFLAKASGLKTALAYGGDGYDKQLQVIERGVDILIGTTGRVIDYVKQGVIGLDEIQVVVLDEADRMFDLGFIRDIRYLLRKCPAPQARLTMLFSATLSYKVRELAFEDMNDPEYIEIEPEQKTGHRIKEELFYPSNQDKMALLLTLMEDEWPERCIVFANTKHRCEEIWGYLAADGHRVGLLTGDVAQKKRLSLLKQFTDGDLDILVATDVAARGLHISDVTHVFNYDLPDDREDYVHRIGRTGRAGESGVSISFACEEYAMNLPAIEEYIGHSIPVSQYETEALLELPKPYRLKRTVPPQGHTRHRSYHTK

SEQ ID NO: 38909 - DNA, 1281 bp, Anabaena variabilis ATCC 29413
  CDS (1)..(1281)
atgtctttttctcatctcggcttgtccaatgaaattattcgtgctgttactgagttggggtacaccaaacctacaccaatccagatgcagtccattcctgctgtcttgtcgggacgtgacttgctagctggcgctcaaactggaactgggaaaactgccagctttaccctcccactgctacatttattatcccaagatagtcttaaaagcgcctccagtccttcctcccccattcgggcgctgattctcaccccgactcgtgaacttgccgcacaggtggaatcaagcgtacgtgactacggcaagtacttgaacctcaactcaatggtgatgtttggtggagtcagtattaatccccaaaaacagcgtttaaagggtcgcgtggatattttggttgctaccccagggcgactcctagaccatgtgcagcagggaacggtaaacctttcacagattgagattctcgtgctggatgaagccgaccggatgttagatatgggctttattcgtgatatccgtcgtatcctctctttgctgcccaaacagcgacaaaatttgctattcttcgctacattctcagacaaaatcaaggaactagccgccggtctgctaaatcgcccacaaatgattgaagtagcacgccgtaacgttaccgccgatacggtgacacaaaaagtctacaaaatagagcgcgacaggaaacgagatttacttgctcacctgattcggaaagataattggtatcaagtactagtatttactcgcaccaagtatggtgctgaccgcctggtgaaacaattgggacatgagcgcattcaagctctagctatccacggcaataagagccagtcggcacgtacccacgctctggcaaagttcaaaaatggtagtttacaagttttagtggcaactgatatcgccgcgcgggggctggacatcagcgaattgccttatgtggtcaatttcgatttgccctatgtaccagaagattatgttcatcgcattggtcgcactggtcgtgctggtgcatcaggtgaggctgtatctttggtgagcgccgatgaatatcatttgttggcagatattgaaaaactgattgaaaaacgattgccttttgaattggtagcgggtattggagctaattcccaaactaaaccagaaccaagccaggatgaacgcaagcaaaaacccaaagatagtaagcatcagcctcgctctgctgctcaagctgtgccaaagaaatcagggaaaaaacgtttaactaattctgggaaaaggtaa

SEQ ID NO: 38910 - protein, 426 aa, Anabaena variabilis ATCC 29413
MSFSHLGLSNEIIRAVTELGYTKPTPIQMQSIPAVLSGRDLLAGAQTGTGKTASFTLPLLHLLSQDSLKSASSPSSPIRALILTPTRELAAQVESSVRDYGKYLNLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQTKPEPSQDERKQKPKDSKHQPRSAAQAVPKKSGKKRLTNSGKR

SEQ ID NO: 38911 - DNA, 1542 bp, Anabaena variabilis ATCC 29413
  CDS (1)..(1542)
atgaacttatcgtttcccgaactaggcatttcccaagaacgcgtagaacacttagaaaaacttggttttacagcaccaacaaacattcaagcccaagccatcccccaactgttgtcaggacgtgatgtagttggtcaatcacaaacaggtacaggtaaaacagcagcattttcactgccaattttagagcggttagatcctcaacaaaaagcagtacaagccatagttttaaccccaacccgcgaattagcaattcaagtccacgatgcaatggctcaattcattggtaacagtggattacggactttagcaatttacggtggtcaatcaattgaccgtcaaatgctgcaactcaaacgcggcgtgcatatcgttgtcggtacaccagggcgggtaattgacttgctagaacggggtaacctgaagctagatcaagtcaagtggtttgtcttagatgaagccgatgaaatgttgagcatgggctttattgacgatgtagagaaaattctttctcaagcaccccaagagcgtcagacagctttattctcagctaccatgccaccatcaattcggatgttggtcaacaagtttttgcgatcgcccgtcacagtcaccgtcgagcagccaaaagccacccccaataaaatcaatcaggtagcttatctcatcccccgtcactggacaaaagccagagccttacagccaattctggaaatggaagacccagaaacagctttaatctttgtccgcaccagacgtacagccgccgaactcaccagccaactgcaagcagccggtcacagtgtagatgaatatcatggtgacttgtctcaacaagcacgggaacggttattaactcggttccgtagtcgtcaagtgcgctgggtagtagcaaccgacattgctgcacgcggtttagatgtcgatcaactatctcacgtaatcaactacgacctacccgatagcgtcgaaacctacgtccaccggatcggtcgtactggtcgtgctggtaaagaaggtacagcaattaccttagtgcaaccatttgagcgtcgcaaacagcaaatttttgaacgccatgtccgccaaaattggcaattgctttccattcccacacgggcgcaaatcgaagcacgccacatcctgaaattgcaagagcaagtcagagaagccttagctggtgagcgtttagcttccttcttgcccattgtcagcgaattgatcgaaaaatatgatgctcaagcgatcgccgcagccgcactacaaatcgcttacgatcaaactcgtcccgcttggttaagcacggatgccgaaatccctgaagaagtcgcatccactcccaaacctaaactaggcggcaaacgtcgtgagttttccggtgacagaggtcgttccaactggaacaaatcagacaataacaacagcgacgacgaaagacgcggtactcccaaaccaaaattacggactagccgtcgtgaaacttccgctacacctagcaatcctaagttgggttcacctgctgcgagagaatcagcttcttag

SEQ ID NO: 38912 - protein, 513 aa, Anabaena variabilis ATCC 29413
MNLSFPELGISQERVEHLEKLGFTAPTNIQAQAIPQLLSGRDVVGQSQTGTGKTAAFSLPILERLDPQQKAVQAIVLTPTRELAIQVHDAMAQFIGNSGLRTLAIYGGQSIDRQMLQLKRGVHIVVGTPGRVIDLLERGNLKLDQVKWFVLDEADEMLSMGFIDDVEKILSQAPQERQTALFSATMPPSIRMLVNKFLRSPVTVTVEQPKATPNKINQVAYLIPRHWTKARALQPILEMEDPETALIFVRTRRTAAELTSQLQAAGHSVDEYHGDLSQQARERLLTRFRSRQVRWVVATDIAARGLDVDQLSHVINYDLPDSVETYVHRIGRTGRAGKEGTAITLVQPFERRKQQIFERHVRQNWQLLSIPTRAQIEARHILKLQEQVREALAGERLASFLPIVSELIEKYDAQAIAAAALQIAYDQTRPAWLSTDAEIPEEVASTPKPKLGGKRREFSGDRGRSNWNKSDNNNSDDERRGTPKPKLRTSRRETSATPSNPKLGSPAARESAS

SEQ ID NO: 38913 - DNA, 1425 bp, Ralstonia eutropha JMP134
  CDS (1)..(1425)
atgaacacaagctccctgcccccgcaagccggcgctgccgcgcccgccgccgatttctccaccctgcccctggcgccggccacgctcgccacgctggcccagctcggctatgacgaaatgacgccgatccaggccgcgagcctgccgctgacgctcgccggccacgacctgatcgcgcaggccaagaccggcagcggcaagaccgctgccttcgcgctggcgctgctgcacaggctcgatgcgcgccgcttcgacgtccaggcgatggtgctgtgcccaacgcgcgagctggccgaccaggtcacgcaggaaatccgccgcctcgcacgggccgaagagaacgtgaaggtgctgacgctgtgcggcggctcgccgatgcgcccgcaggtggacagcctggtccacggcgcgcacgtcgtggtgggcacgccgggccgcatcctcgaccatatcgaccggggcagcctcgaactgtccgcgatcaacacactggtgctcgacgaagcggaccgcatgctcgacatgggctttttcgacgacatctcgtatgtggccagccgctgcccgcgcgaacgccagacgatgctgttttcggccacgtatccggcgggcatcgacaagctcagccagaagttcctgcgcaagccgcaggaggtgaagctggccgagaagcacgacagctcgagcatccgccagtatttctatgaagtcgatgagagcgagcgtctcagcgccgtgggccgcctgctcgaccatttccgcccggccagcacgctggccttctgcaataccaaggcgcgctgccgcgatctggtcgacctgctgcgcggacagggctttcaggcgctggccttgcacggcgacctggagcagcgcgaccgcgatcaggtgctcgtgcagttcgccaacggcagctgctcggtgctggtagcgacggacgtggccgcgcgcgggctggatatcgcccagctcgaagccgtgatcaacgtggaaatcacgcccgaccccgaagtgcatatccaccgcatcggccgcactggccgcgccggcgaggaaggccacgcgttcagcctggtcagcatggacgagatggggcgcgtaggcaacctggagcagcaccacggcggcgaattcgaatggcacccgctggccgaactgcgcgccgcgagcaccgagcgcctgctgccgccgatggtcacgctgcagatgctgggcggccgcaaggaaaagatccggcccggcgatatcctcggtgcgctgaccggcgaggccggcttcaccaaggaacagatcggcaagatcaatgtgatggagatgtcgacctacatcgcggtggatcgcgccatcgggcgagaagcggtgcgccggttgaacgcggggaaggtgaagggcaagaaggtgaaggtgaggatgctgaccgagtga

SEQ ID NO: 38914 - protein, 474 aa, Ralstonia eutropha JMP134
MNTSSLPPQAGAAAPAADFSTLPLAPATLATLAQLGYDEMTPIQAASLPLTLAGHDLIAQAKTGSGKTAAFALALLHRLDARRFDVQAMVLCPTRELADQVTQEIRRLARAEENVKVLTLCGGSPMRPQVDSLVHGAHVVVGTPGRILDHIDRGSLELSAINTLVLDEADRMLDMGFFDDISYVASRCPRERQTMLFSATYPAGIDKLSQKFLRKPQEVKLAEKHDSSSIRQYFYEVDESERLSAVGRLLDHFRPASTLAFCNTKARCRDLVDLLRGQGFQALALHGDLEQRDRDQVLVQFANGSCSVLVATDVAARGLDIAQLEAVINVEITPDPEVHIHRIGRTGRAGEEGHAFSLVSMDEMGRVGNLEQHHGGEFEWHPLAELRAASTERLLPPMVTLQMLGGRKEKIRPGDILGALTGEAGFTKEQIGKINVMEMSTYIAVDRAIGREAVRRLNAGKVKGKKVKVRMLTE

SEQ ID NO: 38915 - DNA, 1521 bp, Ralstonia eutropha JMP134
  CDS (1)..(1521)
atgtctttctccgaactcggcttgtccgacaagcttgtgcgggccgtggccgaacagggctacaccacccccacccccatccaggcccaggcaattcccgccatcctcaaaggtggcgacctgcttgccggcgcgcagaccggtaccggcaagacggcaggctttacgctgccgatgctgcagctgctgtccgaatcggcgccacagcgccagggcaagccggcggtgcgcgcactggtgctgacgccgacgcgtgaactggccgcgcaggtggaagaaagcgtgcgcaactacggcaagtacgtgcggttgcgctcgatggtcatgttcggcggcgtgggcatcaacccgcagatcgaacagctgcgccgtggcgtggaaatcgtcgtggcaacgccgggccgcctgctggatcacgtgtcccagcgcacgatcgacctttccagcgtggaactgctggtactcgatgaagccgaccgcatgctcgacatgggcttcatccacgacatccgcaagatcctcaacgtcctgccgcccaagcgtcagaacctgctgttctcggcaacgttctcggatgatattcgcgcgctggcggaccgcctgctgaacaacccggcatcgatcgaggtcgcgcgccgcaacaccacggccgaaaccgtggcgcagcgcgtctacccggtggaccgcgaacgcaagcgcgaactgctcgcccacctggtgcgcgagcatgactggcaccaggtgctggtcttcacgcggaccaagcacggcgccaaccggctcgccgagcagttgaccaaggacggcctgtccgcgctggcgatccacggcaacaagagccagtcggcgcgcacgcgcgcgctgtccgagttcaaggccggcacgctgcggctgctggtggccaccgatatcgccgcgcgcggcatcgacatcgaccagttgccgcacgtggtcaacttcgacctgcccaacgtgccggaagactacgtgcaccgcatcggccgtaccggccgcgccggcgcagagggtgaggcgatctcgctggtctgcgtggacgagcatggcctgctgcgcgacatcgaacgcctgatcaagcgcaagctcgaacagacggtgctgacgggcttcgaagtcgatccgaccatcgcggcggagccgatccagaagggtcgccagcagcgaggcggcgggcagggcggtggacaaggtggtggacgtggccgtgcgcaggcaaagcctgcggcgccagcggcagccaagccgtcgcagggccagccgcgtcagcgcccggcccagaacgcaccgcgtggcgccagccaggccgggggcgaggcagcccgtggccacggcggcgcaaaccgcaacgccggccaggctcagccgcgcaacccgcaacgcaacggcggcggccaggcgcggcctgctcaggacgccactggcgccccggcgcgcaacaacaaccgccgcccggcctcgcaggccgcactgcttggcggcgcgcgggctaagccggcgcgctga

SEQ ID NO: 38916 - protein, 506 aa, Ralstonia eutropha JMP134
MSFSELGLSDKLVRAVAEQGYTTPTPIQAQAIPAILKGGDLLAGAQTGTGKTAGFTLPMLQLLSESAPQRQGKPAVRALVLTPTRELAAQVEESVRNYGKYVRLRSMVMFGGVGINPQIEQLRRGVEIVVATPGRLLDHVSQRTIDLSSVELLVLDEADRMLDMGFIHDIRKILNVLPPKRQNLLFSATFSDDIRALADRLLNNPASIEVARRNTTAETVAQRVYPVDRERKRELLAHLVREHDWHQVLVFTRTKHGANRLAEQLTKDGLSALAIHGNKSQSARTRALSEFKAGTLRLLVATDIAARGIDIDQLPHVVNFDLPNVPEDYVHRIGRTGRAGAEGEAISLVCVDEHGLLRDIERLIKRKLEQTVLTGFEVDPTIAAEPIQKGRQQRGGGQGGGQGGGRGRAQAKPAAPAAAKPSQGQPRQRPAQNAPRGASQAGGEAARGHGGANRNAGQAQPRNPQRNGGGQARPAQDATGAPARNNNRRPASQAALLGGARAKPAR

SEQ ID NO: 38917 - DNA, 1356 bp, Methylobacillus flagellatus KT
  CDS (1)..(1356)
ttgaacttacatccagccatcctgcgtgccttgaccgaggctggctatagcacccccacacccatccaggcccaggcgattcctgaagtcctagaaggccatgacctcatggcctctgcccagaccggcaccggcaagaccgctgccttcaccctgccagcactcaacctgctggctacgccgcaccctgccaagagccgcggcccccgcatcctggtattgaccccgacccgcgaactggctgcacaggtcaacgaagcagcgcgcaaatacggcaagttcctgcgcgcccgcactgtcagtattgtcggcggcatgccctatccattgcagaacaagttattgtcgcagccaatcgacattctcgtggccacgccgggccgtctgctcgaccatatggaacgcggacgcatcgacatgtcccgcttgcaaatgctgatcctagacgaagccgaccgcatgctggacatgggcttcatgccggatatcgagcgcatttcctccgccttgcctagcgagcgccagacattgatgttctccgccaccttcgaaggccagatcgccaacattgccaagacgttgctgaaaacccccaaggtcattcagatcgcggcacaaaaggaaaagcacgccaatattgagcaaaagctattgttcgtcgatgacatggcgcacaagaacaagctgctggaacatctgctcattgctcccggtgtcaaccaggccatcgttttcacttccaccaagcgtcacgccgacctgctggcggaagacctgtatgctgcaggccacaaatctgccgcactgcatggcgacatgacccagggcgcgcgcaatcgcaccttgaccaagctgcgccatggtgatgtacgcgtgctggttgcaaccgatgtcgcggcccgcggcatcgatgtgcaaggcattacccacgtcatcaactatgacctgccgaagtttgcggaagactatgtccaccgcatcggccgcacaggacgtgcaggcaataccggtgtggcactctcgtttgcttcgcacatggacaggcaccagttgcgcaagatcgaacaatatacaggccagcgcctggagatttccgtgattgaaggcctggagccaaagcgcccagccccacgtatggatcacaatgacaagccacgcagtggccgccctggtcaacgtccaggtggtggcggttacaagccacgcggccagggttacgccagccgcgatggcaaccgttcggaaggccgctcatttggcgaccgggcagcaggcagccgcaccgatgcaaatcgtggcccagccaagcgccaggacagtgaccgtccggcacgccgctcgcgcagctttgcctaa

SEQ ID NO: 38918 - protein, 451 aa, Methylobacillus flagellatus KT
MNLHPAILRALTEAGYSTPTPIQAQAIPEVLEGHDLMASAQTGTGKTAAFTLPALNLLATPHPAKSRGPRILVLTPTRELAAQVNEAARKYGKFLRARTVSIVGGMPYPLQNKLLSQPIDILVATPGRLLDHMERGRIDMSRLQMLILDEADRMLDMGFMPDIERISSALPSERQTLMFSATFEGQIANIAKTLLKTPKVIQIAAQKEKHANIEQKLLFVDDMAHKNKLLEHLLIAPGVNQAIVFTSTKRHADLLAEDLYAAGHKSAALHGDMTQGARNRTLTKLRHGDVRVLVATDVAARGIDVQGITHVINYDLPKFAEDYVHRIGRTGRAGNTGVALSFASHMDRHQLRKIEQYTGQRLEISVIEGLEPKRPAPRMDHNDKPRSGRPGQRPGGGGYKPRGQGYASRDGNRSEGRSFGDRAAGSRTDANRGPAKRQDSDRPARRSRSFA

SEQ ID NO: 38919 - DNA, 1383 bp, Methylobacillus flagellatus KT
  CDS (1)..(1383)
atgaacgctcaacccgaagacaacgtgaatacagacactatcagttttgcatcgctcaatctggcgcccgagttactgaaggcgctggatgagtcaggctataccacgccaaccccgattcaggcccaggcgattcctgtcgtgctggaaggcagcgacctgatggccggcgcacagaccgggaccggcaaaacagccgcctttactttgcccttactgcagaagctgctgccattggccagcagtagtgcctcgcccgcaaggcatccggtgcgggccttgatcctgaccccgacccgggaactggcaatccaggtggaagaaagtgtcaagacgtatgccaagcatacgccgctacgttcgctggttgtcttcggtggagtggatatcaaatcccagacgcccaccctcatgaaaggagtggagatattggtagccactccagggcgcctgctggaccatgtcgaacagcgcacagtgcagctgggccaagtgcagatgctagtgctcgatgaagcagaccgcatgctggacatgggcttcatgccagatctcaagcgcattctcgcactgctgccgaaacaacggcagaacctgatgttttccgcaacattctcacctgaaatcaagaagctttccgaagagttcctgaccaagcctgtactgatcgaagtcgcccgcagcaatgcgacatcagaaaacgtcacgcaaaaaatcctgctggtggaaagcgagcacaagcagcacgtgctggccgacttgttgcgcaaggaagcaacacaggtcatcgtcttcaccaagaccaagctttccgcaagccgcctggcgcgccatcttgagcgcgaaggcattgccgccggcgccattcatggcgacaagagccagcttgagcgtattcaggcgctggatgccttcaagcaaggcaaaatcacagcactcgtggcgaccgatgtggccgcacgcggcctggatatcgaccagctccccatggtggtcaattacgagttgcccagcgccgccgaggactacgtacaccggatcggccgcactggtcgcgccggtgcttccggcatcgccatttccctggtatccagtgaggaggagaagttcctcaaggaaatcgaaaagctcatcaagcgggaattgccaaaagaacaggcgaatgctccccagcctgtacgccgcgggcaggatacccaacgacagaaggctccggcaagtattgctccgcgccaacggcatgctggccgcaacaaggaagacgaatggtttttcaagccgtatgagccttccacagatgcgccggcgcccaagcccatgcattcccgggaaaaatcgaaaaaggaaattcccgccctgctcggcgggttgaaccgcaaataa

SEQ ID NO: 38920 - protein, 460 aa, Methylobacillus flagellatus KT
MNAQPEDNVNTDTISFASLNLAPELLKALDESGYTTPTPIQAQAIPVVLEGSDLMAGAQTGTGKTAAFTLPLLQKLLPLASSSASPARHPVRALILTPTRELAIQVEESVKTYAKHTPLRSLVVFGGVDIKSQTPTLMKGVEILVATPGRLLDHVEQRTVQLGQVQMLVLDEADRMLDMGFMPDLKRILALLPKQRQNLMFSATFSPEIKKLSEEFLTKPVLIEVARSNATSENVTQKILLVESEHKQHVLADLLRKEATQVIVFTKTKLSASRLARHLEREGIAAGAIHGDKSQLERIQALDAFKQGKITALVATDVAARGLDIDQLPMVVNYELPSAAEDYVHRIGRTGRAGASGIAISLVSSEEEKFLKEIEKLIKRELPKEQANAPQPVRRGQDTQRQKAPASIAPRQRHAGRNKEDEWFFKPYEPSTDAPAPKPMHSREKSKKEIPALLGGLNRK

SEQ ID NO: 38921 - DNA, 1548 bp, Methylobacillus flagellatus KT
  CDS (1)..(1548)
ttgtctactgacgtaagcattaccctttccaacttacaattttccgatctcggcctggcagaacccatcctgcgtgccattgcagataccggctatacccacccgacccctatccaggcccaggccattcctttggtattgaatggcggcgacctgctggcaggtgcgcaaaccggcaccggcaagacagcgggcttcaccctgcccgtgcttcacctgttgcatgccaagccggtcaaggtcaagcccggccagcctcgctgcctgatcctgaccccgacgcgcgaacttgccgcccaagtggaagaatcggtacaaacctatggcaaacacctgaaattgacatccatggtgatgttcggcggtgtgggcatcaacccgcagatcgagcgcctgaaaaagccactggatattctggtcgccacgcccggccgcctgcttgaccatgcagcgcagaaaaccatagacctgtccgcgatcgagattctggtcctggatgaggcagaccgcatgctggacatgggctttatccgcgatatcaagcgcgtactggcattgctgccgaaaaagcgccagaacctgctgttttccgccacgttctcagacgagatcaaggagctggccgacggcctgctgcacaaccccggctttgtggaagtggccagacgcaatacggcctccgaactggtcgaacaagccgttcacctcgtcagccaggggcacaagcgcgacttggtcgcgcatctgatccgccaccacgactggaagcaggtgctgatattcacccgcaccaagcatggcgccaaccgacttgcggaaaaactcagcaaggacggcatcgccgctgccgcgattcacggcaacaagagccaatccgcccgcaccaaggcgctagccgaattcaagaacggtaccctgccggtcctggtggcaaccgatattgccgcgcgcggcctcgatatcgaccagttgccgcaagtggtgaacttcgagttgcccaacgtgccggaagactatgtgcaccgcattggccgtaccggccgcgcaggatgctcgggcgctgccgtctctctggtggatggcgaggaaatcaagctgctcaagggcatcgagcgtctgatcaagcgtgaaatcccgcgcctggacattcccggcgctttcgttcccagtgataaaccaggcgtggaaagccgcccgcccaggcagcagcctgcccaagcgcgccaaacgaaaagtaaccgtccgcaagcccagcgtgagcgcagtgacgcggctggcaacagcgccgaaccgcgctccggcaacaagccgcgtcaaggccggaatcaccaggccaaggctcaaggccagcctcagccacaagcgcaacgcagcaagcctcagggccagggccaggcggttcaagccaagaaaaaaccggaaccgctcttgtccgaagccgcacgccaccaggccatgccgcaggtcgggctgttcgtgccgccacagccacccaagcgtcaattccacaatacctctgggcagcgccccaaccggggtcgccgctag

SEQ ID NO: 38922 - protein, 515 aa, Methylobacillus flagellatus KT
MSTDVSITLSNLQFSDLGLAEPILRAIADTGYTHPTPIQAQAIPLVLNGGDLLAGAQTGTGKTAGFTLPVLHLLHAKPVKVKPGQPRCLILTPTRELAAQVEESVQTYGKHLKLTSMVMFGGVGINPQIERLKKPLDILVATPGRLLDHAAQKTIDLSAIEILVLDEADRMLDMGFIRDIKRVLALLPKKRQNLLFSATFSDEIKELADGLLHNPGFVEVARRNTASELVEQAVHLVSQGHKRDLVAHLIRHHDWKQVLIFTRTKHGANRLAEKLSKDGIAAAAIHGNKSQSARTKALAEFKNGTLPVLVATDIAARGLDIDQLPQVVNFELPNVPEDYVHRIGRTGRAGCSGAAVSLVDGEEIKLLKGIERLIKREIPRLDIPGAFVPSDKPGVESRPPRQQPAQARQTKSNRPQAQRERSDAAGNSAEPRSGNKPRQGRNHQAKAQGQPQPQAQRSKPQGQGQAVQAKKKPEPLLSEAARHQAMPQVGLFVPPQPPKRQFHNTSGQRPNRGRR

SEQ ID NO: 38923 - DNA, 1443 bp, Crocosphaera watsonii WH 8501
  CDS (1)..(1443)
atgaccatttccttcgagaacttaggactatccgacgcccgtgtaaacaagttacaaagactgggctttgaaagtcctaccgagattcaagaaaaagcaatacccttaattttagaaagcaacgatatcttaggacaatcccaaacaggaacgggaaaaactgcggcctattccttacctattctggaacaaattgataccaaaaatcctaatgttcagacattaatactaaccccaactcgtgaacttgctcaacaagttgccgaggcgttaaaagatttttcgacagaacgtcgtctatatattttaacggtttatgggggtcaatccattgaaagacaaatccgtagtttagaacgaggggtacagattgttgtcggaacaccaggacgagttatagacttattagaacggaaaaaattggttctagactgtctgcgttgggcggttctcgatgaagcagacgaaatgttaagtatgggcttcattgatgatgtaaaaacgatcctgagaaaaacccctgaaactcgtaatacagcttgtttctctgccaccatgccccgagaaatacgagacttagttaatcagttcctcaagtctcccgtcaccgtatctgtagaacgcaagcaagccgcccctacacacattgaccagcatctctattatgttcccaggggatggtcaaaacgcaaagccctacaaccgatcttagagatggaagatccagagtcggccatcatctttgtccgtactaagcaaactgcctcagaattaaccaccaggctacaagaaatcggtcatagtgtggacgaatatcatggtaacctctcccagtcccaaagagaaagattagtctatcgctttcgggacggaaaaattaagttagtggtagccacagatattgcggctcggggtttagatgtagaaaatttaagtcacgttatcaattacgacttacccgataatagtgaaacctatatccaccgtattggtcgtacaggacgtgcaggaaagacagggacagctatttccctcatcgaaccggttgatcgccgtatggtaagacaaattgagcggaaactgcgacaaaaattagaaacctgcaagatccccagtcgttctcaagtagaagcaaaacgcatcgagaaactgcaaaatgagattaaagaatctttagcaggagaacgcatggcctcatttttacccttggtaagggaattgagtgatgaatacgatccccaagcgatcgcagcggctgctttacagatgatctacgatcaagactgtcccgagtggatgaaaaccgattgggaagtaccagagtccgccgtacctaaacccgtcattaaacgcaaaggaaaatataatcccaataattctaagcgtcatggcaattctaaccgaggtaatcgcaagaaagttattcatccacaaactcgttag

SEQ ID NO: 38924 - protein, 480 aa, Crocosphaera watsonii WH 8501
MTISFENLGLSDARVNKLQRLGFESPTEIQEKAIPLILESNDILGQSQTGTGKTAAYSLPILEQIDTKNPNVQTLILTPTRELAQQVAEALKDFSTERRLYILTVYGGQSIERQIRSLERGVQIVVGTPGRVIDLLERKKLVLDCLRWAVLDEADEMLSMGFIDDVKTILRKTPETRNTACFSATMPREIRDLVNQFLKSPVTVSVERKQAAPTHIDQHLYYVPRGWSKRKALQPILEMEDPESAIIFVRTKQTASELTTRLQEIGHSVDEYHGNLSQSQRERLVYRFRDGKIKLVVATDIAARGLDVENLSHVINYDLPDNSETYIHRIGRTGRAGKTGTAISLIEPVDRRMVRQIERKLRQKLETCKIPSRSQVEAKRIEKLQNEIKESLAGERMASFLPLVRELSDEYDPQAIAAAALQMIYDQDCPEWMKTDWEVPESAVPKPVIKRKGKYNPNNSKRHGNSNRGNRKKVIHPQTR

SEQ ID NO: 38925 - DNA, 1233 bp, Exiguobacterium sp. 255-15
  CDS (1)..(1233)
atgtcaacatttgaagcactacacattcaagaacaatgggtcaagaaattacaaaaacaaggcatcaaacaaccaacgccgattcaagaacaggcgattccgcatttgctcgccggtcgtgatttaataggaaaagcgcaaaccggaacagggaagacactggcgtttcttctgccgattctcgaacaaatcgatttagagagcaaaacggttcaagcgttgatcgtcgcaccgacacgtgaactcgcacgtcagattgcagatgaaacacacaagttaatccggaacatggaagatatccgtgcgctggctgtatacggtggacaggatgtcttcaaacaaatccaacgtctcggtcgcatgccacaaatcatcatcgggacaccgggtcggattttggatcacgtcggtcgtggaacacttgatttgagtgaattgaagacgcttgtcctggatgaagcggatcagatgctgcaaatcggattcttaccggaaatcgaagatatcatcgcagcagcaccggttgatcgtcagttcgtcatgttatcagcaacgatgccggaaaaagtcgagcaactcgcgaaaacgtatttgcgtgatccgattgaagtccaagtcgaggcagaaaaagtaacagtcgacgccatcgaacagttcgtcgtcgaaacgacggatcgccggaaacaggcgacactccggacgatgcttgacgagatgcgtccgtatgccgcaatcatcttctgccggacacaacgccgtgtcagcaagctgaatgaagaattacagatgcaagggtatccgacggatgaattgcacggtggtttgacacaagggaaacgtgaaaaagcgatggcgaagttctatcaaggaaaaacaccattcctgattgcaacagacgttgcatcacgtggtcttgacgtgacgggtgtcacgcacgtcttcaactacgatttaccggacgatgcggaaagttatgttcaccggattggtcggacaggccgtgccggaaacgacggcgtagcgatttcaatcgttaccccacgcgacggccgcagtttccgtgatatggaacgcgaactgggtgtcgaagtgacaccgattgtcgtcgaactttcggatgaaatgattcgtgcacagcacgatcaaagcaaaggaacgaaaaaaccggcggaaggccgcggtaacacacgccgctcgagcaaccgccgtccgggccgtgatcatcataaataa

SEQ ID NO: 38926 - protein, 410 aa, Exiguobacterium sp. 255-15
MSTFEALHIQEQWVKKLQKQGIKQPTPIQEQAIPHLLAGRDLIGKAQTGTGKTLAFLLPILEQIDLESKTVQALIVAPTRELARQIADETHKLIRNMEDIRALAVYGGQDVFKQIQRLGRMPQIIIGTPGRILDHVGRGTLDLSELKTLVLDEADQMLQIGFLPEIEDIIAAAPVDRQFVMLSATMPEKVEQLAKTYLRDPIEVQVEAEKVTVDAIEQFVVETTDRRKQATLRTMLDEMRPYAAIIFCRTQRRVSKLNEELQMQGYPTDELHGGLTQGKREKAMAKFYQGKTPFLIATDVASRGLDVTGVTHVFNYDLPDDAESYVHRIGRTGRAGNDGVAISIVTPRDGRSFRDMERELGVEVTPIVVELSDEMIRAQHDQSKGTKKPAEGRGNTRRSSNRRPGRDHHK

SEQ ID NO: 38927 - DNA, 1536 bp, Exiguobacterium sp. 255-15
  CDS (1)..(1536)
atgggctttgaagaagcaactccaatccaagcagaaacaattccagtcggtcttagcggcgttgacttaatcggtcaagcacaaacaggaacagggaaaacagctgcattcggtattccaacgattgagcgtcttgacgcaaaatcacgttatatccaagcattgatccttgcaccgactcgtgagcttgcgattcaagtagcagaagaacttaaccgcattggtgaagtaaaacgtgttcatgcattgccagtatacggtggtcagcaaatcgaccgtcagattcgtgcgcttcgtaagaacccacaaatcgtcgtcgctacacctggtcgtctaatggaccacatgaaccgtaaaacattaaaccttgaccacgtccaaacagttatcttggatgaggcagatgaaatgttgaacatgggcttcgtggaagatatcgaaaaaatcttgggtacacttccgccaactcgccaaacacttttattctctgcgacaatgccgccgcagattcgtaaaatcgcagatcgtttcatgacgactccgactcacatcaaagtaaaagcaaaagaaatgactgtcgaaaacatcgaccaatcattcatcgaattaaaagaaagccaaaaattcgacgtcctttgccgcttgattgatacggattctccggaactctcgatcatcttcggtcgtacgaaaaaacgtgtcgatgagatgacagaaggtctaatccaacgtggttatacagctgacggcttacacggtgacttaacacaagcaaaacgtgaccaagtcatccgtcgcttcaaaaaaggaacaatcgatatccttgttgcaactgacgtagcggcacgtggacttgatatttcaggcgttacacacgtctacaacttcgacgtcccgcaagatccggagagctatgttcaccgtatcggtcgtacaggtcgtgctggtaaaacaggatcagcaatcacattcgttacaccacgtgagtttggtcaaatcaaaacaatcgaacgtgtaacaaacaaaaaaatgtcacgtcgtcatgcaccgacgcttgacgaaatcttggaaggcaacttgaaacttgctgcacaagagttgatcaaacgtgtagaagcgaaaaactcacaagagtatacaacactcgctcaagaacttcttgaagagtatgaagcggttgaattaatcgcagcagcgcttaaaggattaacgaaagagccggatgcaacgccagttcaaatttcgtcaatcgaaccaatccgtgttaaacgttttggcagcaacggtggcggtggtaaccgtcgtccttacggcaacaaaggtggatcaggttctggttcttcttctaaccgtggtggcggataccgtggcagcaacccacgtggtggggagcgccgtgaaggcggtcgtccttctgaaggaaaccgtagttcttcatcagcgtcatcagatcgccgtgaaggtggatacgctggccgtaaccgcagtgaaagtgatcgcaaccgtggtggacgtaaaccacgttttgaaaagtaa

SEQ ID NO: 38928 - protein, 511 aa, Exiguobacterium sp. 255-15
MGFEEATPIQAETIPVGLSGVDLIGQAQTGTGKTAAFGIPTIERLDAKSRYIQALILAPTRELAIQVAEELNRIGEVKRVHALPVYGGQQIDRQIRALRKNPQIVVATPGRLMDHMNRKTLNLDHVQTVILDEADEMLNMGFVEDIEKILGTLPPTRQTLLFSATMPPQIRKIADRFMTTPTHIKVKAKEMTVENIDQSFIELKESQKFDVLCRLIDTDSPELSIIFGRTKKRVDEMTEGLIQRGYTADGLHGDLTQAKRDQVIRRFKKGTIDILVATDVAARGLDISGVTHVYNFDVPQDPESYVHRIGRTGRAGKTGSAITFVTPREFGQIKTIERVTNKKMSRRHAPTLDEILEGNLKLAAQELIKRVEAKNSQEYTTLAQELLEEYEAVELIAAALKGLTKEPDATPVQISSIEPIRVKRFGSNGGGGNRRPYGNKGGSGSGSSSNRGGGYRGSNPRGGERREGGRPSEGNRSSSSASSDRREGGYAGRNRSESDRNRGGRKPRFEK

SEQ ID NO: 38929 - DNA, 1446 bp, Exiguobacterium sp. 255-15
  CDS (1)..(1446)
atgtctaaaaaaccattcactgattttcaactcagtacgccgattctagaagcgattgaacagctcggttatcatacgccgaccgatgtccaacaagcagtcattccggtcgctttatcggaaaaagatatcatcgtcaaatcacggaccggcagcgggaagacggcatcgttcggaattcccctttgcgaactcgttgagtgggaagaaaacaaaccccaggcgttaattttaacaccaacgcgtgagctggccctgcaagtcacggaagatgtcatgaacatcggtcgttataaacgaatcaaagcgacagctgtgtttgggaaacaaccattccgcggacaagtcgcagaactgaaacagaagacacatatcgtcgtcgggacaccgggtcgtgtgctcgatcacttggagcgcggcacgttatcacttgaaaaagtgaaatacctggttcttgacgaggcggacgagatgctcaacatgggcttcctcgatcaagtggatacgattttaaaacaattgccgaaacaacggacgacgatgctgttctcagcgacgttcccgcaagatattcatcagttgagcgaccgttacatgcagtcaccgaaacaagttgaaatcacgacgaaggcaacggaaatcgcagaaatcgaacacagctatatcaaggtcacggataaaacgaagtttgctgtcctcaaagacgttactgtcgttgaaaacccggaccggtgcatgattttctgccggacaaaagaacatgttgatttcgtcgcccaaggactggcatcgatggattatccggttgaaaaaattcacggtggaatggaacaggacgagcgtctcgccgtcatgaaagccttccgggccggtgagttccgttatctcgtcgcgacggacgtcgcagcccgcgggattgatattgaaaacatcacacacgtcatccaatacgatatgccggttgaaaaagaaagttacgtccaccggacaggtcggacaggacgtgccggagcactcggaaaagctatcagtttggtgacggagtcggatatgcgtcgtctccgtgaagtcgaacagtaccgcggtgaggccatcgaaagacgccaagcaccgactgaacgggaactgatccggacagctgatgcatttgaagagaaaatcacgacagctgatgtccgggcttcaaaaacggagcagctcaacgccgatatcatgaaactgtactttaacggcggcaagaaaaagaaactgcgtgccgttgatttcgtcggaacgattgcgaaaatcgaaggcatgactgcgcaggatatcggaatcatcacgattcaggatacggtcacgtacgtggaaatcctgaacggaaaaggtccgctcgtcctgcgggcgatgaagacaacaaaagttaaaggcaaacagctgaaagtatacgaagcgtttaaaaaataa

SEQ ID NO: 38930 - protein, 481 aa, Exiguobacterium sp. 255-15
MSKKPFTDFQLSTPILEAIEQLGYHTPTDVQQAVIPVALSEKDIIVKSRTGSGKTASFGIPLCELVEWEENKPQALILTPTRELALQVTEDVMNIGRYKRIKATAVFGKQPFRGQVAELKQKTHIVVGTPGRVLDHLERGTLSLEKVKYLVLDEADEMLNMGFLDQVDTILKQLPKQRTTMLFSATFPQDIHQLSDRYMQSPKQVEITTKATEIAEIEHSYIKVTDKTKFAVLKDVTVVENPDRCMIFCRTKEHVDFVAQGLASMDYPVEKIHGGMEQDERLAVMKAFRAGEFRYLVATDVAARGIDIENITHVIQYDMPVEKESYVHRTGRTGRAGALGKAISLVTESDMRRLREVEQYRGEAIERRQAPTERELIRTADAFEEKITTADVRASKTEQLNADIMKLYFNGGKKKKLRAVDFVGTIAKIEGMTAQDIGIITIQDTVTYVEILNGKGPLVLRAMKTTKVKGKQLKVYEAFKK

SEQ ID NO: 38931 - DNA, 1398 bp, Burkholderia cepacia R1808
  CDS (1)..(1398)
atgacgcagcccgccgccacgccgttcagcgcgctgccgctgacgcccgcgacgctcgcgaacctcactcagctcggctacgtcgacatgacgccgatccaggccgcgagcctgccgatcgcgctggccgggcacgacctgatcgcgcaggcgaagacgggcagcggcaagaccgccgcattctcgctcgcgctgctgtcgcgcctcgacgcgcgtcgcttcgacgtgcaggcgatgatcctgtgcccgacgcgcgagctcgccgaccaggtcgcgcaggaagtgcgccgcctcgcgcgcgccgaggagaacgtcaaggtgctgacgctgtgcggcggcacgccgatgcgtccgcaggcgcagagcctcgagcacggcgcgcacgtcgtcgtcggcacgccgggccgcatcatggaccacctcgagcgcggcaacctgaagctcgacgcgctgaacacgctcgtgctcgacgaagccgaccggatgctcgacatgggcttcttcgacgacatcgtgaaagtcgcacggatgtgcccggcgacgcgtcagacgctgctgttttccgcgacctatccggacggcatcgcgaagctgagccagcaattcctgcgcaacccgaaggaagtgaagctcgcggagcgccacgacgacagcaagatccgccagcgcttctacgaagtgacggacaccgagcgtctgcatgcggtcggccagttgctgaaccactaccggccggtcagcacgatcgcgttctgcaacaccaagcagcaatgccgcgacctgctcgacgtgctgcacgcgcagggcttccatgcgctcgcgctgcacggcgagctcgaacagcgcgaacgcgatcaggtgctgatccagttcgcgaaccgcagctgctcggtgctcgtcgcgaccgacgtcgccgcgcgcgggctcgacatcgcgcagctcgaggcggtgatcaacgtcgacgtgacgcccgaccccgaagtgcacgtgcaccggatcggccgcaccggccgggccgaccaggaaggctgggcgctgagcctggcgagcatggacgagatgggccgggtcggcgcgatcgagcaggcgcagaagcgcgacgtcgaatggcattcgctcgcggaactgaagcccgccgacgaaggcacgctgctgccgccgatggaaacgctgcagatcctcggcggacgcaaggacaagatccgcccgggcgacgtgctcggcgcgctgaccggcgatgccggcttcgacggcaagcagatcggcaagatcaacgtgacggagttctcgacctacgtcgcgatcgagtgcggcgtcgcgcgcgacgcgctgcgcaagctcaatgccgggaagatcaagggcaagcgcgtcaaggtgcgcctgatggacgacgaatga

SEQ ID NO: 38932 - protein, 465 aa, Burkholderia cepacia R1808
MTQPAATPFSALPLTPATLANLTQLGYVDMTPIQAASLPIALAGHDLIAQAKTGSGKTAAFSLALLSRLDARRFDVQAMILCPTRELADQVAQEVRRLARAEENVKVLTLCGGTPMRPQAQSLEHGAHVVVGTPGRIMDHLERGNLKLDALNTLVLDEADRMLDMGFFDDIVKVARMCPATRQTLLFSATYPDGIAKLSQQFLRNPKEVKLAERHDDSKIRQRFYEVTDTERLHAVGQLLNHYRPVSTIAFCNTKQQCRDLLDVLHAQGFHALALHGELEQRERDQVLIQFANRSCSVLVATDVAARGLDIAQLEAVINVDVTPDPEVHVHRIGRTGRADQEGWALSLASMDEMGRVGAIEQAQKRDVEWHSLAELKPADEGTLLPPMETLQILGGRKDKIRPGDVLGALTGDAGFDGKQIGKINVTEFSTYVAIECGVARDALRKLNAGKIKGKRVKVRLMDDE

SEQ ID NO: 38933 - DNA, 1413 bp, Listeria monocytogenes str. 1/2a F6854
  CDS (1)..(1413)
atgcataatttaaaattaagtgaagaaattaaaagagcaattaacgaactaggatatacagaagcaacgcctgttcaaaaagcagtaattccagttgccttaacaggggaagatatcgttgctaaatcacaaactggtagtgggaaaacagcagcattcgctattcctattgctgaacaagtcgaatgggaagaaaataaaccgcaagcactaatcatcgttccaacgcgagaacttgcaatgcaagtcaaaacagaatgtacgaatatcgggcgatttaaacgcgtcaaagctgcagcaatatacggacaatcaccatttgcgaaacaaaaattagaactaagccaaaaaaatcatatcgtcgttgggacgcctggtcgcctactggatcatattgaaaaaggatctctgaatgtcgataaagtagctcacttagttttagatgaagtagacgaaatgttaagtatgggctttattgatcaagtagaagatattcttagccgtttaccaaaacagcgccaaaatctatttttctctgcaactatgccagaagaaatgcaaggtttaatcaaacgctatcaagacgatccaatggttatcgaaatggcatcagaaaaaacaaatcctatcctccacgtggagatacaaacagataataaagaaaaaacgctaaaagatgttttaattacggaaaatccagatagcgcaattattttttgcaacacgaaaaatcaagtcgatgaactcactgatttacttgatgtaaaagctagtaaaattcatggtggcttaagacaagaagatcgttttcgggcaatggatgatttcaaaagtggcaaatcgcgtttcttaattgcgacagatgtggcagggcgtggaattgatgtggataatgtctcattagttattaactatgatttaccaatcgaaaaagaaaactatgtgcatcgtatcggccgtactggtcgcgctggcaaaagcgggaaagccattagcttcgtgaaaactaatgaaaatccacttttgcgtgatatagaagaaatgctcgacgttacaattgaaaaaaaacgtaaaccgacagtgattgaagtgaaagcaaacgaagatgctttccgcaaaaaacaacaaaagcgcccaacaatcaaaaaagctcgtggggaaaaattaaataaaaacattatgaaactgtattttaacgggggcaaaaagaaaaaaatccgtgcggtagattttgtgggaactatttctaaattagaaggaattacggccgaagatattggaattattacgattgaagaccatgtttcttttgtcgaaattttaaatggaaaaggtccggcagtgctggaaatgatgcgctctcgtaaagtgaaaggtagacgcctgaaagtaaacgaggccagaaaacgataa

SEQ ID NO: 38934 - protein, 470 aa, Listeria monocytogenes str. 1/2a F6854
MHNLKLSEEIKRAINELGYTEATPVQKAVIPVALTGEDIVAKSQTGSGKTAAFAIPIAEQVEWEENKPQALIIVPTRELAMQVKTECTNIGRFKRVKAAAIYGQSPFAKQKLELSQKNHIVVGTPGRLLDHIEKGSLNVDKVAHLVLDEVDEMLSMGFIDQVEDILSRLPKQRQNLFFSATMPEEMQGLIKRYQDDPMVIEMASEKTNPILHVEIQTDNKEKTLKDVLITENPDSAIIFCNTKNQVDELTDLLDVKASKIHGGLRQEDRFRAMDDFKSGKSRFLIATDVAGRGIDVDNVSLVINYDLPIEKENYVHRIGRTGRAGKSGKAISFVKTNENPLLRDIEEMLDVTIEKKRKPTVIEVKANEDAFRKKQQKRPTIKKARGEKLNKNIMKLYFNGGKKKKIRAVDFVGTISKLEGITAEDIGIITIEDHVSFVEILNGKGPAVLEMMRSRKVKGRRLKVNEARKR

SEQ ID NO: 38935 - DNA, 1467 bp, Rubrivivax gelatinosus PM1
  CDS (1)..(1467)
atggcgtcaccggccctgccggccgaggcgccgcccgcccgtttcgacaccctcgcgctcgatccgaagctgctccgcgcggtggccgaatccggttacctgctgatgacgccgatccaggccaaggcgattccactcgtgctggccggccgcgacgtcatgggcgccgcgcagaccggcaccggcaagacggcggccttctcgctgcccctgctgcagaagatgctcaagcacgagagcagcagcacgtcgccggcccgccacccggtgcgggccctggtgctggccccgactcgtgagctggcggaccaggttgccaacaacgtcaagacctactccaagcacacccagctgcgcgccacggtcgtgttcggcggcatcgacatgaagccgcagacggccgaattgaagcgcggcgtcgaggtactgatcgcgacgccggggcggctgctcgaccacatcgaggccaagaactgctcgctcagccaggtggagtacgtggtgctcgatgaggccgaccgcatgctcgacatcggcttcctgcccgacctgcagcgcatcctgagctacctgcccaagagccggcagacgctgctgttctcggccacgttctcgcccgagatcaagaagctggccaacagctacctgcaggacccgatcctggtcgagacggcgcggcccaatgccacggcgtcgacggtcgagcagcgcttctatcgtgtcgaggacgacgacaagcgcaatgccgtgaagcagctgctgcgcacgcgagccatcacgcagagcatcgtcttcgtcaattccaagctgggcgcggcgcgcctggcgcgtgccttcgagcgcgacggcctgcgcacccaggccctgcacggcgacaagtcgcaggacgagcgcctgaaggccctggccgcgttcaaggccggcgaggtggatctgctggtggccaccgacgtggccgcacgcggactcgatatcgccgacctgccggcggtgttcaatttcgacgtgcccttcaacgccgaggactacgtgcaccgcatcggccgcaccggccgcgccggggcctcgggcctggcgatcacgctggtgtcgcgtgacgatgcccggctggtgtccgacatcgagaagctgatcaagaagaagctcgatatcgaggcgctcgaactcgaggacgaccgtcctcgccgtgcgccgcggcgtgacgatggtgagcgcgacgtcgtgcgccgcgaggatgacgggcgccggaccagcgctgccgcggcaggcgatcggcctgcgccagcgcggcgccccactccgccggcagcgccctccgatccgttcttcagccagccctacgaagcccaggccggcatcgagcccgtgtgggagaagtcggccgcccaggcgtcggcgcccagcagcgggctgtcgcgctacatcaaggccaagaagcgcgtggcgtccttgctgggtggcaagtaa

SEQ ID NO: 38936 - protein, 488 aa, Rubrivivax gelatinosus PM1
MASPALPAEAPPARFDTLALDPKLLRAVAESGYLLMTPIQAKAIPLVLAGRDVMGAAQTGTGKTAAFSLPLLQKMLKHESSSTSPARHPVRALVLAPTRELADQVANNVKTYSKHTQLRATVVFGGIDMKPQTAELKRGVEVLIATPGRLLDHIEAKNCSLSQVEYVVLDEADRMLDIGFLPDLQRILSYLPKSRQTLLFSATFSPEIKKLANSYLQDPILVETARPNATASTVEQRFYRVEDDDKRNAVKQLLRTRAITQSIVFVNSKLGAARLARAFERDGLRTQALHGDKSQDERLKALAAFKAGEVDLLVATDVAARGLDIADLPAVFNFDVPFNAEDYVHRIGRTGRAGASGLAITLVSRDDARLVSDIEKLIKKKLDIEALELEDDRPRRAPRRDDGERDVVRREDDGRRTSAAAAGDRPAPARRPTPPAAPSDPFFSQPYEAQAGIEPVWEKSAAQASAPSSGLSRYIKAKKRVASLLGGK

SEQ ID NO: 38937 - DNA, 1422 bp, Rubrivivax gelatinosus PM1
  CDS (1)..(1422)
atgtctctgcccctctcgaaagacgccccgtccggcgcacctcccctgcccttcagccagctgccgctggcgcccgccgtgctggccaatctggagcagctcggctaccacagcatgacgccggtccaggccgccacactgccgatcgcactggcgggccgcgacctgatcgcccaggccaagaccgggagcggcaagacggctgccttcgccctggcccttctggcgcggctcgatccgcgccgcctcgacgtgcagagcctggtgctgtgcccgacgcgcgaactcgccgaccaggtgacgcaggaactgcgccgcctggctcgcagtcaagagaacaccaagatcctcacgctgtgcggcggcgccacgatgcgcccgcaactggccagcctgcagcacggcgcgcacatcgtcgtcggcacgccaggtcgcatcatcgaccacctggagcgcggcagcctcgcgctcgcctcgctgaacacactggtgctcgacgaagccgaccgcatgctcgacatgggcttcttcgacgacatcgctgccgtcgcccgccattgcccaccgcagcgccagacactgctgttctcggccacctacccggacggcatcgcccggctgagcgcgcagttcctgcgccagcccgagcatgtccggctcgaatcgcagcaggacgcaggcaagatccgccagcgcttctacgaggtgacggaagagcagcgcctgcacgcggtcggactgctgctcgaccacttccgccccgccagcacgctggcgttctgcaacaccaaacagcagtgtcgcgacctggtggccgtgctgagcgcgcaaggcgtgcaggcgctggcgctgcacggcgatctggagcagcgcgaacgggaccaggtgctgatgcagttcgcgaaccgcagctgttcggtgctggtggccaccgacgtcgccgcgcgcggcctcgatgtcgagcaactcgaagcggtcgtcaacgtcgacatctcgcccgacccggaagtgcacatccaccgcatcggccgtaccggccgcgccgatcaggccgggtgggcgctcagcctggcgacgctcgacgaaatgcccagcgtggcgaagatcgatcagttgcaggaccgggaatcggaatggcacccgctgagcgaactcacgccgtccggcgccgggcccctggtgcctccgatggtcacgctgcagattctgggcggccgcaaggagaagatccgtcccggcgacgtgctgggcgcgctgaccggcgacgccggtctggccgccgcccagatcggcaagatcaacgtcaccgaattctcgacctacgtggccgtcgagcgcagcatcgccaaggaggcgctgcgcaagctcgacggcggccgggtcaagggcaagaagatcaaggcacgcagccttcaggcatga

SEQ ID NO: 38938 - protein, 473 aa, Rubrivivax gelatinosus PM1
MSLPLSKDAPSGAPPLPFSQLPLAPAVLANLEQLGYHSMTPVQAATLPIALAGRDLIAQAKTGSGKTAAFALALLARLDPRRLDVQSLVLCPTRELADQVTQELRRLARSQENTKILTLCGGATMRPQLASLQHGAHIVVGTPGRIIDHLERGSLALASLNTLVLDEADRMLDMGFFDDIAAVARHCPPQRQTLLFSATYPDGIARLSAQFLRQPEHVRLESQQDAGKIRQRFYEVTEEQRLHAVGLLLDHFRPASTLAFCNTKQQCRDLVAVLSAQGVQALALHGDLEQRERDQVLMQFANRSCSVLVATDVAARGLDVEQLEAVVNVDISPDPEVHIHRIGRTGRADQAGWALSLATLDEMPSVAKIDQLQDRESEWHPLSELTPSGAGPLVPPMVTLQILGGRKEKIRPGDVLGALTGDAGLAAAQIGKINVTEFSTYVAVERSIAKEALRKLDGGRVKGKKIKARSLQA

SEQ ID NO: 38939 - DNA, 1182 bp, Rhodospirillum rubrum
  CDS (1)..(1182)
atgaccgaatttgcttcgctcgacttgatcgagccgcttgcccgcgccgtcacggcgctgggctataccgttgcgactcccattcaggcgggggctatccctccgcagctgttgggacgcgacgtgctgggcattgcccaaaccgggaccggcaagaccgcgtccttcgtcctgcccctgcttcagcgcctgaccaaggacccccagccccgggttcccggccggccgcgcgcccttatcctgacgccgacccgcgaactggcccagcagatcaccgaaagcatcggcgaccttggccggacgctgtcggccattcgctgcggcgtggtggttggcggggtcgatatcctgcgccagacccgcatggttcagcgcggcttggaaatcctggtggcgacgcccggccgcctgcaagatctgatgaaccgcaaggccgtcgacctgcgcgccatcgaagttctggtgcttgacgaagccgaccgcatgctcgacatgggcttcgcccccgccgtcaagaagatcgccgccgttctgccgcgcaagcgccagacggtgatgttctcggccaccctgcccaatgaagtgaccgggctggtcgccagcctgatgaacgatccggtgcgcgttgaagtcgctccggcggccagcgtcgccaatcgcatcgaccagcgcgtgctgttcgtcgaacagaccaacaagcgtaagctgttgcttgatctgctcggcgacgcccgcaaggtcgaacgcgccatcgtcttcacccgcaccaagcacggcgccaacaagctgggcatcttcttgctggaatacggcgtcaaaagcgacgtgatccacggcaacaagtcgcaaggcgcccgtcagcgcgcgcttaacgacttcaagtcgggcaaggtccgcgccctggtcgccaccgatatcgccgcgcgcggcatcgatgtcgacggcatcacccatgtcatcaacttcgacctgcccaacgagcccgagagctacgtccaccgcatcggccgcacggcgcgggccggcgccgcgggcatcgcgctttcgctctgcgccccccaggaaatgccctatctgaaggcgatcgaaaaggtcatcaaaagccggatcgacgtggattccacccacgccttccatacgccgtcgatggcccgcgcccacggcagccacggccaccgttaa

SEQ ID NO: 38940 - protein, 393 aa, Rhodospirillum rubrum
MTEFASLDLIEPLARAVTALGYTVATPIQAGAIPPQLLGRDVLGIAQTGTGKTASFVLPLLQRLTKDPQPRVPGRPRALILTPTRELAQQITESIGDLGRTLSAIRCGVVVGGVDILRQTRMVQRGLEILVATPGRLQDLMNRKAVDLRAIEVLVLDEADRMLDMGFAPAVKKIAAVLPRKRQTVMFSATLPNEVTGLVASLMNDPVRVEVAPAASVANRIDQRVLFVEQTNKRKLLLDLLGDARKVERAIVFTRTKHGANKLGIFLLEYGVKSDVIHGNKSQGARQRALNDFKSGKVRALVATDIAARGIDVDGITHVINFDLPNEPESYVHRIGRTARAGAAGIALSLCAPQEMPYLKAIEKVIKSRIDVDSTHAFHTPSMARAHGSHGHR

SEQ ID NO: 38941 - DNA, 2034 bp, Rhodospirillum rubrum
  CDS (1)..(2034)
atggactttttccccgcgggtcatccgctgacccaagccttgatcgagcgtaactacaccgaacccaccgccgtgcagacggcggttctcgaacccggggcccagggtcgcgacctgctggtgtcggcccagaccggatcgggcaagaccgtggcctatggtctggcgatcgccagcaccctgcttggcgacgaggctgtgctggagccggcgaccgagccgctggccctgatcgtcgcccccacccgcgagctggccttgcaggtccatcgcgagctggcgtggctttatggccatgccggggccaaggtggtgtcgtgcgtgggcggcatggatccccgcgccgaaacccggcgtctgggcgagggctgtcatatcgtcgtcggtactcccgggcgtttgcgcgaccacctggagcgcggcaacctcgccgtcggccggctgaaggcggtggtgctcgacgaagccgacgagatgcttgatctggggttccgcgaggatctggaattccttctggaggcgacgccccaggagcgccgcaccctgttgttctcggccaccttgcccaaggccatcgtcaccctggccaagcgctatcagcgcgaggcctggcgtatcgccgtggcggcgggcaagcagggccatgccgatatcgaataccgcgcgatcagcgtcgctcccaacgaggtcgagcacgcggtggtcaatctgctgcgctatgtcgaatcgcccgccaccttggtgttctgcaacacccgcgagtcggtgcgccacctgcaggccattttgctcgaacgcggtttcgccgccgtcgccctgtcgggcgaactgggtcagggcgagcgcaatcaggcccttcaggccctgcgtgacggtcgcgcccgggtctgcgtcgccaccgacgtggcggcgcgcggcatcgatctgcccaatatcgggctggtcatccatgccgagctgccccagaacgcccaaaccctgcagcaccgcagcggccgcaccggccgcgccggacgcaaggggatcagcgtgcttttggtgctgttctcgcgcaagcgccgcgctgaacagcttttggaaaccgccggcgtgcgcgcccaatggggcggcgccccctcggccgacgatatccgggcgcttgatcaggaacgcctgctgcaaagcccgctggtcagcgaggatctgaccgaggacgatctggcgatggccaaggcccttttggcggtgcgctcgcccgaggagatcgccgccgccctggtgcgcatgtaccgcgcccagttgcccgccgccgaggatgtgttcgccgccggaaccgccgagccttcgcccgagccgcgcgctcggcgtccggcgtcgcgcgatcgtgaccgcgatggcgagcgcgagccgatgaccgagccgcgcccgggacggaactcggggctgtcgggccccagcgtctgcttccgcttgaatgtcgggcggcagaagaacgccgatccgcgctggctggtgccgatgatctgccgcctgggtaagatcaccaagcaggagatcggcgcgatcagcatcttcgaacgcgacaccaagatcgaaatcgccgctgccttcgccgaacgcttcatcgccgccgtcggtcaggtcgagcgcggcgatatccgcatcgatccctgggtcgagaccagccgtagcaagccggtcgacgccctggaggtggccacggccggcgacgaggcggccgctgcggcgccccgcgccagcgcgccccgcgcgccccgcgccagtgaaccccgggtgacgaagccctatgagccgcgcgccccgcgatcgaccgaaccgcgcgcgccgcgtgccgcccgcagcgccgatcgcccgaccgaggcccgcgccccgcgcacggcggagccccgcccgccgcgggcgagcgaccgcgccagcgaaccgcgcgccgccaaggcgccgcgccgcacggaaaagccggctgttggcaaggcgatggtcaagacttggggcaagcccaagccgggcagccgtcccaagaccaagcagaaataa

SEQ ID NO: 38942 - protein, 677 aa, Rhodospirillum rubrum
MDFFPAGHPLTQALIERNYTEPTAVQTAVLEPGAQGRDLLVSAQTGSGKTVAYGLAIASTLLGDEAVLEPATEPLALIVAPTRELALQVHRELAWLYGHAGAKVVSCVGGMDPRAETRRLGEGCHIVVGTPGRLRDHLERGNLAVGRLKAVVLDEADEMLDLGFREDLEFLLEATPQERRTLLFSATLPKAIVTLAKRYQREAWRIAVAAGKQGHADIEYRAISVAPNEVEHAVVNLLRYVESPATLVFCNTRESVRHLQAILLERGFAAVALSGELGQGERNQALQALRDGRARVCVATDVAARGIDLPNIGLVIHAELPQNAQTLQHRSGRTGRAGRKGISVLLVLFSRKRRAEQLLETAGVRAQWGGAPSADDIRALDQERLLQSPLVSEDLTEDDLAMAKALLAVRSPEEIAAALVRMYRAQLPAAEDVFAAGTAEPSPEPRARRPASRDRDRDGEREPMTEPRPGRNSGLSGPSVCFRLNVGRQKNADPRWLVPMICRLGKITKQEIGAISIFERDTKIEIAAAFAERFIAAVGQVERGDIRIDPWVETSRSKPVDALEVATAGDEAAAAAPRASAPRAPRASEPRVTKPYEPRAPRSTEPRAPRAARSADRPTEARAPRTAEPRPPRASDRASEPRAAKAPRRTEKPAVGKAMVKTWGKPKPGSRPKTKQK

SEQ ID NO: 38943 - DNA, 1905 bp, Ralstonia metallidurans CH34
  CDS (1)..(1905)
atgacccagcacgatttccgtgcggagcagcctattgcctccgccaccgacgcattcgccacgcccgccgatgccgccagcccgctcgacaagctcgacgccatgctgaacgctgacgccgcaccggccgtggaggcctcggaaaacggcttcgcaaaactcggcctcgacgccgctatcctgcgcgcactggccgaagccaactacaacacaccgacaccggtgcaggcgcaggccatccccgccttcctggccggccgcgacctgctggtttccagccagaccggctcgggcaagaccgccgcgttcatgctgcccgcaatccagcgcatcagcgaaaagccggccacgcatcgtccgaccgaaccggccaagcgcatgaagggcaagcgcccccgtccgtctccggcccagccgtcgctgctggtgctgacgccgacgcgtgaactggccctgcaggtaaccgaagccgccgccaagtatggccgccatctgcgccgtatcgtctgcgccagcatcctgggcggcatgccctacccgaagcaactggccatgctggcccgtatgccggacatcctcgtggccacgccgggccgcctgctcgaccatatcgaagccggccgcattgacctgtccgcgctggaaatgctggtgttcgacgaagccgaccgtatgctcgacatgggcttcgccgacgacatcgacgccatcgttgccgccacgccggcatcgcgccagacgctgatgttctcggccacgctcgacgcccgcatcgcccaactggcctcgcgccagctccgcgacccgcagcgcatcgaaatcgccgccgcgcgcgccgaccacagcaacatcgaacagcgcctgcacttcaccgacgacatgtcgcacaaggagcgcctgctcgaccacctgctgcgcgatgcatcgctcaagcaagccatcgtcttcaccgctaccaagcgcgatgccgattcgctggccgagcgcctgtcggacaccggcttctccgccggcgcgctgcatggcgacatgactcagggcgcgcgtaaccgcacgctgacggccctgcgccgtggcaacctgcgcgtgctggtggccaccgacgtggccgcgcgcggcatcgacgtgcccgacattacccacgtggtgaacttcgacctgcccaagcaggcggaagactacgtgcaccgcattggccgtaccggccgtgccggtcgctcgggtgtggcgatcaacctcgtgaaccacggtgacatgttccagtggcgccgtatcgagcgcttcacgaacaaccgcatcgacgcctcggtgatcgagggcttcgaaccgcgtcgctcgccgaagccgcgctcgaacttcggcggcaagccgggcggccgcgacggcttccgcggcaacggtggcaccggtggcggctatcgcggcaacaacggcagcggtggctatcgcggtaaccgcgaaggtagcggcgaccgcaacttcggcgagcgccgattcagcagcgacaaccgtggtttcggcgatcgcgccccgcgtccgttcggcgacgacaaccgtggtggcttcggcgatcgtggtgagcgtggtttcggcgaccgtagcaatggcaatagcaatggcggctaccgtggtcaaggtcaaggccagggtcaaggccaagctcagcagcgcagctttggtggcgaacgcagcttcggcaaccgcgacttcgcacagcgcgatggcaaccgtgacgccacgcaacgtgacggtaaccgcagctttggcggcaaccgtgacggccagcgcgacggcaaccgtagctttggcgatcgcagcttcggcgaccgcaagttcggtgaccgcggtggcgatcgcggcggcttcggcggccagcgcaacagccgctcgcgttacgagcgataa

SEQ ID NO: 38944 - protein, 634 aa, Ralstonia metallidurans CH34
MTQHDFRAEQPIASATDAFATPADAASPLDKLDAMLNADAAPAVEASENGFAKLGLDAAILRALAEANYNTPTPVQAQAIPAFLAGRDLLVSSQTGSGKTAAFMLPAIQRISEKPATHRPTEPAKRMKGKRPRPSPAQPSLLVLTPTRELALQVTEAAAKYGRHLRRIVCASILGGMPYPKQLAMLARMPDILVATPGRLLDHIEAGRIDLSALEMLVFDEADRMLDMGFADDIDAIVAATPASRQTLMFSATLDARIAQLASRQLRDPQRIEIAAARADHSNIEQRLHFTDDMSHKERLLDHLLRDASLKQAIVFTATKRDADSLAERLSDTGFSAGALHGDMTQGARNRTLTALRRGNLRVLVATDVAARGIDVPDITHVVNFDLPKQAEDYVHRIGRTGRAGRSGVAINLVNHGDMFQWRRIERFTNNRIDASVIEGFEPRRSPKPRSNFGGKPGGRDGFRGNGGTGGGYRGNNGSGGYRGNREGSGDRNFGERRFSSDNRGFGDRAPRPFGDDNRGGFGDRGERGFGDRSNGNSNGGYRGQGQGQGQGQAQQRSFGGERSFGNRDFAQRDGNRDATQRDGNRSFGGNRDGQRDGNRSFGDRSFGDRKFGDRGGDRGGFGGQRNSRSRYER

SEQ ID NO: 38945 - DNA, 1476 bp, Burkholderia fungorum LB400
  CDS (1)..(1476)
atgtccgacacacccgtcacgcccagcacttcgacttttgatcaattcggcctcgcgcccgacatcctgaaagccgtcaaagagtcgggctacaccatccccacgccgatccaggagcaggcgattcccgtcgtgctggccggccgtgacatgatgggcgccgcgcaaaccggcaccggcaagaccgcgagcttctcgctgccgatcatccagcgcctgctgccgcaggcgagcacgagcgcttcgcccgcccgccatccggtgcgcgcgctgatcctcacgccgacccgcgagttggccgaccaggtcgccgcgaacgtgcaggcctatgcgaagcacacggcgctgcgcagcgccgtggtgttcggcggggtggatatgaatccgcaatccgagcaactgcgccgcggcgtcgagattctgatcgccacgccgggccgcctgctcgatcatgtgcagcagaaaaccgccaacctgggccaggtgcagattctcgtgctcgacgaagccgaccgcatgctcgacatgggtttcctgccggatctgcagcgcattctgaacctgctgccgaaagaacgtcagacgctgctgttttcggccaccttctcgggcgaaatcaagaagctcgccgccacctatctgcgcgacccgcagactatcgaagtcgcgcgcagcaattcgactgcgaccaacgtgaggcagatcgtctatgaagtcgccgagggcgacaagaccggcgcggtcgtgcaactgattcgcgagcgcggcctcaagcaggttatcgtgttctgcaacagcaagatcggcgcgagccgtctctcgcgcagcctggagcgcgacggcgtgatcgcgaccgcgattcacggcgaccgctcgcagaatgaacggatgcaggcgctcgacgcgttcaagcgcggcgagatcgaagcgctggtggcaacagatgtcgccgcgcgcggcctggatatcgccgaactgccggcggtgatcaacttcgatctgcccttcaacgcggaagactacgtgcatcggatcggccgtaccggccgcgcgggcgcctcgggcgacgcgttgtcgctgtgcagcccgaacgagcgcaagcagcttgccgatatcgaaaagctgatcaagcgcccgctggaggtgcagcgcctgacggtggaagcgccggtgcggcatcaccatgaagagcgcgcgccgcggcgcgagcgtagcagcgaggggcgcgaagatcggggcggccgccgccgctcgggcgcttcgtcgtcgggttcgttcgaccggccgcatcatcatcgcgcgcagcctgtggatgatttcttcctgaagccttatgagccgtcgcctgcttcggtgcgcaaggtcgaggaggccgacgcggcttcggccgcgccgcagaagccggcttccaagcagccgttggcagcgctgttgggcgggttcggcatgccgagaaagtcgccttcgtcttcctga

SEQ ID NO: 38946 - protein, 491 aa, Burkholderia fungorum LB400
MSDTPVTPSTSTFDQFGLAPDILKAVKESGYTIPTPIQEQAIPVVLAGRDMMGAAQTGTGKTASFSLPIIQRLLPQASTSASPARHPVRALILTPTRELADQVAANVQAYAKHTALRSAVVFGGVDMNPQSEQLRRGVEILIATPGRLLDHVQQKTANLGQVQILVLDEADRMLDMGFLPDLQRILNLLPKERQTLLFSATFSGEIKKLAATYLRDPQTIEVARSNSTATNVRQIVYEVAEGDKTGAVVQLIRERGLKQVIVFCNSKIGASRLSRSLERDGVIATAIHGDRSQNERMQALDAFKRGEIEALVATDVAARGLDIAELPAVINFDLPFNAEDYVHRIGRTGRAGASGDALSLCSPNERKQLADIEKLIKRPLEVQRLTVEAPVRHHHEERAPRRERSSEGREDRGGRRRSGASSSGSFDRPHHHRAQPVDDFFLKPYEPSPASVRKVEEADAASAAPQKPASKQPLAALLGGFGMPRKSPSSS

SEQ ID NO: 38947 - DNA, 1512 bp, Thermobifida fusca
  CDS (1)..(1512)
atggaggcatcgaccctgaccactgtcagaagtacgcacagttcagatcagaccacttttcgcgatctcggcgtcatcgacgacatcgccgacgccttggaagccgagggcatcgtcgcccccttccccatccagtccatggccctgcccttggcactgaccggcgccgacatcatcggacaggcgcgcaccggaaccggtaagacgttcgctttcgggctcccgctgcttcagcgggtccacacacagcccggatcagccaagcgcccccgcgcgctcgtggtggtgccgacccgggaactcgcgatccaggtggccgcggacctggccacggcaagcaaacgcatcgacgtgcggatcgccaccgtgtacgggggacgcgcctacgagccgcagatctctgccctgcgcaagggtgtcgacatcgtcgtgggcaccccggggcgcctcctggacttggtgaagcagcgccacctgatcctgtccgaggtgaccgcgctcgtcctggacgaagccgacaagatgctcgacctcggcttcctgcccgacattgaacggatcctcgcgaaaacccctgaccagcggcagaccatgctgttctcggcgacaatgccgagcgaaatcgtggcgctgtcccgcaaatacctgcgccgccccacccacatccgcgctgaagacgatcccctcgacaccggttccggccaggtcacccagcatgtcttccgcacccatccgctggacaagctggaaatgctggcccgcctgctccaggcgcgcaaccggggcctgaccatggtgttctgccagaccaaacgggaatgccaccacgtctccacggagctgtgccgccgcgggttcgctgccgcagccgtccacggcgacctggggcaaggccagcgggagcgggcgctgcgcgcgttccgcaacggcaaagtcgacgtgctggttgccaccgacgtggccgcccggggcatcgacgtggacgacgtgacgcacgtggtcaactacgagtgccccgacgacgagaagacctacacgcaccgcatcggccggaccggccgggcgggacggtccgggaccgctgtcacgttcatcgactggcaggaactcctgcggtggaagctgatcaaccgggcgttggggctgcctttcgctgacccgccggagacctactccacgtcgccgcacttcttcgacgctctcgacattccgcgggacgccaagggagtgctcgccaaggaggagcaggaccgggccggtctggcagcggaagaagtagaggacatcggggagaccgggcgggcctcccgcaccaaggaccgggagcgttcgcggcagcgccggtcccggccccggaaacgcacccggcgtggcgtccccacgacccgctcagctgcggagcccaccggtgagaccgcagcgaaaagcgacgcggactcgtctgcccgcacccgtcggcgcacacgccgccgcagtcgccggaacgccgggacgaacagcgaccgcgcctaa

SEQ ID NO: 38948 - protein, 503 aa, Thermobifida fusca
MEASTLTTVRSTHSSDQTTFRDLGVIDDIADALEAEGIVAPFPIQSMALPLALTGADIIGQARTGTGKTFAFGLPLLQRVHTQPGSAKRPRALVVVPTRELAIQVAADLATASKRIDVRIATVYGGRAYEPQISALRKGVDIVVGTPGRLLDLVKQRHLILSEVTALVLDEADKMLDLGFLPDIERILAKTPDQRQTMLFSATMPSEIVALSRKYLRRPTHIRAEDDPLDTGSGQVTQHVFRTHPLDKLEMLARLLQARNRGLTMVFCQTKRECHHVSTELCRRGFAAAAVHGDLGQGQRERALRAFRNGKVDVLVATDVAARGIDVDDVTHVVNYECPDDEKTYTHRIGRTGRAGRSGTAVTFIDWQELLRWKLINRALGLPFADPPETYSTSPHFFDALDIPRDAKGVLAKEEQDRAGLAAEEVEDIGETGRASRTKDRERSRQRRSRPRKRTRRGVPTTRSAAEPTGETAAKSDADSSARTRRRTRRRSRRNAGTNSDRA

SEQ ID NO: 38949 - DNA, 1713 bp, Thermobifida fusca
  CDS (1)..(1713)
atgttcagcgacgaggagccgcaattgacggagaagaccattacagaacagtttagtttcgccgaccttggcctccggccggaactgctcgatgccctcgccgaggtcggctacgaggagcccacggccatccaacgcgaggcgatcccctcgctgttggaaggccgtgacctgctcggccaggccgcaaccggtacggggaagaccgcagccttctccctgccgatcctgcaccggctgccggacagcgaccgcggggacactccctcggcgctcatcctggtgcccacccgggaactggccttgcaagtatcggaagcactccaccgctacggccgccacctgaaggcacgcatcctccccatctacggcggccagcccatcggccgccagttgcgggccctggaacgcggtgtcgacgtcgtcgtcgccaccccgggacgggccctcgaccacatcggccgcggcaccctcgtcctggacacggtgcgcacggtcgtcttggacgaagccgacgagatgctcgacatgggcttcgccgaagacatcgaggcgatcatcgaagaagtgccggagaaccgccagacagtgctgttctcggcaaccatgcccgaccgcatcgaaggcatcgcccgacgccacctcaccgacccggtgcgcgtacgcatcgcccgcacttctcccgcacccggagaagagccgaaagtccggcagaacgcctacatcgtggcccgcccctacaaacccgcggccctgggacgcgtcctcgacatggaatcccccaccgcggccctcgtgttctgccgcacccgtgaggaagtcgaccagctcaccgagacgctcaacgctcggggataccgcgctgaagcgctccacggcggcatgagccaggaacagcgcgaccgggtcatggcgcgcctccgcggaggaaccgccgacctcctcatcgccacggacgtcgccgcccgcggactcgacatcgaacacctcacccacgtggtcaactacaatgtgccgtcggcaaccgaaacctacgtgcaccgcatcggccgcgtggggcgggccggccgagaaggcgtcgcgatcaccctcgtcgagccgcgggaacaccggatgctcaaaaccattcagcgcagcacgagcggcccgatcagcgtcgagaagctccccaccgtcgcggacctgcgggcccgccgcgtcgaactgacccgtgctgcgctccacgaagctctgaaggaggaggacgacgaccgcgaggcgttccgcgtggtcgtggagtcgctcgccgaagagttcgacatcatggagatcgcgctggccgcggtgaaactggcgcatgaagccagcggcgccgtcaccgaagaggaggagatccccgaaccggtgctccgccccgagcggagcgaacgccgcgaacgccgtggacggcgcggcggaccgggccgcggtgaacggcgcggccgaggcccctccgacggcatgacccgcctcttcgtcggcattggacgcaacgcccgggtccgcccccaagaccttgtgggagcgatcgccggggagaccgcattgagcggacgggacatcggcgcgatcgaaatcgccgaccgcttctccctggtggaagtgcccgaatccactgccgacggtgtgatcgcggcactgaagaaaagcacgattaaaggacgccgcaccgtcgtacgccgcgaacgcttctaa

SEQ ID NO: 38950 - protein, 570 aa, Thermobifida fusca
MFSDEEPQLTEKTITEQFSFADLGLRPELLDALAEVGYEEPTAIQREAIPSLLEGRDLLGQAATGTGKTAAFSLPILHRLPDSDRGDTPSALILVPTRELALQVSEALHRYGRHLKARILPIYGGQPIGRQLRALERGVDVVVATPGRALDHIGRGTLVLDTVRTVVLDEADEMLDMGFAEDIEAIIEEVPENRQTVLFSATMPDRIEGIARRHLTDPVRVRIARTSPAPGEEPKVRQNAYIVARPYKPAALGRVLDMESPTAALVFCRTREEVDQLTETLNARGYRAEALHGGMSQEQRDRVMARLRGGTADLLIATDVAARGLDIEHLTHVVNYNVPSATETYVHRIGRVGRAGREGVAITLVEPREHRMLKTIQRSTSGPISVEKLPTVADLRARRVELTRAALHEALKEEDDDREAFRVVVESLAEEFDIMEIALAAVKLAHEASGAVTEEEEIPEPVLRPERSERRERRGRRGGPGRGERRGRGPSDGMTRLFVGIGRNARVRPQDLVGAIAGETALSGRDIGAIEIADRFSLVEVPESTADGVIAALKKSTIKGRRTVVRRERF

SEQ ID NO: 38951 - DNA, 1740 bp, Methanosarcina barkeri str. fusaro
  CDS (1)..(1740)
atggaaaaattagcaaaatttaaggcattggggctttcagacagtatgttaaaagcccttaaaaagaaagggtttgaagaaccaaccccaattcaggaaaaagtcatcccgctttttttgaaaggagaatgtgatattatagggcaggctcagaccggaaccgggaaaacaacggctttcggagcccccattatagaaaaaattccggaaaaatcaggaaaggtgcaggctatagtcctgaccccgactcgagaattagcaatccaggtctcagaagaacttaactctctgaaaggagacaaaaagctgcatattgtcccgatttatgggggacagtccatgacccagcagttcagaatgctgaaaagcggagttgatattgtcgtgggaactccaggaagggtcatcgatcaccttgagcggaagagcttgaatcttgagaacattgcttatttcgtactggatgaagctgatgaaatgctcaatatgggctttattgatgatattaaggaaatcttaaaggcaactgggcctgataagagaatgcttttcttttcagctacaatgccaaagcctatccttggcatcatcaagaaacacatgaagaactatgaatatgttgctattaagaaagaagatcttgatgtgaaccttactgagcagatttatttcgaagtcaaggaaagcgacaaatttgaagccctgtgcaggattatcgatattgaagacgaattctacgggcttgtgttctgcagaacaaaaaccgatacctcccaacttgcccagaagcttggagaccggggatatgcagccgatgctctgcacggtgatctttcccagcgtgaaagggaaaagatactgaacaggttcagaaaacaaaagattaacatcctcgtagcaaccgatgttgcagctcgaggtatcgatatcatggacctgacccacgtaattaactattctcttccgcaagaccccgagtcttacgtacacaggataggaagaaccggtagggcaggaaagcagggaactgcaattactttcgttacatctacggaatacaggcggctcacatacataaaaaagacttcaaaatccgcaatgaagaggggccgaattcctgagataaaagatgtaattaaagctaaaagggcaagagtaaaagccgaactcgaagaaactataaaaaacgaggagtacggagactgtcttgagatgagtgaaaagttccttgaagaatacccggccgagaaaatcctggctgctctcctgaagtactctttcaaagagatgttcgacgaaagcatgtacacagagatctccggaagttcatatgtcgaccggaaaggcaaaaccaggcttttcatcgcaatgggaaaagctgacggcatgacccctgagaagctctgcgagtttatacaggaagaaaccggagtaagcgaccttaaaataagggatgcagaaattttcccgcacttctccttcgtaactgtaccttttgcccaggcttcagccctgcttgaaatcttcaaagacaaaaagagaggtcgaaaaccctttatagagcttgcccagaaatcaaagagaagaagctcaaagagtgcggatgaatatcgtggtggcactcgtaatggctccaggagttattctagaaatgactcctggaatggctctcgcaatacgaacagcaaaagttatacaagagatacacgaactgcgaagaaaaaatattcttcgtactaa

SEQ ID NO: 38952 - protein, 579 aa, Methanosarcina barkeri str. fusaro
MEKLAKFKALGLSDSMLKALKKKGFEEPTPIQEKVIPLFLKGECDIIGQAQTGTGKTTAFGAPIIEKIPEKSGKVQAIVLTPTRELAIQVSEELNSLKGDKKLHIVPIYGGQSMTQQFRMLKSGVDIVVGTPGRVIDHLERKSLNLENIAYFVLDEADEMLNMGFIDDIKEILKATGPDKRMLFFSATMPKPILGIIKKHMKNYEYVAIKKEDLDVNLTEQIYFEVKESDKFEALCRIIDIEDEFYGLVFCRTKTDTSQLAQKLGDRGYAADALHGDLSQREREKILNRFRKQKINILVATDVAARGIDIMDLTHVINYSLPQDPESYVHRIGRTGRAGKQGTAITFVTSTEYRRLTYIKKTSKSAMKRGRIPEIKDVIKAKRARVKAELEETIKNEEYGDCLEMSEKFLEEYPAEKILAALLKYSFKEMFDESMYTEISGSSYVDRKGKTRLFIAMGKADGMTPEKLCEFIQEETGVSDLKIRDAEIFPHFSFVTVPFAQASALLEIFKDKKRGRKPFIELAQKSKRRSSKSADEYRGGTRNGSRSYSRNDSWNGSRNTNSKSYTRDTRTAKKKYSSY

SEQ ID NO: 38953 - DNA, 1359 bp, Geobacter metallireducens GS-15
  CDS (1)..(1359)
atgacgtttgctgaactgaacctcctcccccccattctcaaggcggtcgccgcctgcggctacaccgacccgaccccgatccaggcccaggcgattcccagggcactggagggccgcgaccttctcgccacggcccagaccggcaccggcaagaccgcagcctttgtccttccagccctccagcgtctggctcggccggcccaaaagcccggtcggggaccccgcgtcctggtcctcacccccacccgggaactggcccaacaggtaaccgacgcggtccgctcctacggtaagttcctgcggatacgcagcggcgccatccttggcggcatgccctaccgggagcagctccggctcctctcggcgccggtggacctgatcgtggccacaccggggcgcctcgtggacctgctggaccggagaagcctcgacctctcccgcctggagttgctgattctcgacgaggcagaccggatgctcgacatgggtttcagcgatgatgtcgaccgggtcgccgccgcctccccctccgaccgccagaccctcctcttcaccgccaccatggacgccaccatggcgcgcctggcggggcggctcctgaacgaaccggagcgcatcgaggtcgcgggcaccaagacgacccatgagcatatcgagcagcgcctccacgtggctgacgacctctcccacaagaacaggctgcttcagcatctgatcaccgatggcgatgtccggaaggcgatcatcttctccgccaccaagcgcgatgccgaaaacatggctatcgaactcaggagccaggggcactccgccgcggcactccacggcgacatgccccagagtgcacgcaaccggaccatcgccgccatgaagcaggggagaatccggctcctggtggctactgacgtggcagcccggggcctcgacgtctccggcatcagccatgtgatcaacttcgacctgcctaaattcgccgaggattacgtccatcgcatcggccgcaccggccgggcaggggcatcggggatcgccatctccttcgcctccctcaatgaggtcagctacctggcccggatcgagcgctacatcggccaaacccttcccgagcaccagattccgggtctggagccccgccggccccttcaccgtgtttctaccggcaggggaagcaggccggggaactccaccggcggtccccggaaaagttacggaaaccgcgacgctgccaagacgggcggcaggcccggcaacgccaagcgttccccctggggcaagcacaccacttccaacggtccagtcgttgaatatcgcagctccaagggacgcgaggggagcggccaaccccgccgacagtcctga

SEQ ID NO: 38954 - protein, 452 aa, Geobacter metallireducens GS-15
MTFAELNLLPPILKAVAACGYTDPTPIQAQAIPRALEGRDLLATAQTGTGKTAAFVLPALQRLARPAQKPGRGPRVLVLTPTRELAQQVTDAVRSYGKFLRIRSGAILGGMPYREQLRLLSAPVDLIVATPGRLVDLLDRRSLDLSRLELLILDEADRMLDMGFSDDVDRVAAASPSDRQTLLFTATMDATMARLAGRLLNEPERIEVAGTKTTHEHIEQRLHVADDLSHKNRLLQHLITDGDVRKAIIFSATKRDAENMAIELRSQGHSAAALHGDMPQSARNRTIAAMKQGRIRLLVATDVAARGLDVSGISHVINFDLPKFAEDYVHRIGRTGRAGASGIAISFASLNEVSYLARIERYIGQTLPEHQIPGLEPRRPLHRVSTGRGSRPGNSTGGPRKSYGNRDAAKTGGRPGNAKRSPWGKHTTSNGPVVEYRSSKGREGSGQPRRQS

SEQ ID NO: 38955 - DNA, 1395 bp, Novosphingobium aromaticivorans DSM 12444
  CDS (1)..(1395)
atgaagtttgccgacctcggcctctcggatgaattgctcaagtcggtactggacgccggctacgacgagccgactccgatccaggcgcaggccattcccgctgtcctcatgatgaaggacatcatcggcattgcccagaccggcaccggcaagaccgccggcttcgtgctgccgatgatcgacatcctcgcccacggacgccgacgcgcgttgatgccgcgctcgctgattctcgaacccacgcgcgaactggccgcccaggtcgccgagaacttcgaaaagtacggcaagaaccacgatctcaagatggcactgctcatcggcggcgtgcagatgggcgaccaggtcaaggcgctgcaggaaggcgtcgacgtgctgatcgccacgccgggccgtctgatggacctgttcgaacgcggcaagatcctcctcaccggctgcgagatgctggtgatcgacgaggctgaccgcatgctcgacatgggcttcatccccgatatcgagaacatctgctcgaagctgccgaccacgcgccagacgctgctgttctcggccaccatgccgccgccgatcaagaagctggccgacaagttcctgtcgaaccccaagtcgatcgaggtggcccgcccggcggcgaccaacaccaacatcgcccagttcaaggtccgcagcaccacccgccagaagcgcgaagtcctgcgccacctgctgcgcaccgacaacgtcagcaccgcgatcatcttcgccaaccgcaagacgaccgtgcgtgaactggccaagtccttgcagcgccacggctttgccgccggcgaaatccatggcgacatggaccagagcgcccgcaacgccgaactccagaagttcaaggacggcgaaatctcgatcctgtgcgcgtccgatgtcgccgcccgcgggctcgacgtgaagggcgtgagccacgtcttcaacttcgacacgccctggcatccggacgattacgtccaccgcgtcggccgcaccggtcgcggcggcgccaccggtcgcgccttcacgctggtctccgacgaggacagcgaatcgatcgagaacgtcgagaagctgcagggcaccaagatccccgagttcaaggtcgaactcccgggcaaggaagagcgcaagccgcgcgaatccggcgccgaacgcgacgaagagcccaagcgtggcagccgccgcgaacgccccgcgcgcgaggaacgcaagccccgcgccgaacgcgaatctcgccccgaacgcgaagcccgtccggaacgcgaagtccgcgccgaacgtgctccgcgccgcgagccgacgccctaccgcgaccagtccgagccgccgtcgaagcccggcgagtggaacggcccgatccccgagtttctggccgtctccgcgctctga

SEQ ID NO: 38956 - protein, 464 aa, Novosphingobium aromaticivorans DSM 12444
MKFADLGLSDELLKSVLDAGYDEPTPIQAQAIPAVLMMKDIIGIAQTGTGKTAGFVLPMIDILAHGRRRALMPRSLILEPTRELAAQVAENFEKYGKNHDLKMALLIGGVQMGDQVKALQEGVDVLIATPGRLMDLFERGKILLTGCEMLVIDEADRMLDMGFIPDIENICSKLPTTRQTLLFSATMPPPIKKLADKFLSNPKSIEVARPAATNTNIAQFKVRSTTRQKREVLRHLLRTDNVSTAIIFANRKTTVRELAKSLQRHGFAAGEIHGDMDQSARNAELQKFKDGEISILCASDVAARGLDVKGVSHVFNFDTPWHPDDYVHRVGRTGRGGATGRAFTLVSDEDSESIENVEKLQGTKIPEFKVELPGKEERKPRESGAERDEEPKRGSRRERPAREERKPRAERESRPEREARPEREVRAERAPRREPTPYRDQSEPPSKPGEWNGPIPEFLAVSAL

SEQ ID NO: 38957 - DNA, 1497 bp, Novosphingobium aromaticivorans DSM 12444
  CDS (1)..(1497)
atgtcgtatttttccgacctcggccttgccgaacccatcctgcgcgccctcgaaacgaagggctacaacgacccgacgccgatccagcgccaggccattcccgccctgctcgaaggccgcgaccttcttggcatcgcgcagaccggcaccggcaagaccgccgcgttcgcgctgccgtcgctccatcgccttgccgcgaacccgcagccacgcaagccggcctcgtgccgcatgctcgtcctctcgcccacgcgtgagctggccgcccagatcgcggacaacatgaagggctatgcccggaacctgaacctgatcgtcgattgcgtgttcggcggcgtgcccatcggcaagcaggcccgtcgcctggtgcccggcgtcgacattctcgtcgccacccccggccgcctgcttgacctgatcgacaaccgggcgctgacgcttggccgcaccgagatcttcgtgctcgacgaagccgaccagatgatggacctcggcttcatccatgcgctcaagcgcgtggcgaacctgctgcccaagacccgccagagcctgttcttctcggcgaccatgcccaaggccatcgaggacctcggcaagcagttcatcgtcaatcccgtgcgcgtcgaggtcgccccgaactcgaccaccgcagaacgcgtcgaacagtacgtcaccttcatcaaccaggccgagaagcaggcgctgctgaccctgcgcatccgcgatctgctcaagaccaaggaactcgaccgcgcgctggtgttcacccgcaccaagcacggcgcggaccgcgtcgtgcgccacctctcgtcggccggcatcgatgcccgcgcgatccacggcaacaagagccaggcgcagcgtaccgccgcgctcgaggccttccgccagggatcgtgcccggtcctcgtcgcgaccgacatcgcggcgcgcggcatcgacgtctcgggcgtgagccacgtgttcaacttcgaactgcccaacgtgcccgaacagtacgtccaccgcatcggtcgcaccgcgcgcgccggcgccgatggcatcgccatcagcttctgtgcgccggatgagaagccctatctcaaggacatcgagcgcctgaccagggtcaaggtcgacgccctccccctgcccgagaacttcaccgccgaagcggccaagctccccgcgccgagccgcaagccggccgagcaggagcaggacgcccgccgcgatgcgcgtgacgcgcgcggcaacggcggtcgcggcggacagggtcgcggccaggcccacggtggccgtgcccagggtcgcgacggccgcccgcgcgacgccagcccgcgccaggaccgccgcgaaggcgatcgcggtccggtgcgcaacccgctccacaccgaccgcaccgaccgccccgagcgtatcgagggcgagcgtgacggcaacaagccgcgccgcttccgtccgcgcggcgcccccggcgtcggcgcgcaccgcaacaaggtccgccgcgcaagctga

SEQ ID NO: 38958 - protein, 498 aa, Novosphingobium aromaticivorans DSM 12444
MSYFSDLGLAEPILRALETKGYNDPTPIQRQAIPALLEGRDLLGIAQTGTGKTAAFALPSLHRLAANPQPRKPASCRMLVLSPTRELAAQIADNMKGYARNLNLIVDCVFGGVPIGKQARRLVPGVDILVATPGRLLDLIDNRALTLGRTEIFVLDEADQMMDLGFIHALKRVANLLPKTRQSLFFSATMPKAIEDLGKQFIVNPVRVEVAPNSTTAERVEQYVTFINQAEKQALLTLRIRDLLKTKELDRALVFTRTKHGADRVVRHLSSAGIDARAIHGNKSQAQRTAALEAFRQGSCPVLVATDIAARGIDVSGVSHVFNFELPNVPEQYVHRIGRTARAGADGIAISFCAPDEKPYLKDIERLTRVKVDALPLPENFTAEAAKLPAPSRKPAEQEQDARRDARDARGNGGRGGQGRGQAHGGRAQGRDGRPRDASPRQDRREGDRGPVRNPLHTDRTDRPERIEGERDGNKPRRFRPRGAPGVGAHRNKVRRAS

SEQ ID NO: 38959 - DNA, 1260 bp, Cytophaga hutchinsonii
  CDS (1)..(1260)
atgggctttaataaacccacaccgatccagacagaagcaatccctgtgattatgtcgaatagtgatctggtagcctgcgcacaaacaggcacaggcaagactgctgcatacatgcttcctatcttacataaaattattgaatcaaatacagatagtctggatacgctggttctagtaccaacgcgtgaacttgccatacagattgatcagcagatagaaggtttctcatacttcattaatgtgagctccattgctgtttatggcggtggtgatggtgcaacgtgggatcagcagcgcaaagcattgaccgatggtgccaacattgttattgcaaccccaggcagattgctggctcagttgcaatccggtacagcaaacttaaaacagatcaaacatcttgtactggatgaagccgatcgtatgctggacatgggtttttatgatgatattgtacgtgtaataagttatctgcctaccgagcgccaaactattatgttctctgcaaccatgcctacaaagatgcgtgcgttagcaaacaaactcatgaaagatccgcagcagatcaacattgcaatttctaaaccggcggaaggtattttacagcaagcatacctggtgtacgaagagcaaaaaaataaattaatcaaacacattctttcaagcggtaattttaacagcatcatcatcttttcttctacaaaggaacacgttaaaaaactcgaacgtgatttatccaatatgggcttctctttgaaaggttttcattcggatctggagcaggaagagcgtgaagagattatgcgcgcatttaaaagccgtcaattgcaaatgctgattggtactgacattctatcccgaggtattgatattgatggcattgatctggtgattaatgcggaagttccaggtgatgcagaaaattatattcaccgtattggccgtaccgctcgggcagcaacaacgggtacagccataacttttatcagcgataccgatcagtataaattcttgcagatcgaaaacctgatcggcagagaaattgaaaaattaaaaatcccgattgaaataggagaaggacctgcatacgaaccggagaaaaaacctaaatataacaacaaaggtttttcaaacaataaatctaaaagcggaagtaaaggtagtaatcgacctacaccgaaagaacattcaaaaccggtacaccgcgaaccaagtggtattaaacataccattgtaaaaaaacaaaatcctccacaggaataa

SEQ ID NO: 38960 - protein, 419 aa, Cytophaga hutchinsonii
MGFNKPTPIQTEAIPVIMSNSDLVACAQTGTGKTAAYMLPILHKIIESNTDSLDTLVLVPTRELAIQIDQQIEGFSYFINVSSIAVYGGGDGATWDQQRKALTDGANIVIATPGRLLAQLQSGTANLKQIKHLVLDEADRMLDMGFYDDIVRVISYLPTERQTIMFSATMPTKMRALANKLMKDPQQINIAISKPAEGILQQAYLVYEEQKNKLIKHILSSGNFNSIIIFSSTKEHVKKLERDLSNMGFSLKGFHSDLEQEEREEIMRAFKSRQLQMLIGTDILSRGIDIDGIDLVINAEVPGDAENYIHRIGRTARAATTGTAITFISDTDQYKFLQIENLIGREIEKLKIPIEIGEGPAYEPEKKPKYNNKGFSNNKSKSGSKGSNRPTPKEHSKPVHREPSGIKHTIVKKQNPPQE

SEQ ID NO: 38961 - DNA, 1743 bp, Cytophaga hutchinsonii
  CDS (1)..(1743)
atgttatttaaagaccttggattgtctcctgaagttgtggaggctatcgaatctattggctattctgaagccacgcctattcaggaaaaaacaattccaattttaatgacaggaaaagaccttacaggtcaggcacaaacgggtactggtaaaacagctgcctttggtattcctgctattgaacatgttgatatttctatcaaccaaacacaatccttaattctttgtcctacacgtgaacttgctttacaggtatgtacggaattaaaaaaactttctaaattcaaaaaaggtcttcgtgtacttgcagtatacggtggcgaatcgattgaaagacaaatccgcgatctgaaagcgggtgcgcatatcgttgtaggtacacctggccgtatcattgatcacctggacagacgtacattgaatgcttctcacctttctcagatcatcttagatgaagcggatgaaatgctgaacatgggtttcagagaagacatcgaattaatcttaacccgtttaccagaagaacgtcagactgtattattttctgcaacgcttgctcctcctatcctggcgcttgctaaacgtttccagaataatccggagatcattaaaattgaaagaaaagaattaacgatcagcacggttgaacaattctattacttagttaaaaactctcaaaaaacagaaattgttacacaaatcattgacctgaacaatcttcagttgatgttgatcttctgtaatacaaaaagaaaagttgaagaagttaccgatgaattaaaagcatacggacacaatccgatcagcttacacggtgataaaacacaacgcgacagaacagaagtaatgagcaaattccgtaagggattagccaatatccttgttgctacagatgttgcggcacgtggtattgacgttacaggtgttgatgcggttatcaactacgatgttccattggatattgaaaactacgttcaccgtatcggcagaacaggtagagcaggtcagttaggtaaatcattcacattggtaacaagtgatgagaaatataaattgagagacatcgaacgttatacaaaggcaacaattgaaaaagctgaaacgcctacacgtcaggaattagttgcttataaaaaagataaattagctacacgtattactactgaattagaaaaaccaaacattaaaatctggtctgatttattagaagaatataaagaaaaaggtattactgctgatcagattgcaattgcgttgctttctaaagaaatgaaagatcttgcagaacctgaacgcagagtatttgaagaccgtggcgatcgtcgtgatcgcggcgacagaggtgaccgtggcggtcgtttcgatcgtggtgacagaagagatggacctcgcagagatggccgttcttcagaccgtttcggagacagaccagctgcttcaagagaccgtgatggtggtgaaagacgtgaaagaacgccgagaccaagaacaagtgatgcaagtatggcacgtttattcgtaaacgttggacgtattgaccgcatctctcctggtgatatcgttggtgcatttgccggtgaggcaaacatcaaaggttctcagatcggacagatcgatatcttcgataaatattcattcgtggaacttccacatgacttagttgatcaggttatggacggaatgagaaacaataaaattaaaggaaaatcaatcaacatcgaaatttcgaacggtaagcaataa

SEQ ID NO: 38962 - protein, 580 aa, Cytophaga hutchinsonii
MLFKDLGLSPEVVEAIESIGYSEATPIQEKTIPILMTGKDLTGQAQTGTGKTAAFGIPAIEHVDISINQTQSLILCPTRELALQVCTELKKLSKFKKGLRVLAVYGGESIERQIRDLKAGAHIVVGTPGRIIDHLDRRTLNASHLSQIILDEADEMLNMGFREDIELILTRLPEERQTVLFSATLAPPILALAKRFQNNPEIIKIERKELTISTVEQFYYLVKNSQKTEIVTQIIDLNNLQLMLIFCNTKRKVEEVTDELKAYGHNPISLHGDKTQRDRTEVMSKFRKGLANILVATDVAARGIDVTGVDAVINYDVPLDIENYVHRIGRTGRAGQLGKSFTLVTSDEKYKLRDIERYTKATIEKAETPTRQELVAYKKDKLATRITTELEKPNIKIWSDLLEEYKEKGITADQIAIALLSKEMKDLAEPERRVFEDRGDRRDRGDRGDRGGRFDRGDRRDGPRRDGRSSDRFGDRPAASRDRDGGERRERTPRPRTSDASMARLFVNVGRIDRISPGDIVGAFAGEANIKGSQIGQIDIFDKYSFVELPHDLVDQVMDGMRNNKIKGKSINIEISNGKQ

SEQ ID NO: 38963 - DNA, 1395 bp, Microbulbifer degradans 2-40
  CDS (1)..(1395)
ttgtctgattcatccaataccgccttttcttctattggcctgcagccaggtttaatgcaaaacctagaatcgcttggctataacaccatgacgcccattcaagcccaaagtttaccgaatattattgccggtaaagatgtgatagggcagggtaaaactgggtcgggcaaaacggcggcatttgggttagggctgctgaatagtttggatgtaaagcgcttctacgtgcagagccttgtgctgtgcccaacccgagagctagccgatcaggtagcgaaagaaatccgacggcttgctcgcgccattcacaatatcaaagtgctcactttgtgcggaggtatgccctttggcccgcaaataggttcgctggagcacggtgcccatatagtagtgggtacccctggccgtgtagaagagcatgtacgtaaaaataatttagacctaagcaagctttctgtattggtgctggatgaagcagaccgcatgctagaaatggggtttcaggcagcgctagatgccattatagaaaccatgcctaagcagcgccaaacactgctttttagcgcaacgtttcctgaagagatacaagccatagccagtcgcataatgacggcaccagtaatgacgcaagttgaatctacgcacgataccagcacgattaagcagcgcttttacaaagttgataacgacgatcaacgtctattggcggtgcgcttacttctactgcaacacaaacctgaatctgccgtagtgttttgcaacaccaagcgcgaaacacaaatggtggccgatgatttagctggtcatggttttactgcgttggcattacatggtgatttggagcagcgcgatagagatttaaccctagtgcggtttgccaatggcagtgccaccgtgttggtagccaccgatgtagcggcacgcgggttagatattgaatcgttagatgctgttattaattatcacatagcgcgcgatatggaagtgcacgtacaccgtattggtcgcaccggccgtgcgggcgcaaaaggtattgcgtgctctatttatagcgaaaaagaacattttaaattagcgcggttagaagaaaccatggggcagcaagtggttaacgataagttaccgccaacaagcgtgctggattaccctgcacccaaacccaaaatggccacgctgcaaattgatggtggtaaaaagcaaaaagtacggcctggggatattgtcggcgggcttaccggtgagaacggtattgcaggtacagaaataggtaagattagtgtttttgataattcgtcttacgtggcggttgctttgccagtaatgaaaactgctttaaataaaattcgcgatggaaaattaaaaggccgcaattttcgagtgcgcgccattacttaa

SEQ ID NO: 38964 - protein, 464 aa, Microbulbifer degradans 2-40
MSDSSNTAFSSIGLQPGLMQNLESLGYNTMTPIQAQSLPNIIAGKDVIGQGKTGSGKTAAFGLGLLNSLDVKRFYVQSLVLCPTRELADQVAKEIRRLARAIHNIKVLTLCGGMPFGPQIGSLEHGAHIVVGTPGRVEEHVRKNNLDLSKLSVLVLDEADRMLEMGFQAALDAIIETMPKQRQTLLFSATFPEEIQAIASRIMTAPVMTQVESTHDTSTIKQRFYKVDNDDQRLLAVRLLLLQHKPESAVVFCNTKRETQMVADDLAGHGFTALALHGDLEQRDRDLTLVRFANGSATVLVATDVAARGLDIESLDAVINYHIARDMEVHVHRIGRTGRAGAKGIACSIYSEKEHFKLARLEETMGQQVVNDKLPPTSVLDYPAPKPKMATLQIDGGKKQKVRPGDIVGGLTGENGIAGTEIGKISVFDNSSYVAVALPVMKTALNKIRDGKLKGRNFRVRAIT

SEQ ID NO: 38965 - DNA, 1179 bp, Microbulbifer degradans 2-40
  CDS (1)..(1179)
atgcataaaaacaacttgtccttcgaagaactcaacctgtcgccgctggtaatgcgtgcattgtcagatttaaagttcaccgagtgttccgccattcaggcgaagtctttgccttttacattgcgcggccacgatgtgttaggtaaggcccaaacggggacgggtaaaaccgcagcttttttaatagcgcttatcgaagatcttctgggtacccccatcgaagaagagcgctacgcgggtgaagcgcgctcactagtgattgcaccaacacgcgagttggccatgcaaattgctaaagatgccgagaatttagttaaacatacagatttaaaagtacatatattggtaggtggagtggattacgctaagcagctgcaaaagctgcaggctgagcacattgatattctggttgctacaccgggtcggttattggacttttgtgaaaagcgggctgtgtatttagatcaagtggaagtgcttgtaatcgacgaagccgaccgcatgctggatatgggctttattccacaggttaagcgcatagtgcgtatgaccccgccttcaactcaccgtcaaacactgctgttttctgccaccttctctgaagatgtgctgcgtttaagcgagcagtggatgcacgagccggtaaccgtttctattgaagatgaaaatgtggcggcagatcgagtgaaacaagtggtgtacttggtttctagcgaagagaaatttaccgtgcttggcaacttaatgcgcgagccggatgtagaaaacataatgatttttgccaatcgccgcgatcagtgccgcgatttacaccacaagctacagcgccgtggttttcgggttggtttgttgtcgggcgaaatcgcgcaaaacaagcgtattcgcaccttagaggacttccgtaccggtaagctgacagcattggtggccaccgatgtggcggggcgcggtattcatattgatggtatatcacacgttgtaaactacaccttgcccgaagagcctgaagattacgtacaccgcattggccgtacaggtcgtgcaggtaaagagggtgtatcggtaagcttggcctgcgaagacgatgcattgcgtttagagcctatccaagagttgcttggtcgcaaaataccctgtgagcagccacccgaagagctacttaagccgttggcacgctaa

SEQ ID NO: 38966 - protein, 392 aa, Microbulbifer degradans 2-40
MHKNNLSFEELNLSPLVMRALSDLKFTECSAIQAKSLPFTLRGHDVLGKAQTGTGKTAAFLIALIEDLLGTPIEEERYAGEARSLVIAPTRELAMQIAKDAENLVKHTDLKVHILVGGVDYAKQLQKLQAEHIDILVATPGRLLDFCEKRAVYLDQVEVLVIDEADRMLDMGFIPQVKRIVRMTPPSTHRQTLLFSATFSEDVLRLSEQWMHEPVTVSIEDENVAADRVKQVVYLVSSEEKFTVLGNLMREPDVENIMIFANRRDQCRDLHHKLQRRGFRVGLLSGEIAQNKRIRTLEDFRTGKLTALVATDVAGRGIHIDGISHVVNYTLPEEPEDYVHRIGRTGRAGKEGVSVSLACEDDALRLEPIQELLGRKIPCEQPPEELLKPLAR

SEQ ID NO: 38967 - DNA, 1788 bp, Microbulbifer degradans 2-40
  CDS (1)..(1788)
atgaccgaatccagccccaattttgctcaactgggcctaaatgaacacattcttaaagcactaacagacgttggttacgaaaccccctcccccattcaggccaaaagtattcctgagttattagctggacgagatattctgggccaagcccaaaccggtacgggaaaaaccgcagcatttgctctaccaatacttaacaacctagacctaagccaaaaagcgccacaggttctagtacttgcacctacccgcgaactagccattcaggtagcagaagcatttcaatcatacgcccatcacttgcccggcttccacattctacctatctacggtggccaagggtacgaccagcaaatacgcgcactgaagcgcggtgttcacgttattgtgggcacacccggtcgtgttatggaccatatgcgtaaaggcacgctaaagctagaccaacttaaagtattggtactagacgaagccgacgaaatgttgcgcatgggctttattgacgacgttgaatgggtactcactcaaaccccacctacccgccaaatcgcgctattttcggctaccatgcctaaagagattgctaaggttgctaacaaataccttaacgacccagcgcttattaagattgaagttaaaacccaaaccgccgacaccattcgtcagcgttactggggcgtgagcggccaccacaagctagatgccactacgcgcatactcgaagcggaagagttcgacgcgatgattattttcgtgcgtaccaaaaccacaactatcgagctggcagaaaaactggccgcacgcggctactccagtgcggcacttaacggcgacatctcgcaaaacctgcgtgagcgcaccgtagagaagttgaaaaaaggccaaattgatattctagttgctaccgatgtagcggcacgcggcctagacgtagatcgcattagccacgtactaaactacgatattccctacgattcagaagcttacgtgcaccgcatcggccgtacaggccgcgctggtcgctcgggcgaagccattctttttgttgcaccgcgcgaaatgcgtatgttgcgcacaatagaaaaagctacccgcaagcctatcgaactaatgaaaatgccaagcacggatgatattaaccaaattcgtgttgatcgctttaaacaaaaaatattggatgcagccaaatcaccaggcctagagtttttccgcaagctcgttaccgaaatgcaacacgacaacgaactggatactgccgacatagcagcagcgcttgctcttctataccaaggtgaccaaccactattgttggaagaccgtcctcagcgtcaacagcgtgaatttaaagagcgcgatggcgacttcgataaacgcggccgtggcgacagagatggccgtggacgcgaaggtcgagatcgcggtaaaggccgtgaaaaagacgaaaacatggagacctaccgtatagaagtaggccgcaaagacggtgttaagcctggcgacattgttggcgccattgccaacgaagcaaatattagcagcaagtttattggccacattaaactgcacgacgacttcagcaccgtagacttgccatcaggtatgcccaaagaagttttcgaaaccctaagcaaaacttgggtttgtcaaaagcagctgcgcattacccgtgcagaaggcaacgctggcggtggtcgaggccgtggtggtgacgacttcaaacgcaaaaaacgcccagccaataaagatggcgcaccgcgtaaaccaagagccaaaaaagccgatagctaa

SEQ ID NO: 38968 - protein, 595 aa, Microbulbifer degradans 2-40
MTESSPNFAQLGLNEHILKALTDVGYETPSPIQAKSIPELLAGRDILGQAQTGTGKTAAFALPILNNLDLSQKAPQVLVLAPTRELAIQVAEAFQSYAHHLPGFHILPIYGGQGYDQQIRALKRGVHVIVGTPGRVMDHMRKGTLKLDQLKVLVLDEADEMLRMGFIDDVEWVLTQTPPTRQIALFSATMPKEIAKVANKYLNDPALIKIEVKTQTADTIRQRYWGVSGHHKLDATTRILEAEEFDAMIIFVRTKTTTIELAEKLAARGYSSAALNGDISQNLRERTVEKLKKGQIDILVATDVAARGLDVDRISHVLNYDIPYDSEAYVHRIGRTGRAGRSGEAILFVAPREMRMLRTIEKATRKPIELMKMPSTDDINQIRVDRFKQKILDAAKSPGLEFFRKLVTEMQHDNELDTADIAAALALLYQGDQPLLLEDRPQRQQREFKERDGDFDKRGRGDRDGRGREGRDRGKGREKDENMETYRIEVGRKDGVKPGDIVGAIANEANISSKFIGHIKLHDDFSTVDLPSGMPKEVFETLSKTWVCQKQLRITRAEGNAGGGRGRGGDDFKRKKRPANKDGAPRKPRAKKADS

SEQ ID NO: 38969 - DNA, 1311 bp, Microbulbifer degradans 2-40
  CDS (1)..(1311)
atggaatttagcgagttagggttacaccaatcactgcaaaaagcgttagataaattaacctttaccaagcctactgatgtacaggtgcaaaccattcctgccgttttagccggcaaagatattatggtgtcggccaaaaccggcagcggtaaaacggccgcttttttgctgcctatgctgcacaaatttttaaacgatccgcgccctaatacatctacccgcgcattaattttattgcctacccgcgagctagctttgcaaaccgtaaaagccttcgagcaattcgccggttacacacaaattaaggtgggcttaattatgggcggtgaagcttacaaacaccaagtggctactgttcgcaaaaaccccgaggtattggtagctacgccaggccgcttggtcgagcatattaaaaatggcaatgtcgatttttccgatttagagtttttagtgttggacgaatccgatcgcatgctggatatgggctttcaagaaaacatgcttgccattgccgctgtgtgtaatgaagaaagacaaaaccttttgttttcggctacgttaaagcacaaggggataggtggtattactggcttgttacaagaccctgtgcgcatccaagtagatagcgctaaagaaggtcatagcaatatcacccaacagcgcgtattcgccgacgacgacagccacaaagaaaaactagtggttaagcttattgcggaagaagacgcgcagcgcgtaatagttttttgtaatacgcgtttgcaatgccagaaagtgagtaatattttacgcgcgaataaattagtgtcggaatatattcacggtgaggttacgcaaagcgaccgcaagcaggtaatgaaccggtttatcgacggtaaaattcgcgtgctggtagctaccgatgtggctgcgcgcgggttggatataaaagatgtagatttggttattaatttctcggcagcgtttaccggcgatgagcatgtgcatcgcgtgggccgtacggggcgctctgacaaaaccggtttggcaattacgcttattagccccaaagaattcaaccctatgtcgagtatcgagcgctacttaaaaattcgcttaataccgcgcaaggtgaaaggtttagagggtacctacaacggccccaaaaaactaaaaagctctggcaaagccgccggccccaaaaagaaaaaaaccaaaactacagccggcaaacccggcaaaaaattaccaagtaaaaaagacccccaaaagaaacgctccgccccaaaagtgaatttgggcgatggcagtgagccattgtttaagagatag

SEQ ID NO: 38970 - protein, 436 aa, Microbulbifer degradans 2-40
MEFSELGLHQSLQKALDKLTFTKPTDVQVQTIPAVLAGKDIMVSAKTGSGKTAAFLLPMLHKFLNDPRPNTSTRALILLPTRELALQTVKAFEQFAGYTQIKVGLIMGGEAYKHQVATVRKNPEVLVATPGRLVEHIKNGNVDFSDLEFLVLDESDRMLDMGFQENMLAIAAVCNEERQNLLFSATLKHKGIGGITGLLQDPVRIQVDSAKEGHSNITQQRVFADDDSHKEKLVVKLIAEEDAQRVIVFCNTRLQCQKVSNILRANKLVSEYIHGEVTQSDRKQVMNRFIDGKIRVLVATDVAARGLDIKDVDLVINFSAAFTGDEHVHRVGRTGRSDKTGLAITLISPKEFNPMSSIERYLKIRLIPRKVKGLEGTYNGPKKLKSSGKAAGPKKKKTKTTAGKPGKKLPSKKDPQKKRSAPKVNLGDGSEPLFKR

SEQ ID NO: 38971 - DNA, 1197 bp, Microbulbifer degradans 2-40
  CDS (1)..(1197)
atgacattttctacccttggtctatgtgacccaatcctgcaggccttaaacgacgtgggctacgaagcgcctactgccattcaagagcaggctataccacctattttggctgggcgagatgtgctggcgaaggcgcaaacaggtacaggtaaaacggcaagctttgtgttgccaatactgcaaacctttaaagataaagcgaaccgcagagccaagcgcataaaggcgcttattttggtgcctacgcgcgagctggccattcaagtagaagataacattaggttgtacggtgcgcatttaagcctcacatctatggctatggtaggtggggtagatattgagccgcaaaaggcaaagcttgtggagggggtggatattctagtcgccacgccgggccgacttatagatttaatgcatcagcgtgccttacatttcgatgagctggaatttttagtattagatgaagccgatagaatgctcgatatgggctttataggggatatcaataaaattattgagcgcctgccggagcgcaggcaaagcttgttattttctgcaacgctttctgataaggtgcgtttgctagcaaaaaccgccatagttaatgcggtagaaatttccattgccgcggataaaaaatctaccccgccgattactcagtggttggtaactgtagacaaacataacaagtcggcactgctcacgcatttaattaatgagaatggttggaagcaggcgttaatatttatccgcaccaagcacggtgcagccaagctggttacacagctagaaaagcgtggtattaaggccgaatcaattcatagcggccgaagccaagcagtacgcacccaactactagcagattttaaggctggaaaaataggctttttagtggccacaggcattgccgcacgcggtatcgatatagatgatttggaccgtgtagttaactatgacttacccgacgatgcacatgattatgtgcatcgtattggccgcacaggcagggcaggcgtaagtggcgaagccgtatcgttaatttctatggatgattttaagcgcttgtgtgcaatagaaagtaggcttggccatattattgatagaaaagaagtggcagaatttaaagcagtaaaagaagtgcctatatctatattaaattacgttaagaaaagtgcaaaaaagccacagagaaggtaa

SEQ ID NO: 38972 - protein, 398 aa, Microbulbifer degradans 2-40
MTFSTLGLCDPILQALNDVGYEAPTAIQEQAIPPILAGRDVLAKAQTGTGKTASFVLPILQTFKDKANRRAKRIKALILVPTRELAIQVEDNIRLYGAHLSLTSMAMVGGVDIEPQKAKLVEGVDILVATPGRLIDLMHQRALHFDELEFLVLDEADRMLDMGFIGDINKIIERLPERRQSLLFSATLSDKVRLLAKTAIVNAVEISIAADKKSTPPITQWLVTVDKHNKSALLTHLINENGWKQALIFIRTKHGAAKLVTQLEKRGIKAESIHSGRSQAVRTQLLADFKAGKIGFLVATGIAARGIDIDDLDRVVNYDLPDDAHDYVHRIGRTGRAGVSGEAVSLISMDDFKRLCAIESRLGHIIDRKEVAEFKAVKEVPISILNYVKKSAKKPQRR

SEQ ID NO: 38973 - DNA, 1566 bp, Oenococcus oeni PSU-1
  CDS (1)..(1566)
ttgaaatttgaagaatttggacttagtccagaacttttgtctgcggtcaaaaagcatggttacgatgaagcaaccccgattcaggaaaaaacaattccgttgattatacagggagttgatgtcattggccaagcacagaccggtacaggtaagacggcagcttttggtttgccgattttagaagaagtggatccaaagaacccacaaatccaagccttggttatcagcccaacacgcgagttggctatgcagaccgaagaagaactcaacaagcttggttccgacaaacacgtgaaaactcaagttgttttcggtgggtatgatattcgccgacagatccatgctttaaaagaacatccacaaatccttgtcggtactcccggacgattgattgatcatttgaatcgtcatacgattgattttcgcggagttaagactttggtaatcgatgaagccgacgagatgctaaacatgggtttcttagaagatatcgaaacgattgttcattacacgccggatgatcgtcaaactttacttttttctgcaacgatgcctgacgacattaagaaaataggcgttaaatttatggaagatcccgaagaagtccacattgcttctaagggtctgactatcgatttggttgaccaatatctggttaatactcgcgaatatgaaaagttcgatgcgatgacacgcttattcgatgtcgaacaacctgaactggcaattgtctttggtcggacaaagcgtcgggttgacgaattgaccaaagctttgcagctccgtggctataaagctgccggaattcatggcgatttggatcaagcagcccgtatgcggactttacgttcctttaaaaaaggagaattgcagttcttggttgcaaccgatgttgcggctcgtggcttggatatttccggagttacgcatgtttataattacgatgttccccaagatcccgagtcttacgttcaccggatcggtcgtaccggtcgtgccggacaccatggtgtttctgtaacttttgttgttcgtggtgaaattgattatctgcgggcaattgaaaaattgatcaataagcgtatggccgctttaaagccgccttcggctgaagaagcgcatattgcccgtctgaagaacgccaaagcagagacttatgctgttttgggtaaaacaactattgataacgtcgaagacgaagcaacagaaattgccaatcaatacgatgctaagttaatcgcagctgcattgttgcacgctctgtccaaagatgatgaaagaactcgtcctgtcgatatcgcacaggaaaagcctcttccgcgtcgtcatagttcatctgaccacggtcataacttccgtagtggacgctctaatggcaatcgtggtcgcaatggtcatagcaatggcaaccgcggtggtcgtcgtggcggatttaaagaagaatttgtaattgatcgtggccataagccggtcgatcgtcgcaatcaacgaattcaggcacgtccaaaaggggttgcgaaagcggctccgaaaaaacgtgagtttaaaattgtcaaaaagtcatga

SEQ ID NO: 38974 - protein, 521 aa, Oenococcus oeni PSU-1
MKFEEFGLSPELLSAVKKHGYDEATPIQEKTIPLIIQGVDVIGQAQTGTGKTAAFGLPILEEVDPKNPQIQALVISPTRELAMQTEEELNKLGSDKHVKTQVVFGGYDIRRQIHALKEHPQILVGTPGRLIDHLNRHTIDFRGVKTLVIDEADEMLNMGFLEDIETIVHYTPDDRQTLLFSATMPDDIKKIGVKFMEDPEEVHIASKGLTIDLVDQYLVNTREYEKFDAMTRLFDVEQPELAIVFGRTKRRVDELTKALQLRGYKAAGIHGDLDQAARMRTLRSFKKGELQFLVATDVAARGLDISGVTHVYNYDVPQDPESYVHRIGRTGRAGHHGVSVTFVVRGEIDYLRAIEKLINKRMAALKPPSAEEAHIARLKNAKAETYAVLGKTTIDNVEDEATEIANQYDAKLIAAALLHALSKDDERTRPVDIAQEKPLPRRHSSSDHGHNFRSGRSNGNRGRNGHSNGNRGGRRGGFKEEFVIDRGHKPVDRRNQRIQARPKGVAKAAPKKREFKIVKKS

SEQ ID NO: 38975 - DNA, 1626 bp, Haemophilus influenzae 86-028NP
  CDS (1)..(1626)
atgactgacaaaattacttttaatgacttaggcttacctgagttcatcttaaaagctgtttctgacttaggttttgaaaccccttctccaattcaacaagcttgtatcccacatttgctcaatggcaatgatgtgctaggtatggcacaaacgggtagtggtaaaaccgctgcttttgcactgcctttattagcgcaaatcgatccaagtgaaaaacatccacaaatgttagtgatggcgcctacacgcgaacttgctattcaagttgccgatgcgtgtgaacaatttgttaaatatgcacacggcactcgcattgttaccttatatggtggccaacgttatgacatccaacttcgtgcattaaaacaaggcgcacaagtggttgtgggtacaccaggccgtattcttgaccatattcgtcgcagaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgcactaaaactggtactttagacattacagaactacttgaaaaaaatggtttccgttctgccgcacttaatggcgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaagatattgctgcagcaatgttgatgctgcttcaaggcaaacaaaaattaattcttccacctgatccgccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtaaaagctcgccatatcgttggtgcgattgctaacgaaggcgatattaacagccgttatattgggcatattaaactttatgatgactacactaccgtggaattgccacaaggcttgccgaaagattatttgcacatttcgctaaaaccgcgtattgaataa

SEQ ID NO: 38976 - protein, 541 aa, Haemophilus influenzae 86-028NP
MTDKITFNDLGLPEFILKAVSDLGFETPSPIQQACIPHLLNGNDVLGMAQTGSGKTAAFALPLLAQIDPSEKHPQMLVMAPTRELAIQVADACEQFVKYAHGTRIVTLYGGQRYDIQLRALKQGAQVVVGTPGRILDHIRRRTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRRERNDRGDRRENPRSAERRGERKGYGNPQPMDLYRIEVGRADGVKARHIVGAIANEGDINSRYIGHIKLYDDYTTVELPQGLPKDYLHISLKPRIE

SEQ ID NO: 38977 - DNA, 1581 bp, Pediococcus pentosaceus ATCC 25745
  CDS (1)..(1581)
ttgaaatttaccgaactagggttagacgaagacattttaaaagcagttttagacaatgggtatgacgaaccaacacctatccaagctgaaactattcctggtgttttagaaggaaaagacatcattggacaagctcaaacaggtactggtaagacagctgctttcggattaccaatcctacaaaatgttgacctagataatcctaacattcaagcaattattatctcacctacacgtgagttagctgctcaaacacaagcagaaatctttaaattaggaaaatataaaaaagctaaagttcaagtggtttacggtggatcagatatccgtcgtcagattaatgctttaaagagccatccacaaatcgtggttggtacacctggtcgtttgttggaccatattggtcgaaagacaattcgtttagaccacgttaaaacattagttcttgatgaagctgacgatatgctagatatgggattcttacctgatatcgaacacattattgaacaaacacctagcgaacgccaaacattattgttctcagccacaatgccagcaccaattaagaaaattggtgttaagttcatgactgatccaaaacaaattacagttaagtctaaagaacttactgctgatttggttgatcaatactacgttcgttctaaagaattcgaaaaatttgatattttaacccgcgtacttgatgtacaagcaccaaaacttgcagttatttttggtcgtactaagcgtcgcgttgatgaagtttctaagggattagttactcgtggttacaatgctgctggaatccatggtgatttaactcaacaacgccggatgagtattttacgtcaattccgtgaaggacaattagatattttagttgctactgacgttgctgcacgtgggcttgatatctctggtgtaactcacgtttacaactatgatattcctcaagacccagaaagttatgttcaccgtattggtcgtacaggccgggccggtgctacaggtacttcagtaaccttcgttactaactgggaaatggactatcttcgtgacgttgaacatttgacaaagaaacgtttgttaccaatgaagccaccaacagaagaagaagcttttgctggacgtgctgcaatggctgaacaaagcattgaagaattggttcaaaaaacagatgttgctaagttcgaagaacaagttgatcatcttttagaacaacatgatgctaaaacgctggttgctgcacttctaaatgaagtaactaagtctgacgctagtgaaatcaaagttaagattactcctgaacgcccacttcctcgtaaaaaaggtggcaacaaaggcggtaaaggtggcggcggataccgtggcggaaaccatcgtggtggtaatggtcgtcgtagtaatggtaatagcagcaatggcgggggccgtggtggtaaatggaataacgatcgtaagggtggcggcaagtcacgctttggtcgcgatgaccgtaaccacaatggtggtaagcgtaatgatcgcaactcaggtaacaagggtggatcaaaccgtcaatttgtaattaaagaaaaataa

SEQ ID NO: 38978 - protein, 526 aa, Pediococcus pentosaceus ATCC 25745
MKFTELGLDEDILKAVLDNGYDEPTPIQAETIPGVLEGKDIIGQAQTGTGKTAAFGLPILQNVDLDNPNIQAIIISPTRELAAQTQAEIFKLGKYKKAKVQVVYGGSDIRRQINALKSHPQIVVGTPGRLLDHIGRKTIRLDHVKTLVLDEADDMLDMGFLPDIEHIIEQTPSERQTLLFSATMPAPIKKIGVKFMTDPKQITVKSKELTADLVDQYYVRSKEFEKFDILTRVLDVQAPKLAVIFGRTKRRVDEVSKGLVTRGYNAAGIHGDLTQQRRMSILRQFREGQLDILVATDVAARGLDISGVTHVYNYDIPQDPESYVHRIGRTGRAGATGTSVTFVTNWEMDYLRDVEHLTKKRLLPMKPPTEEEAFAGRAAMAEQSIEELVQKTDVAKFEEQVDHLLEQHDAKTLVAALLNEVTKSDASEIKVKITPERPLPRKKGGNKGGKGGGGYRGGNHRGGNGRRSNGNSSNGGGRGGKWNNDRKGGGKSRFGRDDRNHNGGKRNDRNSGNKGGSNRQFVIKEK

SEQ ID NO: 38979 - DNA, 1362 bp, Pediococcus pentosaceus ATCC 25745
  CDS (1)..(1362)
atgaacgaatttcagaagtttaatctaaaaccatttttaatgacggctttagatgagattaattttaagacacctacccctgtacaggataaagtgattccacttattgctgatggaaagagtgttgtcggacaatctcaaacggggagtggtaaaacccatgcttttcttttaccaatttttaacaatatcgatccggaattaaatgcaattcaagcagtaattacgacacctagtcgtgaattggcttatcaaatttatgaagatgctaagcaattagcctcagcttcagaagttaagattgaaattggcaattacgttggtggaactgataagaaacgtcaagttgaaaaattaggacatcatcaaccagctatcatcattggtacaccaggacgagttttggacttgttaaaggaacgggccttgaacttccgtcaagtgaagtatatggttattgacgaagctgatatgaccttagatatgggatttttaaacgcggtagatcaaattgctgctgcaatgccatctaagctgcaaattttggttttctcagctaccattccacaacggctaaatgtatttttgaagaagtatatggatcatccggtaattgaagagattcctaccgaaacaactattagccctaccatcaagaatatcttgatttcaactaagagttctggcaaaaataatttaatttataaattattgactatgggagagccctatctagctttagttttcaccaacactaaggaacgtgctgatgagttgaccgattatcttaaagctcagggactcgatgttgctaaaattcatggtggtatccaaccacgtgaacgtaaacgaattatgaaggatattcatcgtcttcgttatcaatacgttgtagcaactgatttggctgctcgtggaatcgatattgatggagtttcactagtaattaatgatgatattccgacagaccttgaattctttatccatcgagtgggtcgtactggtcgaaatggtatgtcaggaaccgcaattaccttatatatgcctaatgaagaagacaaagtagctgatgtcgaaaagatgggaattacattcttacctcaacagattcgaaacaacgaattagttgatacgtacgatcgtgatcgtcgtcagacgcgtcgtctgagtcaaaagaaacttgacccaaccatgattgggatggttaagaaaaagaagaaaaaggttaaaccaggttacaagcgtcgaattcgcaaagcaatttcagaaaaagaaattcgtgatcgtcgtatggaacaacatcaagcagttcgtgaagccaaaaaggctaagataaaacaatcacgaaataagcgaagataa

SEQ ID NO: 38980 - protein, 453 aa, Pediococcus pentosaceus ATCC 25745
MNEFQKFNLKPFLMTALDEINFKTPTPVQDKVIPLIADGKSVVGQSQTGSGKTHAFLLPIFNNIDPELNAIQAVITTPSRELAYQIYEDAKQLASASEVKIEIGNYVGGTDKKRQVEKLGHHQPAIIIGTPGRVLDLLKERALNFRQVKYMVIDEADMTLDMGFLNAVDQIAAAMPSKLQILVFSATIPQRLNVFLKKYMDHPVIEEIPTETTISPTIKNILISTKSSGKNNLIYKLLTMGEPYLALVFTNTKERADELTDYLKAQGLDVAKIHGGIQPRERKRIMKDIHRLRYQYVVATDLAARGIDIDGVSLVINDDIPTDLEFFIHRVGRTGRNGMSGTAITLYMPNEEDKVADVEKMGITFLPQQIRNNELVDTYDRDRRQTRRLSQKKLDPTMIGMVKKKKKKVKPGYKRRIRKAISEKEIRDRRMEQHQAVREAKKAKIKQSRNKRR

SEQ ID NO: 38981 - DNA, 1365 bp, Trichodesmium erythraeum IMS101
  CDS (1)..(1365)
atgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaacacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaa

SEQ ID NO: 38982 - protein, 454 aa, Trichodesmium erythraeum IMS101
MSFDSLGLSPDILRAVAEQGYREPTPIQQQAIPAVLEGRDLMASAQTGTGKTAGFTLPLLQHLITRQPHAKGRRPVRALILTPTRELAAQIGEHVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGRGQQQPRRGEGGAKSASAKPAEKPSRRLGDAKPAGEQQRRRRPRKPAAAQ

SEQ ID NO: 38983 - DNA, 1488 bp, Trichodesmium erythraeum IMS101
  CDS (1)..(1488)
atggatttgtcatttgcaagtttaggaatttcagaggaacgtgcaaatcatctggaaacaattggttttactgaacctacccctatccaagctcaagcaataccccctttgctagagggaaaggatattgtgggtcaagctcaaacaggaacaggtaaaactgcagcgttttcgttaccaatattggagcaaattgatatagatactaatgcagttcaagcattaattttaactcccactcgtgagttagcactgcaagtgacagaagcgattcgtcaatttactggaattaatagtaaaggtcctactaaacggcggttatttgttttaacggtttatggtggtcagtctattgaacgtcagagccagcgtctgcaaaagggtgttcatattgtagtgggaacaccagggcgaattatagatatgctgaatcgaaatagcttgaaactagatcatttgaaaatgatggttttagacgaagctgatgaaatgttgagcatgggttttattcaagatgtggaaaaaattctggaagcagcacctgctgaacgtcaaacagctttcttttccgctactatggattattcaatccggaaactagttaataagtatttgcaatcaccagtaacagttaaagttgcccaacaaaaaactactcctaagcgcatcactcaaactgtatacatattacctcgtggttggtctaaaggaaaagctctacagccaattttagaactagaagacccagaagcagctttgatatttgtccgcacaaggcaagctgcagcagaactaacaaatcaattacaatcagcaggtcatagtgttgatgagtatcacggtaacttaaaccagtctcaacgagaacggttgttaactcgctttcggaatcaacaggtacgttgggttgtggcaactgatattgcagctcgtggtttagatgtagatcatttaactcatgtgattaattacgatttgcctgatagtgtagatagttatgttcatcgcattggtcgtacaggtcgtgcaggtcgggaaggaacagcaatttccttgattcatcctgtagataagcggaagttgcggttaatagaacgtcatttacgtcaacgtttgaacactcgttcaattcctaagcggtctcaaattgaagctcgacagttacagaaattacaggataaagtgcgaagtgctctgagtggtgagcggatggcttctttcttgcccttaatttctcagttaggtaaagaatatgatccccatgcgatcgcggctgcagctttacagatagcttatgatgaaactcgtcctgcttggatgggacttgattattctcaggaggaagatgagcctatgtacgaaactcctaaaccaaggttgaaaaagcagttacctaagaagtctaataataaaagttattctgataaaaataagaatttaaaggatgaaatatatgtagaagaagcatctctgccacagaataattaa

SEQ ID NO: 38984 - protein, 495 aa, Trichodesmium erythraeum IMS101
MDLSFASLGISEERANHLETIGFTEPTPIQAQAIPPLLEGKDIVGQAQTGTGKTAAFSLPILEQIDIDTNAVQALILTPTRELALQVTEAIRQFTGINSKGPTKRRLFVLTVYGGQSIERQSQRLQKGVHIVVGTPGRIIDMLNRNSLKLDHLKMMVLDEADEMLSMGFIQDVEKILEAAPAERQTAFFSATMDYSIRKLVNKYLQSPVTVKVAQQKTTPKRITQTVYILPRGWSKGKALQPILELEDPEAALIFVRTRQAAAELTNQLQSAGHSVDEYHGNLNQSQRERLLTRFRNQQVRWVVATDIAARGLDVDHLTHVINYDLPDSVDSYVHRIGRTGRAGREGTAISLIHPVDKRKLRLIERHLRQRLNTRSIPKRSQIEARQLQKLQDKVRSALSGERMASFLPLISQLGKEYDPHAIAAAALQIAYDETRPAWMGLDYSQEEDEPMYETPKPRLKKQLPKKSNNKSYSDKNKNLKDEIYVEEASLPQNN

SEQ ID NO: 38985 - DNA, 1602 bp, Thiobacillus denitrificans ATCC 25259
  CDS (1)..(1602)
atgagcttctccgaactggggcttgatcccctcattctcaaatccgtactcgccgccggctacgaaaacgccacgccggttcagcagcaggcgattcctgccgcgctgagtgggggcgacctgctggtgtcctcgcacaccggcagcggcaagacggccgccttcctgctgccgtcgatccagcgtctgctcgccgagccggcggtcaaaagcatcgggccgcgtgtgctggtgctgacgccgacgcgcgaactcgcgctgcaggtcgaaaaggccgcgatgacctacggcaaggagatgcgccgcttccgcaccgcctgtctggtcggcggcgccccctatggcctgcagctcaagcgactctcgcagccggtcgacgtcgtggtcgccacgccgggtcgcctgatcgaccatctcgagcgcggcaagatcgacttctcgcgcctcgaggtgctcgtgctcgacgaagccgaccgcatgctcgacatgggcttcgtcgacgacatcaaggcgatcgccgcgcgctgtccggccgaacggcagaccctgctgttctcggccacgctcgacggcgtcgtcggcaacctcgcacgcgaactgacccgcgacgcgcaacgcatcgagatcgaggcggtgccgcacaaggaagccaagatcgagcagcgcctgctgttcgccgacaacatggaccacaagaaccgcctgctcgacgcgctgttgcgtgacgtcgagatggtgcaggcgatcgtgttcgcatcgaccaagcgcagcaccgaggagatttccgacctgctcgccgaaagcggcttcgcctccgacgccttgcacggtgacatgcagcagggccagcgcaaccgcgcgctgcagcggctgcgcgaagggcgcacccgcgtgctcgtcgcgaccgacgtcgcggcccgcggcatcgacgtcgccagcatcagccacgtcatcaacttcgatctgccgcgccaggccgaggactacgtccaccggatcggccgcaccggccgcgcgggtcgtaccggcatcgcggtgagcttcgccggcatgcgcgagggcggactggtgaagaacatcgagcgctacaccggcaaccgcatcgaggtgcacaccttgcccgggctggagccgacgcagcggccgtcgaccgggcgacccggcaatggccggccgcgcggcaacggtccgcgcgggggctacgagaagcgcagcttcggggatcgcagcgagccgcgcagctacggcgaccggccccgtggcgatagccgcgacaaccgcgaccgcggctaccgcggcgacgcccgtcgtaacgacggcgcacccgcccgtcgcttcgacaatggcgtccgcgggccgtccgacgtgccgcgcatgaccagcgagcagacggcagggcctcgtggcgccgcctccaagcccgaggttaatggcaacagcgtcgagtactgggagaagcgcgaacgcgaggccaaggccaaagccgccacgggccgctcctacggcgaccgcggcaacgccgcgcgtccggcacgtggctacggcaacgagaaccgtggcggggcagggcgcggcggggtgcgcgggcgcttcaaggactga

SEQ ID NO: 38986 - protein, 533 aa, Thiobacillus denitrificans ATCC 25259
MSFSELGLDPLILKSVLAAGYENATPVQQQAIPAALSGGDLLVSSHTGSGKTAAFLLPSIQRLLAEPAVKSIGPRVLVLTPTRELALQVEKAAMTYGKEMRRFRTACLVGGAPYGLQLKRLSQPVDVVVATPGRLIDHLERGKIDFSRLEVLVLDEADRMLDMGFVDDIKAIAARCPAERQTLLFSATLDGVVGNLARELTRDAQRIEIEAVPHKEAKIEQRLLFADNMDHKNRLLDALLRDVEMVQAIVFASTKRSTEEISDLLAESGFASDALHGDMQQGQRNRALQRLREGRTRVLVATDVAARGIDVASISHVINFDLPRQAEDYVHRIGRTGRAGRTGIAVSFAGMREGGLVKNIERYTGNRIEVHTLPGLEPTQRPSTGRPGNGRPRGNGPRGGYEKRSFGDRSEPRSYGDRPRGDSRDNRDRGYRGDARRNDGAPARRFDNGVRGPSDVPRMTSEQTAGPRGAASKPEVNGNSVEYWEKREREAKAKAATGRSYGDRGNAARPARGYGNENRGGAGRGGVRGRFKD

SEQ ID NO: 38987 - DNA, 1434 bp, Thiobacillus denitrificans ATCC 25259
  CDS (1)..(1434)
atgactgttgaaaccacctttgccagcctcgcgctggccgaacccattctgcgcgcgatcgccgacgccggctacacggcgcccacgccgatccaggctcaggcgattccgcacgtgctcgccggcggcgatctgctcgccgcggcgcagaccggcaccggtaagacggcgggcttcacgctgccgatcctgcatcagctatcgacccgcgcggcggtcgcgccgaagcccggccggccgcgctgcctgatcctggtgccgacgcgcgaactcgcggcgcaggtcgaggaatcggtcaagacctacggcaaatacctctcgctgacgtcgatggtcatgttcggcggcgtcaacatcaacccgcagttcaaggcgctgaaggcgcgcgtcgacatcctcgtcgcaacgccgggccgcctgctcgatcatgtcgcgcaaaaaaccgtggacctgtccggggtcgaaatcctcgtactcgacgaggccgaccgcatgctcgacatgggcttcatccgcgacatcaggcgggtgctcgccgtgctgccgaaacagcgccagaacctgctgttctcggcgactttctccgacgagatccgcacgctcgcgaacggcctgctgaacaatccgaagagcgtcgaagtcgcacgccgcaacacgacggccgaggtcgtcgagcaatcgatgcaccgcgtgccgcaggcgcacaagcgcgacctgctcgcgcatctgatcaagcaccacgactggcagcaggtgctggtcttcacgcgcaccaagcacggcgccaacaagctcgccgagaagctcaacaaggatggcatcaccgcagcggccatccacggcaacaagagccagtccgcgcgcaccaaggcgctcgcgagtttcaaggacggcagcgtgcgggcgctcgtggcgaccgatatcgccgcgcgcggcatcgacatcgaccagttgccgcaggtcgtcaacttcgaactgcccaacgtccccgaggactacgttcaccgcatcggccgcaccggccgggccggcgcgacgggttccgcgctctcgctcgtcgacgacgaggaaatgggctatctgcgcgacatcgagaagctcatcaagcgcgcgatcgtgcgcgtcgagatcgagccgggcttcgtgccgccggccaaggcagacctgatgtccgacgagcgtccgccacgtccgccgcaggggcgcggcgcatcgcgcgccggccagaacggcgggccgcgccagggccagggcgggcgcggcgggcaaggtagcggacgcaatgcgaaccggccggcccaggggaaatcggccgcggcgcccgtcaagcctgcgagcggccgtgcggccgcgccgaattcgccggcccagccgcgcaagccgcggccgcaggcggcgctgttctcggccaagcccggttcgcgcgggcactga

SEQ ID NO: 38988 - protein, 477 aa, Thiobacillus denitrificans ATCC 25259
MTVETTFASLALAEPILRAIADAGYTAPTPIQAQAIPHVLAGGDLLAAAQTGTGKTAGFTLPILHQLSTRAAVAPKPGRPRCLILVPTRELAAQVEESVKTYGKYLSLTSMVMFGGVNINPQFKALKARVDILVATPGRLLDHVAQKTVDLSGVEILVLDEADRMLDMGFIRDIRRVLAVLPKQRQNLLFSATFSDEIRTLANGLLNNPKSVEVARRNTTAEVVEQSMHRVPQAHKRDLLAHLIKHHDWQQVLVFTRTKHGANKLAEKLNKDGITAAAIHGNKSQSARTKALASFKDGSVRALVATDIAARGIDIDQLPQVVNFELPNVPEDYVHRIGRTGRAGATGSALSLVDDEEMGYLRDIEKLIKRAIVRVEIEPGFVPPAKADLMSDERPPRPPQGRGASRAGQNGGPRQGQGGRGGQGSGRNANRPAQGKSAAAPVKPASGRAAAPNSPAQPRKPRPQAALFSAKPGSRGH

SEQ ID NO: 38989 - DNA, 1383 bp, Thiobacillus denitrificans ATCC 25259
  CDS (1)..(1383)
ttgacgacttttgctgaactcgggcttgcgcccgacatcctgcgcgccctcgacgaaatgggctacgtctcgccgacgccgatccaggcgcaggtgattccgcgtgcgctgcagggcggcgacattctcggcgcggcgcagaccgggaccggcaagaccgcggctttcgcgctgccgctgatccagcgcctgctgcccttcgccaacaccagcacctcgccggccaagcatccgatccgtgcgctcatcctcacgccgacgcgcgaactcgcgatccaggtcgaggaggcgatccaggcctacaccaaacacgttccgctgcgctcgctggtcgtctacggcggcgtcaacatcaacacccagataccgatcctcaagaccggcgtcgaaatcctggtcgcgacgccggggcggctgctcgatcatgtgcagaacaagacgctgatgctgacccaggtcaacacactcgtgctcgacgaagccgaccgcatgctcgacatgggcttcatgccggatctccggcgcatcgtcgccttgctgccggcgcagcgcgtgaacatgatgttctcggcgacctttccggaagaaattcgcaagctcgccgacagcatcctcagcacgccgaccttcatcgaggtggcgcgcaacgagacggccgtcacggtcacccaagtcgtgcatccggtgcatcacgagcgcaagcggcaattgctcgcgcacctgatcaagagccgcgacctgcgccaggtgctcgtcttcacggggaccaagctcggctgcaaccggctggccaacgaactcaacaaggccggcattcatgccgacgcgatccacggcgacaagacccagcaggagcgtatcaaggcgctcgacgccttcaaggccggcacgatccgtgtgctcgtcgcgaccgacgtcgcggcgcgcggaatcgacatcgaggcgctgcctttcgtcgtcaactacgacctgccgcacaacgccgaggattacgtccatcgcatcggccggaccgggcgcgcgggcgccaagggcgaggcgatctcgctcgtcagcgaagccgagacgcgctacctcaaggacatcgaaagactgatcggcacgccgctcgagcccgtgatcgttcccggcttcgagcccggcgcggccgacgtgccggcgttcgagtcgcgcccggcgcgcgccccgcgcagcagcgaccggggacgtgaacgggcgcccgccaaaccccagccgagccgcgacgcgctgttcgacgcaccctatgtgccgcgcgagcccgggcagggcgacgctgcccacgctccggcgcggccggcgccgacaaagcaggtggcggccctctttcgcagcccggtcaagcggaacgtcccggaccagtga

SEQ ID NO: 38990 - protein, 460 aa, Thiobacillus denitrificans ATCC 25259
MTTFAELGLAPDILRALDEMGYVSPTPIQAQVIPRALQGGDILGAAQTGTGKTAAFALPLIQRLLPFANTSTSPAKHPIRALILTPTRELAIQVEEAIQAYTKHVPLRSLVVYGGVNINTQIPILKTGVEILVATPGRLLDHVQNKTLMLTQVNTLVLDEADRMLDMGFMPDLRRIVALLPAQRVNMMFSATFPEEIRKLADSILSTPTFIEVARNETAVTVTQVVHPVHHERKRQLLAHLIKSRDLRQVLVFTGTKLGCNRLANELNKAGIHADAIHGDKTQQERIKALDAFKAGTIRVLVATDVAARGIDIEALPFVVNYDLPHNAEDYVHRIGRTGRAGAKGEAISLVSEAETRYLKDIERLIGTPLEPVIVPGFEPGAADVPAFESRPARAPRSSDRGRERAPAKPQPSRDALFDAPYVPREPGQGDAAHAPARPAPTKQVAALFRSPVKRNVPDQ

SEQ ID NO: 38991 - DNA, 1338 bp, Silicibacter sp. TM1040
  CDS (1)..(1338)
atgaccgaattctcctctatggaccttcccaagcacctgcacacccgcatggaagcgatggggttcaatacacccaccccgattcaggcgcgcgccattccccatgcgctgaatggtcaggacgtgttgggcctggcccagaccggcaccggcaagaccgcggcctttggcgtgccgctggtggcgcagatgctcgaatatggtcgcaagcctgcggccggtacagtgcgcggcctgatcctcgctccgacccgcgagctggccaatcagatcgcagagaccctgcgcggtctcaccgaaggcagcccgctgaagaccgggctcgtcgtgggcggcgtgtcgatcaacccgcagatccaccgcctgtccaaaggcaccgacattctggtggccacccccggccgactgctcgacatcctcgaccgcaaggcgctggatctggggtcttgcgactttcttgttcttgatgaggccgatcaaatgctcgacctcgggttcatccacgccctgcgcaagatcgcggccctcctgcccgaagagcgccagaccatgctgttctcggccacgatgcccaagcagatgaacgagatcgcaaacgcctatctcaagagccccgtgcgcatcgaagtgacccctccgggcaaacccgccgccaaggtcacacaatcggttcatttcatcgccaaggcggaaaagctgagccttctcaaagagctgctctctgcccatgatggcgagcgcacgctggtctttggccgcaccaaacatggcatggaaaagctgatgaaggtgctggacaaggcaggcttcaaggcagcggcgatccacggcaacaagagccagggccagcgcgagcgcgcgctgaaagcgttcaaatcgggcgaaatcaccgtgcttgtggccaccgatgtggccgcgcgcgggcttgatattcccgatgtgaaatacgtctacaactacgagctgcccaatgtgccggatgcctatgtgcaccgcatcggtcgcaccgcacgtgcaggcaaagacggtcaggccgtcgccttctgtgcgccggatgagattggcgatctgaaggcgatccagaaaaccatgggcatcaccatccccgtggcctctggtcgcgcctgggaagagctgccggaccccgcagccaaacccgcacgcggtggcggacgcggtcgccccggcggcggcggcggtggccgtggcaaaggcggtggcaagcctggcggcggtcgtcgtcgctttggcggtggcaaatccgcagccccctcggggggcgcaggcgaatcccgtggtgccgctggtgcgggtggacggcagcggcgcaagtcctga

SEQ ID NO: 38992 - protein, 445 aa, Silicibacter sp. TM1040
MTEFSSMDLPKHLHTRMEAMGFNTPTPIQARAIPHALNGQDVLGLAQTGTGKTAAFGVPLVAQMLEYGRKPAAGTVRGLILAPTRELANQIAETLRGLTEGSPLKTGLVVGGVSINPQIHRLSKGTDILVATPGRLLDILDRKALDLGSCDFLVLDEADQMLDLGFIHALRKIAALLPEERQTMLFSATMPKQMNEIANAYLKSPVRIEVTPPGKPAAKVTQSVHFIAKAEKLSLLKELLSAHDGERTLVFGRTKHGMEKLMKVLDKAGFKAAAIHGNKSQGQRERALKAFKSGEITVLVATDVAARGLDIPDVKYVYNYELPNVPDAYVHRIGRTARAGKDGQAVAFCAPDEIGDLKAIQKTMGITIPVASGRAWEELPDPAAKPARGGGRGRPGGGGGGRGKGGGKPGGGRRRFGGGKSAAPSGGAGESRGAAGAGGRQRRKS

SEQ ID NO: 38993 - DNA, 1587 bp, Desulfovibrio desulfuricans G20
  CDS (1)..(1587)
atggttgaaaaacttcttttcgcagatcttcccctttctaaggaagtgctgcgcgcgatacaggacatgggctttgaggaggcgtctcccatccagacgatgtccatcccgcacatactggcgggtaaggatgtggtcggacaggcccagacaggcacgggcaagactgctgcgttcggcattcccattctcgagcgcattgacccccgtgataaagccacgcaggccgtggtgctgtgtcctacgcgtgaactggccattcaggtggccgaagaagtgactacactggcccgccacaagcggggcatcagtgttgttcccgtatacggcggacagcccatcgaacggcaggtccgcgctctgcgccgtggtgcgcaggttatcgtgggtacgccgggccgcgtgatggaccacctcgacagaggaaccatggacatcaataccgtgaaaatggttgtgctggacgaggcggacgaaatgctcgatatgggcttccgcgatgacattgaattcattctgggcaagatggagcaggaagtacagaccgtgttcttttccgccaccatgccccgcgccattctggatatggcgcagcgctacctcaaggaaccggagttcctgaaagtcacccagaagctgcttaccgtgcccagcatcgagcagatatacttcgaggtgcgtcctttccagaagctggaaagtctgtgccgtgtgctggacgtgtataatcccaagctgaccatcgtgttctgctccaccaaggtgggcgtggacgaactggcaaccaatctgcaggcccgcggatatgatgccgacggactgcacggcaacctgaatcaggcccagcgcgacagggtgatgaaccgcttccgcaaaggaaacattgatattctggtggccaccgacgtggctgcccgcggtattgatgtggaaaacgtggaagccgtggtcaactacgacatacccaacgatgtggaaagctatgtgcaccgtatcggccgtacgggccgtgcgggccgtgcgggccgtgcattcacctttgtgtccggccgcgaattctacaagctgcgcgacatcaagcgctttaccaaggcgcagatagcacagcgtcaggtaccctcgctttccgaagtggaaaacgccaaattcacccagatgctcaatgaagtgaccaaccagatacgcaccggcggtctggagcgctacatagaactggtggaaggcattatcggcgaagagttcacctctgtggaagctgccgccgccctgctgcgcatgatgatgcaccgtaacgcaggcgatgccgtgaccgaagagcagaagttcggtgataccggtgcccagccgggcatggtacgcctgttctttaacgtgggccgcaaagcccgcgtgacggcacgtgactttgtgggggccattgccggagaaaccggcctgcccggacggatgatcggctccatagatatctatgaccggttcacgtttgtggaagtgcccaacgagtttgccgcagaagtgcttgcagtgatgaacggcaaccagatacgcggcaacaagcttgccgtggaacctgccagccgccgctga

SEQ ID NO: 38994 - protein, 528 aa, Desulfovibrio desulfuricans G20
MVEKLLFADLPLSKEVLRAIQDMGFEEASPIQTMSIPHILAGKDVVGQAQTGTGKTAAFGIPILERIDPRDKATQAVVLCPTRELAIQVAEEVTTLARHKRGISVVPVYGGQPIERQVRALRRGAQVIVGTPGRVMDHLDRGTMDINTVKMVVLDEADEMLDMGFRDDIEFILGKMEQEVQTVFFSATMPRAILDMAQRYLKEPEFLKVTQKLLTVPSIEQIYFEVRPFQKLESLCRVLDVYNPKLTIVFCSTKVGVDELATNLQARGYDADGLHGNLNQAQRDRVMNRFRKGNIDILVATDVAARGIDVENVEAVVNYDIPNDVESYVHRIGRTGRAGRAGRAFTFVSGREFYKLRDIKRFTKAQIAQRQVPSLSEVENAKFTQMLNEVTNQIRTGGLERYIELVEGIIGEEFTSVEAAAALLRMMMHRNAGDAVTEEQKFGDTGAQPGMVRLFFNVGRKARVTARDFVGAIAGETGLPGRMIGSIDIYDRFTFVEVPNEFAAEVLAVMNGNQIRGNKLAVEPASRR

SEQ ID NO: 38995 - DNA, 1659 bp, Chloroflexus aurantiacus
  CDS (1)..(1659)
atgacgacttttgctgagttgggcctgagtgatgcgctggtgagcacattgagcgggcttggctacgacgaaccaacacccattcaggcccaggctattccattgttacttgccggtcgcgacgtgatcgctcaggcccagaccggcaccgggaagacggcagcatttgcgttgccgatgattgaacgtgtcaccgacgcgctggtggtgcaggcgcttgtcctggcccctacccgcgagctggccgtccaggtggcagaggcgatccatcgctatggtcgccaccgttcgttgcgcgtgttaccgatttatggcggccagcctatcgagcgccagttgcgcgggctggctcaggggacgcaggtcgtggtcgggactccaggtcgggtgctcgatcatctgaagcgtggcagtctgcgctttgatcacctgcgcatggtggtgcttgacgaagccgatgagatgctcgatatgggcttcgccgaggagttggaggcgattttgcagttgacgccaacggaacggcagaccgctctcttctcggcgacgttgccgccggcagtgcaaaacctgaccctgcgttatacccgccagccggtgcgggtgagcattgctgccgagcaattaacgaccccgcgtatccggcaaacctactacgaagtgctggcccgcgacaagctcgatgctctctgccgggtgctcgacgccgagatgcctcagttggcgattgtgttctgccgaacacgccaggaggccgatgatattggtgaacggctgcaaggccggggctacgctgccgagtcgctgcacggcgacttaagccaggccgcccgtgatcgggtgatgcggcgtttccgcgaagggcaacttgacgtgttggtggcaaccgatgttgcggcccgcggccttgacatcgccgaggtgagtcacgttatcaactacgatgtgcctaccgaccccgaaagctacgtacaccggattggtcgtaccggacgggccgggcgtgaaggggtggcgatcacctttatcaccccacgcgaacgccgcatgttgcagatcatcgagcgggtgacacgcacccggatcgagcgctgccagatgccgacgctggccgatgtagcggcccgccgtcgttcggcgctggtcgatcaattgcggacggcgatggccgatcctgcgcttgccggctacaccaccctggtcgacgaactggctggcacaggtgatctgcgcacggtagctgccgctgcgttgaaattgctcttgaacgaagatcagaccgatcaggtggatacgattacccggctcgacccaccgcctgctgagcgtccgcagcgcgaacgctcggaacgatctgcgcgttcgccacgcaccaaagccgacacacgcagcgagcgtgttgagcggacgatggtgcgcttgcagatcaaccttggtcgcaacgatcagattcgccctgctgacatcgtcggcgccattgcaaacgagtccggtttgcccggacgcagcatcggcgagatcgaaattcgggcacggacaagcgtcgtcgaagtaccgcgtcgggcagcccaacaggtgctccaggcgcttaatcggacaacgttgcgcggtcagcgtgtccgggctgtgctcctggcagaggcggcagtggcagcctga

SEQ ID NO: 38996 - protein, 552 aa, Chloroflexus aurantiacus
MTTFAELGLSDALVSTLSGLGYDEPTPIQAQAIPLLLAGRDVIAQAQTGTGKTAAFALPMIERVTDALVVQALVLAPTRELAVQVAEAIHRYGRHRSLRVLPIYGGQPIERQLRGLAQGTQVVVGTPGRVLDHLKRGSLRFDHLRMVVLDEADEMLDMGFAEELEAILQLTPTERQTALFSATLPPAVQNLTLRYTRQPVRVSIAAEQLTTPRIRQTYYEVLARDKLDALCRVLDAEMPQLAIVFCRTRQEADDIGERLQGRGYAAESLHGDLSQAARDRVMRRFREGQLDVLVATDVAARGLDIAEVSHVINYDVPTDPESYVHRIGRTGRAGREGVAITFITPRERRMLQIIERVTRTRIERCQMPTLADVAARRRSALVDQLRTAMADPALAGYTTLVDELAGTGDLRTVAAAALKLLLNEDQTDQVDTITRLDPPPAERPQRERSERSARSPRTKADTRSERVERTMVRLQINLGRNDQIRPADIVGAIANESGLPGRSIGEIEIRARTSVVEVPRRAAQQVLQALNRTTLRGQRVRAVLLAEAAVAA

SEQ ID NO: 38997 - DNA, 1407 bp, Polaromonas sp. JS666
  CDS (1)..(1407)
atgacttcttcttcctccgacttcagcgccctgtcccttccggcccatgtgctggccaatctgcagcagctgggctacctcagcatgacgccgatccaggcggccagcctgccggtggcgctgctcggcaaggacctgattgcgcaggccaaaaccggcagcggcaagaccgcggcgttcgggctcgcgctgctggccaacctcaatgcacgccgcttcgccgtgcaggccatggtgctgtgcccgacgcgcgaactggccgaccaggtggccacggaaatccgccggctggcgcgcgccgaggaaaacatcaaggtcgtcacgctgtgcggcggcgtgccgctgcgcaaccaggtgtcgagcctgcagaacggcgcacacatcgtggtgggcacgccgggccgcatcatggaccacctggagcgggagacgctggacgtcgacgcgctgaacaccctggtgctggacgaagccgaccgcatgctggacatgggcttttacaacgacatcgccaccgtggccaaacagtgccccgacgagcggcaaaccctgctgttttcggccacctaccccgagggcattgccaagctcagccagcagttcatgaaggagccgcaaaccatcaccgtgcaggcgcagcacgagaaaagcaaaatccgccagcgctggtatgaggtgccggagagcgaccgcgacgaagcgcgcctgaacgcggtggcgctgctgctcaaccattaccgcccggccagcaccctggctttttgcaataccaaatcgcagtgccgcgcgctggtcgcctatttgaagaacaagggcttcagcgcgctggcgctgtacggcgagctcgagcagcgtgagcgcgaccaggtgctggtgcagttttccaaccgcagctgctcggtgctggtggccaccgacgtggccgcgcgcggcctggatatttcgcagctggagatggtgatcaatgtcgatgtcacgcccgatgccgaggtgcacattcaccgcatcggccgcaccggccgcgccgatgaggagggctgggccatcagcctggccagcatggacgagatgggctcggtcggcaaaatcgagcagttgcagaacgccgaatccgaatggcacaagctgactgagctcacacccaccagcaccgagccgctgctgccgcccatggtcactttgcagatcgtcggcgggcgcaaggagaaaattcgcgccggcgatgtgctgggagcgttgaccggggaagcgggttttacccgcgagcaggtcggcaagatcaacgtcaacgagttctcgacctatgtggcggtggaccgcgccatcgccagccaggcgcagcaaaaactcgccagtggccgcgtcaagggcaagagcgtcaaggtccgcttcatggacgagacctga

SEQ ID NO: 38998 - protein, 468 aa, Polaromonas sp. JS666
MTSSSSDFSALSLPAHVLANLQQLGYLSMTPIQAASLPVALLGKDLIAQAKTGSGKTAAFGLALLANLNARRFAVQAMVLCPTRELADQVATEIRRLARAEENIKVVTLCGGVPLRNQVSSLQNGAHIVVGTPGRIMDHLERETLDVDALNTLVLDEADRMLDMGFYNDIATVAKQCPDERQTLLFSATYPEGIAKLSQQFMKEPQTITVQAQHEKSKIRQRWYEVPESDRDEARLNAVALLLNHYRPASTLAFCNTKSQCRALVAYLKNKGFSALALYGELEQRERDQVLVQFSNRSCSVLVATDVAARGLDISQLEMVINVDVTPDAEVHIHRIGRTGRADEEGWAISLASMDEMGSVGKIEQLQNAESEWHKLTELTPTSTEPLLPPMVTLQIVGGRKEKIRAGDVLGALTGEAGFTREQVGKINVNEFSTYVAVDRAIASQAQQKLASGRVKGKSVKVRFMDET

SEQ ID NO: 38999 - DNA, 1269 bp, Polaromonas sp. JS666
  CDS (1)..(1269)
atgccattttcttcactgggcttctcgccggcgcttttgcccgcttttctgcgcgccattggcgacaaaggctaccgtgcacccaccgccattcagtcgcaagccattccggcgatcctgctggggcgcgacgtggtggggtccgcccaaacgggctcgggcaaaacagccgcctttgcattgcccatgctgcagcaactggcaaacgcgcccactggaacaccacggcctacccggggcctgatcctggtgcccacgcgcgagctggcggcgcaggtgggtgaagccatcgccggctttgccaaatacctgccgcagcgcgtcaaggtggccgtggtgtttggcggcgtgtccatcaatccgcaaatgatgaacctgcgcggcggcgcggacatcgtagtggccacgccgggccgcctgctcgacctgctcgaacacaatgcgctgaaaatttctgaggtaagcactttggtgctggacgaggcagaccgcctgctggatctgggctttggcgaagaactgggccgcatcctggagttgcttccaccccggcgccaaaacctctttttctcggcgacgttcccgccagccatcgaggtgctggctgaaagcatgctgcacgacccgctgcgcattgaagtgcaggcggtgcccgagaccaaacccgacatcgcgcagcgcgccattcaagtcgatgccagccgccggacgcaactgctgcgccacctggtgcaaaccgagaagtgggaacgcgcgctggtgtttgtggcgaccaaacacgccgcagaaatcgtggcagacaaactgcgtaaagtgcacatcgaggccgagccctttcatggcgagctgagccaaggcaagcgcacccaggtcttgcaggacttcaggatcaaggccgtgcaggtggtggtggctaccgacgtggccgcacgcggcatcgacattgcgcagatgccggtggtggtgaactacgatttgccccgctcagcggtggactacacgcaccgcattgggcggactggacgtgcgggtgaaagcgggctggctgtgagttttgtgagtgcgggcactgaagcgcacttcaagctgatcgaaaagcgccagggtatcaaggtgcagcgcgagcaggttgaaggatttgagccacttgaaacgctggcgcccaatgctgccgaccctgcctccaccggtggcatcaagggcaagcgcccgagcaagaaagacaagctgcgggaagcggccgcacgcgcgcagacgcaggataaataa

SEQ ID NO: 39000 - protein, 422 aa, Polaromonas sp. JS666
MPFSSLGFSPALLPAFLRAIGDKGYRAPTAIQSQAIPAILLGRDVVGSAQTGSGKTAAFALPMLQQLANAPTGTPRPTRGLILVPTRELAAQVGEAIAGFAKYLPQRVKVAVVFGGVSINPQMMNLRGGADIVVATPGRLLDLLEHNALKISEVSTLVLDEADRLLDLGFGEELGRILELLPPRRQNLFFSATFPPAIEVLAESMLHDPLRIEVQAVPETKPDIAQRAIQVDASRRTQLLRHLVQTEKWERALVFVATKHAAEIVADKLRKVHIEAEPFHGELSQGKRTQVLQDFRIKAVQVVVATDVAARGIDIAQMPVVVNYDLPRSAVDYTHRIGRTGRAGESGLAVSFVSAGTEAHFKLIEKRQGIKVQREQVEGFEPLETLAPNAADPASTGGIKGKRPSKKDKLREAAARAQTQDK

SEQ ID NO: 39001 - DNA, 1533 bp, Thermus thermophilus
  CDS (1)..(1533)
atggagtttaaagactttcccctgaagccagaaatcctggaagccctccacgggcgcggcctcaccacccccacccccatccaggcggcggcgctccccttggccctggagggcaaggacctcatcggccaggcccgcaccggcaccggcaagaccctggccttcgccctccccatcgccgaaaggcttgcgccaagccaggagagggggcggaagccccgggccctcgtcctcacccccacgcgggagctcgccctccaggtggcctccgagctcaccgccgtggccccccacctgaaggtggtggccgtctacgggggcaccgggtacggcaagcagaaggaggccctcctccggggggcggacgcggtggtggccaccccggggcgggccctggactacctgcggcagggggtcttggacctctcccgggtggaggtcgccgtcttggacgaggcggacgagatgctctccatgggctttgaggaggaggtggaggccctcctttccgccacgcccccttcccgccagaccctcctcttctccgctaccctcccctcctgggccaagaggctcgccgagcgctacatgaaaaaccccgtcctcatcaacgtcatcaaggacgagcccgtcacctacgaggaggaagcggtcccggccccggtgcgggggcggcttgaggtcctctccgaccttctttacgtggcctcccccgatcgggccatggtcttcacccggaccaaggcggagacggaggagatcgcccaaggccttttgcgcttgggccacctggcccaggccctccacggggacctctcccagggcgagcgggaacgggtcctgggggccttccgccaaggggaggtgcgggtcctggtggccacggacgtggccgcccgcggcctggacatcccccaggtggacctggtggtgcactaccgcctgcccgaccgggcggaggcctaccagcaccgctcgggccgcacgggccgggcgggccggggagggcgggtcgtcctcctctacgggcccagggagcgccgggacgtggaggccttggagcgggcggtggggcgccgcttcaagcgggtgaacccccctaccccggaggaggtcctcgaggccaagtggcgccaccttttggcccgcctcgcccgggtgccggagaaggactaccggctccacctggactttgcgggccgcctcttcagcgaggggcgggtggaggtggtggccgccctcctcgccctcctcctgggcggggcgcccaaggagaagagcctcctcaccggggaggaggggtggcgcacctacaaggccacggggccgaggctctccctgccccggctcgtggccctcttgaaggggcagggcctcgaggtgggcaagatcgctgaggccgaagggggcctgtacgtggacctccgccccgaggcccggccggaggtggccggcctccggctggagcccgccaggagggtggagggcctcttggagatcccttcccgcacgaggcgcccggccagggcgtag

SEQ ID NO: 39002 - protein, 510 aa, Thermus thermophilus
MEFKDFPLKPEILEALHGRGLTTPTPIQAAALPLALEGKDLIGQARTGTGKTLAFALPIAERLAPSQERGRKPRALVLTPTRELALQVASELTAVAPHLKVVAVYGGTGYGKQKEALLRGADAVVATPGRALDYLRQGVLDLSRVEVAVLDEADEMLSMGFEEEVEALLSATPPSRQTLLFSATLPSWAKRLAERYMKNPVLINVIKDEPVTYEEEAVPAPVRGRLEVLSDLLYVASPDRAMVFTRTKAETEEIAQGLLRLGHLAQALHGDLSQGERERVLGAFRQGEVRVLVATDVAARGLDIPQVDLVVHYRLPDRAEAYQHRSGRTGRAGRGGRVVLLYGPRERRDVEALERAVGRRFKRVNPPTPEEVLEAKWRHLLARLARVPEKDYRLHLDFAGRLFSEGRVEVVAALLALLLGGAPKEKSLLTGEEGWRTYKATGPRLSLPRLVALLKGQGLEVGKIAEAEGGLYVDLRPEARPEVAGLRLEPARRVEGLLEIPSRTRRPARA

SEQ ID NO: 39003 - DNA, 1407 bp, Brachydanio rerio
  CDS (1)..(1407)
atggccacgtttgagtctctcgggctgtctgagtggctgatccagcagtgtaagcagatgggcatcagccgaccgaccgctgtacaggagaagtgtatccctgctatattagacggtcgggattgcatgggctgtgcaaaaactggaagtggaaaaacagcagcatttgttcttccggtactgcagaagttgtccgaggacccttatggtgttttctgcttagtgttaacacccaccagagagcttgcttaccaaattgcagaacaatttcgagttttagggaagccacttggtttaaaagactgtatcattgtgggaggaatggacatggttactcagggtttggagttgtcaaaaaagccacatgttgttgttgccacaccgggacgacttgctgatcacattcgcagctctgacacaattaacctgaacagaatccaatttctaatcatggatgaagctgatcgtcttctggagcagggctgtactgattttactaaagatttagaggtcattctcagtgcggtgccagcaaagcggcagactcttctgttcagtgccacgctcacagacacactgcagcagctgcagagcattgctatgaacaggcccttcttctgggagcataaatcagatgtgcaaacagtggaagaactggatcagagattcatcctcactcctgagaaagttaaagatgcttacctggtccatctcatccaaaccttccaggatgaacatgatgattggtctatcataatattcaccaacacatgcaagagctgtcagatactcactatgatgctgcgggaattcaatttcccaaccatctctctgcactcaatgatgaagcagagacagcgttttgccaaccttgtaaaattcaagtctaacgtcttcaaaattctcatagccacagatgttgctgccaggggtttggatattcccacagttcaggttgttattaatcacaacacacccggtttgccaaaaatctacatccacagagtaggacgaaccgctcgagctggccggaatggagtatcaatcactctagttacacagtatgacattcaccttatcaatgccatagaggaacaaaaccagacaaaactgaaagagtttcctattgaagaaaaagaggtgctgaagatccttacgcaggtcaatgtaacgagacggcagtgtgaaattaaattagagtcgacagattttgatgagaaaaagaagataaacaaaaggaagcagatgattctggatggaaaagatcctgatttggaagaaaaaaggaaaaatgaattagagaagatccgaggaaaaaataagaaactcaaaggaaaaaaaccccagagcaaaaaggaaaagaaaaaacatgagaaaagtgcaaaagcgacagaagttggctcttaa

SEQ ID NO: 39004 - protein, 468 aa, Brachydanio rerio
MATFESLGLSEWLIQQCKQMGISRPTAVQEKCIPAILDGRDCMGCAKTGSGKTAAFVLPVLQKLSEDPYGVFCLVLTPTRELAYQIAEQFRVLGKPLGLKDCIIVGGMDMVTQGLELSKKPHVVVATPGRLADHIRSSDTINLNRIQFLIMDEADRLLEQGCTDFTKDLEVILSAVPAKRQTLLFSATLTDTLQQLQSIAMNRPFFWEHKSDVQTVEELDQRFILTPEKVKDAYLVHLIQTFQDEHDDWSIIIFTNTCKSCQILTMMLREFNFPTISLHSMMKQRQRFANLVKFKSNVFKILIATDVAARGLDIPTVQVVINHNTPGLPKIYIHRVGRTARAGRNGVSITLVTQYDIHLINAIEEQNQTKLKEFPIEEKEVLKILTQVNVTRRQCEIKLESTDFDEKKKINKRKQMILDGKDPDLEEKRKNELEKIRGKNKKLKGKKPQSKKEKKKHEKSAKATEVGS

SEQ ID NO: 39005 - DNA, 2199 bp, Corynebacterium glutamicum
  CDS (1)..(2199)
atgagtaataccgagaacgtcaacggcgacgtagaacagccgaataacgtcatttcgtcggaatctcaggaaaccccgcagggtgactcagcatcagctgacttcgctctcgaaaccccaaccaacactgttgaagatgcaccagcatctgagggtagcgaagagatcaccagggttgcggatacttctgaggacgccgactctgcagatgcagacaacgcgagcaatgtaatcaatgagaatgaggactcctcggaaggtgctaaccagccttcaaacgagtcatcctctacggaagccaaatccggcttcgatgcactcggactgccagagcgtgttcttgacgctgtgcgcaaggtgggttacgaaactccttccccaattcaggcacaaaccatcccaatcctcatggagggccaggatgttgttggtctagcacagaccggtaccggtaagactgcagctttcgcgctgccaatccttgcccgtattgacaagtccgtgcgcagcccacaggcacttgtgcttgcccctacccgtgagcaggcacttcaggttgctgactccttccaatccttcgctgaccacgtcggtggcctgaacgttctgccaatctatggtggacaggcttacggcattcagctctctggcctgcgtcgtggcgctcacatcgtcgtgggtaccccaggccgaatcatcgatcacctcgaaaagggctccctggatatctccggactgcgcttcctcgtgctcgatgaagcagacgagatgctgaacatgggcttccaggaagatgtcgagcgcatcctcgaggacaccccagacgagaagcaggttgcactattctccgcaacgatgccaaacggcattcgtcgcctgtccaagcagtacctgaacaaccctgctgaaatcaccgttaagtccgagaccaggactaacaccaacatcacccagcgcttcctcaacgttgcacaccgcaacaagatggatgcactgacccgtattctcgaggtcaccgagtttgaagcaatgatcatgttcgtgcgcaccaagcacgaaactgaagaagttgctgaaaagctccgtgcacgcggattctccgcagcagccatcaacggcgacattgctcaggcacagcgtgagcgcaccgtcgaccagctgaaggacggccgcctggacatcctcgttgcaaccgacgttgcagcccgtggtcttgacgttgagcgcatctcccacgtgcttaacttcgacattccaaacgacaccgagtcctacgttcaccgcatcggccgcaccggccgtgcaggacgtaccggcgaggcaatcctgttcgtgaccccacgtgagcgtcgtatgcttcgctccatcgagcgcgcaaccaacgcaccactgcacgaaatggaactgccaaccgtcgatcaggtcaacgacttccgcaaggtcaagttcgctgactccatcaccaagtccctcgaggacaagcagatggacctgttccgcaccctggtcaaggaatactcccaggccaacgacgttcctctagaggacatcgcagcggcactggcaacccaggcacagtccggcgacttcctgctcaaggagctcccaccagagcgccgtgagcgcaacgaccgccgtcgtgaccgtgacttcgacgaccgtggtggacgtggacgcgaccgtgaccgtggcgaccgcggagatcgtggctcacgcttcgaccgcgacgacgagaacctggcaacctaccgcctcgcagtgggcaagcgccagcacatccgcccaggcgcaatcgttggtgcacttgccaacgaaggtggcctgaactccaaggacttcggccgcatcaccatcgcagccgaccacaccctggttgaactgccaaaggatctcccacagagcgttcttgacaacctgcgcgacacccgcatctccggccagctcatcaacatagaacgcgactccggtggacgcccaccacgccgcttcgagcgcgatgaccgtggcggacgcggcggattccgcggcgaccgtgatgaccgcggtggacgtggacgtgaccgtgacgatcgtggaagccgtggaggtttccgcggtggacgtgaccgtgatgatcgtggcggacgcggtggattccgcggacgcgacgaccgcggagaccgtggtggccgtggcggttaccgtggcggacgcgactaa

SEQ ID NO: 39006 - protein, 732 aa, Corynebacterium glutamicum
MSNTENVNGDVEQPNNVISSESQETPQGDSASADFALETPTNTVEDAPASEGSEEITRVADTSEDADSADADNASNVINENEDSSEGANQPSNESSSTEAKSGFDALGLPERVLDAVRKVGYETPSPIQAQTIPILMEGQDVVGLAQTGTGKTAAFALPILARIDKSVRSPQALVLAPTREQALQVADSFQSFADHVGGLNVLPIYGGQAYGIQLSGLRRGAHIVVGTPGRIIDHLEKGSLDISGLRFLVLDEADEMLNMGFQEDVERILEDTPDEKQVALFSATMPNGIRRLSKQYLNNPAEITVKSETRTNTNITQRFLNVAHRNKMDALTRILEVTEFEAMIMFVRTKHETEEVAEKLRARGFSAAAINGDIAQAQRERTVDQLKDGRLDILVATDVAARGLDVERISHVLNFDIPNDTESYVHRIGRTGRAGRTGEAILFVTPRERRMLRSIERATNAPLHEMELPTVDQVNDFRKVKFADSITKSLEDKQMDLFRTLVKEYSQANDVPLEDIAAALATQAQSGDFLLKELPPERRERNDRRRDRDFDDRGGRGRDRDRGDRGDRGSRFDRDDENLATYRLAVGKRQHIRPGAIVGALANEGGLNSKDFGRITIAADHTLVELPKDLPQSVLDNLRDTRISGQLINIERDSGGRPPRRFERDDRGGRGGFRGDRDDRGGRGRDRDDRGSRGGFRGGRDRDDRGGRGGFRGRDDRGDRGGRGGYRGGRD

SEQ ID NO: 39007 - DNA, 1908 bp, uncultured marine proteobacterium ANT8C10
  CDS (1)..(1908)
atgtcattcaaagaactcggtttatctgaaccaatattaaaatctctagaagatcttgagcatacaaagccttctgaaattcaacaacaagctatcccagtaattcttgcaggcaagaacattatggctgctgctcaaacaggtacaggtaagacaggaagctttgttcttccaatgctggaaatgcttcacgaacaagcaaagccatacagtaaaaatgttcatgctcttgtattgaccccaactagagaactagcagctcaggtcagagaaagtgttcatagctatggtaaattgactaatatcacctcaacagctgtatttggtggggctaaaatctttccacaaaaggctaagcttaaaaaaggtgtagatattttggttgcaactcctggacgattacttgatttagttaaccagaaagcagttaagttagaccaagtccaaatactcgtgttagatgaagcggatcacatgctagacatgggtttcattcatgacattaaaaagattattgcaatgacaccgcctactagacaaaatttactcttttcagcaaccttctctccagaaattaaaaagttagctcaatcgcttggtgatgggcttgtagaaattagcgctcaatcaccaaatacaactgtcagcaaaatcaagcaaattgtttatcacgtagataaaaataaaaagagcgatttattagctcacatgattgaagaagagcaatgggatcaggcgttagttttctcaaaaactaagcatggatgtgaaaaaattgccgattatctaaatgcagcaggaattgaaacaggaactattcatggtgacaaaactcaaggggcaagaactaaagctctaagagagttcaaaggcaaatttgtacgagtcctagttgctacagatgttgctgctagaggaattgatatcagcaatcttccttttgtcgttaattttgatatgcccacttaccccaacgactatattcatagaattggcagaacagggagagccgggcaagaaggaactgctatctctcttatgagttcagatgagcataagtttttacgagggattgaagggttattaaaaattaaaattgaccaaaccagtcatgaggcctttaagccaaacgataagccttctggcggcggtcgtggtgactctaggtcaagaagtccaagaggaagaaaaccagccttctcaagaaacaatcgaagttctgatggcaaatctggaaatagttattcaaaaccaggtggaagtagttcaagaccaggcaatgctgaaggaagacctgaaagaagtggagctggaagaccaaatagcggcggagctggaagaccaagcaacggtggcggaagaccaaatagcggagccggaagacctgaaagaagtggagctggaagaccaaatagcggagccggaagacctgaaagaagcggagctggaagaccaagtagcggcggagctggaagaccaagcaacggtggcggaagaccaaatagcggagccggaagaccaagcaacggtggcggaagaccaaatagcggagccggaagacctgaaagaagtggagctggaagaccaaatagcggagccggaagacctgaaagaagtggagctggaagaccaaatagcggagccggaagacctgaaagaagcggagctggaagaccaagtagcggcggagctggaagaccaagcaatggtggcggaagaccaaatagcggagccggaagacctgaaagaagcggagctggaagaccaagtggcaattcagcaaataagccatatgacaaaaaacaggatcaaagccaaaaactagctggaaaaagaattaaatccttctggagcatttctccagataatcaattaattgctagagtgatatcttttttaagaagctaa

SEQ ID NO: 39008 - protein, 635 aa, uncultured marine proteobacterium ANT8C10
MSFKELGLSEPILKSLEDLEHTKPSEIQQQAIPVILAGKNIMAAAQTGTGKTGSFVLPMLEMLHEQAKPYSKNVHALVLTPTRELAAQVRESVHSYGKLTNITSTAVFGGAKIFPQKAKLKKGVDILVATPGRLLDLVNQKAVKLDQVQILVLDEADHMLDMGFIHDIKKIIAMTPPTRQNLLFSATFSPEIKKLAQSLGDGLVEISAQSPNTTVSKIKQIVYHVDKNKKSDLLAHMIEEEQWDQALVFSKTKHGCEKIADYLNAAGIETGTIHGDKTQGARTKALREFKGKFVRVLVATDVAARGIDISNLPFVVNFDMPTYPNDYIHRIGRTGRAGQEGTAISLMSSDEHKFLRGIEGLLKIKIDQTSHEAFKPNDKPSGGGRGDSRSRSPRGRKPAFSRNNRSSDGKSGNSYSKPGGSSSRPGNAEGRPERSGAGRPNSGGAGRPSNGGGRPNSGAGRPERSGAGRPNSGAGRPERSGAGRPSSGGAGRPSNGGGRPNSGAGRPSNGGGRPNSGAGRPERSGAGRPNSGAGRPERSGAGRPNSGAGRPERSGAGRPSSGGAGRPSNGGGRPNSGAGRPERSGAGRPSGNSANKPYDKKQDQSQKLAGKRIKSFWSISPDNQLIARVISFLRS

SEQ ID NO: 39009 - DNA, 1974 bp, Yersinia enterocolitica
  CDS (1)..(1974)
atgactactgagcttgaaacctcttttgctgatctggggctgtccgctccaattctttctgctctgactgatcttggttatgaaaaaccatctcctatccagttggagtgtattccacacctgttgaacggccgtgatgttctcggcatggcgcaaaccggtagtggcaaaacagccgcatttggtctgccgctgttacacaacattgatccaagcctgaaagcaccgcaagtgttagtactggctccaactcgtgagttggctattcaagttgctgaagcattatctagcttctctaaacatatgaacggcgttaacgtggttgctctgtatggtggccagcgttatgacgttcaattacgtgctttgcgtcaggggccacaagttgttgttggtaccccaggtcgtctgttagaccatctgaaacgcggtacccttaacttgtccaacctgagtggtttagtgttggatgaagcagatgaaatgctgcgcatgggctttatcgaagacgtggaaaatattctggcgcagatcccggctgaacatcagaccgcgctgttctctgccactatgccagaagcgattcgtcgtattacccgtcgctttatgaaagagccacaggaagttcgcattcagtctagcatgactacccgtcctgatatcagccagagctattgggttgtagacggtgttcgtaaaaacgatgcattggttcgtttcctggaagctgaagattttgacgctgctattattttcgttcgtaccaaaaatgcgacgctggaagtggctgaagctttggaacgtagcggttataacagcgctgcattaaatggtgacatgaaccaggctgcgcgtgagcagactcttgaacgcctgaaaaatggtcgtttagatattctgattgcaactgatgttgcggctcgtggtttggacgttgagcgcatcagcctggtagtaaactatgatatccctatggattcagagtcttatgtccaccgtatcggtcgtaccggtcgtgctggtcgcgctggtcgtgcattactgttcgttgatagacgtgaacgtcgtctgttgcagaacattgaacgtactatgaagatgactattccaccagtccaattgccaaacgcagaattactgggcgaacgtcgcttagctaaatttgcggctaaagttggccaacagctggaaagcagtgatttggatatgtaccgtgcgttgctggctaaactgcaaccagaagaagggtttgatattgaaactctggctgctgcactgctgaaaatggcacagggcgagcgtcctctgattctgcctccagaagcaccacgtcgtccacagcgtgaatttaatactcgcgatgaccgtggtagcgatcgcggtcgtgaccgtaatgatagccgtcgcgaacctcgttctgacagccgtgacggtggcgaacgtccagcacgtcgcgaacgtcgtgatgttggtgagatggaactgtaccgcattgaagttggccgcgatgatggtgttgaagttcgtcatatcgttggcgctatcgctaacgaaggtgatatcagcagccgttacatcggtaacatcaagctgtttgcttcacattcaactattgaactgccgaaaggcatgccgggcgaaatgttatctcacttcactcgcacccgtatcctgaacaagccgctgaacatgcagttgttgggtgatgcacagccgcatgagcgccgtgagcgtccagctggtggtaatggtggtgagcgtcgtggcggtggtgctggccgttcattcggtggcgaacgtcgtgacggtgccgctggtgctcctcctcgccgttcattcggtagtgaccgtgctccagccggtgctggcgaacagcgtcgtggcaatcgtgatggtcagcgcccagctgcaccacgtcgtgatgatgccgcagcgcctgctgcacctgctcgtcgtcgtttcggtgacgcataa

SEQ ID NO: 39010 - protein, 657 aa, Yersinia enterocolitica
MTTELETSFADLGLSAPILSALTDLGYEKPSPIQLECIPHLLNGRDVLGMAQTGSGKTAAFGLPLLHNIDPSLKAPQVLVLAPTRELAIQVAEALSSFSKHMNGVNVVALYGGQRYDVQLRALRQGPQVVVGTPGRLLDHLKRGTLNLSNLSGLVLDEADEMLRMGFIEDVENILAQIPAEHQTALFSATMPEAIRRITRRFMKEPQEVRIQSSMTTRPDISQSYWVVDGVRKNDALVRFLEAEDFDAAIIFVRTKNATLEVAEALERSGYNSAALNGDMNQAAREQTLERLKNGRLDILIATDVAARGLDVERISLVVNYDIPMDSESYVHRIGRTGRAGRAGRALLFVDRRERRLLQNIERTMKMTIPPVQLPNAELLGERRLAKFAAKVGQQLESSDLDMYRALLAKLQPEEGFDIETLAAALLKMAQGERPLILPPEAPRRPQREFNTRDDRGSDRGRDRNDSRREPRSDSRDGGERPARRERRDVGEMELYRIEVGRDDGVEVRHIVGAIANEGDISSRYIGNIKLFASHSTIELPKGMPGEMLSHFTRTRILNKPLNMQLLGDAQPHERRERPAGGNGGERRGGGAGRSFGGERRDGAAGAPPRRSFGSDRAPAGAGEQRRGNRDGQRPAAPRRDDAAAPAAPARRRFGDA

SEQ ID NO: 39011 - DNA, 2247 bp, Arabidopsis thaliana
  CDS (1)..(2247)
atggcgtcgacggtaggagttccatcactataccaagttcctcaccttgaaatctccaaacccaattccaaaaagaggtctaattgtttatctttatctctcgataagcctttcttcactcccttatctcttgttcgtagaactcgtcgtatccattcctcttctcttcttgttccttctgctgttgctactcctaattctgttctcagtgaagaagctttcaaaagtcttggtctttctgaccatgacgaatatgaccttgacggcgacaacaacaacgttgaagctgatgatggtgaagaactcgctatctctaaacttagtttgcctcaacgtcttgaagagtctcttgagaaacgtggtatcactcatctcttccccattcagagagctgtgttggtacctgcactgcaaggaagagatattatagctcgtgcaaagacaggaactggaaagactttggcttttggtattcctatcattaaacgtctcactgaagaagctggagactacactgctttcaggaggtctggtcgtcttcctaagttccttgtccttgcgccgacccgagagctggctaagcaagtggagaaggagattaaggagtctgcaccttatttgagcactgtttgtgtgtatgggggagtttcttataccattcagcagagtgctttaactcgtggtgttgatgttgttgttggaactcctggaagaatcattgatttgattgaaggaaggagtcttaaattgggagaagttgagtatttggtacttgatgaagctgatcagatgcttgctgttgggtttgaggaggccgtggaatcgattcttgagaatcttccaactaagcgacaaagtatgcttttctcagcaactatgcctacttgggttaagaagttggcgaggaagtaccttgacaatcccttgaatattgatctggttggagaccaagatgagaagctcgcagagggtatcaaactttatgcaatcgcaaccacatcgacatcaaaacgcactattctaagcgaccttattacagtgtatgcgaagggtggcaagaccattgtttttacccaaactaaaagagatgcagacgaagtttctcttgcattgtcaaacagtatagctaccgaagcacttcatggagatatatctcagcatcaaagagagagaacactcaatgctttccgtcaagggaaattcaccgtattagttgccactgatgttgcatctcgtggacttgacatcccgaacgtagatctagttatccactatgaacttcctaatgacccagaaacttttgtgcaccgttctggtcgtactgggcgtgcagggaaagaaggctctgccattctcatgcacaccagcagccaaaagagaacagtgaggtctctggagcgtgacgtaggctgccattttgaattcattagcccaccaactgttggagacttgttggaatcgtcagcagaccaagtggtggccactctaaatggtgttcaccctgactccataaagtttttctcagcaactgctcaaaaactatatgaggagaaaggaacagatgctttagctgcagctctagctcacctgagtggtttctctcagccgccttcatcaagatctctcctcagccatgagaagggatgggtgactttgcaattgatccgagatccaacgaacgctagaggctttctgtctgcgaggtctgttactggttttctttccgatctttaccgtacagctgcagatgaagttggaaaaatcttcttgatcgccgatgacaggatccaaggagctgtatttgatctaccagaggagatcgcgaaagagctcctagagaaagatgtccccgaaggcaacagtttatccatgataacaaagttacctccacttcaagatgacggaccatctagtgataactacggacggttctctagcagagacaggatgcctagaggaggaggaggttctagagggtcaagaggcggtagaggaggatcatcacgaggccgtgatagttggggaggtgatgatgacagaggtagtagaaggagcagtggtggaggaagcagctggtcccgaggtggtagtagttccagaggaagttctgatgattggttgatcggtggcagaagttcatcaagcagcagagctccttcgcgggagagaagttttggaggttcatgcttcatttgtgggaaatctggacacagggcaacagattgtcctgataagagaggattttag

SEQ ID NO: 39012 - protein, 748 aa, Arabidopsis thaliana
MASTVGVPSLYQVPHLEISKPNSKKRSNCLSLSLDKPFFTPLSLVRRTRRIHSSSLLVPSAVATPNSVLSEEAFKSLGLSDHDEYDLDGDNNNVEADDGEELAISKLSLPQRLEESLEKRGITHLFPIQRAVLVPALQGRDIIARAKTGTGKTLAFGIPIIKRLTEEAGDYTAFRRSGRLPKFLVLAPTRELAKQVEKEIKESAPYLSTVCVYGGVSYTIQQSALTRGVDVVVGTPGRIIDLIEGRSLKLGEVEYLVLDEADQMLAVGFEEAVESILENLPTKRQSMLFSATMPTWVKKLARKYLDNPLNIDLVGDQDEKLAEGIKLYAIATTSTSKRTILSDLITVYAKGGKTIVFTQTKRDADEVSLALSNSIATEALHGDISQHQRERTLNAFRQGKFTVLVATDVASRGLDIPNVDLVIHYELPNDPETFVHRSGRTGRAGKEGSAILMHTSSQKRTVRSLERDVGCHFEFISPPTVGDLLESSADQVVATLNGVHPDSIKFFSATAQKLYEEKGTDALAAALAHLSGFSQPPSSRSLLSHEKGWVTLQLIRDPTNARGFLSARSVTGFLSDLYRTAADEVGKIFLIADDRIQGAVFDLPEEIAKELLEKDVPEGNSLSMITKLPPLQDDGPSSDNYGRFSSRDRMPRGGGGSRGSRGGRGGSSRGRDSWGGDDDRGSRRSSGGGSSWSRGGSSSRGSSDDWLIGGRSSSSSRAPSRERSFGGSCFICGKSGHRATDCPDKRGF

SEQ ID NO: 39013 - DNA, 1239 bp, Arabidopsis thaliana
  CDS (1)..(1239)
atggcaggatctgcaccagaaggcacacagtttgatgcacgtcagtttgaccagaaactcaatgaagtacttgagggacaagatgagttcttcacatcctatgatgatgttcatgagagctttgatgccatgggtcttcaagagaaccttctcaggggtatttatgcttatggttttgagaagccttctgctattcagcaaagaggaatcgtccccttctgtaagggtcttgatgtgattcaacaggctcagtctggtactgggaaaacagcaactttctgctctggtgtcttgcagcagctggacttctcccttatccagtgtcaggctttggttctagctccaactagagagcttgctcagcaaattgagaaggtcatgagggcccttggtgattaccttggtgtcaaggttcacgcctgtgttggtggaaccagtgtccgtgaggatcagcgcatcctccaagctggtgtccatgttgttgttggaactccagggcgtgtctttgacatgttgaagaggcagtctcttcgtgctgacaacatcaagatgtttgttctcgatgaagctgatgaaatgctctcccgtggtttcaaggaccagatctatgacatattccagcttcttccaccaaagatccaagttggtgtgttctccgcaacaatgccaccagaagctcttgagatcacaaggaagttcatgagcaagccagtgagaatcttggtgaagcgtgatgagcttaccgttgaaggtatcaagcagttctacgtcaacgttgagaaagaagagtggaagctcgagacactctgtgatctctacgagactcttgccatcactcagagtgtcatcttcgtgaacaccaggcgtaaggttgattggctcacagacaaaatgagaagccgtgaccacacagtctctgcaactcacggagacatggaccagaacaccagggacatcatcatgagagagttcaggtctggttcctcccgtgttctcatcaccactgacctcttagctcgtggtattgatgtccaacaagtctccctggttatcaacttcgatctcccaactcagccagagaactaccttcaccgtatcggaagaagtggaaggttcgggagaaagggtgttgcgatcaatttcgtgacccgtgatgatgagaggatgctgtttgatattcagaaattctacaatgtggttgtcgaagagctgccttcgaacgtggccgatctgctgtga

SEQ ID NO: 39014 - protein, 412 aa, Arabidopsis thaliana
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTVEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 39015 - DNA, 1860 bp, Arabidopsis thaliana
  CDS (1)..(1860)
atggctgctaccgctgctgcttctgttgtccgttacgcacctgaggatcatactcttcccaagccctggaaaggccttatcgatgatagaactggttacttgtacttttggaatcctgagaccaatgttactcagtacgagaaaccaaccccctctctacctcctaagttttctcccgccgtttctgttagctcttccgttcaggttcaacaaactgatgcctatgctcctcccaaggatgacgataagtactccagaggctctgaacgtgtgtccaggttttctgagggtggcaggagtggaccgccttattcgaacggtgctgctaatggagttggggattctgcttatggtgcagcatctaccagagttcctcttccttcatcagctccagcaagtgaactatcccctgaggcctattcccgccgtcatgaaattactgtcagtgggggccaagtaccaccacctctaatgtcctttgaagctactggttttccacctgagcttctgcgggaggtactcagtgcaggtttctctgctccaactccaattcaagctcagtcatggcccattgctatgcaaggtagggacatagtagccattgctaaaactggctcgggaaaaactttgggttacttgattcctggatttttgcatcttcaacgtatccgaaatgattcgcgaatgggcccaacaatcttggtattgtctccaacgagagagctggccacacaaatccaagaagaagctgttaaatttgggaggtcatcaagaatttcgtgtacgtgtttgtatggtggtgcaccaaagggccctcagttgagggatttagaaagaggagcagatatcgtggttgcaactcctgggagattgaatgatatccttgaaatgaggaggattagtctgcgtcagatatcttatcttgtgctagatgaggcagatagaatgttggacatgggttttgaacctcagataaggaagattgtgaaagaaattcccactaagcgtcaaacccttatgtacacagctacatggccaaagggagttaggaaaattgcagctgacttgcttgttaaccctgctcaagtcaacattggcaatgttgacgagcttgtggctaacaagtcaatcacacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacagtagaagcagcaatggatggggaagagagcgagaaaagagccgtagccctgagagattcaacagagctccaccaccgtcttccaccggatctcctcctcgcagcttccacgagacgatgatgatgaaacacagatga

SEQ ID NO: 39016 - protein, 619 aa, Arabidopsis thaliana
MAATAAASVVRYAPEDHTLPKPWKGLIDDRTGYLYFWNPETNVTQYEKPTPSLPPKFSPAVSVSSSVQVQQTDAYAPPKDDDKYSRGSERVSRFSEGGRSGPPYSNGAANGVGDSAYGAASTRVPLPSSAPASELSPEAYSRRHEITVSGGQVPPPLMSFEATGFPPELLREVLSAGFSAPTPIQAQSWPIAMQGRDIVAIAKTGSGKTLGYLIPGFLHLQRIRNDSRMGPTILVLSPTRELATQIQEEAVKFGRSSRISCTCLYGGAPKGPQLRDLERGADIVVATPGRLNDILEMRRISLRQISYLVLDEADRMLDMGFEPQIRKIVKEIPTKRQTLMYTATWPKGVRKIAADLLVNPAQVNIGNVDELVANKSITQHIEVVAPMEKQRRLEQILRSQEPGSKVIIFCSTKRMCDQLTRNLTRQFGAAAIHGDKSQPERDNVLNQFRSGRTPVLVATDVAARGLDVKDIRAVVNYDFPNGVEDYVHRIGRTGRAGATGQAFTFFGDQDSKHASDLIKILEGANQRVPPQIREMATRGGGGMNKFSRWGPPSGGRGRGGDSGYGGRGSFASRDSRSSNGWGREREKSRSPERFNRAPPPSSTGSPPRSFHETMMMKHR

SEQ ID NO: 39017 - DNA, 1569 bp, Streptococcus sobrinus
  CDS (1)..(1569)
ttgaaatttactgaattacatttagcagaagatattctgcaagccgttgaaaaagctggttttgttgaaccatcccctattcaagagctgaccattcctttagccctagaaggcaaggatgttatcggtcaagcccaaacagggactggtaaaactgcggcctttggcctaccaactctcaacaaaattgacattgataataatgtcattcaagccttagtcatcgctccaacgcgggaattggcggttcaaagccaggaagaacttttccgctttggtcgtgaaaagggtgttaaggtccgttcggtttacggcggctccagcattgacaagcaaatcaaggccctgcgttcaggtgcccacattgttgtcggaacccctggccgtctcctagacttgattaaacgaaaagctcttaagctcaatcatattgagaccttgatcttggatgaagctgatgaaatgctcaatatgggcttcttggaagacattgaagccatcattagccatgtgcctgatgagcggcaaactttgctcttctcagcaaccatgccggatgctattaagcggattggtgtcaagttcatgaaagagcctgagcacgtcaagattgctgccaaggagttgaccagcgacaatgttgaacaattctatatccgagttaaggaacgtgaaaaatttgataccatgactcgactgattgatgtcgaacagccggaattgtctatcgtctttggtcggaccaaacgtcgggtggatgagttgacacgtggtctcaagctgcgtggataccgagcagagggcatccatggggacttggatcaaaacaaacgtctgcgggttattcgtgattttaagaacgataatctggacatcttagtagccaccgatgtcgctgcccgtggcctagatatttctggtgtgacccatgtctataactatgatattccccaagacccagaaagctatgtccaccggattggtcggacaggacgtgccggtaagtccggtaagtctgtgaccttcgtttctccaaatgaaatgggctatctctctattattgagaatctgaccaagaaacgcatgaaaggcctcaaaccagcctcagctcaggatgctttccaagctaagaaggctgttgccctcaagaaaattgaacgagacttctctgatgaaagtattcgctccaactttgataaattcaagggtgatgcccttaagttggctgaagaattctcaccagaggaattggccctctatatcctcagcctgaccgtgcaggatccagaaaccatgcctgaggtggaaatctctcgcgagcgtcctctgcccttcaaaccatccggtgctaatcgaggcgacggtaaaggtggccgcaataataatcgtggtcgtggtggccgtgatcgttaccgccgtgataatcgagacggcaatggtcgccgtgacttcaaacgcaagtctaataagaatttcagggacttcgacaagaaagacaataagcgacctcaccgcacctctagcgaaaagaaaaatggcttcgttatccgcaataagggtgatcgctaa

SEQ ID NO: 39018 - protein, 522 aa, Streptococcus sobrinus
MKFTELHLAEDILQAVEKAGFVEPSPIQELTIPLALEGKDVIGQAQTGTGKTAAFGLPTLNKIDIDNNVIQALVIAPTRELAVQSQEELFRFGREKGVKVRSVYGGSSIDKQIKALRSGAHIVVGTPGRLLDLIKRKALKLNHIETLILDEADEMLNMGFLEDIEAIISHVPDERQTLLFSATMPDAIKRIGVKFMKEPEHVKIAAKELTSDNVEQFYIRVKEREKFDTMTRLIDVEQPELSIVFGRTKRRVDELTRGLKLRGYRAEGIHGDLDQNKRLRVIRDFKNDNLDILVATDVAARGLDISGVTHVYNYDIPQDPESYVHRIGRTGRAGKSGKSVTFVSPNEMGYLSIIENLTKKRMKGLKPASAQDAFQAKKAVALKKIERDFSDESIRSNFDKFKGDALKLAEEFSPEELALYILSLTVQDPETMPEVEISRERPLPFKPSGANRGDGKGGRNNNRGRGGRDRYRRDNRDGNGRRDFKRKSNKNFRDFDKKDNKRPHRTSSEKKNGFVIRNKGDR

SEQ ID NO: 39019 - DNA, 1464 bp, Synechococcus sp
  CDS (1)..(1464)
atgaccacttcttttcaaaccatcggcttatccgacgctcgcgttgacctgttagaaaatatcggcttcgaaaagcccaccgagattcaaagtaaagcgatccccgcaatcctcgaaggccgggacgtggtgggactatcccaaacaggtacaggtaaaaccgccgcctactccctgcctttccttgaaaaaattgacctggaacaaaagaccgtccagggtttgattctgacccccacccgtgaactggcggtgcaggtgacccagtccctcaaggaattcgccgtggatcgtcgtctctgggtgctcaccgtctgcggtggtcaatccatggaacggcaaattcgcagcctgcaaaagggcgtccacattgttgtgggtacgccgggccgggtcatcgatctcctcgaacggggtaagttgtcctttgaagaactccgttgggcagtgcttgacgaagccgatgaaatgctcagtatgggcttcattgatgatgtgaaaaagattttgcgtcagtcccccaaaactcgccaaacggtttgtttctcggcgaccatgccccccgcaatccgggatctggtggaaaatttcctcaatgacccgatcaacatcacgatcaaacagccccaggtcacgcctgaccgcattgcccaagaagtctatatgattccgcgcggttggtcaaaaaccaaagccctcctgcccatcttggaaatggcaaacccagagtcggcgattatcttcgtgcgcacgaaacgtacagcttcggagttgaccaatgagttggttgaagcgggccaaagtgccgatgagtaccatggcgacctcaaccaaaaccaacgggaaaaactggtacgtcgctttaaggatggcaagatcaagatgattgtcgccacggatattgcggcgcggggtctggacgtggaaaacctcagccacgtgattaactttgatttaccagataatacggaaagttacattcaccgcatcggtcggacgggtcgggctggtaaaacgggaacggcgatcgccctcgtcgaacccagcgatcgccggttgttacgtcaaattgaacggcgcgtcaaacagtccctcaaggtttcgactattccgagccgcactgaagtagaagcccaacgagtgacccgcctggaaacccaagtacgggaagccttggccggggaacggatggcctccttcttgccgattgtgaagcgtttgggtgatgagtatgatccccaggcgatcgccgcggcggtattgcaaatgatgtacgacaataattcccccgaatggctcaacgaagattgggaagtaccggaagtcaacaccaagacaggtctccccaagccgacgaaaaaaggtggccgcagcggacgtcgttctaactacaaagggagtggcggtggctacaaaggcgatcgctcccggggacgccgttcctacagttccaaccattcctaa

SEQ ID NO: 39020 - protein, 487 aa, Synechococcus sp
MTTSFQTIGLSDARVDLLENIGFEKPTEIQSKAIPAILEGRDVVGLSQTGTGKTAAYSLPFLEKIDLEQKTVQGLILTPTRELAVQVTQSLKEFAVDRRLWVLTVCGGQSMERQIRSLQKGVHIVVGTPGRVIDLLERGKLSFEELRWAVLDEADEMLSMGFIDDVKKILRQSPKTRQTVCFSATMPPAIRDLVENFLNDPINITIKQPQVTPDRIAQEVYMIPRGWSKTKALLPILEMANPESAIIFVRTKRTASELTNELVEAGQSADEYHGDLNQNQREKLVRRFKDGKIKMIVATDIAARGLDVENLSHVINFDLPDNTESYIHRIGRTGRAGKTGTAIALVEPSDRRLLRQIERRVKQSLKVSTIPSRTEVEAQRVTRLETQVREALAGERMASFLPIVKRLGDEYDPQAIAAAVLQMMYDNNSPEWLNEDWEVPEVNTKTGLPKPTKKGGRSGRRSNYKGSGGGYKGDRSRGRRSYSSNHS

SEQ ID NO: 39021 - DNA, 1869 bp, Pisum sativum
  CDS (1)..(1869)
atgtcgtatgttcctccacacttgagaaacgcgagctcaaccgcggtggctacaaccaccagaccttcagcatcatccggaaccctagaccaccaccaccacaacaccaacctcgcattctcttcctcgtaccctcactccaactcttcttctctagccaatggttctcgtcgtacctctgccgcaacctccgccatctcggaattggtcaccgtccctgacactgtcttccctaactggcaaccttctgaacgcgtttcccgcatgaaccccgaccagattgaagaggtcgtacggcttaatcttgacgttactgtttcatctgactctactgccgcacctggacctatagaatcgtttaatgatatgtgtttgcatccaagtatcatgaaggatattgcttatcatgaatacaccaggccaagctctatccaggcacaggccatgccaattgctctcagtggaagggatcttttgggttgtgcagaaactggtagtgggaagactgcagctttcaccattcctatgttacagcattgcttggtccaacctccaattcgacgtggagatggtcccctggcattagttttggctcctactagagaacttgctcaacaaatagaaaaggaggtccaagcatttagcagatccctcgagtcattaaagaactgcatagttgttggtggaactaacattgaaaagcagaggtctgaactaagagcaggagttgaaatagcagtcgccacccctggaagattcattgaccacttacaacaaggcaacacttctctctctagaatttcttatgttgttctagacgaggcagatagaatgcttgatatggggtttgaaccacaaataagggagatcatgagaagtctacctgagaagcatcaaacactgctgtttagtgcaacgatgcctgtggagatcgaagcattagcaaaggagtacttagctaacccagttcaagttaaggtgggaaaagtgagcagcccaacaactaatgtttcacaaactcttgtaaaggtgtctggaagtgagaagattgaccgactcctagatttgcttgtagaagaggcatcacaagctgaaaagtgtggtcatcgatttccattgactattgtgtttgttgagagaaagacaaggtgcgatgaagtggctgaagcattggttgctcaaggattatctgcagtttctctgcatggtggtcacagtcagaatgaaagagaggctgcattacaaaattttcggagcagctccaccagcattttggttgccactgatgttgcatcacggggcttggatgtcacaggagtgtcacacgtcatcaatcttgaccttccaaagaccacagaagattatatacaccggattggaaggacagggcgtgcaggatcaactggcatagccacttcgttttacactgatcgtgacatgttccttgtgacaaatataaggaaagcaatagctgatgctgaatctgggaatgctgtggcatttgctactggaaaggttgccagaaggaaggagaaagaagcagcagctgcacacaaggaagcaaatattgcttcatctagacaccttggattaggagctgcatcaattaacatcgaagataagtacagattcatgattgctgcctcaaacagtagaggagaaggcgcagagatagtgcatgggatgattgatgaagtttctgatctacctcccatacatttgatctataggtatgttgtttggcagatactggagatggacaagttaagtttgcatgcctacgtactgtttcacacgttgctagctagcaaactggtaaccggtagcttcctagacacaatttgtagaatcagtcatgtttgtaggtaa

SEQ ID NO: 39022 - protein, 622 aa, Pisum sativum
MSYVPPHLRNASSTAVATTTRPSASSGTLDHHHHNTNLAFSSSYPHSNSSSLANGSRRTSAATSAISELVTVPDTVFPNWQPSERVSRMNPDQIEEVVRLNLDVTVSSDSTAAPGPIESFNDMCLHPSIMKDIAYHEYTRPSSIQAQAMPIALSGRDLLGCAETGSGKTAAFTIPMLQHCLVQPPIRRGDGPLALVLAPTRELAQQIEKEVQAFSRSLESLKNCIVVGGTNIEKQRSELRAGVEIAVATPGRFIDHLQQGNTSLSRISYVVLDEADRMLDMGFEPQIREIMRSLPEKHQTLLFSATMPVEIEALAKEYLANPVQVKVGKVSSPTTNVSQTLVKVSGSEKIDRLLDLLVEEASQAEKCGHRFPLTIVFVERKTRCDEVAEALVAQGLSAVSLHGGHSQNEREAALQNFRSSSTSILVATDVASRGLDVTGVSHVINLDLPKTTEDYIHRIGRTGRAGSTGIATSFYTDRDMFLVTNIRKAIADAESGNAVAFATGKVARRKEKEAAAAHKEANIASSRHLGLGAASINIEDKYRFMIAASNSRGEGAEIVHGMIDEVSDLPPIHLIYRYVVWQILEMDKLSLHAYVLFHTLLASKLVTGSFLDTICRISHVCR

SEQ ID NO: 39023 - DNA, 1494 bp, Lactobacillus reuteri
  CDS (1)..(1494)
ttgaagtttagtgaattaggcttatccgatagcctattaaaagcaatcaaacggagcggatacgaagaagcaacaccaattcaagaacaaacgattccaatggttcttgagggtaaggatgttattggtcaagcacagactggaactggtaagacggctgcttttgggttgccaattattgaaaacgttgatactgaaaatcccaatattcaagcaattatcatttcaccaacacgtgaattagcgatccagacccaagaagaactttatcgtctaggtaaagataaacatgttcgcgtgcaggtagtctatggtggggcagatattcggcgccaaattaagagcttgaaacaacacccccaaattctcgtggggacccctggacggttacgtgaccatattaaccgtcatacagttaaacttgaccacattaagaccctggttctcgatgaagcagatgaaatgctaaacatgggattcttagaagatattgaatccatcatcaaggaaacaccagatgatcggcaaactttgctcttctcagcaaccatgccaccagaaatcaagcgaattggggttcaatttatgtctgatccggaaactgtgcggatcaaggccaaggaattgactactgacttagttgatcagtactatgttcgcgctcgtgactatgaaaagtttgacatcatgacccgcttaattgatgttcaagatcctgacttaacaattgtctttggtcggacaaagcggcgggtagatgaattgtcgaagggcttgattgcgcgtggctacaatgcagctggtatccatggtgaccttactcaggataagcgttctaagatcatgtggaagtttaagaacaatgaacttgatatcttagttgcaacagatgtggctgcccggggcttagacatttcgggggttacgcatgtttataattatgatattccatctgacccagacagctatgttcaccggattggccgaacaggacgggccggacatcacggggtatctttaacctttgtgactccaaatgagatggattaccttcatgagattgaaaaattaacccgggtacggatgttgccactcaagccaccaacagctgaagaagcatttaagggtcaagtagcatcggcctttaatgatatcgatgaattaatcgcgcaggattcaactgatcgttatgaagaagccgctgaaaagctattagaaactcataatgcaactgacctagtagcagcattgttaaataacatgacgaaggaagcagcgagtgaggttcccgttaagattacccctgagcgtccccttccacggcgtaataagcggaataaccgtaatggcaaccgcaataactcgcatggtggcaaccactaccggcgtaagaatttccgtcgtcaccaacatggcagtcatcgaaatgataaccatgggaagagccattccagtcgtcattcatttaatattcggcaccggaaagaaaattaa

SEQ ID NO: 39024 - protein, 497 aa, Lactobacillus reuteri
MKFSELGLSDSLLKAIKRSGYEEATPIQEQTIPMVLEGKDVIGQAQTGTGKTAAFGLPIIENVDTENPNIQAIIISPTRELAIQTQEELYRLGKDKHVRVQVVYGGADIRRQIKSLKQHPQILVGTPGRLRDHINRHTVKLDHIKTLVLDEADEMLNMGFLEDIESIIKETPDDRQTLLFSATMPPEIKRIGVQFMSDPETVRIKAKELTTDLVDQYYVRARDYEKFDIMTRLIDVQDPDLTIVFGRTKRRVDELSKGLIARGYNAAGIHGDLTQDKRSKIMWKFKNNELDILVATDVAARGLDISGVTHVYNYDIPSDPDSYVHRIGRTGRAGHHGVSLTFVTPNEMDYLHEIEKLTRVRMLPLKPPTAEEAFKGQVASAFNDIDELIAQDSTDRYEEAAEKLLETHNATDLVAALLNNMTKEAASEVPVKITPERPLPRRNKRNNRNGNRNNSHGGNHYRRKNFRRHQHGSHRNDNHGKSHSSRHSFNIRHRKEN

SEQ ID NO: 39025 - DNA, 1641 bp, Saccharomyces cerevisiae
  CDS (1)..(1641)
atgacttacggtggtagagatcagcaatataacaagactaactacaagtctagaggtggcgacttccgcggtggaagaaactctgatagaaactcttacaatgacagaccacaaggcggtaactaccgtggtggtttcggtggtcgttccaattacaaccaaccccaggaattgatcaaaccaaactgggatgaagaattacccaaattgccaactttcgaaaagaatttctatgttgaacacgaaagtgttcgcgacagatcggacagtgagattgctcagttcagaaaggaaaatgaaatgactatttccggacacgatattccaaagccaatcaccactttcgatgaagctggtttcccagactacgttttgaatgaagtgaaggctgaaggatttgacaaaccaactggcattcaatgtcagggttggccaatggctttatctggtagggacatggttggtattgctgccactggttccggtaagactttgtcttattgtttaccaggtattgttcatatcaacgctcaaccattattggctccaggcgatggaccaattgttttggttttggctccaactagagaattggctgttcaaattcaaacagaatgttccaagtttggtcatagttccagaatcagaaatacctgtgtctacggtggtgttccaaaaagtcaacaaatcagagatttatctcgtggctctgaaattgttattgctactccaggtcgactaattgatatgctagagattggtaagactaatttgaagagagtcacttacctggttcttgatgaagctgatagaatgttagatatgggttttgaacctcaaatcagaaagattgttgatcaaatcagacctgatagacaaaccttgatgtggtctgccacttggccaaaggaggtgaagcaactagccgctgattacttgaatgatccaattcaagttcaagttggttctctagaactatctgcctcccataatattactcagatcgtcgaagttgtttctgatttcgaaaagagagatcgtttgaacaagtacttagaaacagcctctcaagacaacgaatacaagacattaatctttgcttctacgaaaagaatgtgcgatgatatcaccaagtatctaagagaagatggatggcccgccttggctattcatggtgacaaagaccaaagagaacgtgactgggttctacaagagtttagaaacggtagatccccaattatggttgctactgatgtggccgccagaggtatcgatgtcaaaggtatcaattacgttatcaactacgatatgccaggtaacattgaagattatgttcacagaatcggtagaactggtagagcaggtgctactggtactgctatatctttcttcaccgaacaaaacaaaggtttaggtgctaaattaatctctatcatgagagaagctaatcaaaatattcctcccgaattattgaaatacgacaggagatcttatggtggcggtcacccaagatacggtggtggtcgtggtggtcgtggtggctatggccgtagaggtggttacggtggtggccgtggtggttacggcggtaacaggcagagagatggtggctggggtaacagaggtcgttcaaactattga

SEQ ID NO: 39026 - protein, 546 aa, Saccharomyces cerevisiae
MTYGGRDQQYNKTNYKSRGGDFRGGRNSDRNSYNDRPQGGNYRGGFGGRSNYNQPQELIKPNWDEELPKLPTFEKNFYVEHESVRDRSDSEIAQFRKENEMTISGHDIPKPITTFDEAGFPDYVLNEVKAEGFDKPTGIQCQGWPMALSGRDMVGIAATGSGKTLSYCLPGIVHINAQPLLAPGDGPIVLVLAPTRELAVQIQTECSKFGHSSRIRNTCVYGGVPKSQQIRDLSRGSEIVIATPGRLIDMLEIGKTNLKRVTYLVLDEADRMLDMGFEPQIRKIVDQIRPDRQTLMWSATWPKEVKQLAADYLNDPIQVQVGSLELSASHNITQIVEVVSDFEKRDRLNKYLETASQDNEYKTLIFASTKRMCDDITKYLREDGWPALAIHGDKDQRERDWVLQEFRNGRSPIMVATDVAARGIDVKGINYVINYDMPGNIEDYVHRIGRTGRAGATGTAISFFTEQNKGLGAKLISIMREANQNIPPELLKYDRRSYGGGHPRYGGGRGGRGGYGRRGGYGGGRGGYGGNRQRDGGWGNRGRSNY

SEQ ID NO: 39027 - DNA, 1440 bp, Bacillus subtilis
  CDS (1)..(1440)
atgagtcattttaaaaactatcaaatcagtcatgacattttacgagcattggaaggactgggatatacagaaccgaccaaggtgcagcagagtgtgatccccgctgcccttgaacgaaaggatcttgtcgtcaaatcacagacaggaagcgggaaaacggcttcgttcgggattcctctctgtgagctggcgaattgggatgaaaacaagccgcaggcgcttattttaacaccgacccgtgagcttgcggtgcaagtaaaggaagatatcacgaacatcggacgatttaaacggatcaaagcgacagccgtatttggaaaatcctcctttgataaacaaaaagctgagcttaagcaaaaaagccacattgttgtcggcacgccgggacgtgttctggatcatatcgaaaaaggcacgctgccgttggatcgtctctcttatttggtcattgatgaagcggatgagatgctgaatatgggcttcattgagcaggtggaggcgattatcaagcatctgccgactgagcgtacgacgatgctgttttcagcgacgcttccgcaggatatcgagaagctgagccgtcaatatatgcaaaaccccgagcatatcgaggtcaaagcggccggcctaaccacaagaaatattgaacatgcggtgattcaagtaagagaagagaataagttttcattgctgaaagatgtgctgatgacggagaatcccgacagctgcatcattttctgccgaacgaaggagcacgtcaatcagctgaccgatgaattggatgacttgggatatccatgcgataaaattcacggcggaatgattcaggaagaccgattcgacgtcatgaatgaatttaaacgtggcgagtaccgttacttagtggcgacggatgtcgccgcgcgcgggattgatattgaaaatatctcccttgtcatcaactatgatctgccgcttgaaaaagaaagctatgtccaccgcacgggccgaacgggacgcgcagggaacaaaggaaaggccatttcgtttgtcacggccttcgaaaaacggtttttagccgacattgaagaatatatcggatttgaaatcccaaaaatagaagcaccttctcaagaggaagtggcaaggaagaaaccagaatttctagctaaactgaatgaccgtccggaaagcaaaaaggacaaaagcgaagagctgaataaagacattatgaagctgtattttaacggcggaaagaaaaagaaaatcagagccgttgattttgtaggaacgattgccaaaattgacggtgtgtcagctgacgacatcggcatcatcacgatcatggataacgcctcatacgttgagattttaaatggtaaaggccctcatgttctcaaagtgatgaagaacacaaccgtcaaagggaaacagctgaaggtgaataaagcgaataaatga

SEQ ID NO: 39028 - protein, 479 aa, Bacillus subtilis
MSHFKNYQISHDILRALEGLGYTEPTKVQQSVIPAALERKDLVVKSQTGSGKTASFGIPLCELANWDENKPQALILTPTRELAVQVKEDITNIGRFKRIKATAVFGKSSFDKQKAELKQKSHIVVGTPGRVLDHIEKGTLPLDRLSYLVIDEADEMLNMGFIEQVEAIIKHLPTERTTMLFSATLPQDIEKLSRQYMQNPEHIEVKAAGLTTRNIEHAVIQVREENKFSLLKDVLMTENPDSCIIFCRTKEHVNQLTDELDDLGYPCDKIHGGMIQEDRFDVMNEFKRGEYRYLVATDVAARGIDIENISLVINYDLPLEKESYVHRTGRTGRAGNKGKAISFVTAFEKRFLADIEEYIGFEIPKIEAPSQEEVARKKPEFLAKLNDRPESKKDKSEELNKDIMKLYFNGGKKKKIRAVDFVGTIAKIDGVSADDIGIITIMDNASYVEILNGKGPHVLKVMKNTTVKGKQLKVNKANK

SEQ ID NO: 39029 - DNA, 1446 bp, Xenopus laevis
  CDS (1)..(1446)
atgagcaccgccagaacagagaaccctgttttaatgggtatgtcaagccagaatgggcagctaagaggcccattgaaacccagtgcagggcctggaggtggggggacacagacacaacaaataaaccagctgaaaaatgccagcacaatcaacagtggcagtcagcagcaagcacagagcatgagcagcattataaagcctggtgatgactggaagaagactttaaaactccctccaaaagaccttagaatcaagacttcggatgtcacctccacaaaaggaaatgagtttgaagattattgtttaaaaagagagctgctcatgggaatatttgaaatgggatgggaaaaaccatctccaatacaggaggagagcattcccattgcattgtctggtagggatatcttggctagagcaaaaaatggaactggcaagactggcgcctacctcattcccttacttgaacggctagacctaaagaaggactgtatacaagcaatggtgattgttcctactcgagaactggcactacaggtcagtcagatttgcatccaggtcagcaagcacatgggcggggccaaagtcatggcgacaacagggggaacaaatctgcgggatgatataatgaggcttgatgatacagtacatgtagtaatagcaactcctggcaggattctggatctcattaagaaaggtgtggctaaagtagaccatatccagatgattgtgttggatgaggcagacaaactgctgtctcaggatttcatgcaaataatggaggatataattatgacgctacctaaaaacagacagattcttctttactcagccacatttcccctaagtgttcagaagtttatgactttacatttgcaaaaaccctatgagattaacctgatggaagaattgacgctgaaaggagtaacgcaatattatgcctatgtgacagaacggcagaaagttcactgcctcaacacactgttctcaaggctccaaatcaaccagtcgatcattttctgcaactcctcccaacgagttgaactcctggctaagaaaatatctcaattgggttattcatgtttctacatacatgcaaagatgagacaggagcacaggaatcgtgtttttcatgatttcagaaatggcttgtgccgaaatcttgtatgcactgatctgtttacccgtggtattgatatccaagctgtgaatgtggtgataaactttgactttccaaagctggcagagacatacttgcatcgcataggaagatcaggtcgatttggccaccttgggcttgccataaacttgatcacttatgatgaccgattcaaccttaaaagtattgaagaacagctgggaacagaaatcaagcccatacccagcagcatagacaagaacttatatgtggcagaatatcacagtgaatctggggaagacaaaccttaa

SEQ ID NO: 39030 - protein, 481 aa, Xenopus laevis
MSTARTENPVLMGMSSQNGQLRGPLKPSAGPGGGGTQTQQINQLKNASTINSGSQQQAQSMSSIIKPGDDWKKTLKLPPKDLRIKTSDVTSTKGNEFEDYCLKRELLMGIFEMGWEKPSPIQEESIPIALSGRDILARAKNGTGKTGAYLIPLLERLDLKKDCIQAMVIVPTRELALQVSQICIQVSKHMGGAKVMATTGGTNLRDDIMRLDDTVHVVIATPGRILDLIKKGVAKVDHIQMIVLDEADKLLSQDFMQIMEDIIMTLPKNRQILLYSATFPLSVQKFMTLHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSSIDKNLYVAEYHSESGEDKP

SEQ ID NO: 39031 - DNA, 2336 bp, Klebsiella pneumoniae
  CDS (266)..(2197)
atgactacgttgagcaccgatacgattgttggaattatcgctcttgggccaggagcaagatgacctggcagaatcggaccagcaatagctgacgaacacatcagcccatagttttttgcttgccatcaccttcgcgggtgagggcgttgttgttcgttaatacacctactttgagccggttcacacttttcaatgaaaattaccgtaaattttcacgatgagttatgtagactggccgccattaattttgaggcacacgtactacatggctgaattcgaaaccacttttgcagatctgggcctgaaggctcctatccttgaagcgctcaccgatctgggttacgaaaaaccatctccgatccaggctgagtgcattccgcatctgctggacggccgcgacgttctgggtatggcccagaccggtagcggtaaaaccgcagcattctctttaccgctgctgaacaacatcgatcctgagctgagagcaccgcagattctggtgctggcgccgacccgcgagctggcggtacaggttgctgaagcaatgacggaattctctaaacatatgcgcggcgtgaacgtggttgccctgtatggcggccagcgttatgacgtgcagctgcgcgccctgcgtcagggtccgcagatcgtcgtcggtaccccgggtcgtctgctggaccaccttaagcgcggcaccctggacctctccaaactgagcggcctggtactggatgaagcagatgaaatgctgcgcatgggctttatcgaagacgtagaaaccattatggcgcagatcccggaagggcatcagaccgcgctgttctccgccaccatgccggaagctatccgacgcattacccgtcgctttatgaaagagccgcaggaagtgcgcattcagtccagcgtgacgactcgcccggatatcagccagagctactggacggcctacggcatgcgtaaaaacgaagcgctggtgcgtttcctggaagcggaagactttgatgcggcgattatcttcgtccgtaccaaaaacgcgaccctggaagtagctgaagcgctggagcgtaatggctacaacagcgcggcgctgaacggcgacatgaaccaggcgctgcgtgaacaggctctggaacgcctgaaagatggtcgtctggatatcctgattgcgactgacgttgcggcccgtggcctggacgttgagcgtatcagcctggtggtgaactacgacatcccaatggattctgaatcctacgttcaccgtatcggccgtactggtcgtgccggtcgtgctggccgcgcgctgctgttcgttgagaaccgcgagcgtcgtctgctgcgcaacatcgaacgcaccatgaagctgaccattcctgaagtggaactgcctaacgcggagctgctgagcaagcgtcgtctggaaaaattcgccgcgaaagttcagcagcagctggaaagcagcgatctggatcagtaccgtgcactgctggcgaaaatccacgcgacggcggaaggtgaagagctggacgtggaaacgctggctgctgcgctgctgaagatggctcagggcgaacgttcgctgatcgttccgccggtcgcgccgatgcgtccacgtcgtgaattccgcgatcgtgacgattcgttcgaccgtcgtggcgaccgtaatgatcgcggcccgcgcggcgatcgcgaagatcgtccgaagcgtgagcgtcgtgacgtgggtgacatggagctgtatcgcattgaagtgggtcgcgatgacggcgttgaagtgcgtcatatcgttggcgcgatcgccaatgaaggcgatatcagcagccgttacatcggtaacatcaagctgttcgcttctcactccaccattgagctgccgaaagggatgccgggcgaagtgctgcagcactttactcgtacccgtatcctgaacaagccgatgaacatgcagctgctgggcgatgcgcagccgcgcaccgaacgtcgtggcggcggtgagcgtcgcgaaggcggccgtggcttcggcggcgagcgtcgtgaaggcggccgtggcttcggtggcgaacgtcgtgaaggcggtcgtggtgaaggacgtcgtttcagcggcgaacgtcgtgaaggccgtgcgccgggtcgtgacgatgcatccgcgccgcgccgcgatgactcagccggtcgccgtcgcttcggtggcgatgcgtaatcaacgccgcccgctagcgtaaactaaataatacagccccgatcgtcatgattggggctttttttattccctttgtactcatgtactggtacagtgcgtcatgctcaacgtgagcgaagtattttcgactggagaattc

SEQ ID NO: 39032 - protein, 643 aa, Klebsiella pneumoniae
MAEFETTFADLGLKAPILEALTDLGYEKPSPIQAECIPHLLDGRDVLGMAQTGSGKTAAFSLPLLNNIDPELRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTAYGMRKNEALVRFLEAEDFDAAIIFVRTKNATLEVAEALERNGYNSAALNGDMNQALREQALERLKDGRLDILIATDVAARGLDVERISLVVNYDIPMDSESYVHRIGRTGRAGRAGRALLFVENRERRLLRNIERTMKLTIPEVELPNAELLSKRRLEKFAAKVQQQLESSDLDQYRALLAKIHATAEGEELDVETLAAALLKMAQGERSLIVPPVAPMRPRREFRDRDDSFDRRGDRNDRGPRGDREDRPKRERRDVGDMELYRIEVGRDDGVEVRHIVGAIANEGDISSRYIGNIKLFASHSTIELPKGMPGEVLQHFTRTRILNKPMNMQLLGDAQPRTERRGGGERREGGRGFGGERREGGRGFGGERREGGRGEGRRFSGERREGRAPGRDDASAPRRDDSAGRRRFGGDA

SEQ ID NO: 39033 - DNA, 2259 bp, Saccharomyces cerevisiae
  CDS (1)..(2259)
atggtggtaggaactaaaaaatactctaatttggactttgtccctacaatcagtgacagtgaagacgatgttccaattctagattcttctgatgacgaaaaagtcgaggctaagaagactacgaagaagcggaagggtaagaataacaagaaaaaggttagtgagggggataacctcgatgaggatgttcatgaggacttggacgcggggtttaagtttgatttggacgccgatgataccacttcgaacttccaaggctggaactttctagcagagggcgagtccaataaggacgatgccgaagcttttgtgaagaaggacgttgacttggataagattattagaagaaaaggtgggctggtgaaaatggcccatattgatagtaaacaagaagaagaaaccgagaaagaaaaagtagaaaaagaaaacgatagcgacgatgaggaattagcaatggacgggttcggtatgggagctcccatgaacaatggagacgaaaatcagtcagaagaagaagaagaagaggaggaaaaggaagaggaagaggaggaagaggaggaacaagaagagatgacgttagaaaaaggcggcaaagatgacgaaatagatgaagaagacgattctgaagaggcaaaagccgatttctatgcgcctgaaactgagggagatgaagctaaaaagcaaatgtacgaaaatttcaacagtttgtctttatctcgtccggttcttaagggccttgcaagtttgggttacgtcaagccttcccctattcaaagcgccacaatccccattgccttattgggtaaagacatcattgccggtgctgtgactggttccggtaagactgctgcgtttatgattcccataatcgagcgtttgttgtataaaccagccaaaatcgcttccaccagagttattgttctattgcccactcgtgagttagctatccaagtcgctgacgttggtaaacaaattgcacgtttcgtctccggtataacctttggtctggccgttggtggtttgaacttgagacaacaagaacaaatgttgaaatctcgtccggacatcgtcattgctaccccaggtagattcattgatcatatcaggaactcagcaagttttaatgtggactcagtagagattctggttatggatgaagccgatagaatgttagaagaaggttttcaagatgaactgaacgaaattatgggcctattaccaagcaatagacagaacctattgttttctgctacaatgaactccaaaattaaaagtttagttagtctttctctaaaaaaaccagtaaggattatgattgatcctccaaagaaagctgctactaagttgacacaagaattcgttcgtattcgtaaaagagaccatttgaagcctgccttgttatttaatttgattaggaaattggatccaacgggtcaaaagaggattgtcgtttttgtggctagaaaagaaactgctcataggttaaggattatcatgggtcttttaggtatgagtgtgggtgaattacacggttctttaacccaagaacagcgtttagattccgttaataaattcaaaaatttggaagttcctgtacttatctgtacggatttggcctccagaggtcttgatatccccaagattgaggttgttatcaactacgatatgcccaagagttatgagatctacctgcatagagttggtcgtaccgccagagctggtagggaaggtcgttccgtcaccttcgtcggtgaatcatctcaagatagaagtattgtacgtgctgctataaagagtgtagaagaaaataagtccctaactcaaggtaaagcacttggtagaaacgtagactgggttcaaatcgaagaaacaaacaaacttgttgaatccatgaacgatacgattgaagatattctggtggaagaaaaggaggagaaggaaatattaagggctgaaatgcaattaagaaagggtgaaaatatgttgaagcataaaaaggaaatccaggcaagaccaagaaggacatggttccaaagcgaatcagataagaaaaattccaaagtattaggtgctttatcaaggaacaagaaagtcactaacagcaaaaagagaaagcgtgaagaagctaaggcagatggcaatggtgcacgttcttatagaaaaaccaaaaccgaccgtattgcagatcaagaaagaacttttaaaaagcagaagagtacaaattcaaataagaagaagggcttcaaaagccgtaggtaa

SEQ ID NO: 39034 - protein, 752 aa, Saccharomyces cerevisiae
MVVGTKKYSNLDFVPTISDSEDDVPILDSSDDEKVEAKKTTKKRKGKNNKKKVSEGDNLDEDVHEDLDAGFKFDLDADDTTSNFQGWNFLAEGESNKDDAEAFVKKDVDLDKIIRRKGGLVKMAHIDSKQEEETEKEKVEKENDSDDEELAMDGFGMGAPMNNGDENQSEEEEEEEEKEEEEEEEEEQEEMTLEKGGKDDEIDEEDDSEEAKADFYAPETEGDEAKKQMYENFNSLSLSRPVLKGLASLGYVKPSPIQSATIPIALLGKDIIAGAVTGSGKTAAFMIPIIERLLYKPAKIASTRVIVLLPTRELAIQVADVGKQIARFVSGITFGLAVGGLNLRQQEQMLKSRPDIVIATPGRFIDHIRNSASFNVDSVEILVMDEADRMLEEGFQDELNEIMGLLPSNRQNLLFSATMNSKIKSLVSLSLKKPVRIMIDPPKKAATKLTQEFVRIRKRDHLKPALLFNLIRKLDPTGQKRIVVFVARKETAHRLRIIMGLLGMSVGELHGSLTQEQRLDSVNKFKNLEVPVLICTDLASRGLDIPKIEVVINYDMPKSYEIYLHRVGRTARAGREGRSVTFVGESSQDRSIVRAAIKSVEENKSLTQGKALGRNVDWVQIEETNKLVESMNDTIEDILVEEKEEKEILRAEMQLRKGENMLKHKKEIQARPRRTWFQSESDKKNSKVLGALSRNKKVTNSKKRKREEAKADGNGARSYRKTKTDRIADQERTFKKQKSTNSNKKKGFKSRR

SEQ ID NO: 39035 - DNA, 1575 bp, Streptococcus pneumoniae
  CDS (1)..(1575)
gtgaaatttaatgaattaaacttgtctgctgatttgctagcagaaattgaaaaagctggttttgtagaagctagtcctatccaagaacaaactattcctttggcccttgaaggcaaggatgttatcggtcaagctcagactggtacaggaaaaactgcagcctttggcttgcctacccttgaaaaaatccgtacagaagaagcgactatccaagccttggtcatcgctccaactcgtgaactagctgtccaaagtcaagaagaactcttccgctttggtcgtagtaagggagtcaaagtccgttcagtatatggcggatcaagcattgaaaaacaaattaaggctcttaaatctggtgcccatattgtggtgggaactccaggtcgcctcttggacttgattaaacgcaaggccttgaaattacaagacattgaaacccttatccttgacgaagcggatgaaatgcttaacatgggcttccttgaagacatcgaagccattatttcccgtgtacctgagaaccgtcaaactttgcttttctcagcaactatgccagatgccatcaaacgtatcggtgttcagtttatgaaagcccctgaacatgtcaagattgcggctaaggaattgacaacagaattggttgaccagtactatatccgtgttaaggaacaagaaaaatttgacaccatgactcgtctcatggatgtggcacaaccagaactcgctattgtatttggtcgtaccaaacgccgtgtggatgaattgactcgtggtttgaaaattcgtggcttccgtgcagaaggaattcatggcgacctagaccaaaacaaacgtcttcgtgtccttcgtgactttaaaaatggcaatcttgatgttttggttgcgacagacgttgcagcgcgtggtttggatatttcaggtgtgacccatgtctacaactacgatattccacaagatcctgagagttatgttcaccgtatcggtcgtacaggtcgtgctggtaagtcaggtcaatctattacttttgttgctccaaacgaaatgggttaccttcaaatcattgaaaacttgactaagaaacgcatgaaaggtctcaaacctgcaagtgtagaagaatccttccaatcaaaaaaacaggtagctctcaagaaaatcgaacgtgattttgcagatgaaaccattcgtgccaactttgagaaatttggtaaggatgctcgcaaattggctgctgagtttactccagaagaattggcaatgtatatcttgagtctgacagtccaagacccagatagccttccagaagtggagattgcacgtgaaaaaccactaccgtttaaaccatcaggtaatggtttcggtggtaaagctaagggaggtcgtggaggccgtcgtggggacgaccgtcgagagcgtgatcgccgtggcaatggtcgccgtgatgagttcaaaaaaggaagtcgtggcaacgatcgttttgataaggaaaaacgttaccgtaaggataataaaaaaccacgcaatactttaagcgaaaagcaaacaggctttgttattcgtaacaaaggcgataaataa

SEQ ID NO: 39036 - protein, 524 aa, Streptococcus pneumoniae
MKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 39037 - DNA, 1104 bp, Methanococcus jannaschii
  CDS (1)..(1104)
ttggaagtggaatatatgaattttaacgaattaaatttgtcagataatatcttaaatgccattagaaataaaggttttgaaaagccaacagatattcagatgaaagtcatcccactatttttaaatgatgaatataacattgtagctcaagcaagaactggaagtgggaaaactgcttcgtttgcaattccattaattgagctcgttaatgaaaacaatggaatagaggcaattattttaactcctacaagagaattagctatacaagtggctgatgagatagagtcattaaaaggtaacaaaaatttaaagattgccaaaatttatggtggaaaagctatatatccacaaattaaggctttaaaaaatgccaatatagttgttggaactccaggaagaattttagaccacataaatagaggaactttaaatttaaaaaatgttaaatattttatattggatgaggcagatgaaatgctcaatatgggttttattaaggacgttgaaaagattttaaatgcctgtaataaagacaagaggattttgttgttctctgctactatgccaagggagatattaaatttggctaaaaagtatatgggagattatagctttataaaagctaagataaacgcaaatattgaacagagttatgttgaagttaatgaaaatgagagatttgaagctttatgcagacttttaaaaaataaagaattttatggattagttttttgtaaaactaagagagatactaaagaattggcaagtatgttgagagatattggatttaaagctggagcaattcatggagatttaagtcaatctcaaagggagaaggttataagattgtttaaacaaaaaaagattaggattttaattgccactgatgttatgagtagagggatagatgtcaatgatttaaactgtgtaattaactaccatcttccacaaaatcctgaatcttatatgcatagaattggaagaactgggagagctggaaagaaagggaaggcaatatcaattataaatagaagggaatataaaaaactgagatatatagagagagcaatgaaattgaaaatcaagaaattaaaatttggataa

SEQ ID NO: 39038 - protein, 367 aa, Methanococcus jannaschii
MEVEYMNFNELNLSDNILNAIRNKGFEKPTDIQMKVIPLFLNDEYNIVAQARTGSGKTASFAIPLIELVNENNGIEAIILTPTRELAIQVADEIESLKGNKNLKIAKIYGGKAIYPQIKALKNANIVVGTPGRILDHINRGTLNLKNVKYFILDEADEMLNMGFIKDVEKILNACNKDKRILLFSATMPREILNLAKKYMGDYSFIKAKINANIEQSYVEVNENERFEALCRLLKNKEFYGLVFCKTKRDTKELASMLRDIGFKAGAIHGDLSQSQREKVIRLFKQKKIRILIATDVMSRGIDVNDLNCVINYHLPQNPESYMHRIGRTGRAGKKGKAISIINRREYKKLRYIERAMKLKIKKLKFG

SEQ ID NO: 39039 - DNA, 1239 bp, Arabidopsis thaliana
  CDS (1)..(1239)
atggcaggatctgcaccagaaggcacacagtttgatgcacgtcagtttgaccagaaactcaatgaagtacttgagggacaagatgagttcttcacatcctatgatgatgttcatgagagctttgatgccatgggtcttcaagagaaccttctcaggggtatttatgcttatggttttgagaagccttctgctattcagcaaagaggaatcgtccccttctgtaagggtcttgatgtgattcaacaggctcagtctggtactgggaaaacagcaactttctgctctggtgtcttgcagcagctggacttctcccttatccagtgtcaggctttggttctagctccaactagagagcttgctcagcaaattgagaaggtcatgagggcccttggtgattaccttggtgtcaaggttcacgcctgtgttggtggaaccagtgtccgtgaggatcagcgcatcctccaagctggtgtccatgttgttgttggaactccagggcgtgtctttgacatgttgaagaggcagtctcttcgtgctgacaacatcaagatgtttgttctcgatgaagctgatgaaatgctctcccgtggtttcaaggaccagatctatgacatattccagcttcttccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctacgtcaacgttgagaaagaagagtggaagctcgagacactctgtgatctctacgagactcttgccatcactcagagtgtcatcttcgtgaacaccaggcgtaaggttgattggctcacagacaaaatgagaagccgtgaccacacagtctctgcaactcacggagacatggaccagaacaccagggacatcatcatgagagagttcaggtctggttcctcccgtgttctcatcaccactgacctcttagctcgtggtattgatgtccaacaagtctccctggttatcaacttcgatctcccaactcagccagagaactaccttcaccgtatcggaagaagtggaaggttcgggagaaagggtgttgcgatcaatttcgtgacccgtgatgatgagaggatgctgtttgatattcagaaattctacaatgtggttgtcgaagagctgccttcgaacgtggccgatctgctgtga

SEQ ID NO: 39040 - protein, 412 aa, Arabidopsis thaliana
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 39041 - DNA, 1242 bp, Nicotiana tabacum
  CDS (1)..(1242)
atggctggcttggcaccggaaggttctcaatttgatgctcgtcagtatgatgccaaaatgactgagctgcttgggactgagcaggaggagttcttcacatcatatgatgaggtttatgacagttttgatgccatgggtttgcaagaaaaccttcttaggggcatctatgcttatggttttgagaagccatctgctatccagcaaaggggtattgttccattttgcaagggtcttgatgtgatccaacaggcacaatctggaaccggaaagacagcaactttctgctctggagttctccagcagctcgattacagcttagtcgaatgtcaggctctggttctggctccaacccgtgagcttgcccaacagattgagaaggttatgcgagcacttggtgattatctcggtgtgaaggttcatgcttgtgtaggaggtaccagtgtccgtgaggatcagcgtatccttcaaagtggtgttcatgtggtggttggtactcctggccgtgtctttgacatgttgcgcaggcagtctcttcgccctgaccacatcaagatgtttgttctggatgaagctgatgaaatgctctcaagaggtttcaaggatcagatttatgatatttttcaactgctgccaccaaagattcaagtgggtgttttctctgccactatgccgccagaagcccttgaaattactaggaagttcatgaacaagcctgttaggattcttgtgaagcgtgatgacgttacgcttgaaggtatcaagcaattttatgtcaatgttgataaggaagagtggaagcttgaaactctttgcgatctttacgagaccttagccatcacccagagtgtcatctttgttaacaccaggcgtaaggttgattggctcactgacaaaatgcgcacgcgtgatcacacagtatctgcaactcacggagacatggaccagaacactagagatatcattatgcgagagttccgatctgggtcatctcgtgtgctcatcaccactgatcttctggcacgtggtattgacgtgcagcaagtttcccttgtgattaactatgaccttccaactcagccagagaactacctgcatcgtattggtcgtagtggacgatttggaaggaagggtgttgctatcaactttgtcataaaggatgacgaaaggatgctttctgatattcagaggttttacaatgttgtaatcgaggagttgccagccaatgtggccgatctcctttga

SEQ ID NO: 39042 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRTRDHTVSATHGDMDQNTRDIIMREFRSGSSRVLITTDLLARGIDVQQVSLVINYDLPTQPENYLHRIGRSGRFGRKGVAINFVIKDDERMLSDIQRFYNVVIEELPANVADLL

SEQ ID NO: 39043 - DNA, 1185 bp, Schizosaccharomyces pombe
  CDS (1)..(1185)
atggcggacgaaataatggagaacgtggagcttacgacatcggaagatgtgaatgctgtatcctcttttgaggaaatgaatcttaaagaggatttacttcgtggaatctatgcgtatggctatgagactccgagtgctgtgcaaagccgggcgattattcaaatctgtaaagggagagacgttatcgcacaagctcaatctggtacagggaaaacagcaactttttctattggtattcttcagtcgatcgatttatcagtccgagatactcaagctttaatactttctcctacgagagaattggcagttcaaatccagaatgttgtacttgcattgggtgaccatatgaacgttcaatgtcatgcttgtataggcggcacatccgttggaaatgacatcaaaaaattggattatggacaacacgttgtttctggcactcctgggcgcgtaacggacatgattcgtagacgaaatttgcgaactcgcaatgttaagatgcttattcttgatgaagcggatgagctcttaaatcaaggctttaaggaacaaatttatgacatttatagatatttaccccctggtacacaggtggtagttgtgagtgctaccttgcctcaagacgtgttagaaatgactaacaagtttaccactaaccctgttcgaatattggtcaagcgcgatgaacttactcttgaaggcttaaaacagtactttatagcagttgaaaaagaggaatggaagtttgatactctgtgtgatttatatgatactttaaccattacacaagctgtgatattttgcaattctcgtaggaaggttgattggttgacggagaaaatgcgagaagctaactttaccgttaccagtatgcacggtgagatgccgcaaaaagaaagagacgctatcatgcaagattttcgacaaggaaatagtagggttctcatatgcacagacatatgggcaagaggaattgatgttcagcaagtttcattagtgatcaattacgatcttcctgcaaatcgagaaaactatatacatcgcattggtcgcagtggacgatttggtcgtaaaggtgtagctattaattttgttacaaatgaagatgtacgcattcttcgggatattgaacaatactattctactgttatagatgaaatgcctatgaatataggagatatggtttaa

SEQ ID NO: 39044 - protein, 394 aa, Schizosaccharomyces pombe
MADEIMENVELTTSEDVNAVSSFEEMNLKEDLLRGIYAYGYETPSAVQSRAIIQICKGRDVIAQAQSGTGKTATFSIGILQSIDLSVRDTQALILSPTRELAVQIQNVVLALGDHMNVQCHACIGGTSVGNDIKKLDYGQHVVSGTPGRVTDMIRRRNLRTRNVKMLILDEADELLNQGFKEQIYDIYRYLPPGTQVVVVSATLPQDVLEMTNKFTTNPVRILVKRDELTLEGLKQYFIAVEKEEWKFDTLCDLYDTLTITQAVIFCNSRRKVDWLTEKMREANFTVTSMHGEMPQKERDAIMQDFRQGNSRVLICTDIWARGIDVQQVSLVINYDLPANRENYIHRIGRSGRFGRKGVAINFVTNEDVRILRDIEQYYSTVIDEMPMNIGDMV

SEQ ID NO: 39045 - DNA, 1242 bp, Nicotiana tabacum
  CDS (1)..(1242)
atggctggcttggcaccggaaggttctcagtttgatgctcgtcagtatgatgccaaaatgactgagctgcttgggactgaacaggaggagttcttcacatcatatgatgaggtttatgacagttttgatgccatgggtttgcaagaaaacctgcttaggggcatctatgcttatggttttgagaagccatctgctatccagcaaaggggtattgtcccattttgcaagggtcttgatgtgatccaacaggcacaatccggaaccggaaagactgcaactttctgctctggagttctccagcagcttgattacagcttagtcgaatgtcaggctctggttctggctccaacccgtgagcttgcccaacagattgagaaggttatgcgagcacttggtgactatctcggtgtgaaggttcatgcttgtgtaggaggtaccagtgtccgtgaagatcagcgtatccttcaaagtggtgttcatgtggtggttggtactcctggccgtgtctttgacatgttgcgcaggcagtctcttcgccctgaccacatcaagatgtttgttctggatgaagctgatgaaatgctctcaagaggtttcaaggatcagatttatgatattttccaattgctaccaccaaagattcaagtgggtgttttctctgccactatgccgccagaggcccttgaaattactaggaagttcatgaacaagcctgtgaggattcttgtaaagcgtgatgacgttacgcttgaaggtatcaagcaattttatgtcaatgttgataaggaagagtggaagcttgaaactctttgcgatctttacgagaccttagccatcacccagagtgtcatctttgttaacaccaggcgtaaggttgattggctcactgacaaaatgcgcagccgtgatcacacagtatctgcaactcacggagacatggaccagaatactagagatatcattatgcgagagttccgatctgggtcgtcgcgtgtgctcatcaccactgatcttctggcgcgtggtattgacgtgcagcaagtttcccttgtgattaactacgaccttccaactcagccagagaactatctgcatcgtattggtcgtagtggacgttttggaaggaagggtgttgctatcaactttgtcacaaaggatgatgaaaggatgctttctgacattcagaagttttataatgttgtcatcgaggagttgccagccaatgtggccgatctcctttga

SEQ ID NO: 39046 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQKFYNVVIEELPANVADLL

SEQ ID NO: 39047 - DNA, 1242 bp, Nicotiana tabacum
  CDS (1)..(1242)
atggctggcttagcaccggaaggttctcaatttgatgctcgtcagtatgatgccaaaatgactgagctgcttgggactgaacaggaggagttcttcacatcatatgatgaggtttatgacagttttgatgccatgggtttgcaagagaaccttcttaggggcatctatgcttatggttttgagaagccatctgctatccagcaaaggggtattgtcccattttgcaagggtcttgatgtgatccaacaggcacaatctggaaccggaaagacggcaactttctgctctggagttctccagcagcttgattacagcttagtcgaatgtcaggctctggttctggctccaacccgtgagcttgcccaacagattgagaaggttatgcgagcacttggtgactatcttggtgtgaaggttcatgcttgtgtaggaggtaccagtgtccgtgaggatcagcgtatcctccaaagtggtgttcatgtggtggtcggtactcctggccgtgtctttgacatgttgcgcaggcaatctcttcgccctgaccacatcaagatgtttgttctggatgaagctgatgaaatgctctcaagaggtttcaaagatcagatttatgatattttccaactgctgccaccaaagattcaagtgggtgttttctctgccactatgccgcctgaggcccttgaaattactaggaagttcatgagcaagcctgtgaggattcttgtgaagcgtgatgacgttacgcttgaaggtatcaagcaattttatgtcaatgttgacaaggaagagtggaagcttgaaacgctttgcgatctttacgagaccttagccatcacccaaagtgtcatctttgttaataccaggcgtaaggttgattggctcactgataaaatgcgcagccgtgatcatacagtatctgcaactcacggagacatggatcagaacactagagatatcattatgcgagagttcagatcagggtcatctcgtgtgctcatcaccactgatcttttggcccgtggtattgatgtgcagcaagtttcccttgtgattaactatgaccttcctactcagccagagaactacctgcatcgtatcggtcgtagtggacgatttggaagaaagggtgttgctatcaactttgtcacaaaggatgacgaaaggatgctttttgacattcaaaagttttacaatgttgtaatcgaggagttgccagccaatgtggccgatcttctttga

SEQ ID NO: 39048 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 39049 - DNA, 1632 bp, Xylella fastidiosa
  CDS (1)..(1632)
atgagcgataaaccgttgacaaatttaaatttttcttcatttgatctgcatccagcgttgcttactgggctgacaagagcaggatttacactctgtactccgatccaggcgcttactcttccggttgcactggctggccgtgatattgccggccaagcccaaacgggaaccgggaaaactttggcgtttttggtggtggtagttaaccgtttacttagcagtcctgggctagtcaatcgtaacccagaagatccgcgtgcgttgattttggcgccaacccgtgagcttgcgattcaaatctataacgatgcagtgaaatttggtggcaatcttgggttacgttttgcgttgatttatgggggcgttgattacgataggcagcgcgaaatgttgcgcaaaggtgcggatgtggtcattgcgacgccggggcgcttgattgattatcttaagcagcacgaggtggtttcgttgcgcgtttgtgagatttgcgttcttgatgaagcagatcggatgtttgaccttgggtttatcaaggacattcgctttatattgcggcgtttgcccgagcgttgtagccgtcagactttgctgttctcagccactctcagtcaccgcgtgttggagttggcatatgagtatatgaatgagccagagaagctggtggcggagactgagagtgtcactactacgcgtgtccgtcaacgtatttatttccctgctgaggaggagaaaatcccattgctcttgggtttgctctcgcgtaacgaggggatgcgtactatggtgtttgtcaatacaaaggtgttcgtcgaaggtgttgcgcgcgcgcttgatgaggctggttaccgggtcggtgtgctgtctggagatgtgccacaaaggaagcgagagactttgcttaatcgtttccagaaagggcaattggaaatactggttgccacagatgtggctgcacgtggattgcacattgatggcgttaattacgtatacaactacgacctaccgtttgatgcagaagattacgttcaccgtattggccgtactgcgcgtttgggagctgatggtgatgcgattagttttgcctgtgagcgttacgcgatgagtttgccggacattgaggcatatatcgagcagaagatcccggttgcagcagtgactgctgagttgttggctccattgtcgcgtcctggacgtgcatcgaatggtaacggtgatactgttggagatatttccccacattctcgtgacgtgctggttgctcaggaatggcgtcggggtaagcccaggggtagccctggagagcgcgatggtcgcatccgtgtatgtaaagggacccggtcggatgggggaggtgggcgccgccgcactaaatttcgcttggagaccgagcgtgattccagtgtggatggggcagtcactcctgtatttggagtgtctacggggatagtatctgctccaggtaaagaggtggggcgaaacatcggtctccgacgtcgtagtcgttcaatggattctggtgaaagtggccatgttgtcgccactgccgaccaagtggctgctaagtcaggtagtcaaccgtcgctcttaggtcgaatagggcgccgtatccgctcgctgttaagtatgttctaa

SEQ ID NO: 39050 - protein, 543 aa, Xylella fastidiosa
MSDKPLTNLNFSSFDLHPALLTGLTRAGFTLCTPIQALTLPVALAGRDIAGQAQTGTGKTLAFLVVVVNRLLSSPGLVNRNPEDPRALILAPTRELAIQIYNDAVKFGGNLGLRFALIYGGVDYDRQREMLRKGADVVIATPGRLIDYLKQHEVVSLRVCEICVLDEADRMFDLGFIKDIRFILRRLPERCSRQTLLFSATLSHRVLELAYEYMNEPEKLVAETESVTTTRVRQRIYFPAEEEKIPLLLGLLSRNEGMRTMVFVNTKVFVEGVARALDEAGYRVGVLSGDVPQRKRETLLNRFQKGQLEILVATDVAARGLHIDGVNYVYNYDLPFDAEDYVHRIGRTARLGADGDAISFACERYAMSLPDIEAYIEQKIPVAAVTAELLAPLSRPGRASNGNGDTVGDISPHSRDVLVAQEWRRGKPRGSPGERDGRIRVCKGTRSDGGGGRRRTKFRLETERDSSVDGAVTPVFGVSTGIVSAPGKEVGRNIGLRRRSRSMDSGESGHVVATADQVAAKSGSQPSLLGRIGRRIRSLLSMF

SEQ ID NO: 39051 - DNA, 1365 bp, Escherichia coli
  CDS (1)..(1365)
atgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaa

SEQ ID NO: 39052 - protein, 454 aa, Escherichia coli
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGRGQQQPRRGEGGAKSASAKPAEKPSRRLGDAKPAGEQQRRRRPRKPAAAQ

SEQ ID NO: 39053 - DNA, 2285 bp, Drosophila melanogaster
  CDS (152)..(2137)
cactagatttttggtacttttaacagatccttttcggttttgcgttgcgcgaagtgatctgaacttatcaaagtttgtaaggtaatacataaagtgaaaaagaattaatttgctcttgaaaggcaggccaaattaaaaaaaaaatatcaatatgtctgacgactgggatgatgagcccattgttgatactcgcggcgcccgcggtggagattggagcgatgatgaggacacggccaagagcttcagcggcgaagctgaaggcgatggtgttggagggagcggtggtgaaggcggcggctaccaaggaggaaatcgagatgtgttcggaaggatcggcggaggcagaggaggaggagctggaggttatcgaggaggaaatcgagatggagggggcttccacggtggacgtcgcgagggagaaagggacttccgcggtggagaaggcggcttccgcggtggacaaggcggctcccgcggtggacaaggcggctcccgcgggggacaaggcggcttccgtggtggagaaggcggcttccgcggtcggctgtacgaaaacgaggatggtgatgaacgtcgtggaagactagatcgggaggaacgcggcggtgaacgtcgtggaagactagatcgggaggaacgcggcggtgaacgtggtgaaagaggggacggtggttttgcgaggcgccgtcgaaatgaagatgatataaataataataataatatcgtcgaagatgtcgaaaggaagcgagagttttatattcctcccgagccgtccaacgatgcaattgagatattcagcagtggcatagcttccgggattcatttttcgaaatacaacaacataccggttaaggtgaccggcagcgatgttccacaacctatacaacattttacgagcgctgatttgagagatattattatagacaatgtaaacaaatctggatacaaaataccgacaccaattcaaaagtgttccataccagtaatatcctctggtcgagacctaatggcgtgtgcccagacgggttctggaaaaacggcagcttttttgttgcccattttgagcaagttgttggaggatccccatgaactggagcttggaagaccccaggtagtgattgtatccccaacaagggagctggcaattcagatctttaacgaggcgaggaagtttgctttcgagtcatatctaaagatcggtattgtttacggaggcacctcgttcagacatcaaaacgagtgcattaccagaggctgccatgtagtgatcgccactccgggacgacttctggatttcgtggatcggacctttatcacgtttgaagacactcgattcgttgtgctggatgaggccgatcgcatgctagatatgggtttctcagaagacatgcgaagaatcatgacgcatgtaactatgcgtccagaacatcagacattgatgttttccgccacgtttccagaagaaatccaaagaatggccggcgaattccttaaaaattacgttttcgtcgccattggcattgtaggcggagcttgctctgatgtgaagcagaccatatacgaagttaataagtacgccaagcgatccaagctaatagaaatcctttccgagcaagcagatggcaccattgtgtttgtggagacaaagcgtggcgccgactttttagcttccttcctgtcagaaaaggagtttccgacgacctccattcatggcgatcgtctccagagtcaacgcgagcaggccttgcgtgatttcaagaacggctctatgaaggttctcatagccacttcagtggcttctcgtggattagacattaaaaacatcaagcatgtgatcaactatgacatgcccagcaagatcgatgactacgtacatcgcattggacgtacaggtcgtgtaggcaataatggacgagccacaagcttctttgaccctgaaaaggatcgagctattgctgcggacttggtaaaaatcttggagggatctggccagactgttccggactttctacgcacctgtggtgccggcggtgatgggggttactccaatcaaaatttcggtggggtggatgtgcgtggcaggggaaattacgtcggcgatgccaccaatgtcgaggaagaagagcaatgggattgaaatgtatggacatagatttcaaataattaaatgtaatgcagtaattgatgtaattagttaaataagttagatattaataacatattaattatatgtattataacgcatataataataaaatgcatatttaggatatgcaagccattcg

SEQ ID NO: 39054 - protein, 661 aa, Drosophila melanogaster
MSDDWDDEPIVDTRGARGGDWSDDEDTAKSFSGEAEGDGVGGSGGEGGGYQGGNRDVFGRIGGGRGGGAGGYRGGNRDGGGFHGGRREGERDFRGGEGGFRGGQGGSRGGQGGSRGGQGGFRGGEGGFRGRLYENEDGDERRGRLDREERGGERRGRLDREERGGERGERGDGGFARRRRNEDDINNNNNIVEDVERKREFYIPPEPSNDAIEIFSSGIASGIHFSKYNNIPVKVTGSDVPQPIQHFTSADLRDIIIDNVNKSGYKIPTPIQKCSIPVISSGRDLMACAQTGSGKTAAFLLPILSKLLEDPHELELGRPQVVIVSPTRELAIQIFNEARKFAFESYLKIGIVYGGTSFRHQNECITRGCHVVIATPGRLLDFVDRTFITFEDTRFVVLDEADRMLDMGFSEDMRRIMTHVTMRPEHQTLMFSATFPEEIQRMAGEFLKNYVFVAIGIVGGACSDVKQTIYEVNKYAKRSKLIEILSEQADGTIVFVETKRGADFLASFLSEKEFPTTSIHGDRLQSQREQALRDFKNGSMKVLIATSVASRGLDIKNIKHVINYDMPSKIDDYVHRIGRTGRVGNNGRATSFFDPEKDRAIAADLVKILEGSGQTVPDFLRTCGAGGDGGYSNQNFGGVDVRGRGNYVGDATNVEEEEQWD

SEQ ID NO: 39055 - DNA, 25 bp, Primer
atgaccgctttttctaccctgaatg

SEQ ID NO: 39056 - DNA, 24 bp, Primer
ttattttaataaccgcacccggca

SEQ ID NO: 39057 - protein, 414 aa, consensus
  MISC_FEATURE (1)..(414): consensus for the disclosure of xaa see table XV
GXXXXXXIQXXXXPXXXXGXXDXXXXAXTGXGKTAXFXXPXXXXXXXXXXXXXXXXXXXXXXXXXXXXXXXXXXXXXLXXXPTRELAXQXXXXXXXXXXXXXXXXXXXXXXXXXXXGGXXXXXQXXXLXXXXXXXXXXXXXTPGRXXDXXXXXXXXXXXXXXXXXXXXVLDEADXMLXXXXXGFXXXXXXXXXXXPXXXXXXXXXXXXXXXXXXXXXXXXXXXXQXXXFSATXXXXXXXXXXXXXXXPXXXXXXXXXXXXXXXXXXXXXXXXXXQXXXXXXXXXXXXXXXXXXXXXXXXXXXXXXXXXXXXXXXXXFXXTXXXXXXXXXXLXXXXXXXXXXXHGXXXQXXRXXXXXXFXXXXXXXXLXATDXAARGXDXXXXXXVXNXXXPXXXEXYXHRIGRTGRAGXXXGXA

SEQ ID NO: 39058 - protein, 94 aa, consensus
  MISC_FEATURE (1)..(94): consensus for the disclosure of xaa see table XV
XXXXXXXXXXXXQXXXXXXXXXXXXXXXXXXXXGXGKTXXXXXXXXXXXXXXXXXXXXXXXXXXXXXXXXXXXXXXXXXXXXXXXPTRELXXQX

SEQ ID NO: 39059 - protein, 116 aa, consensus
  MISC_FEATURE (1)..(116): consensus for the disclosure of xaa see table XV
GXXXXXXXXXXXXXXXXXXXXXXXXTXGRXXXXXXXXXXXXXXXXXXXXXXXXXDEXDXXXXXXXXXFXXXXXXXXXXXXXXXXXXXXXXXXXXXXXXXXXXXXXXXXXXXXXXAT

SEQ ID NO: 39060 - protein, 99 aa, consensus
  MISC_FEATURE (1)..(99): consensus for the disclosure of xaa see table XV
XXXXXXXXXXXXXXXXXXXXXXXXXXXXXXXXXQXXRXXXXXXXXXXXXXXXXXXXXXXXRGXXXXXXXXXXXXXXXXXXXXXXHRXGRXXRXXXXGXX

SEQ ID NO: 39061 - DNA, 1923 bp, Escherichia coli K12; identical to SEQ ID NO: 24353
  CDS (777)..(1748)

SEQ ID NO: 39062 - protein, 323 aa, Escherichia coli K12; identical to SEQ ID NO: 24354

SEQ ID NO: 39063 - DNA, 1313 bp, Capsicum annuum (pepper); identical to SEQ ID NO: 24355
  CDS (2)..(1126)

SEQ ID NO: 39064 - protein, 374 aa, Capsicum annuum (pepper); identical to SEQ ID NO: 24356

SEQ ID NO: 39065 - DNA, 1468 bp, Spinacia oleracea (spinach); identical to SEQ ID NO: 24357
  CDS (167)..(1273)

SEQ ID NO: 39066 - protein, 368 aa, Spinacia oleracea (spinach); identical to SEQ ID NO: 24358

SEQ ID NO: 39067 - DNA, 1656 bp, Homo sapiens (man); identical to SEQ ID NO: 24359
  CDS (1)..(1656)

SEQ ID NO: 39068 - protein, 551 aa, Homo sapiens (man); identical to SEQ ID NO: 24360

SEQ ID NO: 39069 - DNA, 984 bp, Aquifex aeolicus; identical to SEQ ID NO: 24361
  CDS (1)..(984)

SEQ ID NO: 39070 - protein, 327 aa, Aquifex aeolicus; identical to SEQ ID NO: 24362

SEQ ID NO: 39071 - DNA, 954 bp, Deinococcus radiodurans; identical to SEQ ID NO: 24363
  CDS (1)..(954)

SEQ ID NO: 39072 - protein, 317 aa, Deinococcus radiodurans; identical to SEQ ID NO: 24364

SEQ ID NO: 39073 - DNA, 1149 bp, Pseudomonas aeruginosa; identical to SEQ ID NO: 24365
  CDS (250)..(1149)

SEQ ID NO: 39074 - protein, 299 aa, Pseudomonas aeruginosa; identical to SEQ ID NO: 24366

SEQ ID NO: 39075 - DNA, 1210 bp, Arabidopsis thaliana (mouse-ear cress); identical to SEQ ID NO: 24367
  CDS (1)..(1179)

SEQ ID NO: 39076 - protein, 392 aa, Arabidopsis thaliana (mouse-ear cress); identical to SEQ ID NO: 24368

SEQ ID NO: 39077 - DNA, 960 bp, Nostoc sp. PCC 7120; identical to SEQ ID NO: 24369
  CDS (1)..(960)

SEQ ID NO: 39078 - protein, 319 aa, Nostoc sp. PCC 7120; identical to SEQ ID NO: 24370

SEQ ID NO: 39079 - DNA, 972 bp, Salmonella enterica subsp. enterica serovar Typhi; identical to SEQ ID NO: 24371
  CDS (1)..(972)

SEQ ID NO: 39080 - protein, 323 aa, Salmonella enterica subsp. enterica serovar Typhi; identical to SEQ ID NO: 24372

SEQ ID NO: 39081 - DNA, 1029 bp, Brucella melitensis; identical to SEQ ID NO: 24373
  CDS (1)..(1029)

SEQ ID NO: 39082 - protein, 342 aa, Brucella melitensis; identical to SEQ ID NO: 24374

SEQ ID NO: 39083 - DNA, 927 bp, Listeria innocua; identical to SEQ ID NO: 24375
  CDS (1)..(927)

SEQ ID NO: 39084 - protein, 308 aa, Listeria innocua; identical to SEQ ID NO: 24376

SEQ ID NO: 39085 - DNA, 975 bp, Nostoc sp. PCC 7120; identical to SEQ ID NO: 24377
  CDS (1)..(975)

SEQ ID NO: 39086 - protein, 324 aa, Nostoc sp. PCC 7120; identical to SEQ ID NO: 24378

SEQ ID NO: 39087 - DNA, 963 bp, Nostoc sp. PCC 7120; identical to SEQ ID NO: 24379
  CDS (1)..(963)

SEQ ID NO: 39088 - protein, 320 aa, Nostoc sp. PCC 7120; identical to SEQ ID NO: 24380

SEQ ID NO: 39089 - DNA, 1011 bp, Brucella melitensis; identical to SEQ ID NO: 24381
  CDS (1)..(1011)

SEQ ID NO: 39090 - protein, 336 aa, Brucella melitensis; identical to SEQ ID NO: 24382

SEQ ID NO: 39091 - DNA, 969 bp, Yersinia pestis; identical to SEQ ID NO: 24383
  CDS (1)..(969)

SEQ ID NO: 39092 - protein, 322 aa, Yersinia pestis; identical to SEQ ID NO: 24384

SEQ ID NO: 39093 - DNA, 942 bp, Staphylococcus aureus; identical to SEQ ID NO: 24385
  CDS (10)..(942)

SEQ ID NO: 39094 - protein, 310 aa, Staphylococcus aureus; identical to SEQ ID NO: 24386

SEQ ID NO: 39095 - DNA, 1038 bp, Agrobacterium tumefaciens; identical to SEQ ID NO: 24387
  CDS (1)..(1038)

SEQ ID NO: 39096 - protein, 345 aa, Agrobacterium tumefaciens; identical to SEQ ID NO: 24388

SEQ ID NO: 39097 - DNA, 921 bp, Helicobacter pylori; identical to SEQ ID NO: 24389
  CDS (1)..(921)

SEQ ID NO: 39098 - protein, 306 aa, Helicobacter pylori; identical to SEQ ID NO: 24390

SEQ ID NO: 39099 - DNA, 1395 bp, Mycobacterium tuberculosis; identical to SEQ ID NO: 24391
  CDS (1)..(1395)

SEQ ID NO: 39100 - protein, 464 aa, Mycobacterium tuberculosis; identical to SEQ ID NO: 24392

SEQ ID NO: 39101 - DNA, 969 bp, Vibrio cholerae; identical to SEQ ID NO: 24393
  CDS (1)..(969)

SEQ ID NO: 39102 - protein, 322 aa, Vibrio cholerae; identical to SEQ ID NO: 24394

SEQ ID NO: 39103 - DNA, 984 bp, Halobacterium sp. NRC-1; identical to SEQ ID NO: 24395
  CDS (1)..(984)

SEQ ID NO: 39104 - protein, 327 aa, Halobacterium sp. NRC-1; identical to SEQ ID NO: 24396

SEQ ID NO: 39105 - DNA, 999 bp, Caulobacter crescentus; identical to SEQ ID NO: 24397
  CDS (1)..(999)

SEQ ID NO: 39106 - protein, 332 aa, Caulobacter crescentus; identical to SEQ ID NO: 24398

SEQ ID NO: 39107 - DNA, 1014 bp, Caenorhabditis elegans; identical to SEQ ID NO: 24399
  CDS (1)..(1014)

SEQ ID NO: 39108 - protein, 337 aa, Caenorhabditis elegans; identical to SEQ ID NO: 24400

SEQ ID NO: 39109 - DNA, 972 bp, Mycobacterium tuberculosis; identical to SEQ ID NO: 24401
  CDS (1)..(972)

SEQ ID NO: 39110 - protein, 323 aa, Mycobacterium tuberculosis; identical to SEQ ID NO: 24402

SEQ ID NO: 39111 - DNA, 888 bp, Vibrio cholerae; identical to SEQ ID NO: 24403
  CDS (1)..(888)

SEQ ID NO: 39112 - protein, 295 aa, Vibrio cholerae; identical to SEQ ID NO: 24404

SEQ ID NO: 39113 - DNA, 999 bp, Xylella fastidiosa; identical to SEQ ID NO: 24405
  CDS (1)..(999)

SEQ ID NO: 39114 - protein, 332 aa, Xylella fastidiosa; identical to SEQ ID NO: 24406

SEQ ID NO: 39115 - DNA, 933 bp, Lactococcus lactis subsp. lactis; identical to SEQ ID NO: 24407
  CDS (1)..(933)

SEQ ID NO: 39116 - protein, 310 aa, Lactococcus lactis subsp. lactis; identical to SEQ ID NO: 24408

SEQ ID NO: 39117 - DNA, 921 bp, Streptococcus pneumoniae; identical to SEQ ID NO: 24409
  CDS (1)..(921)

SEQ ID NO: 39118 - protein, 306 aa, Streptococcus pneumoniae; identical to SEQ ID NO: 24410

SEQ ID NO: 39119 - DNA, 975 bp, Pseudomonas aeruginosa; identical to SEQ ID NO: 24411
  CDS (1)..(975)

SEQ ID NO: 39120 - protein, 324 aa, Pseudomonas aeruginosa; identical to SEQ ID NO: 24412

SEQ ID NO: 39121 - DNA, 1374 bp, Pseudomonas aeruginosa; identical to SEQ ID NO: 24413
  CDS (1)..(1374)

SEQ ID NO: 39122 - protein, 457 aa, Pseudomonas aeruginosa; identical to SEQ ID NO: 24414

SEQ ID NO: 39123 - DNA, 948 bp, Buchnera sp; identical to SEQ ID NO: 24415
  CDS (1)..(948)

SEQ ID NO: 39124 - protein, 315 aa, Buchnera sp; identical to SEQ ID NO: 24416

SEQ ID NO: 39125 - DNA, 906 bp, Staphylococcus aureus; identical to SEQ ID NO: 24417
  CDS (1)..(906)

SEQ ID NO: 39126 - protein, 301 aa, Staphylococcus aureus; identical to SEQ ID NO: 24418

SEQ ID NO: 39127 - DNA, 930 bp, Clostridium acetobutylicum; identical to SEQ ID NO: 24419
  CDS (1)..(930)

SEQ ID NO: 39128 - protein, 309 aa, Clostridium acetobutylicum; identical to SEQ ID NO: 24420

SEQ ID NO: 39129 - DNA, 951 bp, Haemophilus influenzae; identical to SEQ ID NO: 24421
  CDS (1)..(951)

SEQ ID NO: 39130 - protein, 316 aa, Haemophilus influenzae; identical to SEQ ID NO: 24422

SEQ ID NO: 39131 - DNA, 876 bp, Thermotoga maritima; identical to SEQ ID NO: 24423
  CDS (1)..(876)

SEQ ID NO: 39132 - protein, 291 aa, Thermotoga maritima; identical to SEQ ID NO: 24424

SEQ ID NO: 39133 - DNA, 1182 bp, Aeropyrum pernix; identical to SEQ ID NO: 24425
  CDS (1)..(1182)

SEQ ID NO: 39134 - protein, 393 aa, Aeropyrum pernix; identical to SEQ ID NO: 24426

SEQ ID NO: 39135 - DNA, 921 bp, Lactococcus lactis subsp. lactis; identical to SEQ ID NO: 24427
  CDS (1)..(921)

SEQ ID NO: 39136 - protein, 306 aa, Lactococcus lactis subsp. lactis; identical to SEQ ID NO: 24428

SEQ ID NO: 39137 - DNA, 933 bp, Mycobacterium tuberculosis; identical to SEQ ID NO: 24429
  CDS (1)..(933)

SEQ ID NO: 39138 - protein, 310 aa, Mycobacterium tuberculosis; identical to SEQ ID NO: 24430

SEQ ID NO: 39139 - DNA, 900 bp, Campylobacter jejuni; identical to SEQ ID NO: 24431
  CDS (1)..(900)

SEQ ID NO: 39140 - protein, 299 aa, Campylobacter jejuni; identical to SEQ ID NO: 24432

SEQ ID NO: 39141 - DNA, 1371 bp, Xylella fastidiosa; identical to SEQ ID NO: 24433
  CDS (1)..(1371)

SEQ ID NO: 39142 - protein, 456 aa, Xylella fastidiosa; identical to SEQ ID NO: 24434

SEQ ID NO: 39143 - DNA, 918 bp, Pseudomonas aeruginosa; identical to SEQ ID NO: 24435
  CDS (1)..(918)

SEQ ID NO: 39144 - protein, 305 aa, Pseudomonas aeruginosa; identical to SEQ ID NO: 24436

SEQ ID NO: 39145 - DNA, 939 bp, Bacillus halodurans; identical to SEQ ID NO: 24437
  CDS (1)..(939)

SEQ ID NO: 39146 - protein, 312 aa, Bacillus halodurans; identical to SEQ ID NO: 24438

SEQ ID NO: 39147 - DNA, 825 bp, Halobacterium sp. NRC-1; identical to SEQ ID NO: 24439
  CDS (1)..(825)

SEQ ID NO: 39148 - protein, 274 aa, Halobacterium sp. NRC-1; identical to SEQ ID NO: 24440

SEQ ID NO: 39149 - DNA, 987 bp, Caulobacter crescentus; identical to SEQ ID NO: 24441
  CDS (1)..(987)

SEQ ID NO: 39150 - protein, 328 aa, Caulobacter crescentus; identical to SEQ ID NO: 24442

SEQ ID NO: 39151 - DNA, 969 bp, Agrobacterium tumefaciens; identical to SEQ ID NO: 24443
  CDS (1)..(969)

SEQ ID NO: 39152 - protein, 322 aa, Agrobacterium tumefaciens; identical to SEQ ID NO: 24444

SEQ ID NO: 39153 - DNA, 924 bp, Bacillus subtilis; identical to SEQ ID NO: 24445
  CDS (1)..(924)

SEQ ID NO: 39154 - protein, 307 aa, Bacillus subtilis; identical to SEQ ID NO: 24446

SEQ ID NO: 39155 - DNA, 936 bp, Bacillus subtilis; identical to SEQ ID NO: 24447
  CDS (1)..(936)

SEQ ID NO: 39156 - protein, 311 aa, Bacillus subtilis; identical to SEQ ID NO: 24448

SEQ ID NO: 39157 - DNA, 933 bp, Neisseria meningitidis; identical to SEQ ID NO: 24449
  CDS (1)..(933)

SEQ ID NO: 39158 - protein, 310 aa, Neisseria meningitidis; identical to SEQ ID NO: 24450

SEQ ID NO: 39159 - DNA, 924 bp, Bacillus halodurans; identical to SEQ ID NO: 24451
  CDS (1)..(924)

SEQ ID NO: 39160 - protein, 307 aa, Bacillus halodurans; identical to SEQ ID NO: 24452

SEQ ID NO: 39161 - DNA, 1014 bp, Caenorhabditis elegans; identical to SEQ ID NO: 24453
  CDS (1)..(1014)

SEQ ID NO: 39162 - protein, 337 aa, Caenorhabditis elegans; identical to SEQ ID NO: 24454

SEQ ID NO: 39163 - DNA, 912 bp, Clostridium acetobutylicum; identical to SEQ ID NO: 24455
  CDS (1)..(912)

SEQ ID NO: 39164 - protein, 303 aa, Clostridium acetobutylicum; identical to SEQ ID NO: 24456

SEQ ID NO: 39165 - DNA, 1128 bp, Campylobacter jejuni; identical to SEQ ID NO: 24457
  CDS (105)..(1004)

SEQ ID NO: 39166 - protein, 299 aa, Campylobacter jejuni; identical to SEQ ID NO: 24458

SEQ ID NO: 39167 - DNA, 1371 bp, Triticum aestivum (common wheat); identical to SEQ ID NO: 24459
  CDS (72)..(1049)

SEQ ID NO: 39168 - protein, 325 aa, Triticum aestivum (common wheat); identical to SEQ ID NO: 24460

SEQ ID NO: 39169 - DNA, 1351 bp, Salmonella typhimurium; identical to SEQ ID NO: 24461
  CDS (423)..(1334)

SEQ ID NO: 39170 - protein, 303 aa, Salmonella typhimurium; identical to SEQ ID NO: 24462

SEQ ID NO: 39171 - DNA, 1432 bp, Spinacia oleracea (spinach); identical to SEQ ID NO: 24463
  CDS (54)..(1205)

SEQ ID NO: 39172 - protein, 383 aa, Spinacia oleracea (spinach); identical to SEQ ID NO: 24464

SEQ ID NO: 39173 - DNA, 1281 bp, Spinacia oleracea (spinach); identical to SEQ ID NO: 24465
  CDS (52)..(1029)

SEQ ID NO: 39174 - protein, 325 aa, Spinacia oleracea (spinach) [sequence omitted]

SEQ ID NO: 39175 - DNA, 1855 bp, Citrullus lanatus (watermelon); identical to SEQ ID NO: 24467
  CDS (564)..(1541)

SEQ ID NO: 39176 - protein, 325 aa, Citrullus lanatus (watermelon); identical to SEQ ID NO: 24468

SEQ ID NO: 39177 - DNA, 1278 bp, Arabidopsis thaliana (mouse-ear cress); identical to SEQ ID NO: 24469
  CDS (87)..(1061)

SEQ ID NO: 39178 - protein, 324 aa, Arabidopsis thaliana (mouse-ear cress); identical to SEQ ID NO: 24470

SEQ ID NO: 39179 - DNA, 1319 bp, Zea mays (maize); identical to SEQ ID NO: 24471
  CDS (73)..(1050)

SEQ ID NO: 39180 - protein, 325 aa, Zea mays (maize); identical to SEQ ID NO: 24472

SEQ ID NO: 39181 - DNA, 990 bp, Synechococcus sp; identical to SEQ ID NO: 24473
  CDS (1)..(990)

SEQ ID NO: 39182 - protein, 329 aa, Synechococcus sp; identical to SEQ ID NO: 24474

SEQ ID NO: 39183 - DNA, 1775 bp, Flavobacterium sp; identical to SEQ ID NO: 24475
  CDS (509)..(1432)

SEQ ID NO: 39184 - protein, 307 aa, Flavobacterium sp; identical to SEQ ID NO: 24476

SEQ ID NO: 39185 - DNA, 927 bp, Bacillus subtilis; identical to SEQ ID NO: 24477
  CDS (1)..(927)

SEQ ID NO: 39186 - protein, 308 aa, Bacillus subtilis; identical to SEQ ID NO: 24478

SEQ ID NO: 39187 - DNA, 978 bp, Synechocystis sp; identical to SEQ ID NO: 24479
  CDS (1)..(978)

SEQ ID NO: 39188 - protein, 325 aa, Synechocystis sp; identical to SEQ ID NO: 24480

SEQ ID NO: 39189 - DNA, 996 bp, Synechocystis sp; identical to SEQ ID NO: 24481
  CDS (1)..(996)

SEQ ID NO: 39190 - protein, 331 aa, Synechocystis sp; identical to SEQ ID NO: 24482

SEQ ID NO: 39191 - DNA, 912 bp, Escherichia coli; identical to SEQ ID NO: 24483
  CDS (1)..(912)

SEQ ID NO: 39192 - protein, 303 aa, Escherichia coli; identical to SEQ ID NO: 24484

SEQ ID NO: 39193 - DNA, 1308 bp, Solanum tuberosum (potato); identical to SEQ ID NO: 24485
  CDS (35)..(1012)

SEQ ID NO: 39194 - protein, 325 aa, Solanum tuberosum (potato); identical to SEQ ID NO: 24486

SEQ ID NO: 39195 - DNA, 1404 bp, Solanum tuberosum (potato); identical to SEQ ID NO: 24487
  CDS (21)..(1181)

SEQ ID NO: 39196 - protein, 386 aa, Solanum tuberosum (potato); identical to SEQ ID NO: 24488

SEQ ID NO: 39197 - DNA, 1492 bp, Chlamydomonas reinhardtii; identical to SEQ ID NO: 24489
  CDS (73)..(1131)

SEQ ID NO: 39198 - protein, 352 aa, Chlamydomonas reinhardtii; identical to SEQ ID NO: 24490

SEQ ID NO: 39199 - DNA, 1446 bp, chloroplast Spinacia oleracea (spinach); identical to SEQ ID NO: 24491
  CDS (43)..(1215)

SEQ ID NO: 39200 - protein, 390 aa, chloroplast Spinacia oleracea (spinach); identical to SEQ ID NO: 24492

SEQ ID NO: 39201 - DNA, 1035 bp, Caenorhabditis elegans; identical to SEQ ID NO: 24493
  CDS (1)..(1035)

SEQ ID NO: 39202 - protein, 344 aa, Caenorhabditis elegans; identical to SEQ ID NO: 24494

SEQ ID NO: 39203 - DNA, 1014 bp, Caenorhabditis elegans; identical to SEQ ID NO: 24495
  CDS (1)..(1014)

SEQ ID NO: 39204 - protein, 337 aa, Caenorhabditis elegans; identical to SEQ ID NO: 24496

SEQ ID NO: 39205 - DNA, 951 bp, Streptomyces coelicolor; identical to SEQ ID NO: 24497
  CDS (1)..(951)

SEQ ID NO: 39206 - protein, 316 aa, Streptomyces coelicolor; identical to SEQ ID NO: 24498

SEQ ID NO: 39207 - DNA, 1056 bp, Schizosaccharomyces pombe; identical to SEQ ID NO: 24499
  CDS (1)..(1056)

SEQ ID NO: 39208 - protein, 351 aa, Schizosaccharomyces pombe; identical to SEQ ID NO: 24500

SEQ ID NO: 39209 - DNA, 909 bp, Clostridium perfringens; identical to SEQ ID NO: 24501
  CDS (1)..(909)

SEQ ID NO: 39210 - protein, 302 aa, Clostridium perfringens; identical to SEQ ID NO: 24502

SEQ ID NO: 39211 - DNA, 927 bp, Methanosarcina barkeri; identical to SEQ ID NO: 24503
  CDS (1)..(927)

SEQ ID NO: 39212 - protein, 308 aa, Methanosarcina barkeri; identical to SEQ ID NO: 24504

SEQ ID NO: 39213 - DNA, 933 bp, Mycobacterium leprae; identical to SEQ ID NO: 24505
  CDS (1)..(933)

SEQ ID NO: 39214 - protein, 310 aa, Mycobacterium leprae; identical to SEQ ID NO: 24506

SEQ ID NO: 39215 - DNA, 1329 bp, Arabidopsis thaliana (mouse-ear cress); identical to SEQ ID NO: 24507
  CDS (1)..(1329)

SEQ ID NO: 39216 - protein, 442 aa, Arabidopsis thaliana (mouse-ear cress); identical to SEQ ID NO: 24508

SEQ ID NO: 39217 - DNA, 1142 bp, Arabidopsis thaliana (mouse-ear cress); identical to SEQ ID NO: 24509
  CDS (1)..(1107)

SEQ ID NO: 39218 - protein, 368 aa, Arabidopsis thaliana (mouse-ear cress); identical to SEQ ID NO: 24510

SEQ ID NO: 39219 - DNA, 1056 bp, Corynebacterium glutamicum; identical to SEQ ID NO: 24511
  CDS (101)..(1036)

SEQ ID NO: 39220 - protein, 311 aa, Corynebacterium glutamicum; identical to SEQ ID NO: 24512

SEQ ID NO: 39221 - DNA, 1035 bp, Rhodobacter sphaeroides; identical to SEQ ID NO: 24513
  CDS (1)..(1035)

SEQ ID NO: 39222 - protein, 344 aa, Rhodobacter sphaeroides; identical to SEQ ID NO: 24514

SEQ ID NO: 39223 - DNA, 1200 bp, Entamoeba histolytica; identical to SEQ ID NO: 24515
  CDS (83)..(1096)

SEQ ID NO: 39224 - protein, 337 aa, Entamoeba histolytica; identical to SEQ ID NO: 24516

SEQ ID NO: 39225 - DNA, 1524 bp, Saccharomyces cerevisiae; identical to SEQ ID NO: 24517
  CDS (1)..(1524)

SEQ ID NO: 39226 - protein, 507 aa, Saccharomyces cerevisiae; identical to SEQ ID NO: 24518

SEQ ID NO: 39227 - DNA, 894 bp, Yersinia pseudotuberculosis IP 32953; identical to SEQ ID NO: 24519
  CDS (1)..(894)

SEQ ID NO: 39228 - protein, 297 aa, Yersinia pseudotuberculosis IP 32953; identical to SEQ ID NO: 24520

SEQ ID NO: 39229 - DNA, 936 bp, Symbiobacterium thermophilum; identical to SEQ ID NO: 24521
  CDS (1)..(936)

SEQ ID NO: 39230 - protein, 311 aa, Symbiobacterium thermophilum; identical to SEQ ID NO: 24522

SEQ ID NO: 39231 - DNA, 936 bp, Propionibacterium acnes; identical to SEQ ID NO: 24523
  CDS (1)..(936)

SEQ ID NO: 39232 - protein, 311 aa, Propionibacterium acnes; identical to SEQ ID NO: 24524

SEQ ID NO: 39233 - DNA, 921 bp, Desulfotalea psychrophila; identical to SEQ ID NO: 24525
  CDS (1)..(921)

SEQ ID NO: 39234 - protein, 306 aa, Desulfotalea psychrophila; identical to SEQ ID NO: 24526

SEQ ID NO: 39235 - DNA, 1095 bp, Debaryomyces hansenii CBS767; identical to SEQ ID NO: 24527
  CDS (1)..(1095)

SEQ ID NO: 39236 - protein, 364 aa, Debaryomyces hansenii CBS767; identical to SEQ ID NO: 24528

SEQ ID NO: 39237 - DNA, 1476 bp, Debaryomyces hansenii CBS767; identical to SEQ ID NO: 24529
  CDS (1)..(1476)

SEQ ID NO: 39238 - protein, 491 aa, Debaryomyces hansenii CBS767; identical to SEQ ID NO: 24530

SEQ ID NO: 39239 - DNA, 1134 bp, Yarrowia lipolytica CLIB99; identical to SEQ ID NO: 24531
  CDS (1)..(1134)

SEQ ID NO: 39240 - protein, 377 aa, Yarrowia lipolytica CLIB99; identical to SEQ ID NO: 24532

SEQ ID NO: 39241 - DNA, 1617 bp, Yarrowia lipolytica CLIB99; identical to SEQ ID NO: 24533
  CDS (1)..(1617)

SEQ ID NO: 39242 - protein, 538 aa, Yarrowia lipolytica CLIB99; identical to SEQ ID NO: 24534

SEQ ID NO: 39243 - DNA, 1482 bp, Kluyveromyces lactis NRRL Y; identical to SEQ ID NO: 24535
  CDS (1)..(1482)

SEQ ID NO: 39244 - protein, 493 aa, Kluyveromyces lactis NRRL Y; identical to SEQ ID NO: 24536

SEQ ID NO: 39245 - DNA, 969 bp, Erwinia carotovora; identical to SEQ ID NO: 24537
  CDS (1)..(969)

SEQ ID NO: 39246 - protein, 322 aa, Erwinia carotovora; identical to SEQ ID NO: 24538

SEQ ID NO: 39247 - DNA, 2098 bp, Xenopus laevis; identical to SEQ ID NO: 24539
  CDS (30)..(1718)

SEQ ID NO: 39248 - protein, 562 aa, Xenopus laevis; identical to SEQ ID NO: 24540

SEQ ID NO: 39249 - DNA, 924 bp, Acinetobacter sp; identical to SEQ ID NO: 24541
  CDS (1)..(924)

SEQ ID NO: 39250 - protein, 307 aa, Acinetobacter sp; identical to SEQ ID NO: 24542

SEQ ID NO: 39251 - DNA, 999 bp, Acinetobacter sp; identical to SEQ ID NO: 24543
  CDS (1)..(999)

SEQ ID NO: 39252 - protein, 332 aa, Acinetobacter sp; identical to SEQ ID NO: 24544

SEQ ID NO: 39253 - DNA, 1506 bp, Candida glabrata CBS138; identical to SEQ ID NO: 24545
  CDS (1)..(1506)

SEQ ID NO: 39254 - protein, 501 aa, Candida glabrata CBS138; identical to SEQ ID NO: 24546

SEQ ID NO: 39255 - DNA, 918 bp, Bacillus thuringiensis; identical to SEQ ID NO: 24547
  CDS (1)..(918)

SEQ ID NO: 39256 - protein, 305 aa, Bacillus thuringiensis; identical to SEQ ID NO: 24548

SEQ ID NO: 39257 - DNA, 924 bp, Bacillus thuringiensis; identical to SEQ ID NO: 24549
  CDS (1)..(924)

SEQ ID NO: 39258 - protein, 307 aa, Bacillus thuringiensis; identical to SEQ ID NO: 24550

SEQ ID NO: 39259 - DNA, 951 bp, Picrophilus torridus; identical to SEQ ID NO: 24551
  CDS (1)..(951)

SEQ ID NO: 39260 - protein, 316 aa, Picrophilus torridus; identical to SEQ ID NO: 24552

SEQ ID NO: 39261 - DNA, 969 bp, Photobacterium profundum; identical to SEQ ID NO: 24553
  CDS (1)..(969)

SEQ ID NO: 39262 - protein, 322 aa, Photobacterium profundum; identical to SEQ ID NO: 24554

SEQ ID NO: 39263 - DNA, 936 bp, Corynebacterium glutamicum; identical to SEQ ID NO: 24555
  CDS (1)..(936)

SEQ ID NO: 39264 - protein, 311 aa, Corynebacterium glutamicum; identical to SEQ ID NO: 24556

SEQ ID NO: 39265 - DNA, 1047 bp, Bdellovibrio bacteriovorus; identical to SEQ ID NO: 24557
  CDS (1)..(1047)

SEQ ID NO: 39266 - protein, 348 aa, Bdellovibrio bacteriovorus; identical to SEQ ID NO: 24558

SEQ ID NO: 39267 - DNA, 990 bp, Bdellovibrio bacteriovorus; identical to SEQ ID NO: 24559
  CDS (1)..(990)

SEQ ID NO: 39268 - protein, 329 aa, Bdellovibrio bacteriovorus; identical to SEQ ID NO: 24560

SEQ ID NO: 39269 - DNA, 990 bp, Bdellovibrio bacteriovorus; identical to SEQ ID NO: 24561
  CDS (1)..(990)

SEQ ID NO: 39270 - protein, 329 aa, Bdellovibrio bacteriovorus; identical to SEQ ID NO: 24562

SEQ ID NO: 39271 - DNA, 1038 bp, Rhodopseudomonas palustris; identical to SEQ ID NO: 24563
  CDS (1)..(1038)

SEQ ID NO: 39272 - protein, 345 aa, Rhodopseudomonas palustris; identical to SEQ ID NO: 24564

SEQ ID NO: 39273 - DNA, 1398 bp, Rhodopseudomonas palustris; identical to SEQ ID NO: 24565
  CDS (1)..(1398)

SEQ ID NO: 39274 - protein, 465 aa, Rhodopseudomonas palustris; identical to SEQ ID NO: 24566

SEQ ID NO: 39275 - DNA, 999 bp, Rhodopseudomonas palustris; identical to SEQ ID NO: 24567
  CDS (1)..(999)

SEQ ID NO: 39276 - protein, 332 aa, Rhodopseudomonas palustris; identical to SEQ ID NO: 24568

SEQ ID NO: 39277 - DNA, 936 bp, Corynebacterium diphtheriae; identical to SEQ ID NO: 24569
  CDS (1)..(936)

SEQ ID NO: 39278 - protein, 311 aa, Corynebacterium diphtheriae; identical to SEQ ID NO: 24570

SEQ ID NO: 39279 - DNA, 906 bp, uncultured bacterium 561; identical to SEQ ID NO: 24571
  CDS (1)..(906)

SEQ ID NO: 39280 - protein, 301 aa, uncultured bacterium 561; identical to SEQ ID NO: 24572

SEQ ID NO: 39281 - DNA, 927 bp, Desulfovibrio vulgaris; identical to SEQ ID NO: 24573
  CDS (1)..(927)

SEQ ID NO: 39282 - protein, 308 aa, Desulfovibrio vulgaris; identical to SEQ ID NO: 24574

SEQ ID NO: 39283 - DNA, 915 bp, Thermus thermophilus; identical to SEQ ID NO: 24575
  CDS (1)..(915)

SEQ ID NO: 39284 - protein, 304 aa, Thermus thermophilus; identical to SEQ ID NO: 24576

SEQ ID NO: 39285 - DNA, 924 bp, Bacillus cereus; identical to SEQ ID NO: 24577
  CDS (1)..(924)

SEQ ID NO: 39286 - protein, 307 aa, Bacillus cereus; identical to SEQ ID NO: 24578

SEQ ID NO: 39287 - DNA, 933 bp, Mycobacterium paratuberculosis; identical to SEQ ID NO: 24579
  CDS (1)..(933)

SEQ ID NO: 39288 - protein, 310 aa, Mycobacterium paratuberculosis; identical to SEQ ID NO: 24580

SEQ ID NO: 39289 - DNA, 1407 bp, Mycobacterium paratuberculosis; identical to SEQ ID NO: 24581
  CDS (1)..(1407)

SEQ ID NO: 39290 - protein, 468 aa, Mycobacterium paratuberculosis; identical to SEQ ID NO: 24582

SEQ ID NO: 39291 - DNA, 927 bp, Geobacter sulfurreducens; identical to SEQ ID NO: 24583
  CDS (1)..(927)

SEQ ID NO: 39292 - protein, 308 aa, Geobacter sulfurreducens; identical to SEQ ID NO: 24584

SEQ ID NO: 39293 - DNA, 924 bp, Geobacter sulfurreducens; identical to SEQ ID NO: 24585
  CDS (1)..(924)

SEQ ID NO: 39294 - protein, 307 aa, Geobacter sulfurreducens; identical to SEQ ID NO: 24586

SEQ ID NO: 39295 - DNA, 1479 bp, Ashbya gossypii; identical to SEQ ID NO: 24587
  CDS (1)..(1479)

SEQ ID NO: 39296 - protein, 492 aa, Ashbya gossypii; identical to SEQ ID NO: 24588

SEQ ID NO: 39297 - DNA, 1098 bp, Spinacia oleracea; identical to SEQ ID NO: 24589
  CDS (78)..(1076)

SEQ ID NO: 39298 - protein, 332 aa, Spinacia oleracea; identical to SEQ ID NO: 24590

SEQ ID NO: 39299 - DNA, 1221 bp, Penicillium chrysogenum; identical to SEQ ID NO: 24591
  CDS (45)..(1160)

SEQ ID NO: 39300 - protein, 371 aa, Penicillium chrysogenum; identical to SEQ ID NO: 24592

SEQ ID NO: 39301 - DNA, 1206 bp, Solanum tuberosum; identical to SEQ ID NO: 24593
  CDS (35)..(1090)

SEQ ID NO: 39302 - protein, 351 aa, Solanum tuberosum; identical to SEQ ID NO: 24594

SEQ ID NO: 39303 - DNA, 999 bp, Wolinella succinogenes; identical to SEQ ID NO: 24595
  CDS (1)..(999)

SEQ ID NO: 39304 - protein, 332 aa, Wolinella succinogenes; identical to SEQ ID NO: 24596

SEQ ID NO: 39305 - DNA, 969 bp, Vibrio vulnificus; identical to SEQ ID NO: 24597
  CDS (1)..(969)

SEQ ID NO: 39306 - protein, 322 aa, Vibrio vulnificus; identical to SEQ ID NO: 24598

SEQ ID NO: 39307 - DNA, 1029 bp, Photorhabdus luminescens; identical to SEQ ID NO: 24599
  CDS (1)..(1029)

SEQ ID NO: 39308 - protein, 342 aa, Photorhabdus luminescens; identical to SEQ ID NO: 24600

SEQ ID NO: 39309 - DNA, 954 bp, Photorhabdus luminescens; identical to SEQ ID NO: 24601
  CDS (1)..(954)

SEQ ID NO: 39310 - protein, 317 aa, Photorhabdus luminescens; identical to SEQ ID NO: 24602

SEQ ID NO: 39311 - DNA, 882 bp, Photorhabdus luminescens; identical to SEQ ID NO: 24603
  CDS (1)..(882)

SEQ ID NO: 39312 - protein, 293 aa, Photorhabdus luminescens; identical to SEQ ID NO: 24604

SEQ ID NO: 39313 - DNA, 1368 bp, Photorhabdus luminescens; identical to SEQ ID NO: 24605
  CDS (1)..(1368)

SEQ ID NO: 39314 - protein, 455 aa, Photorhabdus luminescens; identical to SEQ ID NO: 24606

SEQ ID NO: 39315 - DNA, 963 bp, Gloeobacter violaceus; identical to SEQ ID NO: 24607
  CDS (1)..(963)

SEQ ID NO: 39316 - protein, 320 aa, Gloeobacter violaceus; identical to SEQ ID NO: 24608

SEQ ID NO: 39317 - DNA, 963 bp, Gloeobacter violaceus; identical to SEQ ID NO: 24609
  CDS (1)..(963)

SEQ ID NO: 39318 - protein, 320 aa, Gloeobacter violaceus; identical to SEQ ID NO: 24610

SEQ ID NO: 39319 - DNA, 933 bp, Chromobacterium violaceum; identical to SEQ ID NO: 24611
  CDS (1)..(933)

SEQ ID NO: 39320 - protein, 310 aa, Chromobacterium violaceum; identical to SEQ ID NO: 24612

SEQ ID NO: 39321 - DNA, 1371 bp, Chromobacterium violaceum; identical to SEQ ID NO: 24613
  CDS (1)..(1371)

SEQ ID NO: 39322 - protein, 456 aa, Chromobacterium violaceum; identical to SEQ ID NO: 24614

SEQ ID NO: 39323 - DNA, 891 bp, Chromobacterium violaceum; identical to SEQ ID NO: 24615
  CDS (1)..(891)

SEQ ID NO: 39324 - protein, 296 aa, Chromobacterium violaceum; identical to SEQ ID NO: 24616

SEQ ID NO: 39325 - DNA, 1131 bp, Neurospora crassa; identical to SEQ ID NO: 24617
  CDS (1)..(1131)

SEQ ID NO: 39326 - protein, 376 aa, Neurospora crassa; identical to SEQ ID NO: 24618

SEQ ID NO: 39327 - DNA, 1587 bp, Neurospora crassa; identical to SEQ ID NO: 24619
  CDS (1)..(1587)

SEQ ID NO: 39328 - protein, 528 aa, Neurospora crassa; identical to SEQ ID NO: 24620

SEQ ID NO: 39329 - DNA, 1371 bp, Neurospora crassa; identical to SEQ ID NO: 24621
  CDS (1)..(1371)

SEQ ID NO: 39330 - protein, 456 aa, Neurospora crassa; identical to SEQ ID NO: 24622

SEQ ID NO: 39331 - DNA, 969 bp, Synechococcus sp; identical to SEQ ID NO: 24623
  CDS (1)..(969)

SEQ ID NO: 39332 - protein, 322 aa, Synechococcus sp; identical to SEQ ID NO: 24624

SEQ ID NO: 39333 - DNA, 987 bp, Synechococcus sp; identical to SEQ ID NO: 24625
  CDS (1)..(987)

SEQ ID NO: 39334 - protein, 328 aa, Synechococcus sp; identical to SEQ ID NO: 24626

SEQ ID NO: 39335 - DNA, 960 bp, Rhodopirellula baltica; identical to SEQ ID NO: 24627
  CDS (1)..(960)

SEQ ID NO: 39336 - protein, 319 aa, Rhodopirellula baltica; identical to SEQ ID NO: 24628

SEQ ID NO: 39337 - DNA, 987 bp, Prochlorococcus marinus subsp; identical to SEQ ID NO: 24629
  CDS (1)..(987)

SEQ ID NO: 39338 - protein, 328 aa, Prochlorococcus marinus subsp; identical to SEQ ID NO: 24630

SEQ ID NO: 39339 - DNA, 969 bp, Prochlorococcus marinus subsp; identical to SEQ ID NO: 24631
  CDS (1)..(969)

SEQ ID NO: 39340 - protein, 322 aa, Prochlorococcus marinus subsp; identical to SEQ ID NO: 24632

SEQ ID NO: 39341 - DNA, 969 bp, Prochlorococcus marinus; identical to SEQ ID NO: 24633
  CDS (1)..(969)

SEQ ID NO: 39342 - protein, 322 aa, Prochlorococcus marinus; identical to SEQ ID NO: 24634

SEQ ID NO: 39343 - DNA, 987 bp, Prochlorococcus marinus; identical to SEQ ID NO: 24635
  CDS (1)..(987)

SEQ ID NO: 39344 - protein, 328 aa, Prochlorococcus marinus; identical to SEQ ID NO: 24636

SEQ ID NO: 39345 - DNA, 987 bp, Prochlorococcus marinus; identical to SEQ ID NO: 24637
  CDS (1)..(987)

SEQ ID NO: 39346 - protein, 328 aa, Prochlorococcus marinus; identical to SEQ ID NO: 24638

SEQ ID NO: 39347 - DNA, 969 bp, Prochlorococcus marinus; identical to SEQ ID NO: 24639
  CDS (1)..(969)

SEQ ID NO: 39348 - protein, 322 aa, Prochlorococcus marinus; identical to SEQ ID NO: 24640

SEQ ID NO: 39349 - DNA, 903 bp, Helicobacter hepaticus; identical to SEQ ID NO: 24641
  CDS (1)..(903)

SEQ ID NO: 39350 - protein, 300 aa, Helicobacter hepaticus; identical to SEQ ID NO: 24642

SEQ ID NO: 39351 - DNA, 942 bp, Helicobacter hepaticus; identical to SEQ ID NO: 24643
  CDS (1)..(942)

SEQ ID NO: 39352 - protein, 313 aa, Helicobacter hepaticus; identical to SEQ ID NO: 24644

SEQ ID NO: 39353 - DNA, 951 bp, Haemophilus ducreyi; identical to SEQ ID NO: 24645
  CDS (1)..(951)

SEQ ID NO: 39354 - protein, 316 aa, Haemophilus ducreyi; identical to SEQ ID NO: 24646

SEQ ID NO: 39355 - DNA, 945 bp, Candidatus Blochmannia floridanus; identical to SEQ ID NO: 24647
  CDS (1)..(945)

SEQ ID NO: 39356 - protein, 314 aa, Candidatus Blochmannia floridanus; identical to SEQ ID NO: 24648

SEQ ID NO: 39357 - DNA, 912 bp, Bordetella parapertussis; identical to SEQ ID NO: 24649
  CDS (1)..(912)

SEQ ID NO: 39358 - protein, 303 aa, Bordetella parapertussis; identical to SEQ ID NO: 24650

SEQ ID NO: 39359 - DNA, 969 bp, Propionibacterium freudenreichii shermanii; identical to SEQ ID NO: 24651
  CDS (1)..(969)

SEQ ID NO: 39360 - protein, 322 aa, Propionibacterium freudenreichii shermanii; identical to SEQ ID NO: 24652

SEQ ID NO: 39361 - DNA, 927 bp, Propionibacterium freudenreichii shermanii; identical to SEQ ID NO: 24653
  CDS (1)..(927)

SEQ ID NO: 39362 - protein, 308 aa, Propionibacterium freudenreichii shermanii; identical to SEQ ID NO: 24654

SEQ ID NO: 39363 - DNA, 1466 bp, Porphyra purpurea; identical to SEQ ID NO: 24655
  CDS (149)..(1282)

SEQ ID NO: 39364 - protein, 377 aa, Porphyra purpurea; identical to SEQ ID NO: 24656

SEQ ID NO: 39365 - DNA, 1436 bp, Oryza sativa; identical to SEQ ID NO: 24657
  CDS (57)..(1190)

SEQ ID NO: 39366 - protein, 377 aa, Oryza sativa; identical to SEQ ID NO: 24658

SEQ ID NO: 39367 - DNA, 1059 bp, Betula verrucosa; identical to SEQ ID NO: 24659
  CDS (1)..(1059)

SEQ ID NO: 39368 - protein, 352 aa, Betula verrucosa; identical to SEQ ID NO: 24660

SEQ ID NO: 39369 - DNA, 1990 bp, Xenopus laevis; identical to SEQ ID NO: 24661
  CDS (68)..(1765)

SEQ ID NO: 39370 - protein, 565 aa, Xenopus laevis; identical to SEQ ID NO: 24662

SEQ ID NO: 39371 - DNA, 924 bp, Bacillus cereus; identical to SEQ ID NO: 24663
  CDS (1)..(924)

SEQ ID NO: 39372 - protein, 307 aa, Bacillus cereus; identical to SEQ ID NO: 24664

SEQ ID NO: 39373 - DNA, 924 bp, Bacillus cereus; identical to SEQ ID NO: 24665
  CDS (1)..(924)

SEQ ID NO: 39374 - protein, 307 aa, Bacillus cereus; identical to SEQ ID NO: 24666

SEQ ID NO: 39375 - DNA, 951 bp, Streptomyces avermitilis; identical to SEQ ID NO: 24667
  CDS (1)..(951)

SEQ ID NO: 39376 - protein, 316 aa, Streptomyces avermitilis; identical to SEQ ID NO: 24668

SEQ ID NO: 39377 - DNA, 1395 bp, Streptomyces avermitilis; identical to SEQ ID NO: 24669
  CDS (1)..(1395)

SEQ ID NO: 39378 - protein, 464 aa, Streptomyces avermitilis; identical to SEQ ID NO: 24670

SEQ ID NO: 39379 - DNA, 888 bp, Nitrosomonas europaea; identical to SEQ ID NO: 24671
  CDS (1)..(888)

SEQ ID NO: 39380 - protein, 295 aa, Nitrosomonas europaea; identical to SEQ ID NO: 24672

SEQ ID NO: 39381 - DNA, 933 bp, Enterococcus faecalis; identical to SEQ ID NO: 24673
  CDS (1)..(933)

SEQ ID NO: 39382 - protein, 310 aa, Enterococcus faecalis; identical to SEQ ID NO: 24674

SEQ ID NO: 39383 - DNA, 918 bp, Enterococcus faecalis; identical to SEQ ID NO: 24675
  CDS (1)..(918)

SEQ ID NO: 39384 - protein, 305 aa, Enterococcus faecalis; identical to SEQ ID NO: 24676

SEQ ID NO: 39385 - DNA, 951 bp, Coxiella burnetii; identical to SEQ ID NO: 24677
  CDS (1)..(951)

SEQ ID NO: 39386 - protein, 316 aa, Coxiella burnetii; identical to SEQ ID NO: 24678

SEQ ID NO: 39387 - DNA, 990 bp, Shigella flexneri; identical to SEQ ID NO: 24679
  CDS (1)..(990)

SEQ ID NO: 39388 - protein, 329 aa, Shigella flexneri; identical to SEQ ID NO: 24680

SEQ ID NO: 39389 - DNA, 927 bp, Bacillus stearothermophilus; identical to SEQ ID NO: 24681
  CDS (1)..(927)

SEQ ID NO: 39390 - protein, 308 aa, Bacillus stearothermophilus [sequence omitted]

SEQ ID NO: 39391 - DNA, 1230 bp, Oryza sativa; identical to SEQ ID NO: 24683
  CDS (1)..(1230)

SEQ ID NO: 39392 - protein, 409 aa, Oryza sativa; identical to SEQ ID NO: 24684

SEQ ID NO: 39393 - DNA, 1371 bp, Xylella fastidiosa; identical to SEQ ID NO: 24685
  CDS (1)..(1371)

SEQ ID NO: 39394 - protein, 456 aa, Xylella fastidiosa; identical to SEQ ID NO: 24686

SEQ ID NO: 39395 - DNA, 969 bp, Vibrio parahaemolyticus; identical to SEQ ID NO: 24687
  CDS (1)..(969)

SEQ ID NO: 39396 - protein, 322 aa, Vibrio parahaemolyticus; identical to SEQ ID NO: 24688

SEQ ID NO: 39397 - DNA, 975 bp, Pseudomonas syringae; identical to SEQ ID NO: 24689
  CDS (1)..(975)

SEQ ID NO: 39398 - protein, 324 aa, Pseudomonas syringae; identical to SEQ ID NO: 24690

SEQ ID NO: 39399 - DNA, 984 bp, Pseudomonas syringae; identical to SEQ ID NO: 24691
  CDS (1)..(984)

SEQ ID NO: 39400 - protein, 327 aa, Pseudomonas syringae; identical to SEQ ID NO: 24692

SEQ ID NO: 39401 - DNA, 903 bp, Pseudomonas syringae; identical to SEQ ID NO: 24693
  CDS (1)..(903)

SEQ ID NO: 39402 - protein, 300 aa, Pseudomonas syringae; identical to SEQ ID NO: 24694

SEQ ID NO: 39403 - DNA, 975 bp, Pseudomonas putida; identical to SEQ ID NO: 24695
  CDS (1)..(975)

SEQ ID NO: 39404 - protein, 324 aa, Pseudomonas putida; identical to SEQ ID NO: 24696

SEQ ID NO: 39405 - DNA, 900 bp, Pseudomonas putida; identical to SEQ ID NO: 24697
  CDS (1)..(900)

SEQ ID NO: 39406 - protein, 299 aa, Pseudomonas putida; identical to SEQ ID NO: 24698

SEQ ID NO: 39407 - DNA, 912 bp, Lactobacillus plantarum; identical to SEQ ID NO: 24699
  CDS (1)..(912)

SEQ ID NO: 39408 - protein, 303 aa, Lactobacillus plantarum; identical to SEQ ID NO: 24700

SEQ ID NO: 39409 - DNA, 918 bp, Clostridium tetani; identical to SEQ ID NO: 24701
  CDS (1)..(918)

SEQ ID NO: 39410 - protein, 305 aa, Clostridium tetani; identical to SEQ ID NO: 24702

SEQ ID NO: 39411 - DNA, 978 bp, Bradyrhizobium japonicum; identical to SEQ ID NO: 24703
  CDS (1)..(978)

SEQ ID NO: 39412 - protein, 325 aa, Bradyrhizobium japonicum; identical to SEQ ID NO: 24704

SEQ ID NO: 39413 - DNA, 1035 bp, Bradyrhizobium japonicum; identical to SEQ ID NO: 24705
  CDS (1)..(1035)

SEQ ID NO: 39414 - protein, 344 aa, Bradyrhizobium japonicum; identical to SEQ ID NO: 24706

SEQ ID NO: 39415 - DNA, 948 bp, Bacteroides thetaiotaomicron; identical to SEQ ID NO: 24707
  CDS (1)..(948)

SEQ ID NO: 39416 - protein, 315 aa, Bacteroides thetaiotaomicron; identical to SEQ ID NO: 24708

SEQ ID NO: 39417 - DNA, 954 bp, Bacteroides thetaiotaomicron; identical to SEQ ID NO: 24709
  CDS (1)..(954)

SEQ ID NO: 39418 - protein, 317 aa, Bacteroides thetaiotaomicron; identical to SEQ ID NO: 24710

SEQ ID NO: 39419 - DNA, 909 bp, Staphylococcus epidermidis; identical to SEQ ID NO: 24711
  CDS (1)..(909)

SEQ ID NO: 39420 - protein, 302 aa, Staphylococcus epidermidis; identical to SEQ ID NO: 24712

SEQ ID NO: 39421 - DNA, 930 bp, Oceanobacillus iheyensis; identical to SEQ ID NO: 24713
  CDS (1)..(930)

SEQ ID NO: 39422 - protein, 309 aa, Oceanobacillus iheyensis; identical to SEQ ID NO: 24714

SEQ ID NO: 39423 - DNA, 1089 bp, Synechococcus elongatus; identical to SEQ ID NO: 24715
  CDS (1)..(1089)

SEQ ID NO: 39424 - protein, 362 aa, Synechococcus elongatus; identical to SEQ ID NO: 24716

SEQ ID NO: 39425 - DNA, 966 bp, Synechococcus elongatus; identical to SEQ ID NO: 24717
  CDS (1)..(966)

SEQ ID NO: 39426 - protein, 321 aa, Synechococcus elongatus; identical to SEQ ID NO: 24718

SEQ ID NO: 39427 - DNA, 927 bp, Streptococcus mutans; identical to SEQ ID NO: 24719
  CDS (1)..(927)

SEQ ID NO: 39428 - protein, 308 aa, Streptococcus mutans; identical to SEQ ID NO: 24720

SEQ ID NO: 39429 - DNA, 927 bp, Streptococcus agalactiae; identical to SEQ ID NO: 24721
  CDS (1)..(927)

SEQ ID NO: 39430 - protein, 308 aa, Streptococcus agalactiae; identical to SEQ ID NO: 24722

SEQ ID NO: 39431 - DNA, 969 bp, Shewanella oneidensis; identical to SEQ ID NO: 24723
  CDS (1)..(969)

SEQ ID NO: 39432 - protein, 322 aa, Shewanella oneidensis; identical to SEQ ID NO: 24724

SEQ ID NO: 39433 - DNA, 924 bp, Oceanobacillus iheyensis; identical to SEQ ID NO: 24725
  CDS (1)..(924)

SEQ ID NO: 39434 - protein, 307 aa, Oceanobacillus iheyensis; identical to SEQ ID NO: 24726

SEQ ID NO: 39435 - DNA, 927 bp, Oceanobacillus iheyensis; identical to SEQ ID NO: 24727
  CDS (1)..(927)

SEQ ID NO: 39436 - protein, 308 aa, Oceanobacillus iheyensis; identical to SEQ ID NO: 24728

SEQ ID NO: 39437 - DNA, 930 bp, Leptospira interrogans; identical to SEQ ID NO: 24729
  CDS (1)..(930)

SEQ ID NO: 39438 - protein, 309 aa, Leptospira interrogans; identical to SEQ ID NO: 24730

SEQ ID NO: 39439 - DNA, 936 bp, Corynebacterium efficiens; identical to SEQ ID NO: 24731
  CDS (1)..(936)

SEQ ID NO: 39440 - protein, 311 aa, Corynebacterium efficiens; identical to SEQ ID NO: 24732

SEQ ID NO: 39441 - DNA, 1227 bp, Bifidobacterium longum; identical to SEQ ID NO: 24733
  CDS (1)..(1227)

SEQ ID NO: 39442 - protein, 408 aa, Bifidobacterium longum; identical to SEQ ID NO: 24734

SEQ ID NO: 39443 - DNA, 1572 bp, Phytophthora infestans; identical to SEQ ID NO: 24735
  CDS (5)..(1474)

SEQ ID NO: 39444 - protein, 489 aa, Phytophthora infestans; identical to SEQ ID NO: 24736

SEQ ID NO: 39445 - DNA, 942 bp, Streptococcus pyogenes; identical to SEQ ID NO: 24737
  CDS (1)..(942)

SEQ ID NO: 39446 - protein, 313 aa, Streptococcus pyogenes; identical to SEQ ID NO: 24738

SEQ ID NO: 39447 - DNA, 1371 bp, Chlorobium tepidum; identical to SEQ ID NO: 24739
  CDS (1)..(1371)

SEQ ID NO: 39448 - protein, 456 aa, Chlorobium tepidum; identical to SEQ ID NO: 24740

SEQ ID NO: 39449 - DNA, 933 bp, Chlorobium tepidum; identical to SEQ ID NO: 24741
  CDS (1)..(933)

SEQ ID NO: 39450 - protein, 310 aa, Chlorobium tepidum; identical to SEQ ID NO: 24742

SEQ ID NO: 39451 - DNA, 1075 bp, Fusobacterium nucleatum; identical to SEQ ID NO: 24743
  CDS (135)..(1055)

SEQ ID NO: 39452 - protein, 306 aa, Fusobacterium nucleatum; identical to SEQ ID NO: 24744

SEQ ID NO: 39453 - DNA, 1386 bp, Rhodococcus erythropolis; identical to SEQ ID NO: 24745
  CDS (1)..(1386)

SEQ ID NO: 39454 - protein, 461 aa, Rhodococcus erythropolis; identical to SEQ ID NO: 24746

SEQ ID NO: 39455 - DNA, 1303 bp, Arabidopsis thaliana; identical to SEQ ID NO: 24747
  CDS (93)..(1067)

SEQ ID NO: 39456 - protein, 324 aa, Arabidopsis thaliana; identical to SEQ ID NO: 24748

SEQ ID NO: 39457 - DNA, 1422 bp, Arabidopsis thaliana; identical to SEQ ID NO: 24749
  CDS (239)..(1210)

SEQ ID NO: 39458 - protein, 323 aa, Arabidopsis thaliana; identical to SEQ ID NO: 24750

SEQ ID NO: 39459 - DNA, 1602 bp, Magnaporthe grisea; identical to SEQ ID NO: 24751
  CDS (1)..(1602)

SEQ ID NO: 39460 - protein, 533 aa, Magnaporthe grisea; identical to SEQ ID NO: 24752

SEQ ID NO: 39461 - DNA, 960 bp, Xanthomonas campestris; identical to SEQ ID NO: 24753
  CDS (1)..(960)

SEQ ID NO: 39462 - protein, 319 aa, Xanthomonas campestris; identical to SEQ ID NO: 24754

SEQ ID NO: 39463 - DNA, 1371 bp, Xanthomonas campestris; identical to SEQ ID NO: 24755
  CDS (1)..(1371)

SEQ ID NO: 39464 - protein, 456 aa, Xanthomonas campestris; identical to SEQ ID NO: 24756

SEQ ID NO: 39465 - DNA, 1371 bp, Xanthomonas axonopodis; identical to SEQ ID NO: 24757
  CDS (1)..(1371)

SEQ ID NO: 39466 - protein, 456 aa, Xanthomonas axonopodis; identical to SEQ ID NO: 24758

SEQ ID NO: 39467 - DNA, 960 bp, Xanthomonas axonopodis; identical to SEQ ID NO: 24759
  CDS (1)..(960)

SEQ ID NO: 39468 - protein, 319 aa, Xanthomonas axonopodis; identical to SEQ ID NO: 24760

SEQ ID NO: 39469 - DNA, 939 bp, Thermoanaerobacter tengcongensis; identical to SEQ ID NO: 24761
  CDS (1)..(939)

SEQ ID NO: 39470 - protein, 312 aa, Thermoanaerobacter tengcongensis; identical to SEQ ID NO: 24762

SEQ ID NO: 39471 - DNA, 921 bp, Thermoanaerobacter tengcongensis; identical to SEQ ID NO: 24763
  CDS (1)..(921)

SEQ ID NO: 39472 - protein, 306 aa, Thermoanaerobacter tengcongensis; identical to SEQ ID NO: 24764

SEQ ID NO: 39473 - DNA, 951 bp, Fusobacterium nucleatum; identical to SEQ ID NO: 24765
  CDS (1)..(951)

SEQ ID NO: 39474 - protein, 316 aa, Fusobacterium nucleatum; identical to SEQ ID NO: 24766

SEQ ID NO: 39475 - DNA, 927 bp, Methanosarcina acetivorans; identical to SEQ ID NO: 24767
  CDS (1)..(927)

SEQ ID NO: 39476 - protein, 308 aa, Methanosarcina acetivorans; identical to SEQ ID NO: 24768

SEQ ID NO: 39477 - DNA, 1267 bp, Glycine max; identical to SEQ ID NO: 24769
  CDS (82)..(1059)

SEQ ID NO: 39478 - protein, 325 aa, Glycine max; identical to SEQ ID NO: 24770

SEQ ID NO: 39479 - DNA, 903 bp, Clostridium perfringens; identical to SEQ ID NO: 24771
  CDS (1)..(903)

SEQ ID NO: 39480 - protein, 300 aa, Clostridium perfringens; identical to SEQ ID NO: 24772

SEQ ID NO: 39481 - DNA, 975 bp, Ralstonia solanacearum; identical to SEQ ID NO: 24773
  CDS (1)..(975)

SEQ ID NO: 39482 - protein, 324 aa, Ralstonia solanacearum; identical to SEQ ID NO: 24774

SEQ ID NO: 39483 - DNA, 903 bp, Ralstonia solanacearum; identical to SEQ ID NO: 24775
  CDS (1)..(903)

SEQ ID NO: 39484 - protein, 300 aa, Ralstonia solanacearum; identical to SEQ ID NO: 24776

SEQ ID NO: 39485 - DNA, 2433 bp, Mus musculus; identical to SEQ ID NO: 24777
  CDS (187)..(1872)

SEQ ID NO: 39486 - protein, 561 aa, Mus musculus; identical to SEQ ID NO: 24778

SEQ ID NO: 39487 - DNA, 969 bp, Rhizobium meliloti; identical to SEQ ID NO: 24779
  CDS (1)..(969)

SEQ ID NO: 39488 - protein, 322 aa, Rhizobium meliloti; identical to SEQ ID NO: 24780

SEQ ID NO: 39489 - DNA, 1601 bp, Pichia pastoris; identical to SEQ ID NO: 24781
  CDS (14)..(1519)

SEQ ID NO: 39490 - protein, 501 aa, Pichia pastoris; identical to SEQ ID NO: 24782

SEQ ID NO: 39491 - DNA, 1089 bp, Rhizobium loti; identical to SEQ ID NO: 24783
  CDS (1)..(1089)

SEQ ID NO: 39492 - protein, 362 aa, Rhizobium loti; identical to SEQ ID NO: 24784

SEQ ID NO: 39493 - DNA, 1440 bp, Rhizobium loti; identical to SEQ ID NO: 24785
  CDS (1)..(1440)

SEQ ID NO: 39494 - protein, 479 aa, Rhizobium loti; identical to SEQ ID NO: 24786

SEQ ID NO: 39495 - DNA, 1035 bp, Rhizobium loti; identical to SEQ ID NO: 24787
  CDS (1)..(1035)

SEQ ID NO: 39496 - protein, 344 aa, Rhizobium loti; identical to SEQ ID NO: 24788

SEQ ID NO: 39497 - DNA, 1370 bp, Trypanosoma cruzi; identical to SEQ ID NO: 24789
  CDS (15)..(1169)

SEQ ID NO: 39498 - protein, 384 aa, Trypanosoma cruzi; identical to SEQ ID NO: 24790

SEQ ID NO: 39499 - DNA, 1200 bp, Arabidopsis thaliana; identical to SEQ ID NO: 24791
  CDS (1)..(1200)

SEQ ID NO: 39500 - protein, 399 aa, Arabidopsis thaliana; identical to SEQ ID NO: 24792

SEQ ID NO: 39501 - DNA, 948 bp, Pasteurella multocida; identical to SEQ ID NO: 24793
  CDS (1)..(948)

SEQ ID NO: 39502 - protein, 315 aa, Pasteurella multocida; identical to SEQ ID NO: 24794

SEQ ID NO: 39503 - DNA, 1392 bp, Streptomyces venezuelae; identical to SEQ ID NO: 24795
  CDS (1)..(1392)

SEQ ID NO: 39504 - protein, 463 aa, Streptomyces venezuelae; identical to SEQ ID NO: 24796

SEQ ID NO: 39505 - DNA, 927 bp, Bacillus stearothermophilus; identical to SEQ ID NO: 24797
  CDS (1)..(927)

SEQ ID NO: 39506 - protein, 308 aa, Bacillus stearothermophilus; identical to SEQ ID NO: 24798

SEQ ID NO: 39507 - DNA, 951 bp, Selenomonas ruminantium; identical to SEQ ID NO: 24799
  CDS (19)..(951)

SEQ ID NO: 39508 - protein, 310 aa, Selenomonas ruminantium; identical to SEQ ID NO: 24800

SEQ ID NO: 39509 - DNA, 1378 bp, Solanum tuberosum; identical to SEQ ID NO: 24801
  CDS (55)..(1215)

SEQ ID NO: 39510 - protein, 386 aa, Solanum tuberosum; identical to SEQ ID NO: 24802

SEQ ID NO: 39511 - DNA, 1354 bp, Solanum tuberosum; identical to SEQ ID NO: 24803
  CDS (85)..(1062)

SEQ ID NO: 39512 - protein, 325 aa, Solanum tuberosum; identical to SEQ ID NO: 24804

SEQ ID NO: 39513 - DNA, 1250 bp, Solanum tuberosum; identical to SEQ ID NO: 24805
  CDS (96)..(1139)

SEQ ID NO: 39514 - protein, 347 aa, Solanum tuberosum; identical to SEQ ID NO: 24806

SEQ ID NO: 39515 - DNA, 1493 bp, Nicotiana tabacum; identical to SEQ ID NO: 24807
  CDS (88)..(1062)

SEQ ID NO: 39516 - protein, 324 aa, Nicotiana tabacum; identical to SEQ ID NO: 24808

SEQ ID NO: 39517 - DNA, 927 bp, Methanosarcina thermophila; identical to SEQ ID NO: 24809
  CDS (1)..(927)

SEQ ID NO: 39518 - protein, 308 aa, Methanosarcina thermophila; identical to SEQ ID NO: 24810

SEQ ID NO: 39519 - DNA, 1269 bp, Salmonella enterica subsp; identical to SEQ ID NO: 24811
  CDS (205)..(1176)

SEQ ID NO: 39520 - protein, 323 aa, Salmonella enterica subsp; identical to SEQ ID NO: 24812

SEQ ID NO: 39521 - DNA, 1386 bp, Streptomyces coelicolor; identical to SEQ ID NO: 24813
  CDS (1)..(1386)

SEQ ID NO: 39522 - protein, 461 aa, Streptomyces coelicolor; identical to SEQ ID NO: 24814

SEQ ID NO: 39523 - DNA, 915 bp, Clostridium sticklandii; identical to SEQ ID NO: 24815
  CDS (1)..(915)

SEQ ID NO: 39524 - protein, 304 aa, Clostridium sticklandii; identical to SEQ ID NO: 24816

SEQ ID NO: 39525 - DNA, 1671 bp, Allium tuberosum; identical to SEQ ID NO: 24817
  CDS (417)..(1394)

SEQ ID NO: 39526 - protein, 325 aa, Allium tuberosum; identical to SEQ ID NO: 24818

SEQ ID NO: 39527 - DNA, 1868 bp, Oryctolagus cuniculus; identical to SEQ ID NO: 24819
  CDS (71)..(1726)

SEQ ID NO: 39528 - protein, 551 aa, Oryctolagus cuniculus; identical to SEQ ID NO: 24820

SEQ ID NO: 39529 - DNA, 1077 bp, Leishmania tarentolae; identical to SEQ ID NO: 24821
  CDS (1)..(1077)

SEQ ID NO: 39530 - protein, 358 aa, Leishmania tarentolae; identical to SEQ ID NO: 24822

SEQ ID NO: 39531 - DNA, 990 bp, Synechococcus sp; identical to SEQ ID NO: 24823
  CDS (1)..(990)

SEQ ID NO: 39532 - protein, 329 aa, Synechococcus sp; identical to SEQ ID NO: 24824

SEQ ID NO: 39533 - DNA, 921 bp, Lactococcus lactis; identical to SEQ ID NO: 24825
  CDS (1)..(921)

SEQ ID NO: 39534 - protein, 306 aa, Lactococcus lactis; identical to SEQ ID NO: 24826

SEQ ID NO: 39535 - DNA, 1014 bp, Zymomonas mobilis; identical to SEQ ID NO: 24827
  CDS (1)..(1014)

SEQ ID NO: 39536 - protein, 337 aa, Zymomonas mobilis; identical to SEQ ID NO: 24828

SEQ ID NO: 39537 - DNA, 927 bp, Streptococcus suis; identical to SEQ ID NO: 24829
  CDS (1)..(927)

SEQ ID NO: 39538 - protein, 308 aa, Streptococcus suis; identical to SEQ ID NO: 24830

SEQ ID NO: 39539 - DNA, 1173 bp, Cyanidioschyzon merolae; identical to SEQ ID NO: 24831
  CDS (1)..(1173)

SEQ ID NO: 39540 - protein, 390 aa, Cyanidioschyzon merolae; identical to SEQ ID NO: 24832

SEQ ID NO: 39541 - DNA, 1170 bp, Cyanidioschyzon merolae; identical to SEQ ID NO: 24833
  CDS (1)..(1170)

SEQ ID NO: 39542 - protein, 389 aa, Cyanidioschyzon merolae; identical to SEQ ID NO: 24834

SEQ ID NO: 39543 - DNA, 972 bp, Arabidopsis thaliana; identical to SEQ ID NO: 24835
  CDS (1)..(972)

SEQ ID NO: 39544 - protein, 323 aa, Arabidopsis thaliana; identical to SEQ ID NO: 24836

SEQ ID NO: 39545 - DNA, 1068 bp, Entamoeba dispar; identical to SEQ ID NO: 24837
  CDS (26)..(1036)

SEQ ID NO: 39546 - protein, 336 aa, Entamoeba dispar; identical to SEQ ID NO: 24838

SEQ ID NO: 39547 - DNA, 1151 bp, Entamoeba dispar; identical to SEQ ID NO: 24839
  CDS (100)..(1110)

SEQ ID NO: 39548 - protein, 336 aa, Entamoeba dispar; identical to SEQ ID NO: 24840

SEQ ID NO: 39549 - DNA, 1780 bp, Drosophila melanogaster; identical to SEQ ID NO: 24841
  CDS (66)..(1634)

SEQ ID NO: 39550 - protein, 522 aa, Drosophila melanogaster; identical to SEQ ID NO: 24842

SEQ ID NO: 39551 - DNA, 1020 bp, Oryza sativa; identical to SEQ ID NO: 24843
  CDS (1)..(1020)

SEQ ID NO: 39552 - protein, 339 aa, Oryza sativa; identical to SEQ ID NO: 24844

SEQ ID NO: 39553 - DNA, 1758 bp, Fugu rubripes; identical to SEQ ID NO: 24845
  CDS (1)..(1758)

SEQ ID NO: 39554 - protein, 585 aa, Fugu rubripes; identical to SEQ ID NO: 24846

SEQ ID NO: 39555 - DNA, 1511 bp, Dictyostelium discoideum; identical to SEQ ID NO: 24847
  CDS (1)..(1494)

SEQ ID NO: 39556 - protein, 497 aa, Dictyostelium discoideum; identical to SEQ ID NO: 24848

SEQ ID NO: 39557 - DNA, 1280 bp, Brassica juncea; identical to SEQ ID NO: 24849
  CDS (74)..(1042)

SEQ ID NO: 39558 - protein, 322 aa, Brassica juncea; identical to SEQ ID NO: 24850

SEQ ID NO: 39559 - DNA, 1290 bp, Oryza sativa; identical to SEQ ID NO: 24851
  CDS (74)..(1039)

SEQ ID NO: 39560 - protein, 321 aa, Oryza sativa; identical to SEQ ID NO: 24852

SEQ ID NO: 39561 - DNA, 1238 bp, Brassica juncea; identical to SEQ ID NO: 24853
  CDS (18)..(992)

SEQ ID NO: 39562 - protein, 324 aa, Brassica juncea; identical to SEQ ID NO: 24854

SEQ ID NO: 39563 - DNA, 1363 bp, Oryza sativa; identical to SEQ ID NO: 24855
  CDS (139)..(1116)

SEQ ID NO: 39564 - protein, 325 aa, Oryza sativa; identical to SEQ ID NO: 24856

SEQ ID NO: 39565 - DNA, 969 bp, Buchnera aphidicola; identical to SEQ ID NO: 24857
  CDS (1)..(969)

SEQ ID NO: 39566 - protein, 322 aa, Buchnera aphidicola; identical to SEQ ID NO: 24858

SEQ ID NO: 39567 - DNA, 942 bp, Staphylococcus epidermidis; identical to SEQ ID NO: 24859
  CDS (10)..(942)

SEQ ID NO: 39568 - protein, 310 aa, Staphylococcus epidermidis; identical to SEQ ID NO: 24860

SEQ ID NO: 39569 - DNA, 1459 bp, Arabidopsis thaliana; identical to SEQ ID NO: 24861
  CDS (1)..(1215)

SEQ ID NO: 39570 - protein, 404 aa, Arabidopsis thaliana; identical to SEQ ID NO: 24862

SEQ ID NO: 39571 - DNA, 24 bp, Primer
atgagtaagatttttgaagataac

SEQ ID NO: 39572 - DNA, 25 bp, Primer
ttactgttgcaattctttctcagtg

SEQ ID NO: 39573 - protein, 420 aa, consensus; identical to SEQ ID NO: 25512
  MISC_FEATURE (1)..(420): consensus for the disclosure of xaa see table XV

SEQ ID NO: 39574 - protein, 56 aa, consensus; identical to SEQ ID NO: 25508
  MISC_FEATURE (1)..(56): consensus for the disclosure of xaa see table XV

SEQ ID NO: 39575 - protein, 53 aa, consensus; identical to SEQ ID NO: 25509
  MISC_FEATURE (1)..(53): consensus for the disclosure of xaa see table XV

SEQ ID NO: 39576 - protein, 74 aa, consensus; identical to SEQ ID NO: 25510
  MISC_FEATURE (1)..(74): consensus for the disclosure of xaa see table XV

SEQ ID NO: 39577 - protein, 32 aa, consensus; identical to SEQ ID NO: 25511
  MISC_FEATURE (1)..(32): consensus for the disclosure of xaa see table XV

SEQ ID NO: 39578 - DNA, 735 bp, Escherichia coli
  CDS (1)..(735)
atgtccaaactcgatctaaacgccctgaacgaactgccgaaggtagatcgcattctggcgctggcggaaactaacgccgaactggaaaaactggacgctgaaggccgcgtagcctgggcgctggataatctgcccggtgaatatgtactttcttccagctttggcattcaggcggcggtgagcctgcatctggtgaatcaaattcgcccggatattccggtgatcctcaccgatacgggttacttgttcccggaaacctaccgctttattgacgagttaacggacaaactcaagctcaacctgaaagtgtaccgtgctaccgaaagcgcagcctggcaggaagcacgctacggaaaactgtgggagcagggcgttgaaggcattgaaaagtacaatgacatcaacaaagtcgaaccgatgaaccgggctctgaaagaactgaatgcgcaaacctggtttgctggcctgcgccgtgaacaatccggcagtcgtgccaatttaccggtgctggcaattcagcgtggcgtatttaaagtgctgccgattatcgactgggataaccgaactatttatcagtacctgcaaaaacatggcctgaaatatcacccattatgggatgaaggatatttatcggtgggcgatacccatacaacccgtaaatgggaacccggcatggcggaagaagaaacgcgtttctttggcttaaaaagggaatgtgggttacacgaagggtaa

SEQ ID NO: 39579 - protein, 244 aa, Escherichia coli
MSKLDLNALNELPKVDRILALAETNAELEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 39580 - DNA, 819 bp, Cryptococcus neoformans var. neoformans JEC21
  CDS (1)..(819)
atgtccagtgaagacatcctcactccccagtacacccctgaagaaatcgagcgatttaacgccgaactcgacggcaaaactcctcaggagatcttgacctgggctgtcgacaacgtcgatggcttgtaccagactactgctttcgggctgactggtaccgccgctgtagatatgatttccaagatttctttggaccgcgaagaaactcaccttgttccacttatcttccttgacacccttcaccacttccctgaaactcttgctctcgctcaaaccatggccgacacctacctcgctccgttacacatttacactccccccggcgtttctactgctgaagaattcgccgtcaagtatggcgagaagctctgggagactgacgaaggcgcctacgattatctggtgaaggttgaacctgcagccagggcttacaaggagctgggcgtccgggcggtcatcactggtaggcgaagaagccaaggcgccgatcgagcagacttgaaggtgctcgaaatcgatgagaggggattgctcaagatcaaccctttgatcggatggagctttaaagaggtcaaggaatacattgacaaggaaggagttccttacaacccacttctcgacaagggctaccgatctatcggtgacgtccactccactgccccccctgaccccaacgccgccagtgatgctgctgagcgaagtggtcgatggcaaggtaaggccaagaccgaatgtggtttacacagcaactattttgagatgaagaagaagtttgaagagaaagcggccgctgcgggcgaagcttccaagcagtcataa

SEQ ID NO: 39581 - protein, 272 aa, Cryptococcus neoformans var. neoformans JEC21
MSSEDILTPQYTPEEIERFNAELDGKTPQEILTWAVDNVDGLYQTTAFGLTGTAAVDMISKISLDREETHLVPLIFLDTLHHFPETLALAQTMADTYLAPLHIYTPPGVSTAEEFAVKYGEKLWETDEGAYDYLVKVEPAARAYKELGVRAVITGRRRSQGADRADLKVLEIDERGLLKINPLIGWSFKEVKEYIDKEGVPYNPLLDKGYRSIGDVHSTAPPDPNAASDAAERSGRWQGKAKTECGLHSNYFEMKKKFEEKAAAAGEASKQS

SEQ ID NO: 39582 - DNA, 732 bp, Staphylococcus epidermidis RP62A
  CDS (1)..(732)
atgtctatagaaagaattacttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtcaaattctagtaagactgaatgcgggttacatgtaactgataaaccataa

SEQ ID NO: 39583 - protein, 243 aa, Staphylococcus epidermidis RP62A
MSIERITYDNFQNDPFINELDINDETKGAYEILKWAYQTYENDIVYSCSFGAESMVLIDLISQIKPDAQIVFLDTDLHFQETYDLIDRVKDKYPQLRIKMKKPELTLEEQGEKYNPALWKNDPNQCCYIRKIKPLEDVLSGAVAWISGLRRAQSPTRAHTNFINKDERFKSIKVCPLIYWTEEEVWSYIRDKDLPYNELHDQNYPSIGCIPCTSPVFDSNDSRAGRWSNSSKTECGLHVTDKP

SEQ ID NO: 39584 - DNA, 681 bp, Gluconobacter oxydans 621H
  CDS (1)..(681)
atgcctctctcacggacggaattggatcatctccgccagatccccgaagaccgggtgctgggggagactctggatctgctgcggggacgcgtggccgtgatttcgtctttcggggcggagtcggcggttctgctggatcttgtagcgcaggctgacccttcggttccggtgtttttcctggatacgaagcggcactttcccgaaacgctggaataccgtgacagactgtcccgcaggctggggctttcggatgtccggaccctgtctcctacaccgcaagcgctgcatgaccgtgatccacaggatcagctcgcggatttcgatccggatgcgtgctgtgcgctgcgcaaggtcgagccgctggatctggtgctgccggatttcgatgtctggattacggggcgcaagcgcagccagtccgcgacgcgggcggcgctgccgctggttgatccgcagcctgatggcagcgtgaagctcaacccgctggcgggctggggccccgagaaaatcgaggcgcagatgcagcgccgggacctgccacggcaccccctggttgcaaaaggttacacctcgatcggttgtgctccatgcacaagggcggtcaaggatggtgaagatggacgggcgggccgctgggccggtctggccaagacggaatgcggcattcacaggccggcatga

SEQ ID NO: 39585 - protein, 226 aa, Gluconobacter oxydans 621H
MPLSRTELDHLRQIPEDRVLGETLDLLRGRVAVISSFGAESAVLLDLVAQADPSVPVFFLDTKRHFPETLEYRDRLSRRLGLSDVRTLSPTPQALHDRDPQDQLADFDPDACCALRKVEPLDLVLPDFDVWITGRKRSQSATRAALPLVDPQPDGSVKLNPLAGWGPEKIEAQMQRRDLPRHPLVAKGYTSIGCAPCTRAVKDGEDGRAGRWAGLAKTECGIHRPA

SEQ ID NO: 39586 - DNA, 726 bp, Xanthomonas oryzae pv. oryzae KACC10331
  CDS (1)..(726)
atgaccgcgctacctgccgcatcaatcacctcttccgcgttggacgatctggacgcgctcaatgcgcagctggaaggcctgcgtgccgacgaacgcgtggcctgggcgctgcagcacggcccgcaggacgcggcgctgtcgtccagcttcggcgcgcaatcggcagtgacgctgcatctgctcagccagcaacgcccggacatcccggtgatcctgatcgacaccggctacctgttcccggaaacctaccgcttcgccgatgccttgaccgaacggctcaagctcaatctcaaggtatatcgcccgctggtcagccgcgcctggatggaagcgcgccacggccgcctgtgggaacaaggcatggtcggcatcgatcagtacaacaacctgcgcaaggtcgaaccgatgcgccgcgccttggacgaactcaacgtgggcacctggttcaccggcctgcgccgcagccaatccggcggccgcgcgcagacgccaatcgtgcagaagcgcggtgagcgctacaaaatcagccccatcgccgactggaccgatcgcgacgtgtggcagtacctgcaggcgcacgagctgccgtaccacccactgtgggaacaaggctacgtgtccatcggcgatttccacaccacgcgtcgctgggaacccggcatgcgcgaggaagacacgcgcttctttggcctgaagcgggagtgcggcatccacgaggatatctag

SEQ ID NO: 39587 - protein, 241 aa, Xanthomonas oryzae pv. oryzae KACC10331
MTALPAASITSSALDDLDALNAQLEGLRADERVAWALQHGPQDAALSSSFGAQSAVTLHLLSQQRPDIPVILIDTGYLFPETYRFADALTERLKLNLKVYRPLVSRAWMEARHGRLWEQGMVGIDQYNNLRKVEPMRRALDELNVGTWFTGLRRSQSGGRAQTPIVQKRGERYKISPIADWTDRDVWQYLQAHELPYHPLWEQGYVSIGDFHTTRRWEPGMREEDTRFFGLKRECGIHEDI

SEQ ID NO: 39588 - DNA, 720 bp, Sulfolobus solfataricus P2
  CDS (1)..(720)
atgcttagcaaagatgagttagactccctaaataaattgttcgaagataaggaacccctagaagtgctgaaatggggaatagagaaattttaccctaaaatcgccttagcttgtagtcttcaggctgaagatttggtaatactagatatgttaagtaaggttactgaaaaaccaagagtctttataatagatactggtagactccaccaagaaagttatgacttaatagaggaaatagtgaaaaagtataacatagacttaaggatatattttccagactataaagaggtagaagatctagttaataagtatggaatcaacttattttacaaaagtgttgaacttagaaaggcgtgctgtgaagtgaggaaagttagacccctaaagagagcgttggatggaatggaagcttggataactgggctaaggagagaacaaaatttcactagagggaggataaggaaaatagaaatagacgaagtcaatggagggattattaagttaaatccgttggctgactggacatgggaacaggtatgggaatatataaataaaaataatgttccttataataagctctacgataaagggtataagagtataggatgtgtaccatgtactagaccagttaaaccttgggagcatccaagagctggtagatggtggtgggagcagaatagtgacaaggaatgtgggcttcattatagagaggtgaagtga

SEQ ID NO: 39589 - protein, 239 aa, Sulfolobus solfataricus P2
MLSKDELDSLNKLFEDKEPLEVLKWGIEKFYPKIALACSLQAEDLVILDMLSKVTEKPRVFIIDTGRLHQESYDLIEEIVKKYNIDLRIYFPDYKEVEDLVNKYGINLFYKSVELRKACCEVRKVRPLKRALDGMEAWITGLRREQNFTRGRIRKIEIDEVNGGIIKLNPLADWTWEQVWEYINKNNVPYNKLYDKGYKSIGCVPCTRPVKPWEHPRAGRWWWEQNSDKECGLHYREVK

SEQ ID NO: 39590 - DNA, 720 bp, Sulfolobus tokodaii str. 7
  CDS (1)..(720)
atgataagcagagaagaacttgaaaaactcaacagttacttcgaagagaaagagccaatagaaatcttaaaatggggtatagaaaagttccaccctaaaataacattagcgtgcagtcttcaagcagaagatttagtaatattagacatgcttagtaaaatagtgaaaagaccaaaggttttcataatagatactgggagattacatcaagaaacttacgatttgatagaacagattacaagtaaatacgacgtagatttatcgatatacttcccagattataaagaggtagaggaaatggtcaaaaaatatggaataaatctattttataaaagtatcgagcttagaaaattatgctgtgaaattaggaaagtaaggcctttaaagagagctttagaggggatggatgcatggataacagggcttagaagggaacaaaatttcactagaagcaaaataaggaaaattgaaattgatgagattaatggaggaatagtaaaactaaatcctttagcagattgggtttatgaacaagtatgggattatataaagaagaataacgttccttacaataagctttacgataagggctataagagcattggctgtgtaccatgtacgagacctgtaaagccttgggaacaccctagggcaggtagatggtggtgggaacaaagtggagataaagaatgtggattacattatagggaggtgaagtga

SEQ ID NO: 39591 - protein, 239 aa, Sulfolobus tokodaii str. 7
MISREELEKLNSYFEEKEPIEILKWGIEKFHPKITLACSLQAEDLVILDMLSKIVKRPKVFIIDTGRLHQETYDLIEQITSKYDVDLSIYFPDYKEVEEMVKKYGINLFYKSIELRKLCCEIRKVRPLKRALEGMDAWITGLRREQNFTRSKIRKIEIDEINGGIVKLNPLADWVYEQVWDYIKKNNVPYNKLYDKGYKSIGCVPCTRPVKPWEHPRAGRWWWEQSGDKECGLHYREVK

SEQ ID NO: 39592 - DNA, 735 bp, Caulobacter crescentus CB15
  CDS (1)..(735)
gtggcctacgaccagacgagcgcgacggctccaggccttgccgcccggctggacgccgagctgcgcgacgcccatcccagcgagatcctccgcacggcccatgagcacttcggcgacaagctggcgctggtgtcgtcgttcggcgccgagtcggcggtgctgctgcatctggcctcgcgcgtctcgccgggcctgccggttctgttcctcgacaccgggatgctgtttggccagacgctggactatcgaaagaatatcgcggcccagttcggcctgaccgatgtccgcgatctgcggccggctttcgcggacctggcgacccaggaccctaactccgacctctggcgcaccagcgtcgacggctgctgccacattcgcaaggttctgccgctggatcgcgcgttgggcggcttcgacgcctggatcaccggtcgcaagcgcttccacggcggtgatcgcctgagcctgccagtggtcgaagaggccgacggcaagatcaagttcaacccgttggccaactggtccaaggccgagctcgacgcctatgtcgccgaacatgacctgccggcccacccgctggtggcccagggctatgcctcggtcggctgttggccgtgcacgcagccttccgacgacggaaggtccgggcgctgggcgggtcaggaaaagaccgagtgcggcatccacgtcgcgcgggcgcccggtgtcgcgccgaacgtgggcggggatatctga

SEQ ID NO: 39593 - protein, 244 aa, Caulobacter crescentus CB15
MAYDQTSATAPGLAARLDAELRDAHPSEILRTAHEHFGDKLALVSSFGAESAVLLHLASRVSPGLPVLFLDTGMLFGQTLDYRKNIAAQFGLTDVRDLRPAFADLATQDPNSDLWRTSVDGCCHIRKVLPLDRALGGFDAWITGRKRFHGGDRLSLPVVEEADGKIKFNPLANWSKAELDAYVAEHDLPAHPLVAQGYASVGCWPCTQPSDDGRSGRWAGQEKTECGIHVARAPGVAPNVGGDI

SEQ ID NO: 39594 - DNA, 735 bp, Salmonella typhimurium LT2
  CDS (1)..(735)
atgtcccaactcgatctcaacgcattgaatgaattgccaaaagtcgatcgcgtaatggctctggcggaaaccaacgcccaactggaaaaactgagcgccgaagaacgcgtggcctgggcgctggaaaatctgcccggcgaatacgtgctctcctcaagctttggcatccaggcggcggtgagcctgcacctggtgaaccagattcgcccggatatcccggtgatcctcaccgataccggctatttgttcccggaaacctaccagtttattgatgagctaacggacaaactcaaactcaacctgaaagtttaccgcgcgggcgaaagtccggcctggcaggaagcgcgctacggcaagctgtgggagcagggcgttgagggcattgagaaatacaatgagatcaacaaagtcgagccgatgaaccgggcgctaaaagagctgaaagcgcagacgtggtttgcgggtctgcgtcgcgagcagtccggcagccgcgcgcatttacccgttctcgctatccagcgcggcgtgtttaaagtgctaccgattatcgactgggataatcgcaccgtttaccagtacctgcaaaagcatggcctgaaataccatccgctgtgggatcagggctatctgtcggtgggcgatacgcacaccacccgcaaatgggagccgggtatggcggaagaagagacacgcttcttcgggctgaagcgcgagtgcgggctgcatgaagggtaa

SEQ ID NO: 39595 - protein, 244 aa, Salmonella typhimurium LT2
MSQLDLNALNELPKVDRVMALAETNAQLEKLSAEERVAWALENLPGEYVLSSSFGIQAAVSLHLVNQIRPDIPVILTDTGYLFPETYQFIDELTDKLKLNLKVYRAGESPAWQEARYGKLWEQGVEGIEKYNEINKVEPMNRALKELKAQTWFAGLRREQSGSRAHLPVLAIQRGVFKVLPIIDWDNRTVYQYLQKHGLKYHPLWDQGYLSVGDTHTTRKWEPGMAEEETRFFGLKRECGLHEG

SEQ ID NO: 39596 - DNA, 726 bp, Nostoc sp. PCC 7120
  CDS (1)..(726)
atgacagcttctacggcatttaaaacccaaacaaacgaatttaatttagatgaattaaatcaacagtttgaaactgccactcctaaagaaattctggcatggtctatagagcatatccccacagggttggtacaaactagcgcctttaatgtggatgacttagtaattacccatatcctttatagtgaactcaagcaaccagtacctgtaatctttctcgatactctgttccactttcaacaaactttagaactcgttgctaaagcgaaagaaatatataatctagatttacaaacctacaaaactccagatgtagatacccgtgaagcctttactgctaaatacggcgaagcgctttgggataaagatattacgcaattccaccacgttaccaaaattgaacctctacaacgtggtttagatgaacttaataccgttgcttggattactggccgtcgtcgcgatcaagccgttacccgcgcgaatatgcctgtatttgaattagatggcaaaggtcgtttgaaagtaaatcccttagcagcttggacacgtcaagatagctgggattacgtagctgaacataaagtaatttataatcctctacacgatcaaggttatcccagtattggcgatgaacccatcaccaccaaggtaggcgaaggcgaagacgaacgcgccggacgctggagaggaagcaataaaactgaatgtgggattcacatttag

SEQ ID NO: 39597 - protein, 241 aa, Nostoc sp. PCC 7120
MTASTAFKTQTNEFNLDELNQQFETATPKEILAWSIEHIPTGLVQTSAFNVDDLVITHILYSELKQPVPVIFLDTLFHFQQTLELVAKAKEIYNLDLQTYKTPDVDTREAFTAKYGEALWDKDITQFHHVTKIEPLQRGLDELNTVAWITGRRRDQAVTRANMPVFELDGKGRLKVNPLAAWTRQDSWDYVAEHKVIYNPLHDQGYPSIGDEPITTKVGEGEDERAGRWRGSNKTECGIHI

SEQ ID NO: 39598 - DNA, 804 bp, Ralstonia solanacearum GMI1000
  CDS (1)..(804)
atgagcgcgctccaagaggccgccgtgtcggaagtgccgatgtccgcgatcgggcgcccggtgctgtggtcgcgtccggtctacacgggcacgcccgaggggctggccgtcaaggaggccgcgctgctcgagcgcctgaccgagattgccgccaagcatggcaccgcgaagttcgccagcagcctggccgccgaggacatggtggtgacggacgccattctgcgcagtccggaagccgtgcgcgcgcatctgccgatcttcacgctgcagaccggccgcctgcacgccgagacgctggccatgctcgagcgcatccgcgaacactacggctatgcgatcgagcagttcgcgccggatgcccgcgcggtgcaagcctatgtgcgcgaccacgggctgaacgcgttctacgacagcatcgaattgcgcaaggcctgctgcaccatccgcaaggtggtgccgctgaaccgcgcgctccgggacgcagatgcatggctgagcggccagcgccgcgagcaggccgtcacccgtgccgacctgccgttcgtcgaagaggacgacacgcgcggcatcgccaaatacaatccgctgttcgactggaccgaggccgaagtctgggcctacctggaacggcatgcggtgcccgtcaacgcgctgcacgataagggctaccccagcatcggctgcgagccctgcacgcgtgcggtgcgcgccggcgaggacgtgcgcgccggccgctggtggtgggaatcgcgcgatagcaaggaatgcggtttgcatgcgacgaacctgtcgcacaagagctaa

SEQ ID NO: 39599 - protein, 267 aa, Ralstonia solanacearum GMI1000
MSALQEAAVSEVPMSAIGRPVLWSRPVYTGTPEGLAVKEAALLERLTEIAAKHGTAKFASSLAAEDMVVTDAILRSPEAVRAHLPIFTLQTGRLHAETLAMLERIREHYGYAIEQFAPDARAVQAYVRDHGLNAFYDSIELRKACCTIRKVVPLNRALRDADAWLSGQRREQAVTRADLPFVEEDDTRGIAKYNPLFDWTEAEVWAYLERHAVPVNALHDKGYPSIGCEPCTRAVRAGEDVRAGRWWWESRDSKECGLHATNLSHKS

SEQ ID NO: 39600 - DNA, 804 bp, Pyrobaculum aerophilum str. IM2
  CDS (1)..(804)
atgaggcgcgagtggactgatttagaagtggaagagctgtccctaaggtttgagaattctacggctgaggaattattaagctgggctcttaatgaattctatcccaatatagcattggcctttagtggtcaagctgaggatgtagtagtgctagacattatgcacaaagtagctcccgataagattagagtttttatgctggataccggccgtttgcccgaagaaatatatgagttagtggacaaagtacgcgaacactacggcgttgagatagaaatttactatccagatactaaagaaattgaggaatttgtaaagagatatggcattaatccattctatcgtgacgtagagcttaggcatttatgttgtaaaatacgaaaagtgaatcccttactgagggctctgtcaggactagacgcgtggatcacaggcttacgtagagatcaattccccacaagagctacaacaaggaaaatccaaatcgatcacgatcattacggaatattaaaaatatcgcctatatgtgattggacgtgggacgaagtgtggcagtatataaagaaatataatttgccatactgcaaattatacgatcgcggctatactagcatagggtgcgagccctgtacaaggcctacctttgtaagcctcggggatgtgacaggagaggagctaagaaaagggcgttggtggtgggagaaaaacgctccgaaagagtgcggaatacattgctcgctggaggcaggctcatttgaaaggcacatggaaacggtgtttaagctgaagatcaaaattaaatga

SEQ ID NO: 39601 - protein, 267 aa, Pyrobaculum aerophilum str. IM2
MRREWTDLEVEELSLRFENSTAEELLSWALNEFYPNIALAFSGQAEDVVVLDIMHKVAPDKIRVFMLDTGRLPEEIYELVDKVREHYGVEIEIYYPDTKEIEEFVKRYGINPFYRDVELRHLCCKIRKVNPLLRALSGLDAWITGLRRDQFPTRATTRKIQIDHDHYGILKISPICDWTWDEVWQYIKKYNLPYCKLYDRGYTSIGCEPCTRPTFVSLGDVTGEELRKGRWWWEKNAPKECGIHCSLEAGSFERHMETVFKLKIKIK

SEQ ID NO: 39602 - DNA, 711 bp, Streptomyces coelicolor A3(2)
  CDS (1)..(711)
atgacggcggttcaggaagagcgtacgaccgaggaactcaaggcgctggccgagcgggcgggccgcgagctggaggacgccacggcgctggaaatcctccggtgggcggccgagaccttcggcgaccggttctgcgtgacctcctccatggaggacgcggtcgtcgcccatctcgcctcccgcgccctgcccggcgtggacgtggtgttcctcgacaccggctaccacttcccggagaccatcggcacccgcgacgcggtcgaggccgtgatggacgtgaacgtcatcacgctcaccccgcgccagacggtcgccgagcaggacgccgagtacggcccgaagctgcacgaccgcgaccccgacctgtgctgcgcgctgcgcaaggtgaagccgctggaggaggggctggccggctaccgggcctgggcgaccgggctgcgccgcgacgagtccgagacccgggcgaacacgccggtcgtgggctgggacgagaagcggggcaaggtgaagatctcgcccatcgccaagtggtcacaggaagatgtgcaaacgtacgtcaccgagcacggcgtcctcacgaacccgctgctgacggacggctatgcctccgtgggctgcgcgccctgcacccgtcgtgtgctggagggcgaggacgcccgcgccggacgctgggcgggccgctcgaagaccgagtgcggactgcacggctga

SEQ ID NO: 39603 - protein, 236 aa, Streptomyces coelicolor A3(2)
MTAVQEERTTEELKALAERAGRELEDATALEILRWAAETFGDRFCVTSSMEDAVVAHLASRALPGVDVVFLDTGYHFPETIGTRDAVEAVMDVNVITLTPRQTVAEQDAEYGPKLHDRDPDLCCALRKVKPLEEGLAGYRAWATGLRRDESETRANTPVVGWDEKRGKVKISPIAKWSQEDVQTYVTEHGVLTNPLLTDGYASVGCAPCTRRVLEGEDARAGRWAGRSKTECGLHG

SEQ ID NO: 39604 - DNA, 741 bp, Thermosynechococcus elongatus BP-1
  CDS (1)..(741)
atgttttctaaaaccatgctaacaccgcctatggctgcctccgtaagctttgacctcgatgccctcaaccaacgctttgaaggggcacatccccgtgacattttggcatgggccgtcacagaaattccccaggggctggtgcagaccagtgcctttaacgtagatgacatggtgattacagatctgctgtaccgtgatctgcgccccaatccaccggtgcccgttctctttttggacacgctccatcactttgccgagaccctagcatttgtgcagcaggccaaggaaaaatacagtctggatttgcgcacctacaaaatccctgatgttgacagccgcgaagcctttgctgcccgctatggcgacaaactttgggaaaccaatgttgagcagtttcaccatctcactaaaattgaaccgctgcaacggggcttggcagaactgcatactgtggcttggattaccggccggcgtcgcgatcaagcgctcacccgtgccaatatgccctatgtggaactggacaaagagggtcgtctgaaaattaatccccttgctgcttggacacggaaacaaacttgggcctatgtgatggagcacggggtgatttacaatcccctccacgatcgcggctatgccagcattggcgatgagcccctcaccacccctatcgccgagggggaagatgaacgggccggtcgctggcgcggcatgggcaaaaccgagtgcgggattcacatctaa

SEQ ID NO: 39605 - protein, 246 aa, Thermosynechococcus elongatus BP-1
MFSKTMLTPPMAASVSFDLDALNQRFEGAHPRDILAWAVTEIPQGLVQTSAFNVDDMVITDLLYRDLRPNPPVPVLFLDTLHHFAETLAFVQQAKEKYSLDLRTYKIPDVDSREAFAARYGDKLWETNVEQFHHLTKIEPLQRGLAELHTVAWITGRRRDQALTRANMPYVELDKEGRLKINPLAAWTRKQTWAYVMEHGVIYNPLHDRGYASIGDEPLTTPIAEGEDERAGRWRGMGKTECGIHI

SEQ ID NO: 39606 - DNA, 723 bp, Oceanobacillus iheyensis HTE831
  CDS (1)..(723)
atgggtggctattcagttacctatagtaattttgttaaggatccatataaagactggtttcctgacgatgagacgaatggtgcttcaaaaatattgcaatgggcttatgaagtatatggaacggatatcgtatatgcttgcagctttggagcggaaggaatggtgctgatcgatctcatttcgaagacacaaaagaatgctgatattgtctttcttgatactgatcttcattttcaggaaacatatgacctgatagaagatataaaagtgaaatacccaacactcaacattcatatcaagaagcctgatttaacgttggaagagcaggcagccgaacatggttcagctttatggaagcgtcagccagaccaatgctgttatattcgtaaaattaagccattagaggatgcattaagtggtgcaccagcatggatatctggtctacggagagaacagtccgtatcaagaagcaaaacagattttataaacaaagatgaacggtttaaatctatcaaagtttgtcccttaattcattggacgtgggacgatgtatgggagtatatcaaagacaataacttaccgtacaatgaattacatgataatggatatccgagtattgggtgtattccttgtacttcccaagtgagtgattcctctgattcacgtgcaggaagatgggcgggtacccaaaagacggaatgtggtctccatacttccgattaa

SEQ ID NO: 39607 - protein, 240 aa, Oceanobacillus iheyensis HTE831
MGGYSVTYSNFVKDPYKDWFPDDETNGASKILQWAYEVYGTDIVYACSFGAEGMVLIDLISKTQKNADIVFLDTDLHFQETYDLIEDIKVKYPTLNIHIKKPDLTLEEQAAEHGSALWKRQPDQCCYIRKIKPLEDALSGAPAWISGLRREQSVSRSKTDFINKDERFKSIKVCPLIHWTWDDVWEYIKDNNLPYNELHDNGYPSIGCIPCTSQVSDSSDSRAGRWAGTQKTECGLHTSD

SEQ ID NO: 39608 - DNA, 759 bp, Brucella suis 1330
  CDS (1)..(759)
gtgctgcctgacgccgacattgccgatgcggatgagcgcgctgccgcgcaagcccggcttctcgaagcaagccacggcgcatccgcgccgcacgaaataatcgcgcttgtcacgcatgagcttttcgaggggcgggttgcggttgtttcgtccttcggggcggaatcggcggtgctcctgcatatgatctcgcagatcgaccgggcaacgccggtgctgtttctcgatacgggcaagcattttcgcgccacactcgattatcgccatcaactggtgggtcgcctgggccttgccgatgtgcgggatatcctgcctgttgcggacagcctggcaaaggaagacccgttcggcgccttgtcgatgaccgacaaggaccgttgctgctttatccgcaaggtggagccgatggcgcgcgccgttgcgccttaccgggcatggatgacgggacgtaagcagtttcaggcatccacccgcaatgggctgccggtgtttgaatcggttggcccgcgtatccgtatcaacccgctggcgcgctggcgggccgaagacctcagggcctatgccgaaaagtacagcctgccgccgcacccgctgaccgcgcagggctatcgctccatcggctgcatgccttgcacacgccccgtctcggagggcgaggatcagcgtgccggacgctgggcggggtcggaaaagaccgaatgcggcattcatctttccggccttgccgatagcctgaagggcatcccgaaagctgtgtaa

SEQ ID NO: 39609 - protein, 252 aa, Brucella suis 1330
MLPDADIADADERAAAQARLLEASHGASAPHEIIALVTHELFEGRVAVVSSFGAESAVLLHMISQIDRATPVLFLDTGKHFRATLDYRHQLVGRLGLADVRDILPVADSLAKEDPFGALSMTDKDRCCFIRKVEPMARAVAPYRAWMTGRKQFQASTRNGLPVFESVGPRIRINPLARWRAEDLRAYAEKYSLPPHPLTAQGYRSIGCMPCTRPVSEGEDQRAGRWAGSEKTECGIHLSGLADSLKGIPKAV

SEQ ID NO: 39610 - DNA, 741 bp, Leptospira interrogans serovar Lai str. 56601
  CDS (1)..(741)
atgaacgcgcaagagttggaacaaaaacttgctcctttgaagaacctagaagacgccttagaatggattagtaaagaatatggagaaactgcggctttctctacaagcttgggtcttgaagatcaagtcatcactcacgttatattctctcgaaatcttaaaattagaatttttactttggatacggggcggcttttcaacgagacctacgatttacataaattgacaaacgcaagttatggtaaaaagatagaaacttattttcccgacacgaatgcggttcaaaacctaatcaacttaaaaggtcccgacagtttctacgactcagttgaaaacagaaaagaatgttgttatattcgaaaagtcgaaccactcaatcgtgcgttagtcggaaccaagctttggatcaccggaatccgttccgaacaatccgattctagaaattctctcacaaaagtagaactggattcttctcgaaacatactcaagtatcatcctcttttggattggtccttggaacgcattcaagattttatagatacgtatcggattccgactaacgttcttcataaaaaaggttttccttctatcgggtgtgctccctgcacaagagcaattcaacccggagaagatattcgcgccggaagatggtggtgggaagaatccaaccaagaatgtggacttcacgttgtagacggcaagttagttcgtcaaaagcttggtcctaaaagagcaatatga

SEQ ID NO: 39611 - protein, 246 aa, Leptospira interrogans serovar Lai str. 56601
MNAQELEQKLAPLKNLEDALEWISKEYGETAAFSTSLGLEDQVITHVIFSRNLKIRIFTLDTGRLFNETYDLHKLTNASYGKKIETYFPDTNAVQNLINLKGPDSFYDSVENRKECCYIRKVEPLNRALVGTKLWITGIRSEQSDSRNSLTKVELDSSRNILKYHPLLDWSLERIQDFIDTYRIPTNVLHKKGFPSIGCAPCTRAIQPGEDIRAGRWWWEESNQECGLHVVDGKLVRQKLGPKRAI

SEQ ID NO: 39612 - DNA, 786 bp, Corynebacterium efficiens YS-314
  CDS (1)..(786)
atgagcttcgttaccgtcaacgcactgaagaacgccggtcccacccaggacccagaggtctccccggagggcccccgcaccaccgcacccctccccgaagaggtcgcacaccgcaaccgggagctcgtcgacaagcatgccgacgagctgtaccacgccgatgccgccaccatcctggagtgggcggcggagcacgtgccgggccgtgtcgcagtcacgctgagcatggagaacaccgtgctggccgaactggccgcccgtcacctgccgcaggcggatttcctcttcctggacaccgggtatcacttcgaggagaccctcgaggtggcccggaaagtggacgagcgttacagccagaccctggtcaccgcgctgccgatcctcacccgcgccgagcaggattcgctctatggaaagaatctgtaccgcagcaacccgacggcgtgctgccggatgcgtaaggtggagcccctcgcggccagcctctcgccatatgcggggtggatcaccggcctgcgacgctccgatgggcccacccgtgcccaggctccggcgctgtcgctggatgccaccggccggttgaagatctccccgatcatcacctggtcgctggaggagaccaaccggttcatcaccgacaacaacctcatcgatcaccccctcacgcaccagggatacccatccatcggttgcgccacctgcaccctgcctgtcgcagagggacaggacccccgtgccggccgctgggccggaaacgccaagacagaatgcggacttcactcatga

SEQ ID NO: 39613 - protein, 261 aa, Corynebacterium efficiens YS-314
MSFVTVNALKNAGPTQDPEVSPEGPRTTAPLPEEVAHRNRELVDKHADELYHADAATILEWAAEHVPGRVAVTLSMENTVLAELAARHLPQADFLFLDTGYHFEETLEVARKVDERYSQTLVTALPILTRAEQDSLYGKNLYRSNPTACCRMRKVEPLAASLSPYAGWITGLRRSDGPTRAQAPALSLDATGRLKISPIITWSLEETNRFITDNNLIDHPLTHQGYPSIGCATCTLPVAEGQDPRAGRWAGNAKTECGLHS

SEQ ID NO: 39614 - DNA, 735 bp, Pseudomonas putida KT2440
  CDS (1)..(735)
atgagccaacccttcgacgtcgccgccctggccgcgacctatgccaacaagtccccgcaggacatcctcaagcttgccttcgagcacttcggtgatgacctgtggatctccttcagcggcgccgaggatgtggtgctggtcgacatggcctggaagctgaacaagcaggtaaaggtattcagcctcgacactgggcgcctgcacccggagacctaccggttcatcgaccaggtacgcgaacagtacaacctgcccatcgagatcctcagccccgaccgcgccaagctcgacccgttcgtcaaggaaaagggcctgttcagcttctacaaggacggccatggcgagtgctgcggcattcgcaagatcgagccgctgcgacgcaagctggccaccgtcagcgcctgggccaccggccagcgccgcgaccaaagcccgggcacccgcagccaggtggcggcactggaaatcgacagcgccttttccacgcctgagcgcacgctgtacaagttcaacccactggcgcagatgagcagtgaagaggtatggggttatatccgcatgctcgagctgccgtacaacagcctgcacgagcgtggcttcatcagcattggctgcgagccatgcacccgcccggtgctgccaaaccagcatgagcgtgaagggcgctggtggtgggaagagtcgacgcagaaggaatgcgggttgcatgcgggcaacctgatcagcaaggcttga

SEQ ID NO: 39615 - protein, 244 aa, Pseudomonas putida KT2440
MSQPFDVAALAATYANKSPQDILKLAFEHFGDDLWISFSGAEDVVLVDMAWKLNKQVKVFSLDTGRLHPETYRFIDQVREQYNLPIEILSPDRAKLDPFVKEKGLFSFYKDGHGECCGIRKIEPLRRKLATVSAWATGQRRDQSPGTRSQVAALEIDSAFSTPERTLYKFNPLAQMSSEEVWGYIRMLELPYNSLHERGFISIGCEPCTRPVLPNQHEREGRWWWEESTQKECGLHAGNLISKA

SEQ ID NO: 39616 - DNA, 732 bp, Bradyrhizobium japonicum USDA 110
  CDS (1)..(732)
atgaacgcaattgcgcctcaggtatctcctgtgtccgtttccgcgctgccctctgccgcggaactcgatcgcgccttgcgcgatgcctcgcccgcggaggtcatcgccgcggccctgaaggcggtcggccgcgacaagcttgcgctggtgtcgtccttcggcacggaatcggcgacgcttctgaaggtgatggcggacgtcgatccgtcgatccccgtgatcttcctcgacaccggctggctgttcgaggagacgctcgcctatcgcgacatgctgatcgcgacgctggggctcaaggacgtccgctcgatcaggccggcggaggagacgctgtcgcgcgaggatcccgaccgcgacctctggttctccgatcccgacgcctgctgccgcatccgcaaggtggagccgctggcgcgcgcgctgaagccgttcgacgcctggatcaacggccgcaagcgcttccagggcaatgcgcgcgccgacattccggtggtcgaggacgacggcgcgcggttgaagttcaaccccttcgccaacgtttcgcgcgaggaactcgaggcgattttcgtccgcgccaaattgccgcgtcatccactggccgcctccggtttcctgtcggttgggtgtatgccttgcaccagcagaacggccgaaggcgaggatgcacgcgccggtcgctggcgcggccgggccaagacagaatgcggcatccacacgatgaagacttcgtag

SEQ ID NO: 39617 - protein, 243 aa, Bradyrhizobium japonicum USDA 110
MNAIAPQVSPVSVSALPSAAELDRALRDASPAEVIAAALKAVGRDKLALVSSFGTESATLLKVMADVDPSIPVIFLDTGWLFEETLAYRDMLIATLGLKDVRSIRPAEETLSREDPDRDLWFSDPDACCRIRKVEPLARALKPFDAWINGRKRFQGNARADIPVVEDDGARLKFNPFANVSREELEAIFVRAKLPRHPLAASGFLSVGCMPCTSRTAEGEDARAGRWRGRAKTECGIHTMKTS

SEQ ID NO: 39618 - DNA, 735 bp, Pseudomonas syringae pv. tomato str. DC3000
  CDS (1)..(735)
atgagccaacctttcgacgtcgctgaactggcgacgacttatgcgaacaagtctgcacaggacattctgaaactggcgttcgagcatttcggtgacgaactgtggatctccttcagcggcgccgaagacgtcgtgctggtggacatggcctggaaactgaacaaaaacgtcaaggtcttcagcctcgacacaggccgtctgcaccccgagacctatcgcttcatcgaacaggtccgtgatcactacaaaatcgacatcgagatcatctcgccggaccagcgcgcgcttgaacctttcgtcaaggaaaagggcctgttcagcttctaccgggacgggcatggcgaatgctgcggcatccgcaagatcgagccgctgcgccgtaagctgtccagcgtcaaggcctgggccaccggccagcgccgcgaccagagccccgggacgcgcagtgctgttgcggcactggaagtagacagcgcattctcaacggccgaaagcacgctgtacaagttcaacccgttggcgcagatgagcagcgaggaaatctggggctacatccgcatgctggaactgccttacaacagcctgcacgagcgtggcttcatcagcatcggctgcgaaccctgcacccgcccggtcctgcccaaccagcacgaacgcgaaggccgctggtggtgggaagaagccacccagaaagaatgcggactgcatgcgggcaatctgatagtgcgcgactga

SEQ ID NO: 39619 - protein, 244 aa, Pseudomonas syringae pv. tomato str. DC3000
MSQPFDVAELATTYANKSAQDILKLAFEHFGDELWISFSGAEDVVLVDMAWKLNKNVKVFSLDTGRLHPETYRFIEQVRDHYKIDIEIISPDQRALEPFVKEKGLFSFYRDGHGECCGIRKIEPLRRKLSSVKAWATGQRRDQSPGTRSAVAALEVDSAFSTAESTLYKFNPLAQMSSEEIWGYIRMLELPYNSLHERGFISIGCEPCTRPVLPNQHEREGRWWWEEATQKECGLHAGNLIVRD

SEQ ID NO: 39620 - DNA, 738 bp, Streptomyces avermitilis MA-4680
  CDS (1)..(738)
atgaggacggttcaggccgacacggacaccggcacagagcgtgcgaccggccgcgacgcggagctgaagacgctcgccgagcaggccgggcgcgacctggaggacgcctccgccctggagatcctccagtgggcggcggacaccttcggcaagaagttctgcgtgacctcctccatggaggacgccgtggtcgcccacctcgcctcccggaccttccccggtgtggacgtggtcttcctcgacaccggctaccacttcccggagaccatcggcacccgcgacgcggtcgaggccgtgatggacgtcaacgtcatcacgctcaccccgcgccggacggtcgccgagcaggacgcggagtacggcccgaagctgcacgaccgcgaccccgacctgtgctgcaagctccgcaaggtccagccgctggagcagggcctgaccgcgtacgacgcctgggcgacgggcctgcgccgcgacgagtccccgacccgggcgaacaccccggtcgtcagctgggacgagaagcgccgcaaggtgaagatctcgccgatcgcccgctggacccaggacgacgtggacgcgtacgtcgcggagcacggcgtgctgaccaacccgctgctgatggacggctacccctccgtgggctgcgcgccctgcacccgccgtgtgctggagggcgaggacgcgcgcgccggccgctgggcgggcagcaccaagaccgagtgcgggctgcacggatga

SEQ ID NO: 39621 - protein, 245 aa, Streptomyces avermitilis MA-4680
MRTVQADTDTGTERATGRDAELKTLAEQAGRDLEDASALEILQWAADTFGKKFCVTSSMEDAVVAHLASRTFPGVDVVFLDTGYHFPETIGTRDAVEAVMDVNVITLTPRRTVAEQDAEYGPKLHDRDPDLCCKLRKVQPLEQGLTAYDAWATGLRRDESPTRANTPVVSWDEKRRKVKISPIARWTQDDVDAYVAEHGVLTNPLLMDGYPSVGCAPCTRRVLEGEDARAGRWAGSTKTECGLHG

SEQ ID NO: 39622 - DNA, 699 bp, Nitrosomonas europaea ATCC 19718
  CDS (1)..(699)
atgggtgagcaggcattgcagcaaaaggttgagcagttgcacagtttgttaggcaatattcagcgggattattctcctgccgtgtttgccagtagttttggtgctgaggatatggtactgacggatctcattgcgcgccattatcctgaaattggcatatttactctggataccgggcgcctgccggaggaaacctatgatctgatgcaaaaggtaaaagagcgttatggtgtttccattcatgcttattttcctgatgcatcggctgttgagcactatgtagcacagcatgggccaaacgggttttatgatagtgttgccttgcgtaagcgttgttgttacatacgtaaggttgaacctctgaaacgtgcgctggctgataaaaaagcctggattacggggatgcgtcgtgatcaatcgacgacacgtgaagaattagagctatcggcatacgatagcgatcacggtctgcacaaattcaatccactctgtgactggaccgagaaggatgtatggaattacatcaggcagcacgatgttccctataacgcattgcatgatcgcttttatcccagtattggttgtgccccctgcacccgggcgatcacgccgggtgaagatattcgctcagggcgctggtggtgggagaatcccgaatccagggaatgtggtttgcatacccggaaaatagaagcataa

SEQ ID NO: 39623 - protein, 232 aa, Nitrosomonas europaea ATCC 19718
MGEQALQQKVEQLHSLLGNIQRDYSPAVFASSFGAEDMVLTDLIARHYPEIGIFTLDTGRLPEETYDLMQKVKERYGVSIHAYFPDASAVEHYVAQHGPNGFYDSVALRKRCCYIRKVEPLKRALADKKAWITGMRRDQSTTREELELSAYDSDHGLHKFNPLCDWTEKDVWNYIRQHDVPYNALHDRFYPSIGCAPCTRAITPGEDIRSGRWWWENPESRECGLHTRKIEA

SEQ ID NO: 39624 - DNA, 918 bp, Rhodopirellula baltica SH 1
  CDS (1)..(918)
atgcccattcgcctgaacgagacagccgtggtgaaccccacttatgtcccctctgaatccgaatccacacctgtctcggctgagccagcatccagaccgtcgttgcgtgttctcacgccggctgagatcgctcacaacgcggctgctgcgggccctgacgtcgatgcgcaggggattccaaccaaacgtggtgccctggcggcggatcctcccctggctcccacagacgaatttctggccgaactgaagcgagacagcgattcattggaatccgcgactccacaagaagtgctgaaatgggcggtggatcgatttgccccgaaattcaccatggcgaccgccttcggccccgaaggcatgacgatcattcacatgctcgccgaaattgctcccgaaacgccaattttcaacttagaaaccggctaccaatttcgagaaactctcgatcttcgcgagaaggtcaaggaacgctacgggatcgaagtccagtacaaatacccgtcgacgacggtcgaggaattcgaaacgctccatggcggaccgctctacaagaccgaccccaatcgctgctgcttcgaacgcaaactacgcgtgctacatcgtgcggccagtggttggcatgcatgggccagcgctatccgtcgcgaccagagcgaagatcgtgcgaaggctccgatcgttggctgggacaagaaattccagctggtaaagatcagtcctctggcaaactggaccaaaaaagatgtttggtcgctgatctcgaaagagagcatcccatacaacccattgcacgaccaaggctatccgagcatcggatgccaagcttgcacgcgtcctgtccaacttggcgaagacgaacgagcaggtcgttggagtggattccaaaagaccgaatgcggattgcacacctcggaatga

SEQ ID NO: 39625 - protein, 305 aa, Rhodopirellula baltica SH 1
MPIRLNETAVVNPTYVPSESESTPVSAEPASRPSLRVLTPAEIAHNAAAAGPDVDAQGIPTKRGALAADPPLAPTDEFLAELKRDSDSLESATPQEVLKWAVDRFAPKFTMATAFGPEGMTIIHMLAEIAPETPIFNLETGYQFRETLDLREKVKERYGIEVQYKYPSTTVEEFETLHGGPLYKTDPNRCCFERKLRVLHRAASGWHAWASAIRRDQSEDRAKAPIVGWDKKFQLVKISPLANWTKKDVWSLISKESIPYNPLHDQGYPSIGCQACTRPVQLGEDERAGRWSGFQKTECGLHTSE

SEQ ID NO: 39626 - DNA, 765 bp, Prochlorococcus marinus subsp. marinus str. CCMP1375
  CDS (1)..(765)
atggatgataaacacatgacttctagaaaattggaaaaaattccattcttaaagattcccttaaaagaagctcgtaagcatcttgaaccactatctccacaaaaacgcttgacatgggcttatgaacaatttggtcctcatcttgctattacgacaagtttcgggattcaatcatcggttttacttcacatgctttaccagctcaatagtggcaatactataaaagtaatatgggttgatacagggtatttaccaaaagagacttatcaatatgcagctgcacttacagacagacttaagctagatgtcactgttgcacaaagcataataactccagcaagaatggaagccttatacggtgaactttggaatactaactctctaaaagatatgggaaaatatcaccgcattcgaaaagtcgaacctttagaaaaagctttagaagatttagatatctattgctgggcaagtggcgtcagaagcagtcaaactgacaataggagctcaatgagcatattagatcgtattagaaaccgtctatctcttagaccaatattggaatggtcgcaaaaagacattttttattacatgcaaaccaatgatttacctcaacaccctctttttgaaaaagggtattcaacaataggtgattggcattcaagttccccagatactactgatgcagctggaagaaaaacacgatttggaggcttacaacaagaatgtggaattcatattgaggacagtaataaagaacacaagtaa

SEQ ID NO: 39627 - protein, 254 aa, Prochlorococcus marinus subsp. marinus str. CCMP1375
MDDKHMTSRKLEKIPFLKIPLKEARKHLEPLSPQKRLTWAYEQFGPHLAITTSFGIQSSVLLHMLYQLNSGNTIKVIWVDTGYLPKETYQYAAALTDRLKLDVTVAQSIITPARMEALYGELWNTNSLKDMGKYHRIRKVEPLEKALEDLDIYCWASGVRSSQTDNRSSMSILDRIRNRLSLRPILEWSQKDIFYYMQTNDLPQHPLFEKGYSTIGDWHSSSPDTTDAAGRKTRFGGLQQECGIHIEDSNKEHK

SEQ ID NO: 39628 - DNA, 741 bp, Candidatus Blochmannia floridanus
  CDS (1)..(741)
gtgaatcgttgttggtgtgttgaagaattggatgtattgggtgtagttgaacgtgcattaatattaaatgagataaatcagtatttagaatctgtaacaatagaagataggataatgtgggttatgaagtatttatctgggcaattagtattatcttcaagttttggtattcattcttatgtaagtttgcatttaatgactaattattatccttctgttccagtgattttaattgatacgggttatttgtttccagaaacatatcaatttattgatcgattgacggaaaaaatgaaattaaatttgcatgtttttcgtcctgataaatctcctgcttggcaggaagcacgttatggaaaattgtgggagcaaggaattgaaggaattagacagtataattttatgaataaagtaaaacctatgcgttatgctttaaaaaaacttaaagttagagtatgggtgtcggggttaaggagatatcaatcttgtagtcgtaaaaatttgttaattttggatatgcaaaatggtatgtttaaatttttaccaattgttgattgggatcataatcaagtacatcaatatattaaaagatatgatttagaatatcatccattatggaaacaagggtatgtatcagtaggtgatgtacatactactattaaaaaagaacctggtatgaaggatgaagaaactcgtttttttggattacaacgagaatgtgggttacatgttattgattaa

SEQ ID NO: 39629 - protein, 246 aa, Candidatus Blochmannia floridanus
MNRCWCVEELDVLGVVERALILNEINQYLESVTIEDRIMWVMKYLSGQLVLSSSFGIHSYVSLHLMTNYYPSVPVILIDTGYLFPETYQFIDRLTEKMKLNLHVFRPDKSPAWQEARYGKLWEQGIEGIRQYNFMNKVKPMRYALKKLKVRVWVSGLRRYQSCSRKNLLILDMQNGMFKFLPIVDWDHNQVHQYIKRYDLEYHPLWKQGYVSVGDVHTTIKKEPGMKDEETRFFGLQRECGLHVID

SEQ ID NO: 39630 - DNA, 753 bp, Bordetella bronchiseptica RB50
  CDS (1)..(753)
atgatggcggcccgtcccctcgccgccatcgccggcctgacggccgccgccgccgcccgctggcacgacctgcagtcgcgcctggcgatcatcgcgcggcagtatcccgacgcggcgctggcttcctcgctggccgccgaagacatggtgctgacccacgccatctatgccggcgggctggacctggaggtgttcaccctggatacgggccggctgcataccgagaccctcggcgtgctggacgcggtggccacgcgctacgggcgcgccatcacggtttaccggcccgacgccgccgcggtgcaggcgcatgtggacgcgcacggcatgcacgccttctatgaaagcgtggcgttgcgcaaggcctgctgcgaaatccgcaaggtcgagcccttgcgccgcgcgctggccgggcgcggcgcctggatcaccgggcagcgccgcgcgcaatcggccactcgcggcgagctgcccgacgaggagcgcgatcccgtgttcggcctctacaagttcaacccgctggcggcgtggaacgaggccgatgtgtggagcgtcattcgcgcgctgggcatcccgtacaacccgctgcacgaccagggctacccgtccatcggctgcgaaccctgtacgcgcgccgtccgcccgggcgaggacgtgcgggccggccgttggtggtgggaatcgtcggactcgaaggaatgcggcctgcacgccggcaaccgggtcatccagatcgcggcccggcctgcctga

SEQ ID NO: 39631 - protein, 250 aa, Bordetella bronchiseptica RB50
MMAARPLAAIAGLTAAAAARWHDLQSRLAIIARQYPDAALASSLAAEDMVLTHAIYAGGLDLEVFTLDTGRLHTETLGVLDAVATRYGRAITVYRPDAAAVQAHVDAHGMHAFYESVALRKACCEIRKVEPLRRALAGRGAWITGQRRAQSATRGELPDEERDPVFGLYKFNPLAAWNEADVWSVIRALGIPYNPLHDQGYPSIGCEPCTRAVRPGEDVRAGRWWWESSDSKECGLHAGNRVIQIAARPA

SEQ ID NO: 39632 - DNA, 723 bp, Prochlorococcus marinus subsp. pastoris str. CCMP1986
  CDS (1)..(723)
atgattaagaaaacgctagaaagtattcaacttaatttagaagggcataataaaaaattaaaagatatgacccccaaagaaataatattatggggttataaaaactttggtaatcaattcgctattacaacaagctttggtatacaatcatcagttattttacatatggtgcatcagcactcactacaaaaaaaaattaagattttctggatagatacaggttacttaccctcagagacttataaatatgcagagagactaattaatgatttatctttagaaattgaggttttacaaagtgaactatctccagcaagaatggaatccctttatggaaaactttgggaaactaataaatctagtgatttagataaataccatgacataagaaaaatcaaacctttagaaaatgctttagataaacacgacatattctgctgggctagcggtgttagatcggagcaaacgaaaaataggaataaaatgaattttgttgacgtaattcgcaaacgactttctttaaggcccttactcaactggaaaaacaaagatattttttattacatgaaagaaaatcaattaccgtcacacccacttttctcaaaaggttattcaactgttggagattggcattccagttctcctgaaagtgttgataaagaaggcaggacaacaagatttggcggaatgaagcaagaatgtggaattcatactgaaaattaa

SEQ ID NO: 39633 - protein, 240 aa, Prochlorococcus marinus subsp. pastoris str. CCMP1986
MIKKTLESIQLNLEGHNKKLKDMTPKEIILWGYKNFGNQFAITTSFGIQSSVILHMVHQHSLQKKIKIFWIDTGYLPSETYKYAERLINDLSLEIEVLQSELSPARMESLYGKLWETNKSSDLDKYHDIRKIKPLENALDKHDIFCWASGVRSEQTKNRNKMNFVDVIRKRLSLRPLLNWKNKDIFYYMKENQLPSHPLFSKGYSTVGDWHSSSPESVDKEGRTTRFGGMKQECGIHTEN

SEQ ID NO: 39634 - DNA, 801 bp, Prochlorococcus marinus str. MIT 9313
  CDS (1)..(801)
atgactgatggctccattgatacggtttccactgccacgtctactgcggcaggccaatctccgagtgtgcaggttgcctcgactctcgagatgcctctggaggatgcacggatacaccttgccaatctttctgcccagaagcgtcttgagtgggcactgaaacagtttggtcaaggctttgttctgacaacgagcttcggcattcaatcagctgttctgctgcacatgctccatggtcttgatggtggttcggtggtccctgtggtctgggtggatacgggctatctaccagcagagacctatttctatgcggatcagctcacgcgtcagcttgggttggatttaaaggtggttcaaagcacaatgtctcccgctcggatggaggctatctatggccggctctgggagacaggttcggtgaaggatctggagacatatcaccgtattcgcaaggtggagcccctcgagcaggctctggatgatctccgtgtgcattgctgggccagtggggtgcgcagtgatcagaccgactatcggcgctcaatggcttttttggacctgattcgtgatcgcctttcattgaggcctttactcgactggactcccaaggaggttttctattacatgcaggagcatcagttgccgcagcatcctctgtttgaaaagggttactccacggtcggcgattggcattccagtgctcccgatggggggggggcttctggacgggagacacgctttggaggtcttaagcaggaatgcggccttcacctcccaggtgtgttgggcgaaggcatctaa

SEQ ID NO: 39635 - protein, 266 aa, Prochlorococcus marinus str. MIT 9313
MTDGSIDTVSTATSTAAGQSPSVQVASTLEMPLEDARIHLANLSAQKRLEWALKQFGQGFVLTTSFGIQSAVLLHMLHGLDGGSVVPVVWVDTGYLPAETYFYADQLTRQLGLDLKVVQSTMSPARMEAIYGRLWETGSVKDLETYHRIRKVEPLEQALDDLRVHCWASGVRSDQTDYRRSMAFLDLIRDRLSLRPLLDWTPKEVFYYMQEHQLPQHPLFEKGYSTVGDWHSSAPDGGGASGRETRFGGLKQECGLHLPGVLGEGI

SEQ ID NO: 39636 - DNA, 765 bp, Synechococcus sp. WH 8102
  CDS (1)..(765)
atggatggggtccgcggcatgacgggcgtgttggttcgggacaatctcgatgcggaccgcggcagcctggagccgttgagtcctcaagatcgactggcttgggcacaccagcgcttcggatccggatttgctctcaccaccagcttcggcatccaatcggcggtgctgctgcacatgctcagtcaactgccggagggtgacgccgttcctgtgatctgggtggacactggctatctgccggaggagacctaccgctatggcgcccagctcacgaagctgctcagcatccgcctggtggtggctcaaagcgccatgtcgccggctcggatggaggctctgcatggccgcctctgggacaccggacagctcgatgatcttgagaaataccaccagatccgcaaggtggagcccctggatcgggctttggcgcaactggaggtgagctgctgggccagtggcgtgcgtcgcggccagactgaccaccgccgcgcgatgaccgtgctggacccgatccgagagcggctgtctctgcgtccgctgttggattggacccagaaggacatctactactacatgcaggacaacaacctgccgcaacacccgttgttcgagcagggatactcaaccgtgggggattggcactccagtgctccggatggcgctgagctcagcggacgtaacacccgtttcgggggcctgaaacaggaatgtgggatccacgttccccaggaggccgtggaaggcttgatgggggatgggatctag

SEQ ID NO: 39637 - protein, 254 aa, Synechococcus sp. WH 8102
MDGVRGMTGVLVRDNLDADRGSLEPLSPQDRLAWAHQRFGSGFALTTSFGIQSAVLLHMLSQLPEGDAVPVIWVDTGYLPEETYRYGAQLTKLLSIRLVVAQSAMSPARMEALHGRLWDTGQLDDLEKYHQIRKVEPLDRALAQLEVSCWASGVRRGQTDHRRAMTVLDPIRERLSLRPLLDWTQKDIYYYMQDNNLPQHPLFEQGYSTVGDWHSSAPDGAELSGRNTRFGGLKQECGIHVPQEAVEGLMGDGI

SEQ ID NO: 39638 - DNA, 852 bp, Rhodococcus erythropolis
  CDS (1)..(852)
atgagtgcaactccggatggcttgaacatggccacgctcaatgcattccgccctatccggcacgatctggagtcaatacgagcgaaaatcgctgcacacctcgaagacaatgacggctacgtcgcgttctccggcggtaaggattcgcttgtcgtgcttcacctcgccctttccgtggagccgaatgttcccgtcgtcttcttcgactccggagcggaatttcctgagacgtacgaattcgtgcagcgagtggcacaggaatggaagttgaactttcaggtatatgcggcagagcccccattactggaaatgctctcccgcgacgggggttggcagcacgaacgcgcggcggactacccaaagtccgtttcactgcacgaatcattgattgctgagccagctcgtcgcgcgcacgccgaccacgggccaggcgagatatggggcgtacgcgccgacgaatctgtcaaaggcacagctcgatggtcgctctatcacagcaatctcgcgctcgaaatcgaacggaactgccgaacttgttgcgccactaaggcggagcaacgccgggcacacggtggcttgatctcgcgcgccgacggaactcgcgtgattgggccggcatgggattggagccgcgacgatgtctggggctacctggctcgacacaagctgccggccaacccgatctacgacaaactacgtggtctcggcgtctccgacgaaaacttgcgggtcagccatctcatcgacggacacttcctcgaacaaggccgggtcacgtggctacgacgcggatggccgacattgttcgaggaaatcgccgatgtacttcttcgtatccgcgagtacatctga

SEQ ID NO: 39639 - protein, 283 aa, Rhodococcus erythropolis
MSATPDGLNMATLNAFRPIRHDLESIRAKIAAHLEDNDGYVAFSGGKDSLVVLHLALSVEPNVPVVFFDSGAEFPETYEFVQRVAQEWKLNFQVYAAEPPLLEMLSRDGGWQHERAADYPKSVSLHESLIAEPARRAHADHGPGEIWGVRADESVKGTARWSLYHSNLALEIERNCRTCCATKAEQRRAHGGLISRADGTRVIGPAWDWSRDDVWGYLARHKLPANPIYDKLRGLGVSDENLRVSHLIDGHFLEQGRVTWLRRGWPTLFEEIADVLLRIREYI

SEQ ID NO: 39640 - DNA, 705 bp, Chromobacterium violaceum ATCC 12472
  CDS (1)..(705)
atgagcctggagtccaaactcgccgccaccacggccctgctgcaaaccatcgccgccgaacatcccgacgcggtgctggccaacagctacggcgccgaagacatggtgctgaccgacctgatcgcccgtctcggcctgccgctggaaagcttcagcctggacaccggccgcctgccggccgaaacctatgagttgatgcagcaagtcgccgagcgttatccaggccatccggtcaggatgtacttccccgacaccgccgccaccgagcagtacgtcaacttccacggcatcaacggcttctatcggagcgtcgagttgcgcaagtcctgttgcgcggttcgcaagctggagccgctgaagcgcgcgctggccggccgatcggcctggatcaccggcctgcgccgccagcagtcgccgacgcgccaggacctggccgacagggagtacgacgccgacaacgggctcgtgaaattcagcccgctgctggaatggacggaagccgaagtgtggcagtacctgaaggaaaaccaggtgccgtacaacgcgctgcacgatcggcactatccgtcgataggctgcgcgccctgtacccgcgccatcagcgtgggcgaagacgtgcgcgccggccgctggtggtgggaaaacccggaaaccaaggagtgcgggctgcacgcgaagtccagtccgctgcagcgccccgtctga

SEQ ID NO: 39641 - protein, 234 aa, Chromobacterium violaceum ATCC 12472
MSLESKLAATTALLQTIAAEHPDAVLANSYGAEDMVLTDLIARLGLPLESFSLDTGRLPAETYELMQQVAERYPGHPVRMYFPDTAATEQYVNFHGINGFYRSVELRKSCCAVRKLEPLKRALAGRSAWITGLRRQQSPTRQDLADREYDADNGLVKFSPLLEWTEAEVWQYLKENQVPYNALHDRHYPSIGCAPCTRAISVGEDVRAGRWWWENPETKECGLHAKSSPLQRPV

SEQ ID NO: 39642 - DNA, 684 bp, Wolinella succinogenes DSM 1740
  CDS (1)..(684)
atgagagacgccacaaaagaatctctggagcgcctttgtgaggtcaaaggcctcatcacgcttgccttcagccatcaagccgaagatgtcgtggttctcgatcttttgctcaaacactatcctcgatcttttgaggttttcacgctagagacgggcaaactctttactcaaacactcgcttttcatgaggaagtggagcgattttttaatctcaccatccaaaagtatcacccctcgcccaaggcgctcttagagcttgaacgagagcttggcgagtgggggatgcgtgaaagcttagagaatcgccatcgctgttgccgtgtgcgaaaaatcgaacccctcaaagaagccctcaaaggcaagagtgcatgggtcacagggcttagggccgagcagtcgatcactcgcgctgagcttaagagcgttgaatttgatgaaacttttgatctgctcaaattcaatcctctaagcacttggagcgaaacagaggtttttgaatacatcaaggaacacgccctcccccttcaccctctctacacagagggctatcgaagcatcggctgctcgccttgcactcgcgctattgaggcaggcgaggagctaagagcgggaaggtggtggtgggaaaatcccgaacacaaagagtgcggactacatctaaaaggagctcaatggacaagttag

SEQ ID NO: 39643 - protein, 227 aa, Wolinella succinogenes DSM 1740
MRDATKESLERLCEVKGLITLAFSHQAEDVVVLDLLLKHYPRSFEVFTLETGKLFTQTLAFHEEVERFFNLTIQKYHPSPKALLELERELGEWGMRESLENRHRCCRVRKIEPLKEALKGKSAWVTGLRAEQSITRAELKSVEFDETFDLLKFNPLSTWSETEVFEYIKEHALPLHPLYTEGYRSIGCSPCTRAIEAGEELRAGRWWWENPEHKECGLHLKGAQWTS

SEQ ID NO: 39644 - DNA, 726 bp, Gloeobacter violaceus PCC 7421
  CDS (1)..(726)
gtgaatttactgcaggaccaaccggcgatgggcatcgaccagacgactctggagcatctggcccggcagtgggaggatctggctcctgaggccatcctggcggaagcggtgcgctgttttggcgacaagttggtgctggcgagcgccttcggtcccgagtcgatcattttgctcgacatgctggtgaaggtgtggccccggccgcaggcattcttcctcgagacgggctttcattttcccgagacgctggcgctcaaagaccgggtgctcgcgcgctttccgcagttgcagcttgaggtggtggggccgctgatgtccgtcgctcagcaaaatgccatctacggcgagcgcctgcacgatcgcaacccggatcattgctgcgccattcgcaaagtcgagccgctcaaccgcgccctcgccccttacaaagcctggattgccggcatgcgccgcgaacagtcgccgacccgcggccagattggcgtcgtgcagtgggattcgcgccgcggcatggtcaagttcaatccgctggccacctggacgcacaagcaagtctgggcctacattgtcgagcgcgatttgccctataaccccctgcacgacgaggggtttccgtcgatcggctgctcgcctcttaactgcaccgccccggtggccgacggggcggacccgcgctcggggcgctggcggggcaaggccaagaccgagtgcggcctgcatgcgtga

SEQ ID NO: 39645 - protein, 241 aa, Gloeobacter violaceus PCC 7421
MNLLQDQPAMGIDQTTLEHLARQWEDLAPEAILAEAVRCFGDKLVLASAFGPESIILLDMLVKVWPRPQAFFLETGFHFPETLALKDRVLARFPQLQLEVVGPLMSVAQQNAIYGERLHDRNPDHCCAIRKVEPLNRALAPYKAWIAGMRREQSPTRGQIGVVQWDSRRGMVKFNPLATWTHKQVWAYIVERDLPYNPLHDEGFPSIGCSPLNCTAPVADGADPRSGRWRGKAKTECGLHA

SEQ ID NO: 39646 - DNA, 741 bp, Rhodopseudomonas palustris CGA009
  CDS (1)..(741)
atgaccgagctggcgcaatctctccccccctccacttccgcttccacgggtgtggagacgcgtgcgcaggcactcgacgcagcgcttcggaccgcatcgccggccgaagttgttgccgcggcgctgcgcgaggtcggtcgcgaccagctggcgctggtgtcctcattcggcaccgagtcggcggcgctgttgaaagtgatggcggatgtcgatccggcaattccggtagtgtttctcgataccggttggctgttcgaagaaaccctcgcctatcgcgatacgcttaccaacgtgctcggccttcgtgacgtacgttcgatcaagccgctcgacgccgatctcgatcgcgacgatgcggcgcgcgagttgtggttttccgatccggacaaatgctgcctgatccgcaaggtcgagccgctgaagcgggcactggcgccgttcgacggctggatcaacggtcgcaagcgcttccagggcggtgcgcgcgccgacatcccggtggtcgaagccgacggcaagcgactgaagttcaatccgttcgcgaatatcacgccgaccgacatcgcggcgatctacgccaccgcaaagctgccgcagcatccgttactcgcgtcgggttttctctccgtcggctgcatgccgtgtaccagccgcgccgaaaccggtgaggatgcacgcgccggccgctggcgtggacgcggcaagacggaatgcggcattcacacgatcaagacttcatag

SEQ ID NO: 39647 - protein, 246 aa, Rhodopseudomonas palustris CGA009
MTELAQSLPPSTSASTGVETRAQALDAALRTASPAEVVAAALREVGRDQLALVSSFGTESAALLKVMADVDPAIPVVFLDTGWLFEETLAYRDTLTNVLGLRDVRSIKPLDADLDRDDAARELWFSDPDKCCLIRKVEPLKRALAPFDGWINGRKRFQGGARADIPVVEADGKRLKFNPFANITPTDIAAIYATAKLPQHPLLASGFLSVGCMPCTSRAETGEDARAGRWRGRGKTECGIHTIKTS

SEQ ID NO: 39648 - DNA, 708 bp, Geobacter sulfurreducens PCA
  CDS (1)..(708)
atggccatagagaagcattcatcactgccccagatccctgaaaatgccactccactggagatactcagaattggtatcgaagcggcgggcggtgccgtgagccttgcctgctccttttcagtcgaagacgtaatcatcatcgacctgatcacgtcccatgatcttccggtgggaatcttcgccatagacaccgggcggcttcccgaggagacccatgaggtcgccgaggctatcgtctccaggtacggagtgggcattgactggtatttcccccgcaacgacgaggtggagcggctgctgcgggggaaagggccgttttcgttccgtgaaagccttgtcaatcgccaccagtgttgtcatatccgcaaagtggagccgctggggcgtgccctggcggggctggccggctgggtgacgggcgtgcggcgggcccacggtgtgacacgggctaatctcgctcctcttgagattgatgacaccaacggcggtatcgtgaagatcaatcccctcctggactggaccgactcccaggtatgggcgtatgcggaggcacggcggctaccggtgaatcgcctccatcaccaggggtatccgtccatcggctgcgccccctgcacccgggccgttaccccaggccagcccccccggtcggggcgctggtggtgggaagatcctgagcacaaggaatgcgggctgcaccggcgctga

SEQ ID NO: 39649 - protein, 235 aa, Geobacter sulfurreducens PCA
MAIEKHSSLPQIPENATPLEILRIGIEAAGGAVSLACSFSVEDVIIIDLITSHDLPVGIFAIDTGRLPEETHEVAEAIVSRYGVGIDWYFPRNDEVERLLRGKGPFSFRESLVNRHQCCHIRKVEPLGRALAGLAGWVTGVRRAHGVTRANLAPLEIDDTNGGIVKINPLLDWTDSQVWAYAEARRLPVNRLHHQGYPSIGCAPCTRAVTPGQPPRSGRWWWEDPEHKECGLHRR

SEQ ID NO: 39650 - DNA, 744 bp, Mycobacterium avium subsp. paratuberculosis str. k10
  CDS (1)..(744)
atgagcgacgtggcaaccgacttcaccgaggaacagctgcgcgagctggccgagcgcggcgcctcggagctggagggcgccagcgcgatcgacatcctgcgctggaccgacgagcacttcgggcccgtcgacgggccgcgcggctgggccacctgcaaatacgtggtggcctgcaacatgcaggacgcggtgacggtgtcgctggcctcagacgtgcgccccggcgtgccggtgttgttcctggacaccggctatcacttcgccgagaccatcggcacccgcgacgccgtcgaggcggtctacgacatccacctgctcaacgtcaccccggagcacaccgtggccgagcaggacgagctgctgggcaaggacctgttcgcccgggaccccaacgaatgctgccggctgcgcaaggtggagccgctgcgcagggcgctgcgcggctacgcggcgtgggtgagcgggctgcgccgggtggaggcgcccacccgcgccgacgccccgctgatcagcttcgacgagtcgttcaaggtggttaaggtcaacccgatcgccgcctggaccgacgagcaggtcgacgaatacatcgagcgcaaccgggttttggtcaacccgctggtgcaggagggctacccgtcgatcggctgcgccccgtgcaccgccaagccggcaccgggcgaggatccgcgcagcgggcgttggcggggacgaaacaaggtcgaatgcgggttacacgcctcatga

SEQ ID NO: 39651 - protein, 247 aa, Mycobacterium avium subsp. paratuberculosis str. k10
MSDVATDFTEEQLRELAERGASELEGASAIDILRWTDEHFGPVDGPRGWATCKYVVACNMQDAVTVSLASDVRPGVPVLFLDTGYHFAETIGTRDAVEAVYDIHLLNVTPEHTVAEQDELLGKDLFARDPNECCRLRKVEPLRRALRGYAAWVSGLRRVEAPTRADAPLISFDESFKVVKVNPIAAWTDEQVDEYIERNRVLVNPLVQEGYPSIGCAPCTAKPAPGEDPRSGRWRGRNKVECGLHAS

SEQ ID NO: 39652 - DNA, 744 bp, Mycobacterium avium subsp. paratuberculosis str. k10
  CDS (1)..(744)
atgaccgaacgaacgaccaaacttccagaggccgaactgcgtgaactagccgcccgcggcgccgccgagctcgaaggcgccagcgccagcgacgtgttgcgttggaccgacgagacattcggcggcgtcaacgggccacgcggatgggccacctgcaactacgtggtggcctcgagcatgcaggaagcggtgttgatcgacctggccgccaaggtccgccccggtgtgccggtggtcttcctggacaccggctaccacttcgccgagaccatcgggacccgggatgcgatcgaatccgtctacgacatccgggtgctcaacgtcactcccgagcacagcgtcgccgagcaggacaaactgctgggcaaggacctgttcgcgcgcgaccccggcgaatgctgccggctgcgcaaggtcgccccgctgggcaagacgctgcgcggatactcggcctgggtgaccggcctgcgccgctcggaggccgcgacacgggccaacgcgccggtgatcggcttcgacgagggcttcaagctggtcaaggtcaaccccatggccacctggaccgacgaggacgtgcagaactacatcgacgagcacaacgtgctggtcaatccgcttatctacgaaggctattcgtcgatcggctgcgccccctgcacggccaagccgctggccggcgccgacccgcgcagcgggcgctggcagggcctggccaagacggaatgcgggctgcacgcctcgtaa

SEQ ID NO: 39653 - protein, 247 aa, Mycobacterium avium subsp. paratuberculosis str. k10
MTERTTKLPEAELRELAARGAAELEGASASDVLRWTDETFGGVNGPRGWATCNYVVASSMQEAVLIDLAAKVRPGVPVVFLDTGYHFAETIGTRDAIESVYDIRVLNVTPEHSVAEQDKLLGKDLFARDPGECCRLRKVAPLGKTLRGYSAWVTGLRRSEAATRANAPVIGFDEGFKLVKVNPMATWTDEDVQNYIDEHNVLVNPLIYEGYSSIGCAPCTAKPLAGADPRSGRWQGLAKTECGLHAS

SEQ ID NO: 39654 - DNA, 798 bp, Eremothecium gossypii
  CDS (1)..(798)
atgctgcgtaataacaagtatgaactcaacgatggtctagttgtgacagactcacagctagactgctggaacatgactgccgcaaaattgacctctcccgctgaagtcttacattgggctgttacaacgtttccgcatctctatcaaatgaccgcatttggtttaaccgggctggcaacaatcgacatgttgtcaaaactaccagctctagaggagcaaatggttccgttaatatttatcgatacactccatctatttccgcaaacgttgtccttgttgcaccaagttgaggacaggtactataagcccctttcgcagtcaatccatatcttccgccccgcaggtgtcagcaccgaaaaggagttcgctgaaaagtacggcagctgcctgtgggaaactgacgaggacaagtacgacttcatagccaaggtggagcccgctcaccgggcttttcgttcgttgggcgtaggtgccgtgctcaccggacgcaggcgctcgcagggtggaagccgcgaacagctcaacttcgttgaagtcgatgaggtcaacgctgtacttaaaatcaatccctttgttacatggagttttgatcaagtctggtcttatatcttggataaccggattccttataacgagctgttaaactatggctacaagtcaattggtgactatcactccacgctgcccgtggtcgatggcgccggagaaagatccggacgatggaaaggcaaggcaaaaacagaatgtggtttacacacggccagcaaatatgcccggtatcttctggaacagaagtaa

SEQ ID NO: 39655 - protein, 265 aa, Eremothecium gossypii
MLRNNKYELNDGLVVTDSQLDCWNMTAAKLTSPAEVLHWAVTTFPHLYQMTAFGLTGLATIDMLSKLPALEEQMVPLIFIDTLHLFPQTLSLLHQVEDRYYKPLSQSIHIFRPAGVSTEKEFAEKYGSCLWETDEDKYDFIAKVEPAHRAFRSLGVGAVLTGRRRSQGGSREQLNFVEVDEVNAVLKINPFVTWSFDQVWSYILDNRIPYNELLNYGYKSIGDYHSTLPVVDGAGERSGRWKGKAKTECGLHTASKYARYLLEQK

SEQ ID NO: 39656 - DNA, 1287 bp, Methanococcus maripaludis S2
  CDS (1)..(1287)
atgtttaatgaagacacaaaatttgcatcgccttatgaaataaatgttttaaatgaattaactggaaaaaactttcaagaagacgatttaatccttttagaaaagctttctggaatggattaccgaaaaagagtttacgtttcagaagatcagattggaacactcgaatttgatttactggatttaacgtggaaatttatcccttcccctctttattatatgattgaagacccaaaaatctccttaaaatatactaaaaaaaggcttaaaggaaaatacattaaagaagaactgcttgaaaaccctgaagaattaaatgaagcattaaaagataattttgaatatatcggggtaaaaattggggattttttaggagttggggttagaaaagaagatcgggtaaaagtaaaagatctttcaaggaaaaaagagctagattttcaaaaaattgcagattatttagaatataataaagaataccttgacgaaatggttgaaaattcaatagaaatcctccaagatgctgttgaaaaatacaaaagaaaaggatacgcgataaacgcatcttttagtggtggaaaggacagtgcagtatgcactttaatttcaaaagaagttattccggatttagatgttgtatttatcgatacaggcttagaatatcctgaaaccctaaattatgtgaaagattttgtagataaatatgatatcaatcttgatactgtagatggggataatttctgggacaacctcgaaaaagaaggcattccaacaaaagacaatcgatggtgcaacagtgcctgtaaattaatgcctttgaaaagatacttaaaaaagaagtatgggaacaaaaaagttcttacaatcgatggttccagaaaatacgagagtttcacccgtgcaaatttggactacgaaagaagaagcggatttatagatttccaaacgaatgtattcccaattcttgactggaattcgattgatatctggagctacatatattcaaaagatatcccatacaatccgatgtatgataaaggatttgaaagaattggctgttatttatgcccttcagcattaaacagcgaatttttaagggtaaaagaacttcatcctgactactttgaaagatgggttaaatatcttaagaaatacttccctgaaagcgaagtattaaggggtttttggagatgggatgaacttcctccaaaaatggtagaactcgaagaaaatatgggtgtagatattgacaaaaagaaaagattaaaaagaattactcaactgtaa

SEQ ID NO: 39657 - protein, 428 aa, Methanococcus maripaludis S2
MFNEDTKFASPYEINVLNELTGKNFQEDDLILLEKLSGMDYRKRVYVSEDQIGTLEFDLLDLTWKFIPSPLYYMIEDPKISLKYTKKRLKGKYIKEELLENPEELNEALKDNFEYIGVKIGDFLGVGVRKEDRVKVKDLSRKKELDFQKIADYLEYNKEYLDEMVENSIEILQDAVEKYKRKGYAINASFSGGKDSAVCTLISKEVIPDLDVVFIDTGLEYPETLNYVKDFVDKYDINLDTVDGDNFWDNLEKEGIPTKDNRWCNSACKLMPLKRYLKKKYGNKKVLTIDGSRKYESFTRANLDYERRSGFIDFQTNVFPILDWNSIDIWSYIYSKDIPYNPMYDKGFERIGCYLCPSALNSEFLRVKELHPDYFERWVKYLKKYFPESEVLRGFWRWDELPPKMVELEENMGVDIDKKKRLKRITQL

SEQ ID NO: 39658 - DNA, 705 bp, Anopheles gambiae str. PEST
  CDS (1)..(705)
atggaaaatagtctgaaaatacaactgaatgaattgctggaaggtatattggaaaccctttctaatacagaggttttacagttactggtagacaggtttccgaaagaggtaatcttttctaccagttttagttacgaggatcaggttgtaacacatctggtaaaagatcttgatgtggatatttttacactggatacaggaaggctttttgagcagacttacgaaacatggtcagcaacaaaagcttttttcaaaaaagatatcaaagctttttatccggacgcagaagtattggggaaatttgtaactgagaatggacccgactcattttatcgttctgtagaaaacagaaaaacctgttgtaatatccgcaaagtacagcctttgaaaaaggcactgcaggggtataaagtttgggttaccggattgagagcggaacattctgccaacaggcatagtatgtccccattggagtgggacgcagacaatcagattataaaataccatccattgctagactggacaactcaggaagtaaaggactatgtaaaaggaaacagactaccatataattatcttcatgaaaagggttttgtaagcattggatgtgaaccatgtaccagagctattcaggaaggagaagatttcagagccggccgctggtggtgggaagatgctaataaaaaggagtgtggtctgcattag

SEQ ID NO: 39659 - protein, 234 aa, Anopheles gambiae str. PEST
MENSLKIQLNELLEGILETLSNTEVLQLLVDRFPKEVIFSTSFSYEDQVVTHLVKDLDVDIFTLDTGRLFEQTYETWSATKAFFKKDIKAFYPDAEVLGKFVTENGPDSFYRSVENRKTCCNIRKVQPLKKALQGYKVWVTGLRAEHSANRHSMSPLEWDADNQIIKYHPLLDWTTQEVKDYVKGNRLPYNYLHEKGFVSIGCEPCTRAIQEGEDFRAGRWWWEDANKKECGLH

SEQ ID NO: 39660 - DNA, 936 bp, Neurospora crassa
  CDS (1)..(936)
atggcctccgagcaaaactcccagacctccaccagggcctcgtcccccaagcttgacggcaagtttgacgacaacgcctccgtcgactccggcttcgcttccgccaactcctccaccgccaaccttcccttgatttctctcaccaagcctcatctcgaccacctaaacaaacagctcgagaacatggaggccctggacatcctccgcttctgcaagattctcttccccaacctcttccagaccacggccttcggcctgaccggcctcgtcacgctcgacatgctctccaagctggccaaggagtcacccgacgcggcccccgtcgacctgatcttcctcgacacgctctaccacttcaaggaaacttatgctcttgtcgaccgcgtgcaggagcgctaccccaacatccggctgcacgtcttcaagccggccgacgtgtccaacgtcgacgagtttgaggccctctacggcgagaagttgtacgaaacctccgaagaactatacgattggatcgccaaggtggagccgcagaaccgcgcctaccaggaactcaaggtggctgccgtgttcacaggccgccgccgctcccagggaggtgcacgcggctccattcccgtcattgagctggatgaggagcgtggcatcgtcaagatcaacccgctcgtcaactggagcttccagcaggtcaaggcctacattgatgagcaccaagtgccttacaacgagctgctcgataaggggtacaagtccattggtgattggcactcgactagccccgtcgccgcgggcgaggacgagcgtgctgggcgctggaagggcaagaacaagacggagtgcggaatccacaacaagcagagcaggtatgcccagtttctggcggagaacgcgaggaagcaggcaaagggtgctgctccggtcgagacggttcaggcttga

SEQ ID NO: 39661 - protein, 311 aa, Neurospora crassa
MASEQNSQTSTRASSPKLDGKFDDNASVDSGFASANSSTANLPLISLTKPHLDHLNKQLENMEALDILRFCKILFPNLFQTTAFGLTGLVTLDMLSKLAKESPDAAPVDLIFLDTLYHFKETYALVDRVQERYPNIRLHVFKPADVSNVDEFEALYGEKLYETSEELYDWIAKVEPQNRAYQELKVAAVFTGRRRSQGGARGSIPVIELDEERGIVKINPLVNWSFQQVKAYIDEHQVPYNELLDKGYKSIGDWHSTSPVAAGEDERAGRWKGKNKTECGIHNKQSRYAQFLAENARKQAKGAAPVETVQA

SEQ ID NO: 39662 - DNA, 1065 bp, Magnaporthe grisea 70-15
  CDS (1)..(1065)
atgacgcaaccatcatccagggagtcttctccacgtatgaagcccctccacgtcaagttcgaggacgccgcagagatggactcgggctactgctcggccagctcgtcgacggcatctctccctcaggtttccttcacaccctctcacctgcgccatatcaacgaccagctcgagaagatgcaagccatggacatcctccgcttctgccgcgtcctcttcccaaacctataccagacgacggcctttggcctgacggggctcgtgacgcttgacatgctatccaagatggagaaggagtcttccttcctgccttcggtcgaactcatattcctcgacaccctgtaccactttgacgagacgtaccagctcgtcgagagggtcaaggagcggtacagcaacgtcaagatgcacgtgtacaagccggcagactgcgggacggtggccgacttcgagacgaagtacggcgagaagctgtatgagactagcgccgagttctacgactgggtggccaaggtcgagccccagcagcgcgcctactcggacctcaacgtcggtgccgtcctcaccggccgccgcaggtctcagggcggccagcgcaacaagatccccatcgtcgaggtcgacaacgagacaggcatcgtcaagatcaaccccctcgtcaactggtcgttccaggacgtgcaaaagtacatcaaggagaacgacgtcccgtacaacgtcctgctcgacagggggtacaagtcggtcggcgactggcactcgaccagccccgtggctgagggagaggacgagagggccggaaggtggaagggtcagaacaagaccgagtgcggaatccataacaagaagtcgcgttacgcccagtttcttgaggaggccgacaggaaggctgcggaggctgccaaggctgccaaggctgctacggcggcggccatgcaagactcgccggtcggcagcgagattgcagatgatgctcgctggcacgctgcgaggaggccaggtgctcgccggcgccaacatcatcaccaggaccatgtcccttctgccgtcacctcatccgcttga

SEQ ID NO: 39663 - protein, 354 aa, Magnaporthe grisea 70-15
MTQPSSRESSPRMKPLHVKFEDAAEMDSGYCSASSSTASLPQVSFTPSHLRHINDQLEKMQAMDILRFCRVLFPNLYQTTAFGLTGLVTLDMLSKMEKESSFLPSVELIFLDTLYHFDETYQLVERVKERYSNVKMHVYKPADCGTVADFETKYGEKLYETSAEFYDWVAKVEPQQRAYSDLNVGAVLTGRRRSQGGQRNKIPIVEVDNETGIVKINPLVNWSFQDVQKYIKENDVPYNVLLDRGYKSVGDWHSTSPVAEGEDERAGRWKGQNKTECGIHNKKSRYAQFLEEADRKAAEAAKAAKAATAAAMQDSPVGSEIADDARWHAARRPGARRRQHHHQDHVPSAVTSSA

SEQ ID NO: 39664 - DNA, 951 bp, Gibberella zeae PH-1
  CDS (1)..(951)
atgcctaccttcatctctgaatcatcctcgcaggtgtccctccccgacatgaagcttgaatgcgagtcaggctatgtctctggacaaaactcagaatactcttcaccatcatcatcaaccactcttcctcgagtcactctcacaaagccccatattgaccacctcaacaacatgcttgaggacatgcaccccatggacattctccgattctgcaaggtcatgttccctaacctgtaccaatcgactgcttttggcttgaccggtctcgccaccatggacatgctctccaagattcaaaaggagcaccccaacactcccactgtcgacctcatcttcttggataccttgtaccacttcaaggagacacacgacctcgtcgaccgagtcaaggcccggtaccccaacgttcccgttcacatttacaagcctgacggtgtcaacaacgccgaagaattcgaggacatgtacggcaaggagatgtggaacaccgctagcgaaatgtatgactggattgtcaaggttgagccccttcagcgagcgtacgatgagctcaaggttgctgccgtcctcaacggtcgccgacgatctcagggtgctgcccgcggctccatccccatcatcgagattgatgatgagcgtggtgttgtcaagatcaaccccttggccacttggtctttcaagcaggttgatgcatacatcaaggagaacaacgtcccctacaacgctctcctcgatcaaggctacaagtctgtcggcgactggcactccaccgtccccgtcaaggagggcgaagatgagcgagccggccgatggaagggccaggacaagaccgagtgtggtattcacaacaagcaatctcgctactccgagtttgttgccatgatggagcgcaagcaacaagaggaaaagctcgctgctgctcttgagaaagtggctctgcccacagtctaa

SEQ ID NO: 39665 - protein, 316 aa, Gibberella zeae PH-1
MPTFISESSSQVSLPDMKLECESGYVSGQNSEYSSPSSSTTLPRVTLTKPHIDHLNNMLEDMHPMDILRFCKVMFPNLYQSTAFGLTGLATMDMLSKIQKEHPNTPTVDLIFLDTLYHFKETHDLVDRVKARYPNVPVHIYKPDGVNNAEEFEDMYGKEMWNTASEMYDWIVKVEPLQRAYDELKVAAVLNGRRRSQGAARGSIPIIEIDDERGVVKINPLATWSFKQVDAYIKENNVPYNALLDQGYKSVGDWHSTVPVKEGEDERAGRWKGQDKTECGIHNKQSRYSEFVAMMERKQQEEKLAAALEKVALPTV

SEQ ID NO: 39666 - DNA, 918 bp, Ustilago maydis 521
  CDS (1)..(918)
atgactgcccccaaccagatcgcccagtcttcaaaacaggccgaagaggaggctcagatccgccacgtcatccgaaatctcgaagccatcaaccgtaagctcggtgaagctgacccaaccgaaatcatcgaatgggccatcgacaaccttcccagtctctaccagaccaccgctttcggtatcaccggctgcatcaccgtcgacatgatttcgcgcatcagcgagcagcgtgccgccaaggctggccttcccgccaaacacctcgtcccactcatctttgtcgacacgctctatcactttccccagacgctcgacctggcccacaaggcagccaagcactacaacgctcctatgcacatctactacccaccgggcaccaacacggtgcgcgagtttgaggaaaagtggggcccacaattgtgggagaaggacgaggatacgtacgactacttggtcaaggtggaacctgcacgacgatcatacgaagagcttggcgttcgcgccgtattcaccggtcgacgtcgatcgcaaggtgccgatcgcgcctcgttgaaagcggtcgaagtggacgagaccgggttggtcaaggtgaatgcgctgatgaactggtcctttggtcaggttgatgcgtacgccaaagccaatgctgttccgtacaacgagcttctcgatttgggttacaagtcgatcggcgactggcactcgactgcacttcccggtaccggagatgcgggcgagcgtgccggcaggtggaaggacaaggctggcaagaccgagtgcggtttgcacaaggactacttcaagatgaagaacctcgccgagaagaagctgcgtgaagcagagctggcgcgcaaggatgaggcaaaagacaaggatgcttctcaagcgctctcgtctccaccagcagcgaccgcatag

SEQ ID NO: 39667 - protein, 305 aa, Ustilago maydis 521
MTAPNQIAQSSKQAEEEAQIRHVIRNLEAINRKLGEADPTEIIEWAIDNLPSLYQTTAFGITGCITVDMISRISEQRAAKAGLPAKHLVPLIFVDTLYHFPQTLDLAHKAAKHYNAPMHIYYPPGTNTVREFEEKWGPQLWEKDEDTYDYLVKVEPARRSYEELGVRAVFTGRRRSQGADRASLKAVEVDETGLVKVNALMNWSFGQVDAYAKANAVPYNELLDLGYKSIGDWHSTALPGTGDAGERAGRWKDKAGKTECGLHKDYFKMKNLAEKKLREAELARKDEAKDKDASQALSSPPAATA

SEQ ID NO: 39668 - DNA, 909 bp, Aspergillus nidulans FGSC A4
  CDS (1)..(909)
atgcattccaactacccctccgattcggagactgcggaactaagagactctactgagtcgggctatgtcagtggtggctcaagtgaagagtatctaccagagattgtcttcaccaaacctcatcttcagttcctcaaccgacaacttcaattccttgaaccccaagatgtcctcagatggtgtgtcacttcgctacctcacctgtatcagaccaccgcctttggtcttactggtcttgtgatcatggatatgctttccaaactgtccatccctcgccctcaaatggtcaacctcatcttcctcgacactctgcaccacttccccgagacattgaaacttgtcgacaatgtccgcaagaggtacccgctacagcacatccatgtctacaagccccagggtgttgagaccgaagaggagtttgctaagaagcacggtgaacgcctgtgggaaaaggatgaccagctgtacgactggattgccaaggtcgagcctgctcaacgtgcctaccgtgagctcaacgttcacgcagtcctcaccggacgccgccgcagccaaggaggcaagcgtggagacctggacattattgaggtggacgaagccggcctcattaagatcaaccctctcgccaactggacctttgaccaggtcaagcagtatgtcaaggagaatgatatcccctacaacgagttactcgacaagggctacaagagcgttggtgactatcactctacatcccccgtcaaggagaacgaagacgaacgatcaggccgctggaagggccaggcgaaaaccgagtgtggtatccacaaccctcggtcaaagtacgcccagtacttgatggatatggaacgcaagcgacaggaggaagctttgtctcaagcgttgcagaacaagcttaccaccgcttaa

SEQ ID NO: 39669 - protein, 302 aa, Aspergillus nidulans FGSC A4
MHSNYPSDSETAELRDSTESGYVSGGSSEEYLPEIVFTKPHLQFLNRQLQFLEPQDVLRWCVTSLPHLYQTTAFGLTGLVIMDMLSKLSIPRPQMVNLIFLDTLHHFPETLKLVDNVRKRYPLQHIHVYKPQGVETEEEFAKKHGERLWEKDDQLYDWIAKVEPAQRAYRELNVHAVLTGRRRSQGGKRGDLDIIEVDEAGLIKINPLANWTFDQVKQYVKENDIPYNELLDKGYKSVGDYHSTSPVKENEDERSGRWKGQAKTECGIHNPRSKYAQYLMDMERKRQEEALSQALQNKLTTA

SEQ ID NO: 39670 - DNA, 780 bp, Candida glabrata CBS138
  CDS (1)..(780)
atgaaagtatataacttgaataacgggatatcggtcactgaggagcagcttgcgcactggaaccaggcgctgtcgcagctggagccacaagaaatactgaagtggtcactggccacattcccacacttattccagaccactgcgtttgggctcactggtctggctacgatagacatgctttccaagctcggtgccgatgcgctagtgccgttgattaccattgacacattgcacttattcccacagactgtgacactgagggagaacgtcgaagataagtactacaggcctcatggcaagacgatccacgtctacaagcccatcggttgcgacaccgagcagcagtttgcggacaagtacggtgagttcctgtgggagaccgacgacgacaagtacgactacctggttaaagtggaaccggcagccagggcctacaaggacttgcaagtaaccgctgtgttcactggcaggagaaagtcgcaagggtcagccagatcggagctgcagttcgttgagatcgaggaactcacgggaatcataaagatcaacccgttggccaattggacatttgaccaggtcaagcagtacatcgacgacaacgcagtcccatacaatgagctactcgacctaggctacaagtccatcggtgactaccattcaactgtacctgtcaaggaaggtgaagacgagagaagtggcagatggaagggcaaagccaagacggagtgcgggatccacgagacgagcaggttcgccaagttcctgaaacaggatacctga

SEQ ID NO: 39671 - protein, 259 aa, Candida glabrata CBS138
MKVYNLNNGISVTEEQLAHWNQALSQLEPQEILKWSLATFPHLFQTTAFGLTGLATIDMLSKLGADALVPLITIDTLHLFPQTVTLRENVEDKYYRPHGKTIHVYKPIGCDTEQQFADKYGEFLWETDDDKYDYLVKVEPAARAYKDLQVTAVFTGRRKSQGSARSELQFVEIEELTGIIKINPLANWTFDQVKQYIDDNAVPYNELLDLGYKSIGDYHSTVPVKEGEDERSGRWKGKAKTECGIHETSRFAKFLKQDT

SEQ ID NO: 39672 - DNA, 795 bp, Kluyveromyces lactis NRRL Y-1140
  CDS (1)..(795)
atgagtcaacaagtgtttcagctgaataacgcagtaacggtaactcaagaagaaatcgatcattggaatgaaaagttaagtgaattgtcacctgaagaaattatacgttgggctatcgttactttcccacatttatttcaaaccactgcgtttggcttaactgggttggctactatcgatatgctttctaagattaatcaaaatgaaacagaaccaatcgttccattaatatttattgatacattgcaccatttccctcagacgttagagcttttgaaagtggtagaaactcggtattacaagccaagaggacagaatgtcaatgtatatcagccgaaagattgtggttcggagcaagaatttgctgccaaatacggtgatttcttatgggatacagacgatgataaatacgatttcctagtcaaggtggaacctgctcatagagcttataaggaattgcaagtgactgctgtattcactggtagaagaaagagtcaaggtggtgcaaggtcgaatctgaaattcatcgaattggacgaattcaatcatatcatcaagatcaacccgctagcgaactgggacttcaaccaagtgcaaagttatatccgtgataataacgtaccttacaatgaattgctagatctaggataccggtcgattggtgattatcactctacacaacctgttcaagaaggtgaggatgagagatcaggcaggtggaagggtaaggcaaagacggaatgtgggattcacgagacaagcagatttgcacaatatctcaaacaaagagaatga

SEQ ID NO: 39673 - protein, 264 aa, Kluyveromyces lactis NRRL Y-1140
MSQQVFQLNNAVTVTQEEIDHWNEKLSELSPEEIIRWAIVTFPHLFQTTAFGLTGLATIDMLSKINQNETEPIVPLIFIDTLHHFPQTLELLKVVETRYYKPRGQNVNVYQPKDCGSEQEFAAKYGDFLWDTDDDKYDFLVKVEPAHRAYKELQVTAVFTGRRKSQGGARSNLKFIELDEFNHIIKINPLANWDFNQVQSYIRDNNVPYNELLDLGYRSIGDYHSTQPVQEGEDERSGRWKGKAKTECGIHETSRFAQYLKQRE

SEQ ID NO: 39674 - DNA, 783 bp, Debaryomyces hansenii CBS767
  CDS (1)..(783)
atgacaataacagggcctgtaaacttatctgctgagcatttgcaacatttgaacgaaaaacttcaggagttatcaccagaggaaatcatcaagtgggcttatattacttttccaaacttatatcaaaccactgcttttggattaacaggattagttaccatagatatgatctcaaagttaaaaccagaagaagatcatttcatagaccttatttttattgacactttgcatcactttcctcaaacttatgatttggttaacaacgtaagcaaaaagtataattctaagatccacacattcaaaccgttaaacgtcgaaactgaatctgaatttgcacaaagatacggagatcaactatgggaaaccaacgactcgtattatgatttcttaataaaggttgagccttctcaacgagcatataaagatttgcaagtggttgcagtgttgacaggtagaagaaagtcccaaggtggggcccgtggctcattgccggtgattgaaattgaagaatcgagtggtaccatcaagattaacccgttgtgtaactgggacttcaataaggtgaaaagctacatcgacgaaaataacgtgccgtataatgaattattagatttaggctacaaatcgatcggtgactggcactcgactgtccccgttgccgaaggtgaagatgaaagaagtggtagatggaagggtaaagccaagactgaatgtgggattcacgaaactagcaagtttgcccaatatttaaaatcgaatgagaatcctaccatcaattcttag

SEQ ID NO: 39675 - protein, 260 aa, Debaryomyces hansenii CBS767
MTITGPVNLSAEHLQHLNEKLQELSPEEIIKWAYITFPNLYQTTAFGLTGLVTIDMISKLKPEEDHFIDLIFIDTLHHFPQTYDLVNNVSKKYNSKIHTFKPLNVETESEFAQRYGDQLWETNDSYYDFLIKVEPSQRAYKDLQVVAVLTGRRKSQGGARGSLPVIEIEESSGTIKINPLCNWDFNKVKSYIDENNVPYNELLDLGYKSIGDWHSTVPVAEGEDERSGRWKGKAKTECGIHETSKFAQYLKSNENPTINS

SEQ ID NO: 39676 - DNA, 1428 bp, Oryza sativa (japonica cultivar-group)
  CDS (1)..(1428)
atggcttccgctaccgcttccatctcgtcccactccgtcgccctccgcgacctcaaagctgcgaggattggagccgtgaagcagcaggtggccgcggccccggcggcgggcacggcggcggcgagggcccagcgcgcgagggcggtgcgcccgctgcgcgcggcggagccggcgaggcagcccgtctccgcctccgcggcggcggcgccggccgccgcgcccgtggcggaggacgccgccgccgccgccgtcgacgcccctgctccggccgtggactacgaggccctggcccaggagctgcagggcgcgtcgccgctggagatcatggatcgggcactcgccatgttcggatccgacatcgccatcgccttcagcggggcggaggacgtggcgctgatcgagtacgcgaagctgacggggcgtccgttccgcgtgttcagcctggacacggggcggctgaacccggagacgtaccagctgttcgacaaggtggagaagcactacgggatccggatcgagtacatgttcccggacgccggcgaggtgcaggcgctggtgcgcgccaagggcctcttctccttctacgaggacggccaccaggagtgctgccgcgcccgcaaggtgcgcccgctccgccgcgcgctccgcggcctcagggcctggatcaccggccagcgcaaggaccagtccccgggcacccgcgccgccatccccgtcgtccaggtcgacccctccttcgagggcctcgctggcggcgccggcagcctcgtcaagtggaaccccgtcgccaacgtcgacggcaaggacgtgtggaccttcctccgcgccatggatgtccccgtcaacgccctgcacgcccaggggtacgtctcgatcgggtgcgagccgtgcaccaggcccgtgcttcccggccagcacgagcgggaagggcggtggtggtgggaggacgccaaggccaaggagtgcggcctccacaaggggaacatcgacgaccagggtggggcggcggcggcggcggcgcacaaggccggcggcgccaacggcaacgggtcggccggcgcgccggacatcttcgagagcagcggcgtggtgagcctcacccgcgccggcgtcgagaacctgctccgcctggagagccgcgcggagccgtggctggtggtgctgtacgcgccgtggtgccccttctgccaggccatggaggcgtcctacctggagctcgccgagaggctgggcggcgcgggcggcggcgtgaaggtgggcaagttccgcgccgacggcgagcagaaggcgttcgcgcagcaggagctgcagctgcagagcttcccgaccatcctcctcttcccgagccgcaccgcgaggccgatcaagtacccgtcggagaagcgggacgtcgactcgctcctcgccttcgtcaacagcctccgatga

SEQ ID NO: 39677 - protein, 475 aa, Oryza sativa (japonica cultivar-group)
MASATASISSHSVALRDLKAARIGAVKQQVAAAPAAGTAAARAQRARAVRPLRAAEPARQPVSASAAAAPAAAPVAEDAAAAAVDAPAPAVDYEALAQELQGASPLEIMDRALAMFGSDIAIAFSGAEDVALIEYAKLTGRPFRVFSLDTGRLNPETYQLFDKVEKHYGIRIEYMFPDAGEVQALVRAKGLFSFYEDGHQECCRARKVRPLRRALRGLRAWITGQRKDQSPGTRAAIPVVQVDPSFEGLAGGAGSLVKWNPVANVDGKDVWTFLRAMDVPVNALHAQGYVSIGCEPCTRPVLPGQHEREGRWWWEDAKAKECGLHKGNIDDQGGAAAAAAHKAGGANGNGSAGAPDIFESSGVVSLTRAGVENLLRLESRAEPWLVVLYAPWCPFCQAMEASYLELAERLGGAGGGVKVGKFRADGEQKAFAQQELQLQSFPTILLFPSRTARPIKYPSEKRDVDSLLAFVNSLR

SEQ ID NO: 39678 - DNA, 768 bp, Yarrowia lipolytica CLIB99
  CDS (1)..(768)
atgtctatctctgtgtcgacgtcgcaactggaccactacaacgcgctgctgagtcagctggagccgcaacagatcattcaatgggcggtgctcaccttccccaacttgttccagaccacggcgtttggactcacgggattagtcagcactgacatgatcagcaagctggagcagtcacgtggcggccacgctgtcgatcttatttttctcgacaccctgtaccatttcgacgaaacgctgcagctggtcgaccgggtccaggccaagtacccatcggcgaaaatccacagattccgacccgagggcttcgagtcgcgtgcggagtttgaaaaggtgtatggcgattcccttttcgacacaaacgacgatctctatgattatctggtcaaggtagagccttctcagcgggcctacaaggagctggatgttgttgctgttctgaccgggcgtcgcaagtcccagggagacgcacgtgactctctaaagattgtggagattgaagccgagaccaatctcatcaaaatcaaccctcttgccaactggtcgtttgcccaggtcaagaattatatcgattccaacgacgtgccttacaactccttgttggataaggggtaccgatctgtgggcgattttcactcaactgtgccggtcaaggagggcgaaaatgagcgagccggacgatggaagggtaaacagaagactgagtgtggcattcatcagcagaaacgatttgctcagttctcgggggtcaatgttcgggctatttaa

SEQ ID NO: 39679 - protein, 255 aa, Yarrowia lipolytica CLIB99
MSISVSTSQLDHYNALLSQLEPQQIIQWAVLTFPNLFQTTAFGLTGLVSTDMISKLEQSRGGHAVDLIFLDTLYHFDETLQLVDRVQAKYPSAKIHRFRPEGFESRAEFEKVYGDSLFDTNDDLYDYLVKVEPSQRAYKELDVVAVLTGRRKSQGDARDSLKIVEIEAETNLIKINPLANWSFAQVKNYIDSNDVPYNSLLDKGYRSVGDFHSTVPVKEGENERAGRWKGKQKTECGIHQQKRFAQFSGVNVRAI

SEQ ID NO: 39680 - DNA, 705 bp, Bacillus thuringiensis serovar konkukian str. 97-27
  CDS (1)..(705)
atgttgacgtatgaaacgtgggaagaaaatgatatttcattttcagaagaagatgaaacgaaaggcgcgctatcagtattaagttgggcgtataaagaatatgaaaatgagattgtatacgcatgtagcttcggagtggaagggatggtactactgcatcttattaaccaagtaaatccatctgctaaagttgtatttttggatacaaatgttcattttcaagaaacgtatgaattaattcaaaaagtacgagaacgatttccttcattaaatattatagaaaaacagccaaaacttacacttgatgaacaagccaaattgcatggtaacaagctatgggaaagcaatcctaatctttgttgtaagattaggaaaattttaccgttagaagaatcattagcgaatgaaaaagcgtggatatcggggttgaggagggaacaatcagaaacgcgtaagcatacaaagtttataaatcaagatcatcgctttcaatctattaaagtttgtccgctcattcattggacgtggaaagaggtatggcgatatgtatacaagcatagcttgccgtataacccattacatgatattggatatccaagtattgggtgtgagaagtgtacgttgcctgtaggagagggtggcgattcaagagatggtagatgggctgggaaagtgaaaactgaatgtggtcttcattatcaataa

SEQ ID NO: 39681 - protein, 234 aa, Bacillus thuringiensis serovar konkukian str. 97-27
MLTYETWEENDISFSEEDETKGALSVLSWAYKEYENEIVYACSFGVEGMVLLHLINQVNPSAKVVFLDTNVHFQETYELIQKVRERFPSLNIIEKQPKLTLDEQAKLHGNKLWESNPNLCCKIRKILPLEESLANEKAWISGLRREQSETRKHTKFINQDHRFQSIKVCPLIHWTWKEVWRYVYKHSLPYNPLHDIGYPSIGCEKCTLPVGEGGDSRDGRWAGKVKTECGLHYQ

SEQ ID NO: 39682 - DNA, 750 bp, Acinetobacter sp. ADP1
  CDS (1)..(750)
ttgccaggagcatttatgaccgccattcctaccattgatttggttgatgcacttaatacagagtatgcagacaagtatccgaccgagattcttgagcttgctctgaatcaagaaggtgaaattgccatttcattttctggtgcagaagatgtagtactcattgatatggcctcacgtttacgtaagccgtttcgtgtttttagtctggatacaggacgtttacatccagagacttatcaattcattgaaactgtccgcaaacattataatatcgagatcgaaatctgttttcccgaagctgaaacagttcaaaacttcgtaaaagaaaaaggattgtttagcttctttgaagatggtcattccgaatgttgtggtattcgaaaagtacagccacttcgtaaaaaactggcaacattagatggctggatcacaggtcaacgtaaagatcaaagccctggtactcgtaatgaaattccagttgttcaggcagatgcaggtttttcaggcccaggaaaacagttaatcaagtataatccgcttgccaactggtcaagtgcagatgtatggaattatattcgtatgatggaaattccgtataatccattgcacgagcgtggttttgtttcgattggctgtgaaccatgtactcgccctgttttgcccaaccagcatgaacgtgaaggtcgttggtggtgggaagaagcgactaaaaaagaatgtggcctacatgcaggcaacttaaataaataa

SEQ ID NO: 39683 - protein, 249 aa, Acinetobacter sp. ADP1
MPGAFMTAIPTIDLVDALNTEYADKYPTEILELALNQEGEIAISFSGAEDVVLIDMASRLRKPFRVFSLDTGRLHPETYQFIETVRKHYNIEIEICFPEAETVQNFVKEKGLFSFFEDGHSECCGIRKVQPLRKKLATLDGWITGQRKDQSPGTRNEIPVVQADAGFSGPGKQLIKYNPLANWSSADVWNYIRMMEIPYNPLHERGFVSIGCEPCTRPVLPNQHEREGRWWWEEATKKECGLHAGNLNK

SEQ ID NO: 39684 - DNA, 735 bp, Erwinia carotovora subsp. atroseptica SCRI1043
  CDS (1)..(735)
atggccgaatttaaccttgaggcgctcaacgcgttaccgaaagatgaacaggtggccgcgttggcggctgtgaatggccagcttgaacagctgtccgcgcaggagagggtgagctgggcgctggagaatttgccgggcgatttcgttttgtcgtccagtttcggcattcaggctgcgatatcgctgcatctggtgacgcaacagcggccggatattccggtcatccttacggataccggctatctgtttcctgaaacctaccagtttattgatgcactgacggaacagctgaagctgaatctgcacgtgtatcgcgccgcagagtctccagcatggcaagagtctcgttatggcaagctgtgggatcagggcgtggaaggtattgagcgctacaacctgctgaataaagttgagccgatgaatcgggcgttgagtgagctaaacgctgggacgtggtttgctggcctgcgccgtgaacagtccggcagccggggggagttgcccgtgctggcgattcagcgcggcgtctttaaattcctgccgattatcgattgggataaccggacggtgtatcagtatctgaaagaaaacggcctgagttaccatccgctgtgggatcagggctatttgtccgtcggcgatacgcacaccactcgcaaatgggagccgggcatgagcgaagaagaaacccgcttcttcggcttaaagcgcgagtgcgggttgcacgaagggtaa

SEQ ID NO: 39685 - protein, 244 aa, Erwinia carotovora subsp. atroseptica SCRI1043
MAEFNLEALNALPKDEQVAALAAVNGQLEQLSAQERVSWALENLPGDFVLSSSFGIQAAISLHLVTQQRPDIPVILTDTGYLFPETYQFIDALTEQLKLNLHVYRAAESPAWQESRYGKLWDQGVEGIERYNLLNKVEPMNRALSELNAGTWFAGLRREQSGSRGELPVLAIQRGVFKFLPIIDWDNRTVYQYLKENGLSYHPLWDQGYLSVGDTHTTRKWEPGMSEEETRFFGLKRECGLHEG

SEQ ID NO: 39686 - DNA, 735 bp, Yersinia pseudotuberculosis IP 32953
  CDS (1)..(735)
gtgagtcaatttaatctgagcgaactgaatgcgttgccgaaagccaagcaagcggcagcgctggtgctggtgaatggtcaactcgagcatttgaccgcgcaggagcgtgtcagttgggcattggataatttgcctggcgaatttgtcctttcctccagttttgggattcaggctgcggtttgtttgcatctggtgacccgtcagcgtcctgatattccggtgatcttgaccgataccggttacctgttcccagaaacatatcgttttattgatgatttgaccgagaagcttcaacttaatttacaggtgtttcgtgccgcacacagccctgcctggcaggaagcccgttatggcaagttatgggagcagggggtggagggtattgagcgttataacaccctcaataaagttgaaccaatgaatcgggcgttggaggctttaggtgcgcaaacctggtttgcgggtttgcgccgtgagcaatctggcggccgctcacaattgccggtattggcgcttcagcgtggcatatttaagctgttgcctattattgattgggataatcgccaagtttatcaatacctcacacaacatggcctgagttatcacccactgtgggagcaaggttacttatctgtcggcgatacccatacaacccgcaaatgggaaccgggcatgagtgaggaagaaacccgtttctttggtctgaaacgcgagtgtggtttgcacgaaggttaa

SEQ ID NO: 39687 - protein, 244 aa, Yersinia pseudotuberculosis IP 32953
MSQFNLSELNALPKAKQAAALVLVNGQLEHLTAQERVSWALDNLPGEFVLSSSFGIQAAVCLHLVTRQRPDIPVILTDTGYLFPETYRFIDDLTEKLQLNLQVFRAAHSPAWQEARYGKLWEQGVEGIERYNTLNKVEPMNRALEALGAQTWFAGLRREQSGGRSQLPVLALQRGIFKLLPIIDWDNRQVYQYLTQHGLSYHPLWEQGYLSVGDTHTTRKWEPGMSEEETRFFGLKRECGLHEG

SEQ ID NO: 39688 - DNA, 702 bp, Symbiobacterium thermophilum IAM 14863
  CDS (1)..(702)
atggctgaaaagagatggagcccggaggagatcgccgccgcggcccggtccctggaggggcaggggcctgtcgcggcgctccgctgggcctacgaacagtttgcaccggaggagatcgccttcgcgtgctccttcggggccgaggacgtggccctggcccacatgatcagccgggtggcgcccggcgcccaggtcttctacctggacaccgactttctgttccccgagacctaccggaccatcgaggcggtccgggccgcctatcccctgcggatccggcgggtgtcccccgcgctcacgccccgggagcaggcggagcggtacggcgacgaactgtggagccgcgaccccgatctctgctgcagcctgcggaaggtggagcctctccgggaggtgctccgggggctgaaggcgtggatcaccggcatccgccgggcgcagtcgcccacccgggccggggcgcaggtggtggagtgggacaggaagttcggcctggtgaaggtcaaccccctggtggactggaaggacgcggacgtctggaagtacatcctcgagcacaacgtgccgtacaacccgctgcacgaccggggctacccctccatcggctgcacgcattgcacccgtccggtcaggccgggggaggatccccgggccggccgctggtccggcttcgccaagaccgagtgcgggctgcaccagtga

SEQ ID NO: 39689 - protein, 233 aa, Symbiobacterium thermophilum IAM 14863
MAEKRWSPEEIAAAARSLEGQGPVAALRWAYEQFAPEEIAFACSFGAEDVALAHMISRVAPGAQVFYLDTDFLFPETYRTIEAVRAAYPLRIRRVSPALTPREQAERYGDELWSRDPDLCCSLRKVEPLREVLRGLKAWITGIRRAQSPTRAGAQVVEWDRKFGLVKVNPLVDWKDADVWKYILEHNVPYNPLHDRGYPSIGCTHCTRPVRPGEDPRAGRWSGFAKTECGLHQ

SEQ ID NO: 39690 - DNA, 531 bp, Bacillus licheniformis ATCC 14580
  CDS (1)..(531)
gtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaa

SEQ ID NO: 39691 - protein, 176 aa, Bacillus licheniformis ATCC 14580
MKKDAVIVFLDTGLHFKETYETIDAVKERYPGLQIIMKKPELTVEEQAKEYGDELWKTAPNSCCEMRKVIPLRETLSGYPAWLSGLRREQSPGRSKTNFLNKDEKFKSIKVCPLIHWTWKDIWRYVTKHDLPYNPLHDQGYPSIGCAPCTSPAFTMDDLRSGRWNGSAKTECGLHE

SEQ ID NO: 39692 - DNA, 705 bp, Bacillus cereus ZK
  CDS (1)..(705)
atgttgacgtatgaaacgtgggaagaaaataatgtttcattttcagaagaagatgaaacgaaaggcgcgctatctgttttaagttgggcttataaagaatatgaaggtgaaattgtatatgcatgtagcttcggagtggaagggatggtactactgcatcttataaaccaagtaaatccatctgctaaagttgtatttttagatacaaatgttcattttcaagaaacgtatgaattaattcaaaaagtacgagaacgatttccttcattaaatattatagaaaaacagccaaaacttacacttgatgaacaagccaaattgcatggtaacaagctatgggaaagcaatcctaatctttgttgtaagattagaaaaattttaccgttagaagaatcattagcgaatgaaaaagcgtggatatcggggttgaggagggaacaatcagaaacccgtaagcatacaaagtttataaatcaagatcatcgctttcaatctattaaagtttgtccgctcattcattggacgtggaaagaggtatggcgatatgtatacaagcatagcttgccgtataacccattacatgatattggatatccaagtattgggtgtgagaagtgtacgttgcctgtaggagagggtggcgattcaagagatggtagatgggctgggaaagtgaaaactgaatgtggtcttcattatcaataa

SEQ ID NO: 39693 - protein, 234 aa, Bacillus cereus ZK
MLTYETWEENNVSFSEEDETKGALSVLSWAYKEYEGEIVYACSFGVEGMVLLHLINQVNPSAKVVFLDTNVHFQETYELIQKVRERFPSLNIIEKQPKLTLDEQAKLHGNKLWESNPNLCCKIRKILPLEESLANEKAWISGLRREQSETRKHTKFINQDHRFQSIKVCPLIHWTWKEVWRYVYKHSLPYNPLHDIGYPSIGCEKCTLPVGEGGDSRDGRWAGKVKTECGLHYQ

SEQ ID NO: 39694 - DNA, 732 bp, Mannheimia succiniciproducens MBEL55E
  CDS (1)..(732)
atgattattaaaccgaatttttggcagattcctcagccgacagcaacggatttcgccgcgctggctgaaaaagaacagcttctggcacagcgtattcatgaaattgccaatcggcatcaacatgccaaatttgccagcagtttagccgtggaagacatggtgattaccgatgttatcgctaaaagcaaggcaaagattacggtattcaccttggaaaccggacgtttaaatcctgaaacgctggctttggcggatacggtgaaaaagacgtatcccgatttggattttcgattattccgtcctaatcctatcgccgcggaaaaatatgatcgcgaaaaaggcagatttgccttttatgaaagcgtggaattacgccgcgaatgttgttttatccgtaaaatcgagccgttaaaccgggcgttagccgatgcggatgcctggctgacagggcagcgcagagagcagtcggtcacccgtaccgaacttgaatttcatgaatgggatcaaagccgtggcattgacaaatataacccgatttttgactggcatgaaatggatgtgtgggcctatatcctgaaatatgacattccttataacgaactgtacaaacagggctatccgagtatcggttgtgagccttgcactaaacaagtgaaagccggcgaagacatccgtgccggtcgctggtggtgggaaaacaaagacagcaaggaatgcggtttgcataaataa

SEQ ID NO: 39695 - protein, 243 aa, Mannheimia succiniciproducens MBEL55E
MIIKPNFWQIPQPTATDFAALAEKEQLLAQRIHEIANRHQHAKFASSLAVEDMVITDVIAKSKAKITVFTLETGRLNPETLALADTVKKTYPDLDFRLFRPNPIAAEKYDREKGRFAFYESVELRRECCFIRKIEPLNRALADADAWLTGQRREQSVTRTELEFHEWDQSRGIDKYNPIFDWHEMDVWAYILKYDIPYNELYKQGYPSIGCEPCTKQVKAGEDIRAGRWWWENKDSKECGLHK

SEQ ID NO: 39696 - DNA, 543 bp, Bacillus licheniformis ATCC 14580
  CDS (1)..(543)
ttgatttataaggtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaa

SEQ ID NO: 39697 - protein, 180 aa, Bacillus licheniformis ATCC 14580
MIYKVKKDAVIVFLDTGLHFKETYETIDAVKERYPGLQIIMKKPELTVEEQAKEYGDELWKTAPNSCCEMRKVIPLRETLSGYPAWLSGLRREQSPGRSKTNFLNKDEKFKSIKVCPLIHWTWKDIWRYVTKHDLPYNPLHDQGYPSIGCAPCTSPAFTMDDLRSGRWNGSAKTECGLHE

SEQ ID NO: 39698 - DNA, 711 bp, Bacillus licheniformis ATCC 14580
  CDS (1)..(711)
atgaacgatgttttaacgtatagcacatgggatgaaaaagcttctgaagaggtgatggatactttcagcggcgagatggacgttttgaaatgggcgtacagcacgtatcaaaaaatcgtttacgcctgcagcttcggcgcggaaggaatcgttttgatcgacttgatttcaaaggttgtgaaagaagcggacatcgtgtttttagatacaggactgcattttccggaaacatatgagctgatcaatgaagtgaaagatcgctatcccggtctgtcgatccactttttaaaacccggcctctcacttgaagagcaggaaaaacgctatggcagcgaactttggaagcgccagccggaccagtgctgccgccttcgcaaaatcgagccgctcagggagcatctgtcaggcatggaagcctggattaccgggctgaggcgggagcagtcggaaacacggaaacatgtccgatatatcaacaaggacgacaattttaaactgattaaaatctgcccccttattcactggacatgggaggatgtctggacttacattaagctgaatcagctgacgtatcacaagcttcatgatcaagattatccgagcatcggctgtgaggtgtgtacgcttcccgtgacagacagcggcaatttaagagcgggaaggtgggcccaccaggaaaaaacagaatgcgggctgcatcaattccggtag

SEQ ID NO: 39699 - protein, 236 aa, Bacillus licheniformis ATCC 14580
MNDVLTYSTWDEKASEEVMDTFSGEMDVLKWAYSTYQKIVYACSFGAEGIVLIDLISKVVKEADIVFLDTGLHFPETYELINEVKDRYPGLSIHFLKPGLSLEEQEKRYGSELWKRQPDQCCRLRKIEPLREHLSGMEAWITGLRREQSETRKHVRYINKDDNFKLIKICPLIHWTWEDVWTYIKLNQLTYHKLHDQDYPSIGCEVCTLPVTDSGNLRAGRWAHQEKTECGLHQFR

SEQ ID NO: 39700 - DNA, 750 bp, Burkholderia mallei ATCC 23344
  CDS (1)..(750)
atgagcgccgcccacgccccggccctcacgccggcgctcgccgagaagagcgcgcggctcgacgcgctgctcgcgcaaatcgccgcgcgtcatccgaaggtcaagttcgcgagcagcctggcggccgaggacatgctgctcgcccatgcgatcctgtcgaagggcgtcgcgatcggaatcttttcgctgaacacgggccgcctgcacgcggagacgctcgacatgatcgagcgtgtgcgcgagcgctacggctacgagatcgagcagtttcatccgcggcaggacgcggtcgacgcgtatgtcgccgagcatggcctgaacgcgttctacgagagcgtcgagctacgcaagcgctgctgcgagatccgcaaggtcgagccgctgaaccgcgcgctcgcgggcgtcgacgcgtgggtgacgggccagcggcgcgagcagtcggtcacgcgcgcggagctccacgaacaggagcacgacgccgcgcgcgggatcgcgaagtacaacccgctcgcggactggaccgaaagcgacgtgtgggcctatctgaacgcgttcgacgtgcccgtcaatccgttgcacgcacgcggctatccgagcatcggctgtgagccgtgcacgcgggcgatccgtcccggcgaggacagccgtgcgggccgctggtggtgggagtcgcgcgacacgaaggagtgcgggctgcacatcacgatcacgccggtgccggcggacggggccgaatcggcttgcgcctga

SEQ ID NO: 39701 - protein, 249 aa, Burkholderia mallei ATCC 23344
MSAAHAPALTPALAEKSARLDALLAQIAARHPKVKFASSLAAEDMLLAHAILSKGVAIGIFSLNTGRLHAETLDMIERVRERYGYEIEQFHPRQDAVDAYVAEHGLNAFYESVELRKRCCEIRKVEPLNRALAGVDAWVTGQRREQSVTRAELHEQEHDAARGIAKYNPLADWTESDVWAYLNAFDVPVNPLHARGYPSIGCEPCTRAIRPGEDSRAGRWWWESRDTKECGLHITITPVPADGAESACA

SEQ ID NO: 39702 - DNA, 723 bp, Methylococcus capsulatus str. Bath
  CDS (1)..(723)
atgacacagaccgagatcgacacgctccaggccgaactggccggccgctccccccgcaccattctggaaacggcattgagccgcttccagcggatcgcggtatcgttcagcggggcggaagacgtcgttttggtggaaatggccgcgcggttgcgaccgggcatcgaggtcttcaccctggacacgggacgcctgcatccggagacctaccgcttcatcgaagaagtgcgcgagcgctttgccgtccgcctcgacgtgctgtcaccggacgccgcggaactggaagcaatggtgcgggaaaaaggactgttcagcttctaccgcgacggtcatcaggaatgctgcggaatccgcaaggtccggcccttgcgccggaagctggcgacgctcgatgcatggatcaccggtcagcgccgggaccagaacccgacccggcaggcggtccctgaagtggaagccgatccagcttttgcgactggacatcaccccctcgtgaaattcaatccgctggcagcctggacttccgcccaggtatgggattacatcacggcctgcgaaatcccgttcaacgccctgcatctcaaagggtatgtcagcatcggctgcgaaccctgcacccgcccggtccgcccgggccaacacgaacgcgagggccgctggtggtgggaggatgcactcaagaaggaatgcggcctgcacatcggcgacgcttccagggtttga

SEQ ID NO: 39703 - protein, 240 aa, Methylococcus capsulatus str. Bath
MTQTEIDTLQAELAGRSPRTILETALSRFQRIAVSFSGAEDVVLVEMAARLRPGIEVFTLDTGRLHPETYRFIEEVRERFAVRLDVLSPDAAELEAMVREKGLFSFYRDGHQECCGIRKVRPLRRKLATLDAWITGQRRDQNPTRQAVPEVEADPAFATGHHPLVKFNPLAAWTSAQVWDYITACEIPFNALHLKGYVSIGCEPCTRPVRPGQHEREGRWWWEDALKKECGLHIGDASRV

SEQ ID NO: 39704 - DNA, 720 bp, Nocardia farcinica IFM 10152
  CDS (1)..(720)
gtgacaacccaactcgcggagaagctggccgaggacgagctgcgggccatcgccgagcgcggggcggccgagctcggccccgacgcttcggcgcaggacctgctgcgctggaccgacgagaccttcggcaccggctacatcgtcgcctcgaacatgcaggacggcgtgctggtgcatctggccgcccaggtccgggccggggtggacgtgctctttctggacaccggctaccacttcgccgagacgatcggcacccgcgacgccgtggaggcggtgtacggggtgaacgtggtgaacgtgcgcccggagcagtcggtggacgagcaggaccggctgctcggcaaggatctgttcgcccgcgaccccaacgagtgctgccggttgcgcaaggtggtgccgttgcagcgcgcgctggccggctacaacgcctgggtcaccggcatccgccgggtggaggcgccgacccgcgcgaacgcgccgctgatctccttcgacgaagccttcggcctggtgaagatcaacccgatcgcaccgtggtcggacgaggatatggacaactacatcgccgcgcacggcatcctcgtcaatcccctggtggaggagggttatccgtccatcggctgcgcaccgtgcacacggaagccggagccgggatccgatccgcgaagcggccgttgggccggcctcgccaagaccgaatgcgggttgcaccagtcatga

SEQ ID NO: 39705 - protein, 239 aa, Nocardia farcinica IFM 10152
MTTQLAEKLAEDELRAIAERGAAELGPDASAQDLLRWTDETFGTGYIVASNMQDGVLVHLAAQVRAGVDVLFLDTGYHFAETIGTRDAVEAVYGVNVVNVRPEQSVDEQDRLLGKDLFARDPNECCRLRKVVPLQRALAGYNAWVTGIRRVEAPTRANAPLISFDEAFGLVKINPIAPWSDEDMDNYIAAHGILVNPLVEEGYPSIGCAPCTRKPEPGSDPRSGRWAGLAKTECGLHQS

SEQ ID NO: 39706 - DNA, 762 bp, Photobacterium profundum SS9
  CDS (1)..(762)
atgcctaactatgcattagcagatttactggaaaaaacgaagatagaacagattctgcaattggctgagattaatgctgaacttgaagcgctttctgcacaggaaagagtacgttgggcactggcgaatcttggtagtgaatttgctcttgcgtctagttttggtattcaatctgctgtgatgttgcacttggtcacgaatgaatcccctaaagtgccagttattttaacggacacggggtatttgtttcctgaaacctatcaattcattgatcagctgactctccgcctatcgttaaacctttatgtataccgtgctgaaataagctcggcatggcaagaagcacgacacggtaagctgtgggaacaaggggttgacggtattaaacaatataaccgcttgaataaagtcgaacctatgcggcgcgcgttagatgaattgaatgtaagcgcatggttttcagggctacgtcgcgaacaatcgagttctcgtgcatcattgccagtgttggctattcaaaacggcgtatttaaattcctgcctcttattgattggactgataatgatatcgagcaatacttgaatcaatatgatcttccttatcatcctcttcgtgatgaaggctacctttctatgggtgatacgcatacgactaaaaagtgggagcctggaatgacggaggaagaaacccgtttctttggtttaaagcgagagtgtggtttacatgaagaagatgcagaatcggatggctctggtatttaa

SEQ ID NO: 39707 - protein, 253 aa, Photobacterium profundum SS9
MPNYALADLLEKTKIEQILQLAEINAELEALSAQERVRWALANLGSEFALASSFGIQSAVMLHLVTNESPKVPVILTDTGYLFPETYQFIDQLTLRLSLNLYVYRAEISSAWQEARHGKLWEQGVDGIKQYNRLNKVEPMRRALDELNVSAWFSGLRREQSSSRASLPVLAIQNGVFKFLPLIDWTDNDIEQYLNQYDLPYHPLRDEGYLSMGDTHTTKKWEPGMTEEETRFFGLKRECGLHEEDAESDGSGI

SEQ ID NO: 39708 - DNA, 708 bp, Geobacillus kaustophilus HTA426
  CDS (1)..(708)
atgctcacgtatgatcagtgggaaaaggcggaaaaaccgtcttttccgtccgataatgaaacaaaaggggcgcttgacgtccttgcttgggcgtatcgcgaatacggcgatgagatcgtatacgcgtgcagcttcggcatcgaggggattgtgctgattgatctcatctcccaagtcaaaccggacgctgaaatcgtctttttggataccggcctgcattttccagagacgtacgatacgatcgcgaaagtgaaagaaaaatatccgtcgcttcgcatcgtgatgaagcagccgcgcttgacgttggaagaacagaaggcgcagtttggcgacgagttatggaaacgcgacccgaacaaatgctgtgagctgcgcaaagtcattccgctgcgcgaggtgctgaccggggtgacggcgtggatttccggcttgcgccgcgagcaatcgccgacgcggcggcatgtcgagtacattaacaaagacgacaagttccgttctattaaagtctgtccgctcattcactggacgtggaaagacgtatggaattacgtgtacaaacgccatctcccgtacaatgtgctccacgaccgcggctacccgagcatcggttgcgccccgtgcaccgctccggctacagatccgaacgacttgcgctccgggcgctgggccggccaaggaaagacggaatgcggtctccatctcgcttaa

SEQ ID NO: 39709 - protein, 235 aa, Geobacillus kaustophilus HTA426
MLTYDQWEKAEKPSFPSDNETKGALDVLAWAYREYGDEIVYACSFGIEGIVLIDLISQVKPDAEIVFLDTGLHFPETYDTIAKVKEKYPSLRIVMKQPRLTLEEQKAQFGDELWKRDPNKCCELRKVIPLREVLTGVTAWISGLRREQSPTRRHVEYINKDDKFRSIKVCPLIHWTWKDVWNYVYKRHLPYNVLHDRGYPSIGCAPCTAPATDPNDLRSGRWAGQGKTECGLHLA

SEQ ID NO: 39710 - DNA, 699 bp, Azoarcus sp. EbN1
  CDS (1)..(699)
ttgcgcgcgagtgtcgcgacgaaatccgccgccgcgctggagttccttcgtgccgcagccgccgagttcggttcggccggcgagctgacgttcgcgaacagcttcggcgctgaagacatggtgctgaccgacctgatcctgcgcgaagcgctgccgatcgagatcttctcgctcgacaccggccgcctgccggccgaaacctacacgctgatcggcgaagtcgaacagcgttacggcgcgaagctgaagatcttcttccccgacgcaacagcagtcgaaacccacgtccgcacccacggcatcaacgcgttctacgactcggtcgagctgcgcaaggcgtgctgcggcgtgcgcaagatggagccgctgcgccgtgcgctggccgggaaaaaagcgtggatcaccggtctgcgcgccgcccagtcggtcactcgtaccggcctgccgcagcgtgaattcgatgccggcaacgggctcgagaagctcaacccgctgtcggactggtccgaggccgaagtgtgggcctacatccgcatccatgaagtgccgtacaacgcgctgcatgaccagttctacccgagcatcggctgtgcgccctgcacgcgcgcgatcgcgctcggcgaggacgtccgcgccggacgctggtggtgggaggatccggcgtcgaaggaatgcggactgcatgtcaggaagggctga

SEQ ID NO: 39711 - protein, 232 aa, Azoarcus sp. EbN1
MRASVATKSAAALEFLRAAAAEFGSAGELTFANSFGAEDMVLTDLILREALPIEIFSLDTGRLPAETYTLIGEVEQRYGAKLKIFFPDATAVETHVRTHGINAFYDSVELRKACCGVRKMEPLRRALAGKKAWITGLRAAQSVTRTGLPQREFDAGNGLEKLNPLSDWSEAEVWAYIRIHEVPYNALHDQFYPSIGCAPCTRAIALGEDVRAGRWWWEDPASKECGLHVRKG

SEQ ID NO: 39712 - DNA, 909 bp, Zymomonas mobilis subsp. mobilis ZM4
  CDS (1)..(909)
atgcaggaagaacggctcacccatttacggcagttagaagcggaaagcatctatatcatccgcgaagtcgccgccgaattcggcaatccggttatgctgtattccatcggcaaagactcttctgtcatgctccatctggcgcgaaaagcctttttcccggggacattgcctttcccgctcttgcatgttgataccggctggaaattccgcgaaatgtatgaattccgcgaccggacagccaaagaatacgatttcaacttgctcgtctataaaaatcccgaaggggaggccttaggcatcaatcccttcattcatggcagcgccaaacataccgacatcatgaaaaccgaaggcctcaaacaagccttggacaaatacggctttgatgcagcctttggcggtgccagacgggatgaagaaaaatccagagccaaggaaagaatctactctttccgcgataaattccaccgctgggaccccaaaaaccaacgccccgaattatggcacaattataatggccagattaacaagggtgaatccatccgcgtctttccgctctctaattggacggaactcgacatctggcagtatatttatctcgaaaatatcgacattgtgccgctttatctcgcagccaaacgcccagttatcgaacgtgacggcatgttaatgatggtcgatgatgaccgcattgatctcaaagaaggcgagaaagtcgaagaacggatggtgcgtttccgaacattaggatgctggccattaacgggagccgtggaatcccaagcccaaacgcttcccgaaatcatcgaagaaatgctggtttcaaccaccagtgaacgccaaggccgtgttatcgaccgcgaccagtcagggtcaatggaactgaaaaaacgtcagggttatttctag

SEQ ID NO: 39713 - protein, 302 aa, Zymomonas mobilis subsp. mobilis ZM4
MQEERLTHLRQLEAESIYIIREVAAEFGNPVMLYSIGKDSSVMLHLARKAFFPGTLPFPLLHVDTGWKFREMYEFRDRTAKEYDFNLLVYKNPEGEALGINPFIHGSAKHTDIMKTEGLKQALDKYGFDAAFGGARRDEEKSRAKERIYSFRDKFHRWDPKNQRPELWHNYNGQINKGESIRVFPLSNWTELDIWQYIYLENIDIVPLYLAAKRPVIERDGMLMMVDDDRIDLKEGEKVEERMVRFRTLGCWPLTGAVESQAQTLPEIIEEMLVSTTSERQGRVIDRDQSGSMELKKRQGYF

SEQ ID NO: 39714 - DNA, 735 bp, Zymomonas mobilis subsp. mobilis ZM4
  CDS (1)..(735)
atgtctgcgtttcatctcgaaactttaaaatccttgcccaaagccgaacaagaggcggctttgtccgaagccaatcggcaattggaagagatgagcgcagaagatcgtctcaaatgggcttttgacaatctttcgggtcaatttgtgctgtcatccagcttcggcattcaggcagctgtgatgctgcatctggtgacccgaaagaaagccgatattccagttatccttactgataccggctatctttttcctgaaacctatcgctttattgatgctctgacagaaaagctcgatttgaatcttcaagtctttcgggcggctttgtctccggcatggcaagaagctcgctatggtaaattatgggaacagggtgtcgaaggtatcgaacggtataacgacatcaacaaagtcgaacccatgaaccgcgctttaaaaaccttggaggctggaacatggtttgccggattacggcgcgatcagtcgaaaagccggtcacatctaccgattttggcaatccagcgcggggttttcaaattcctgccgatcatcgactgggataaccgcaaaatccactattatctgaaagagcacgacctcccttatcacccgctttgggatgaaggctatctctctgtcggcgacactcacacaacccgcaaatgggaagaggggatgagcgaggaagaaacccgctttttcggtttaaaaagggaatgtgggctacatgaaggataa

SEQ ID NO: 39715 - protein, 244 aa, Zymomonas mobilis subsp. mobilis ZM4
MSAFHLETLKSLPKAEQEAALSEANRQLEEMSAEDRLKWAFDNLSGQFVLSSSFGIQAAVMLHLVTRKKADIPVILTDTGYLFPETYRFIDALTEKLDLNLQVFRAALSPAWQEARYGKLWEQGVEGIERYNDINKVEPMNRALKTLEAGTWFAGLRRDQSKSRSHLPILAIQRGVFKFLPIIDWDNRKIHYYLKEHDLPYHPLWDEGYLSVGDTHTTRKWEEGMSEEETRFFGLKRECGLHEG

SEQ ID NO: 39716 - DNA, 762 bp, Silicibacter pomeroyi DSS-3
  CDS (1)..(762)
atgccgcttgacgagatccagacggaactgggccgcgaccggagcgttttgacgcagaaggtcgcggcgctcaacgcccgctacaagcatcacagcgccaccgatgtcatgcacggggcgctacgcgaggcgggcgatatcgcactggtgtcaagctttggcgcggaatcggtggtgttgttgcacatggcggcggtgatcgaccgccaggtgccggtgttgttcatcgacacccagatgctgtttgccgaaacgctggtctatcagcaggaggtgagcgagcgtctgggcctgaagaacgtgcaggtgatccgcgccgccgaggatgacgttgcccgcgacgacccctatggcgccctgcgcctgcgcgataccgatgcctgctgcaccctgcgcaagacgatcccactgcaacgagcgctgtcgggctatgacggctggatcaccgggcgcaagcggtttcaggccggcacccgcgccgcgctcgacttcttcgaggtcgaggacggcaccggccggatcaaggtcaacccgctggcccattgggcccccgaggacgtgcgcgcctatatggaggaaaaccgcctgccccggcatccgctggtggcacagggatacccctcgatcggctgcgcaccctgcacgtcgccggtggcgcccggagaggacccgcgcgccggacgctggcgcaaccagaacaaggaagaatgcggcatccatttcgtcgatggcaagatggtgcgcaacggagacaagacatga

SEQ ID NO: 39717 - protein, 253 aa, Silicibacter pomeroyi DSS-3
MPLDEIQTELGRDRSVLTQKVAALNARYKHHSATDVMHGALREAGDIALVSSFGAESVVLLHMAAVIDRQVPVLFIDTQMLFAETLVYQQEVSERLGLKNVQVIRAAEDDVARDDPYGALRLRDTDACCTLRKTIPLQRALSGYDGWITGRKRFQAGTRAALDFFEVEDGTGRIKVNPLAHWAPEDVRAYMEENRLPRHPLVAQGYPSIGCAPCTSPVAPGEDPRAGRWRNQNKEECGIHFVDGKMVRNGDKT

SEQ ID NO: 39718 - DNA, 699 bp, Synechococcus elongatus PCC 6301
  CDS (1)..(699)
atgcctgctttgctgcccagcctgaccgaaatcaatgcccagcttgctgatcaagcagcaacgcagatcattcagtgggcagcaactgaatttggatcggggctggtgctcagcacgagttttggcattcagtcggcggtgatgctgcacttggcgactcaggtgcagccggatattccggtgatctggatcgacacgggttatctgcctacggaaacctatcggtttgcggcagagctgacggaacggctcaagctgaatctgaaggtctatcaatcggagatcagcccggcgcggatggaagcgctctatggccggctctgggaaagcgagtcggtggaagacttcaaccgctatgaccaaatgcgcaaggtggagccgatgaatcgtgccctgcaagaactgggtgcaacggcttggttgtcgggcgtacgacggcagcaaacggcgcatcgccagtcaatggaaattgtcgaactcaaacgcgatcgctatgcgattcggccgattcttggttggcactcccgcgacgtttatcagtacctgactgctcacgatctgccctaccatccgctctttgatcagggctacgtcaccgttggtgactggcattccagccgccccctgcaagcagatgacagtgatgagcgcagcacccggttccggggcttgaagcaagagtgtggcctgcacttgtaa

SEQ ID NO: 39719 - protein, 232 aa, Synechococcus elongatus PCC 6301
MPALLPSLTEINAQLADQAATQIIQWAATEFGSGLVLSTSFGIQSAVMLHLATQVQPDIPVIWIDTGYLPTETYRFAAELTERLKLNLKVYQSEISPARMEALYGRLWESESVEDFNRYDQMRKVEPMNRALQELGATAWLSGVRRQQTAHRQSMEIVELKRDRYAIRPILGWHSRDVYQYLTAHDLPYHPLFDQGYVTVGDWHSSRPLQADDSDERSTRFRGLKQECGLHL

SEQ ID NO: 39720 - DNA, 726 bp, Bacillus clausii KSM-K16
  CDS (1)..(726)
atggcttacgtttttgagcaaatggaggctaccgactatgaaaaggtaaataccaagttgaaaaatcgggatagcctggatattttgcgctgggcgaatcaaacgtatggtgaaaagctcgtgtatgcttgcagttttggagccgaggccatggtgctgcttgacttgttgtcaaaaatacaaaaagaagcccacattttgtttttagatacagattttcattttgccgaaacgtacgaattgatcgaacgtgtaaaggaacgatacccgacatttcgtattaacatggctaaacctgctttgtctccagaggaacaagcggaacgttacggcgatgaactatggcttaaaaatccagaccagtgctgtcaaattcgaaaattggatgtgctggcccgtgagcttgagccttacgatgcttggctttcaggcttaaggcgtgagcagtctccaacacgagcaaataccgagtttgttaatcaggataagcgctttaaaaaggtgaaggtttgtccgttgattcattggacggaagaagaaatatggatgtacatcaaattgcatcaattgccctacaatgagttgcacgaccagcactatccgagcattggctgtacgtactgcacgaaagcggtcatgcctggggaagatgctcgaagcggccgctgggcgggaacaggaaaaacggaatgcgggttgcatgcaccaacgaaaggagattcatga

SEQ ID NO: 39721 - protein, 241 aa, Bacillus clausii KSM-K16
MAYVFEQMEATDYEKVNTKLKNRDSLDILRWANQTYGEKLVYACSFGAEAMVLLDLLSKIQKEAHILFLDTDFHFAETYELIERVKERYPTFRINMAKPALSPEEQAERYGDELWLKNPDQCCQIRKLDVLARELEPYDAWLSGLRREQSPTRANTEFVNQDKRFKKVKVCPLIHWTEEEIWMYIKLHQLPYNELHDQHYPSIGCTYCTKAVMPGEDARSGRWAGTGKTECGLHAPTKGDS

SEQ ID NO: 39722 - DNA, 714 bp, Xylella fastidiosa Dixon
  CDS (1)..(714)
atgaccgtacttcccgccttacctcctctggacgatctggaaacgctcaacgtccacctagaaacgctgagtgctgaaaatcgcgtgtgctgggcactgcagcacgcccctgaccaccctgcactgtcttccagcttcggcgcgcaatcggccgtcatgctgcatctactcacccggtttgcaccggatatcccggtcattctggtcgacaccggctatcttttcccagaaacctaccgtttcgccgacacgctgaccgaacgactcaaactcaatctgaaggtataccagccgctgcgtagcggcacttggacggaagcccgtcatggtcgactatgggaacaagggatcgacggaattaatcaatacaacaccctgcacaaggtcgaaccgatgcgccgggcattagaggaattgcaagtcggcacctggtttaccggcctacgtcgcggacaatccagtacccgtacccaaacatcaatcgtgcaacgacgtgacgagcggtacaaaatcagtccaattgtcgactggaccgaccgtgatatctgggaatacatgaaacaccatgatctgccctatcacccgctttgggaacagggctacgtttcaatcggtgacattcacacgacacgccccttggaaccagacatgcgcgaagaagacacacgcttcttcggattcaaacgtgagtgcgggattcacgagaacatctaa

SEQ ID NO: 39723 - protein, 237 aa, Xylella fastidiosa Dixon
MTVLPALPPLDDLETLNVHLETLSAENRVCWALQHAPDHPALSSSFGAQSAVMLHLLTRFAPDIPVILVDTGYLFPETYRFADTLTERLKLNLKVYQPLRSGTWTEARHGRLWEQGIDGINQYNTLHKVEPMRRALEELQVGTWFTGLRRGQSSTRTQTSIVQRRDERYKISPIVDWTDRDIWEYMKHHDLPYHPLWEQGYVSIGDIHTTRPLEPDMREEDTRFFGFKRECGIHENI

SEQ ID NO: 39724 - DNA, 714 bp, Xylella fastidiosa Ann-1
  CDS (1)..(714)
atgaccgtacttcccgccttacctcctctggacgatctagaaatgctcaacgtccacctagaaacgctgagtgctgaaaatcgcgtgcgctgggcactggagcacggtcctgaccaccctgcactgtcttccagcttcggcgcgcaatcggccgtcatgctgcatctactcacccggtttgcaccggatatcccggtcattctggtcgacaccggctatcttttcccagaaacctaccgtttcgccgacacgctgaccgaacgactcaagctcaatctgaaggtataccaaccgctgcgtagcggcgcttggacggaagcccgtcatggtcgactatgggaacaagggatcgacggaattaatcaatacaacaccttgcacaaggtcgaaccgatgcgccgggcattagaggaattgcaagtcggcacctggtttacaggcctacgtcgcggacaatccagtacccgtacccaaacatcaatcgtgcaacgacgtgacgagcggtacaaaatcagtccaattgtcgactggaccgaccgtgatatctgggaatacatgaaacaccatgatctgccctatcacccgctttgggaacagggctacgtttcaatcggtgacattcacacgacacgccccttggaaccagacatgcgcgaggaagacacacgcttcttcggattcaaacgtgagtgcgggattcacgagaacatctaa

SEQ ID NO: 39725 - protein, 237 aa, Xylella fastidiosa Ann-1
MTVLPALPPLDDLEMLNVHLETLSAENRVRWALEHGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQRRDERYKISPIVDWTDRDIWEYMKHHDLPYHPLWEQGYVSIGDIHTTRPLEPDMREEDTRFFGFKRECGIHENI

SEQ ID NO: 39726 - DNA, 699 bp, Magnetospirillum magnetotacticum MS-1
  CDS (1)..(699)
atgtccctggacgtcgagcatctgatccgccaatacggccatctggaaggaagggaactccttgccgccctggtggccggtgatctggccgggcgtatcgccgtgacctcttccttcggggcggaatcggcggtgctgctcgatctggtggcccaggtcgatcccggtctgccggtgatctttctcgacaccaacgaattgtttgatgaaaccatcgcctatcgcagccaattggaagcaatcctgggcttgaccaatgtgctggcggtccatccctccgaggcggagttgaaggaagccgacgagttgtggcgtgaagatcatgaccgatgttgcgaattgcgcaaggtccgccccctggcccgtgccgtgaagggattcgacgccctggtggacgggcgcaagcgggcccatggcgccgagcgggaaaaccttgccaccctgtccgatggcggcggcgtgttgaaggtcagcccgttggccaagtggagcgccgaggagatcgaggcctatttcgtcaagcgtagcctgccgcgccaccctttggtggcgcaaaactaccgctccatcggctgctggccctgcacccgcccggtggatccgggccagcccctccgggccgggcgctgggcaggcaagggcaagagcgagtgcggcattcataccatgtccctgggcctcgatggcgccgggatctga

SEQ ID NO: 39727 - protein, 232 aa, Magnetospirillum magnetotacticum MS-1
MSLDVEHLIRQYGHLEGRELLAALVAGDLAGRIAVTSSFGAESAVLLDLVAQVDPGLPVIFLDTNELFDETIAYRSQLEAILGLTNVLAVHPSEAELKEADELWREDHDRCCELRKVRPLARAVKGFDALVDGRKRAHGAERENLATLSDGGGVLKVSPLAKWSAEEIEAYFVKRSLPRHPLVAQNYRSIGCWPCTRPVDPGQPLRAGRWAGKGKSECGIHTMSLGLDGAGI

SEQ ID NO: 39728 - DNA, 735 bp, Azotobacter vinelandii
  CDS (1)..(735)
atgaagcaagccgtgaacaccgccgagctggccgccgcctgcatcggcaaatcgccccaggacatcctgcagatcgccttcgatcacttcggcgacgatctgtggatctccttcagtggcgccgaagacgtagtactgctcgacatggcctggaagctcaacaagaacgtcaaggtcttcagcctggataccggccgcctgcaccccgaaacctaccgtttcatcgagcaggtgcgcgagcactatggcctggccatcgaagtgctctcgcccgatgcccgcctgctcgaaccactggtcagggaaaaagggctgttcagcttctataaggatggccacggcgaatgctgcggcatccgcaagatcgaaccgctcaagcgcaaactggccaccgtgagcgcctgggccaccggccagcgtcgcgaccagagccccgggactcgcagccaggtcgccgagttcgaggtggacggcgccttctccactccggacaggccgctgtacaagttcaatccgctggcacagatgagcagcgaggagatctggggctatatccgcatgctggaaatcccctacaactcgctgcacgaacgaggctatatcagcatcggctgcgaaccctgcacccggccggtactgcccaaccagcacgagcgcgagggtcgctggtggtgggaggaggccacccacaaggagtgcggtctgcatgccggcaacctgatcggcaagagctga

SEQ ID NO: 39729 - protein, 244 aa, Azotobacter vinelandii
MKQAVNTAELAAACIGKSPQDILQIAFDHFGDDLWISFSGAEDVVLLDMAWKLNKNVKVFSLDTGRLHPETYRFIEQVREHYGLAIEVLSPDARLLEPLVREKGLFSFYKDGHGECCGIRKIEPLKRKLATVSAWATGQRRDQSPGTRSQVAEFEVDGAFSTPDRPLYKFNPLAQMSSEEIWGYIRMLEIPYNSLHERGYISIGCEPCTRPVLPNQHEREGRWWWEEATHKECGLHAGNLIGKS

SEQ ID NO: 39730 - DNA, 918 bp, Azotobacter vinelandii
  CDS (1)..(918)
atggccgacaaactgacgcatctgaagcagctggaggcggaaagcatccacatcatccgtgaggtggccgctgagttcgacaacccggtgatgctgtactccatcggcaaggactctgccgtgatgttgcatctggcgcgcaaggcattcttcccgggcaagctgccgttcccggtgatgcatgtcgatactcagtggaagtttcaggagatgtacagatttcgcgacaagatggtcgcggagatgggcttggagctgatcacccacgtcaatcccgacggggtggcgcagggcatcaaccccttcacccacggtagtgccaagcacaccgacatcatgaagaccgagggcctcaagcaggcgctggacaagtacggcttcgatgccgccttcggcggtgcccggcgcgacgaggagaaatcccgcgccaaggagcgcgtgtattcgttccgcgacagcaagcatcgctgggatccgaagaaccagcgccccgaactgtggaacgtctacaacggcaaggtgaagaagggcgaatcgattcgcgtgtttccgttgtccaactggaccgagctggatatctggcagtatatctacctggagcagatccctatagtgccgttgtacttcgccgccgagcgcgaagtcatcgagaagaacggcaccctgatcatgatcgacgatgatcgtattctcgaacatctctccgccgaggagaaagcgcgcatccagaagaagatggtgcgtttccgcaccctcggttgctacccgttgaccggtgccgtggagtctaccgccgctaccctgccggacatcatccaggaaatgctcctgacccgcacgtccgaacgccaagggcgagtcatcgatcacgatggcgccggctcgatggaagaaaagaaacgtcagggttacttctaa

SEQ ID NO: 39731 - protein, 305 aa, Azotobacter vinelandii
MADKLTHLKQLEAESIHIIREVAAEFDNPVMLYSIGKDSAVMLHLARKAFFPGKLPFPVMHVDTQWKFQEMYRFRDKMVAEMGLELITHVNPDGVAQGINPFTHGSAKHTDIMKTEGLKQALDKYGFDAAFGGARRDEEKSRAKERVYSFRDSKHRWDPKNQRPELWNVYNGKVKKGESIRVFPLSNWTELDIWQYIYLEQIPIVPLYFAAEREVIEKNGTLIMIDDDRILEHLSAEEKARIQKKMVRFRTLGCYPLTGAVESTAATLPDIIQEMLLTRTSERQGRVIDHDGAGSMEEKKRQGYF

SEQ ID NO: 39732 - DNA, 726 bp, Nostoc punctiforme PCC 73102
  CDS (1)..(726)
atgacagtctccacggcatctagaaatcaagcgatcgcttttgacttagaaaaattaaatgagcaatttgaaactgccactcctaaagagatactggcatggtctatagagaatatcccaacgggattggtgcaaaccagcgcctttaacgtggatgacatgataattacccatattctttacagtgaactgaagcatcccgttcctgtgatctttctcgacactttacatcacttccctgagagcctagaattagtagccaaagccaaagaaatctacaatctggacttgcaaactttcaaaactccagacgtagaaacccgtgaagcctttgaagccaaatacggcgacaaactttgggatacggatattgccaaattccaccacattacaaaaattgaaccactgttacggggtctagacgaactcaacagcgtggcttggattaccggtcgccgccgtgaccaagcagtaacccgtgcgaatatgcccatatttgaatttgatggtaaaggtcggttgaaagtaaatcccattgctacctggacacgtcaagatacctgggtttacgtagctgaacacggagtcatctacaacccactccatgacaaaggctatcccagcataggcgaccaacccatcaccaccaaagtaggcgaaggtgaagacgaacgcgccggacgttggcggggaagtgataaaacagaatgcggaattcatatttag

SEQ ID NO: 39733 - protein, 241 aa, Nostoc punctiforme PCC 73102
MTVSTASRNQAIAFDLEKLNEQFETATPKEILAWSIENIPTGLVQTSAFNVDDMIITHILYSELKHPVPVIFLDTLHHFPESLELVAKAKEIYNLDLQTFKTPDVETREAFEAKYGDKLWDTDIAKFHHITKIEPLLRGLDELNSVAWITGRRRDQAVTRANMPIFEFDGKGRLKVNPIATWTRQDTWVYVAEHGVIYNPLHDKGYPSIGDQPITTKVGEGEDERAGRWRGSDKTECGIHI

SEQ ID NO: 39734 - DNA, 735 bp, Pseudomonas syringae pv. syringae B728a
  CDS (1)..(735)
atgagccaacctttcgacgtcgctgaactggcgacgacctatgcgaccaaatctgcacaagacattctgaaactggccttcgagcacttcggcgacgacctgtggatctctttcagcggtgccgaggacgtggttctggtcgacatggcctggaagctgaacaagaacgtcaaggtcttcagcctggatacagggcgcctgcatgcgcaaacctatcgcttcatcgagcaggtccgcgagcactacaagatcgagatcgagatcgtttcgcccgatcacagcaagcttgaacctttcgtcaaggaaaagggcctgttcagcttttaccgggacggccatggcgaatgctgcggcatccgcaagatcgagccgctgcgtcgcaaactgtctggcgtcagcgcctgggcaaccggccagcgccgtgatcagagccccggcacccgcagcgccgttgctgcagtggaaatcgacagcgctttttcgacagccgagcgcacgctgtacaaattcaacccgttggcacaaatgagcagcgaggaaatctggggctacatccgcatgctggagctgccctacaacagcctgcacgagcgcggcttcatcagcatcggctgcgaaccctgcacccgcccggtattgccgaaccagcacgagcgcgaaggtcgctggtggtgggaagaagccacgcagaaggaatgcgggctgcatgcgggcaatctgatagtgcgcgactaa

SEQ ID NO: 39735 - protein, 244 aa, Pseudomonas syringae pv. syringae B728a
MSQPFDVAELATTYATKSAQDILKLAFEHFGDDLWISFSGAEDVVLVDMAWKLNKNVKVFSLDTGRLHAQTYRFIEQVREHYKIEIEIVSPDHSKLEPFVKEKGLFSFYRDGHGECCGIRKIEPLRRKLSGVSAWATGQRRDQSPGTRSAVAAVEIDSAFSTAERTLYKFNPLAQMSSEEIWGYIRMLELPYNSLHERGFISIGCEPCTRPVLPNQHEREGRWWWEEATQKECGLHAGNLIVRD

SEQ ID NO: 39736 - DNA, 639 bp, Psychrobacter sp. 273-4
  CDS (1)..(639)
atgagccaattacacccacatttagatatcgatcaagccaaccaagacttgcaaggtaaatcgccagaacagatcgtagaatgggcactgagccaagcgaaaaacccaatcatcactactaactttcgcccttacgaatcagcgattttgcatttggttgccaaacaacgccctgatatcaccgtattgtgggtagattctggctataacactgacgccacttaccagtttgccaataaagtcatccgtgatttaaatttaaacgttatcacctatattcctaagcaaaccgctgcccatcgtgacgtgacgatggaaggtatccctggtattgataatccactacatgatgagttcaccgatcaagtaaaacttgagccattccgccgcgctttagatgagctaaagcctgacgtttggttcaatgctattcgtaaagatcaaaccgaatttcgccaaggtcttgatgtgctgagcctatctaaagatggcgtattaaaagtagcgcctttgtttgaaaagagcgatgctgatttagatgtttacttagatgagcatggtttaccgaatgagttcgattattttgatccgactaaagtagaagagcatcgcgaatgtggtctacatacgcagttgtag

SEQ ID NO: 39737 - protein, 212 aa, Psychrobacter sp. 273-4
MSQLHPHLDIDQANQDLQGKSPEQIVEWALSQAKNPIITTNFRPYESAILHLVAKQRPDITVLWVDSGYNTDATYQFANKVIRDLNLNVITYIPKQTAAHRDVTMEGIPGIDNPLHDEFTDQVKLEPFRRALDELKPDVWFNAIRKDQTEFRQGLDVLSLSKDGVLKVAPLFEKSDADLDVYLDEHGLPNEFDYFDPTKVEEHRECGLHTQL

SEQ ID NO: 39738 - DNA, 720 bp, Dechloromonas aromatica RCB
  CDS (1)..(720)
atgacccccagcctgctcaacatcacgccagaactgaccgccagcgttgccgtcaagaccaaaacggtcaaagcactgctcgccgacatcgcgaccaactggtcgagcgccgccttcgccaacagcctgggcgccgaggacatggtactgactgacctgatcgtcaaggccaagctgccgatcgaaatcttcagcctcgacaccggccgcctgccgctcgaaacctacgacctgatcgccgcggtcgacaagcattacggcctgaaactgaagctctatttcccgcaggccgaagaagtcgaaagctacgtccgcaaccacggcatcaacgccttctacgaatcggtcacgctgcgcaaggcctgctgttacgcccgcaaggtcgagccgctgaaacgcgccctggctggcaagcgagcctggatcaccggcatgcgcgccgagcaggcggcgactcgcgggaacctcgccatccgcgagtacgatgaaggcaatggtctggaaaaattcaatccgctgtcggactggaccgagaaggaagtctggacctacatcaagcagaacgccgtgccctacaacgccctgcacgacaagttctaccccagcatcggctgcgccccctgcacccgcgccatttcgcccggcgaagacatccgggctggccgctggtggtgggagaatcctgagtccaaggagtgcggactgcacgtcaagggctga

SEQ ID NO: 39739 - protein, 239 aa, Dechloromonas aromatica RCB
MTPSLLNITPELTASVAVKTKTVKALLADIATNWSSAAFANSLGAEDMVLTDLIVKAKLPIEIFSLDTGRLPLETYDLIAAVDKHYGLKLKLYFPQAEEVESYVRNHGINAFYESVTLRKACCYARKVEPLKRALAGKRAWITGMRAEQAATRGNLAIREYDEGNGLEKFNPLSDWTEKEVWTYIKQNAVPYNALHDKFYPSIGCAPCTRAISPGEDIRAGRWWWENPESKECGLHVKG

SEQ ID NO: 39740 - DNA, 726 bp, Anabaena variabilis ATCC 29413
  CDS (1)..(726)
atgacagcttctacggcatttaaaacccaaacaaacgaatttaatttagatgaattaaatcaacagtttgaaactgccactcctaaagaaattctggcatggtctatagagcatatccccacagggttggtacaaactagcgcctttaatgtggatgacttagtaattacccatatcctttatagtgaactcaagcaaccagtacctgtaatctttctcgatactctgttccactttcaacaaactctagaactcgttgcaaaagcgaaagaaatatacaacctagatttacaaacctacaaaactccagatgtagacacccgcgaagcctttactgctaaatatggcgaggcgctttgggataaagatattacacaatttcaccaagttaccaaaattgaacctctacaacggggtttagatgaactcaacacagttgcgtggattactggtcgtcgccgtgatcaagcagttacccgcgctaatatgcctgtatttgaattagatggcaaaggtcgtttgaaagtaaatcccctagctacttggacacgtcaagatagttgggcttacgtagccgaacatggtgtgatttacaacccactccacgaccaaggttatcccagcattggcgatgaacccatcaccaccaaagtgggcgaaggcgaagacgaacgcgccggacgctggagaggaagcaataaaactgaatgtgggattcacatttag

SEQ ID NO: 39741 - protein, 241 aa, Anabaena variabilis ATCC 29413
MTASTAFKTQTNEFNLDELNQQFETATPKEILAWSIEHIPTGLVQTSAFNVDDLVITHILYSELKQPVPVIFLDTLFHFQQTLELVAKAKEIYNLDLQTYKTPDVDTREAFTAKYGEALWDKDITQFHQVTKIEPLQRGLDELNTVAWITGRRRDQAVTRANMPVFELDGKGRLKVNPLATWTRQDSWAYVAEHGVIYNPLHDQGYPSIGDEPITTKVGEGEDERAGRWRGSNKTECGIHI

SEQ ID NO: 39742 - DNA, 621 bp, Methylobacillus flagellatus KT
  CDS (1)..(621)
atgcaactggacttggcaaacatcaacgcagaatggggacacgacgcacaaaagctagtggaatgggcgctcggcctgaacaagaaagccatcgtcacgaccaacttccgccctttcgaagctgtcatcctgcacatggtcacccaagtccagcccgatacgcccgtcatctggatggacagcggctacaacaccgaagcaacctaccgctttgccgacgaagtcacgcgccagctcaacctcaacctgagcatctacctccccaagcgctcccgcgcgcatagggaggccgtggacggacctgtcccggcacttgatgacccgcgccacgccgcatttacagaagaagtcaaactggaaccctttgcacgtgccctgcgtgaaaccgcgcctgaaatctggttcaccgccctgcgcgccaccgataccgccgtacgcgcccagatggacccggtcagcattaacccggacggcttgatcaaggtagcgcccttgctgcattggagttcaaaagacttgtaccagtacctgaccgcccacaacttgccaaacaatttcgactacttcgatccaactaagggcgaggaaaaccgcgagtgcggcttgcatttgtcacactaa

SEQ ID NO: 39743 - protein, 206 aa, Methylobacillus flagellatus KT
MQLDLANINAEWGHDAQKLVEWALGLNKKAIVTTNFRPFEAVILHMVTQVQPDTPVIWMDSGYNTEATYRFADEVTRQLNLNLSIYLPKRSRAHREAVDGPVPALDDPRHAAFTEEVKLEPFARALRETAPEIWFTALRATDTAVRAQMDPVSINPDGLIKVAPLLHWSSKDLYQYLTAHNLPNNFDYFDPTKGEENRECGLHLSH

SEQ ID NO: 39744 - DNA, 831 bp, Crocosphaera watsonii WH 8501
  CDS (1)..(831)
atgccccaatctaatctacatctcatcaactctcatgtagataaccatcaggtttccgaacatcactacaacaagcaaactcatcaagcttataaacctgaattatccttaaaagaagttaaccaaagcctagaaaatgccaacgctcaacaggttgtagaatggactagggagacctttggggaaggattagtcatgagtaccagttttggtattcaagctgctgtgatgctgcatctagtgaccgaagtagtgccagatattcccgttatctgggtggatacaggctatcttcctgctgaaacctatcgctttgccgaagaattaaccgaacggctcaaactcaatctcaaggtttatcagtctcctttcacccctgcgagaatggaagcactgtatggtaaactctggaatcaacacgatctaaattctcttaatcgttacgattttctccgaaaagtagaacccatgcaacgagctttgaaagaacttcaagccactgcttggttggcggggttacgtcgtcaacaaacggaacatagacagtccttagaaaaagttgaattacaaggggaaaagtacaaagtttatcctattttaacctgggattctcgcgatatttatcattatttaactgctcatgatttgccttatcatccttattttgataaaggctatgttacggtaggagactggcattctagtcgtccgttgatggctgatgatgaaagtgaaagagatagtcgttttcatggtgttaaacaagagtgtggcctccatttaaacttgtctcctggagcagcagaaagtttagattctagcaccctttaa

SEQ ID NO: 39745 - protein, 276 aa, Crocosphaera watsonii WH 8501
MPQSNLHLINSHVDNHQVSEHHYNKQTHQAYKPELSLKEVNQSLENANAQQVVEWTRETFGEGLVMSTSFGIQAAVMLHLVTEVVPDIPVIWVDTGYLPAETYRFAEELTERLKLNLKVYQSPFTPARMEALYGKLWNQHDLNSLNRYDFLRKVEPMQRALKELQATAWLAGLRRQQTEHRQSLEKVELQGEKYKVYPILTWDSRDIYHYLTAHDLPYHPYFDKGYVTVGDWHSSRPLMADDESERDSRFHGVKQECGLHLNLSPGAAESLDSSTL

SEQ ID NO: 39746 - DNA, 738 bp, Mesorhizobium sp. BNC1
  CDS (1)..(738)
atggcagcgaagccaaagccgcttgacgccgaaatcgaggcgctggaactcgatgcgcgttacggccatttggcggccgaggcgatcgtcgagcttgccgtgaaccggttccgcgacgagggcggtattgccaccgtctcctctttcggtgccgattcggccgtgcttcttcacatggtcgccagcgtcgacaagagcttgcccgtgctcttcctcgataccggccagcattttggtgagacgatcgaatatcgcgaccagttggcgtcggatcttggcctgtcaaacctggtggtcgttcacccgaagtccgagatgctgagcgcgcgcgatccgggtaatgatcttcacaagagcgactccgatctgtgctgcgagattcgcaaggtggagcccatggcgcgcgcggtggagccgtattccgcctggttcaccggccgcaagcgccaccaggcggagtcgcgggcgcaaatgccggtattcgaggcggttggtccgcgcattcgcatcaacccgctcgcccgctggaccacggccgaccaggccgcctatatgcgcgcgaacgacctgcgcgagaatccgctggtggcctatggctatctctcgatcggctgctttccctgcacgcagcccgtgaagcccggcgaggatcaacgcagcgggcgctgggcaggcttggctaaaaccgaatgcggcatccatctgccgggtcttgaagctctcaccaacgcggcgtga

SEQ ID NO: 39747 - protein, 245 aa, Mesorhizobium sp. BNC1
MAAKPKPLDAEIEALELDARYGHLAAEAIVELAVNRFRDEGGIATVSSFGADSAVLLHMVASVDKSLPVLFLDTGQHFGETIEYRDQLASDLGLSNLVVVHPKSEMLSARDPGNDLHKSDSDLCCEIRKVEPMARAVEPYSAWFTGRKRHQAESRAQMPVFEAVGPRIRINPLARWTTADQAAYMRANDLRENPLVAYGYLSIGCFPCTQPVKPGEDQRSGRWAGLAKTECGIHLPGLEALTNAA

SEQ ID NO: 39748 - DNA, 756 bp, Rhodobacter sphaeroides 2.4.1
  CDS (1)..(756)
atgctgcgtgaggttccccaggccccggtcgccgagcgcgtggcggcgctcaacggtcgctacaagcaccacggcgcgacggccgtgctcgaacatgcgctgaaggatgcggatctgggccgggtggcgcttgtctcctccttcggggccgagtcggtcgtgcttttgcatctcgtctcggtcatcgcgcccgagacgccggtgatcttcatcgacacgcggatgctgtttcaggagacgctcgactatcagcgcgagctggccgacacgctgcacctctgcgacatccgcacgatccgggcgacccagccgcggatcgccttcgaggatccggacgggacgctgaaccgctacaacaccgacgcctgctgcgcggtgcgcaaggtcgagccgctcgaacgggcgctcaagcatttcgatggctggatcaccggccgcaagcgctaccagagcggcacgcgggcggcggtcgagttcttcgaggccgaggacgaccggcgcatcaaggtcaatccgctcgcccactgggggcgcgaggatctggaagactatatcgtcaacaacaacctgccgcgtcatccgctggtcgccaggggctatccctcgatcggctgcgagccctgcacctcgccggtggccgagggagaggatccccgcgcgggccgctggcgcggcagcgccaagaccgaatgcggcatccatttcatcaacggccgcgcggtgcgcggacccgtgaacaaggaggacgcggcatga

SEQ ID NO: 39749 - protein, 251 aa, Rhodobacter sphaeroides 2.4.1
MLREVPQAPVAERVAALNGRYKHHGATAVLEHALKDADLGRVALVSSFGAESVVLLHLVSVIAPETPVIFIDTRMLFQETLDYQRELADTLHLCDIRTIRATQPRIAFEDPDGTLNRYNTDACCAVRKVEPLERALKHFDGWITGRKRYQSGTRAAVEFFEAEDDRRIKVNPLAHWGREDLEDYIVNNNLPRHPLVARGYPSIGCEPCTSPVAEGEDPRAGRWRGSAKTECGIHFINGRAVRGPVNKEDAA

SEQ ID NO: 39750 - DNA, 747 bp, Burkholderia cepacia R1808
  CDS (1)..(747)
atgagcgccgcgaccgcactcacgcccgaactggccgccaaggtcgagcggctcgacgcgctgctcgcgcagatcggcgcgcgccacgacaaggtcaagttcgcgagcagcctcgccgcggaagacatgctgctgacgcacgcgatcctgtcgaagcaggtgccgatcggcatcttttctctgaacaccggccgcctgcacgcggagacgctcggcatgatcgaccgcgtgcgcgagcgctacggctacgagatcgagcagttccatccgaaccaggaggcggtcgatcagtacgtcgccgagcacggcgcgaacgcgttctacgacagcgtcgagctgcgcaagtcgtgctgccacatccgcaaggtggagccgctgaaccgcgcgctggccgacgtcggcgcgtgggtcacgggccagcgtcgcgagcagtcggtcacgcgcgcggagctgcacgaggaagaaagggacgaatcgcgcgggatcgcgaagtacaacccgctcgccgactggacggaagccgacgtgtgggcgtaccttaacgcgttcgaagtgccggtcaatccgctgcacgcgcgcggttacccgagcatcggctgcgagccgtgtacgcgtgcgattcgccccggcgaggacagccgcgcgggccgttggtggtgggagtcgcgcgacaccaaggaatgcggtctgcacatcacgacgatcacgccgattcccgcgagcgccgaagccggcgccgcgcactga

SEQ ID NO: 39751 - protein, 248 aa, Burkholderia cepacia R1808
MSAATALTPELAAKVERLDALLAQIGARHDKVKFASSLAAEDMLLTHAILSKQVPIGIFSLNTGRLHAETLGMIDRVRERYGYEIEQFHPNQEAVDQYVAEHGANAFYDSVELRKSCCHIRKVEPLNRALADVGAWVTGQRREQSVTRAELHEEERDESRGIAKYNPLADWTEADVWAYLNAFEVPVNPLHARGYPSIGCEPCTRAIRPGEDSRAGRWWWESRDTKECGLHITTITPIPASAEAGAAH

SEQ ID NO: 39752 - DNA, 705 bp, Bacillus cereus G9241
  CDS (1)..(705)
atgttgacgtatgaaacgtgggaagaaaatgatgtttcattttcagaagaagatgaaacgaaaggcgcgttatctgtattaagttgggcttataaagaatataaaagtgaaattgtatacgcatgtagcttcggagtggaagggatggtactgctgcatcttattaaccaagtaaattcatctgctaaagttgtatttttggatacaaacgtacattttcaagaaacgtatgaattaattcaaaaagtgcgggaacgatttcctttattgaatattatagaaaaacagccagaacttacacttgatgaacaagccaaagcgcatggtgacaagctatgggaaagcaatcccaatctctgttgtaagattagaaaaattttacctttagaagaatcattagcgaatgaaaaagcgtggatatcgggattgagaagggaacaatcagaaacccgtaagcatacaaagtttataaatctagatcatcgctttcaatctattaaagtttgtccgctcattcattggacgtggaaagaagtatggagatatgtatacaaacatagcttgccttataacccattacatgacattggatatccaagcattgggtgtgagaagtgtacgttgcctgtaggagagggtggcgattcgagagatggtagatgggctgggaaagtgaaaactgaatgtggtcttcattaccaataa

SEQ ID NO: 39753 - protein, 234 aa, Bacillus cereus G9241
MLTYETWEENDVSFSEEDETKGALSVLSWAYKEYKSEIVYACSFGVEGMVLLHLINQVNSSAKVVFLDTNVHFQETYELIQKVRERFPLLNIIEKQPELTLDEQAKAHGDKLWESNPNLCCKIRKILPLEESLANEKAWISGLRREQSETRKHTKFINLDHRFQSIKVCPLIHWTWKEVWRYVYKHSLPYNPLHDIGYPSIGCEKCTLPVGEGGDSRDGRWAGKVKTECGLHYQ

SEQ ID NO: 39754 - DNA, 750 bp, Rubrivivax gelatinosus PM1
  CDS (1)..(750)
atgagcgcgatcgcgctgtatgcgcgagcctccgaaggcttcgaggcgcgcgtcgcgcaagccgtggagcggctgcgtgacgcggcagttgagcatgccggacgcatcgtgcaggccaccagcctcggcgcggaagacatggtgatcaccgacctgatcgcgcgccacgcgctgccgatcgcgatcggcacgctcgagaccggcaagctgcacgccgagaccagcgcgctgatcgaccgcatcgagcagcactacggcctggcggtcgaggtctaccgcccgaagaacgaggcggtgatcgagttcgtgcgcaccaacggcgaggaggccatgtaccggagcctcgcattgcgcaagggctgctgcggcatccgcaagctcgagccgctgtcgcgcatgctggccgagcgcggtgcctggatcaccggcctgcgccgcgagcagtccgacgcgcgcggcgaggtgccgttccgcgaccacgacgacgccggccggctgaagctcaacgcgctggccgactggagctgggccgacgtgtggcactacatcgaacgccaccaggtgccctacaacccgctgcacgaccagttcatgcccagcatcggctgcgcaccctgcacccgtgcgatcgcggtgggcgaacccttccgcgcgggccgctggtggtgggaggacgagaccgccaaggaatgcggcctgcacgtccaccaggaagcggccgtcgtctccgcgatcggagctccccaatga

SEQ ID NO: 39755 - protein, 249 aa, Rubrivivax gelatinosus PM1
MSAIALYARASEGFEARVAQAVERLRDAAVEHAGRIVQATSLGAEDMVITDLIARHALPIAIGTLETGKLHAETSALIDRIEQHYGLAVEVYRPKNEAVIEFVRTNGEEAMYRSLALRKGCCGIRKLEPLSRMLAERGAWITGLRREQSDARGEVPFRDHDDAGRLKLNALADWSWADVWHYIERHQVPYNPLHDQFMPSIGCAPCTRAIAVGEPFRAGRWWWEDETAKECGLHVHQEAAVVSAIGAPQ

SEQ ID NO: 39756 - DNA, 735 bp, Pseudomonas fluorescens PfO-1
  CDS (1)..(735)
atgagcccaacgttcgacgtcgtggaactcgccacgacctatgccaacaaatccgcgcaggacatcctcaaactcgcgttcgccgagttcggcgatgacctgtggatatctttcagcggcgccgaggatgtggtgctggtggacatggcctggaagctgaacaagaacgtcaaggtgttcagtctcgacaccggccgcctgcatccggaaacctaccgtttcatcgatcaggtgcgcgagcactacaagatcgacatcgaactggtctcgccggactacacgaaacttgaaccgttcgtgaaggaaaaaggcctgttcagtttctacaaggacggtcacggcgaatgctgcgggatccgcaagatcgagccgctgcgccgcaagctgtccggcgtcaaagcctgggccaccggccagcgccgcgatcaaagccctggcacccgcagcgctgtggcggtgatggaaatcgatacagcgttctccaccccggagcgcaccctgtacaagttcaacccgctggcacagatgaccagcgaggaaatctggggctacatccgcatgctggagctgccgtacaacagcctgcacgagcgcggctttatcagcatcggctgcgaaccgtgcactcgtcctgtcctgccgaaccagcacgaacgtgaaggtcgctggtggtgggaagaagcgacccaaaaagaatgcgggttgcatgccgggaacatcatcagcaaggcataa

SEQ ID NO: 39757 - protein, 244 aa, Pseudomonas fluorescens PfO-1
MSPTFDVVELATTYANKSAQDILKLAFAEFGDDLWISFSGAEDVVLVDMAWKLNKNVKVFSLDTGRLHPETYRFIDQVREHYKIDIELVSPDYTKLEPFVKEKGLFSFYKDGHGECCGIRKIEPLRRKLSGVKAWATGQRRDQSPGTRSAVAVMEIDTAFSTPERTLYKFNPLAQMTSEEIWGYIRMLELPYNSLHERGFISIGCEPCTRPVLPNQHEREGRWWWEEATQKECGLHAGNIISKA

SEQ ID NO: 39758 - DNA, 918 bp, Pseudomonas fluorescens PfO-1
  CDS (1)..(918)
atggtcgacaaactgacgcatctgaaacagctggaggcggaaagcatccacatcatccgcgaggtggccgccgagttcgacaacccggtgatgctgtactccatcggtaaagactccgccgtgatgctgcatctggcacgcaaggcgttcttcccgggcaaactgccgtttccggtgatgcacgtcgacacccgctggaaattccaggagatgtacaagttccgcgacaagatggtcgaagagcttggcctggacctcatcactcacatcaaccccgacggcgtggcgcagaacatcaacccgttcacccacggcagcgccaagcacaccgacatcatgaagaccgagggcctgaagcaggcactcgacaagcatggtttcgacgcagccttcggcggtgcccgtcgcgatgaagagaagtcccgcgccaaggagcgcgtctactcgttccgtgacagcaaacaccgctgggacccgaagaaccagcgtcccgagctgtggaacgtctacaacggcaaggtcaacaagggcgaatccattcgtgtgttcccgctgtcgaactggaccgagctggacatctggcagtacatctacctcgaaggcatcccgatcgtaccgctgtacttcgccgccgagcgcgaagtgatcgagaagaacggcacgctgatcatgatcgacgacgagcgcatcctcgagcacctgtccgacgaggacaaggcgcgcatcgtcaaaaagaaagtgcgtttccgtacccttggctgctacccgttgacgggcgcggtggagtccgaggccgaaagcctgacggacatcattcaggaaatgctcctgacgcgaacttccgagcgccagggccgggtcatcgaccacgatggcgcaggctcgatggaagacaagaaacgtcagggttatttctaa

SEQ ID NO: 39759 - protein, 305 aa, Pseudomonas fluorescens PfO-1
MVDKLTHLKQLEAESIHIIREVAAEFDNPVMLYSIGKDSAVMLHLARKAFFPGKLPFPVMHVDTRWKFQEMYKFRDKMVEELGLDLITHINPDGVAQNINPFTHGSAKHTDIMKTEGLKQALDKHGFDAAFGGARRDEEKSRAKERVYSFRDSKHRWDPKNQRPELWNVYNGKVNKGESIRVFPLSNWTELDIWQYIYLEGIPIVPLYFAAEREVIEKNGTLIMIDDERILEHLSDEDKARIVKKKVRFRTLGCYPLTGAVESEAESLTDIIQEMLLTRTSERQGRVIDHDGAGSMEDKKRQGYF

SEQ ID NO: 39760 - DNA, 777 bp, Rhodospirillum rubrum
  CDS (1)..(777)
atgggcggcccgcgcggcggcatcggcgcaagccgaggatggcttggcatgaccgccgaagtcgatgtctcgccggcgatcgaggatctgctcggccgtcatggcgacagcgccgccgaggcgatcttggaggatgttctgaagcgggccttcgtgcggcggaccgccctggtttcgtcctttggcaccgaggcggcggcgctgttgcacatggtcgccgccatcgaaccggcgaccccggtgctgttcgtcgataccggccggctgtttggcgaaaccctgcgctatcgcgaccggctggtcgaacgtctggggctcaccgatgtgcgcagcctcaagcccgaaccgcggatcgccgccgaggatcaggatctgatgctgttcagccgcgatgccgaccgctgctgctacctgcgcaaggttctgccgctgcgcaaggcgctggaaggctttgattgctggatcaatggccgcaagggccatcatggcggcgggcgggcgcagatgccggtggccgaggccgatggttttttggtgaaaatcacgccgctggcgcgctggggcgccgatgacgtcgacgcctattatgaaacccacgacctgccgcgccatccgctgtgggaggatggctttccctcggtcggctgcctgccctgcacggtgcgcgcttcggccgaggatggcttccgcgccggacgctgggccggggcgcagaagaccgaatgcggcattcatctgccggtggccgaggttcttcgccgcgccggcggctgctga

SEQ ID NO: 39761 - protein, 258 aa, Rhodospirillum rubrum
MGGPRGGIGASRGWLGMTAEVDVSPAIEDLLGRHGDSAAEAILEDVLKRAFVRRTALVSSFGTEAAALLHMVAAIEPATPVLFVDTGRLFGETLRYRDRLVERLGLTDVRSLKPEPRIAAEDQDLMLFSRDADRCCYLRKVLPLRKALEGFDCWINGRKGHHGGGRAQMPVAEADGFLVKITPLARWGADDVDAYYETHDLPRHPLWEDGFPSVGCLPCTVRASAEDGFRAGRWAGAQKTECGIHLPVAEVLRRAGGC

SEQ ID NO: 39762 - DNA, 801 bp, Ralstonia metallidurans CH34
  CDS (1)..(801)
atgagctccgtgatctccgagatcccagtcgtcgacggttcggtgtcgtcgctgcgccccccagcgctgtggacgaagccggcgtacgccggcacgatcgaggcgctcgaagtgaaggaacgtgaactggccgaacgcctgtccggaatcgcggcgcgtttcttccgcgcgcgcttcgccacgagcctggccgccgaagacatggtgctgaccgacgcgatcctgcgcggcagcccggccgtgcgcgccggcatccgcgtgttcacgctgaacaccggccgcctgcacgccgaaacgcttgctgtgctggacaaggtcgagacgcactacggctacacgatcgagcagttcacgcccgaccaggaagccgtggagaactacctgaagaagaacggcctgaatgccttctacgacagcgtggacctgcgcaagagctgctgcggcatccgcaaggtggaaccgctcaatcgcgcgctttcgcacgccgatgcgtggatgacgggccagcgccgcgagcaggccgtgacgcgcgccgaactgccgttcgaggaaacggacgagtcgcgcggcattcccaagttcaatccgctggccgactggaccgaggccgaagtgtgggcgtacctgtcgcgccacaacgtcccggtcaacgcgctgcacgagaagggctatccgagcatcggttgcgagccctgtacgcgggcggtcaaggccggcgaggatgtacgcgccggacggtggtggtgggagagcaaggactcgaaagagtgcgggctccacgaacagaacatcaagcactga

SEQ ID NO: 39763 - protein, 266 aa, Ralstonia metallidurans CH34
MSSVISEIPVVDGSVSSLRPPALWTKPAYAGTIEALEVKERELAERLSGIAARFFRARFATSLAAEDMVLTDAILRGSPAVRAGIRVFTLNTGRLHAETLAVLDKVETHYGYTIEQFTPDQEAVENYLKKNGLNAFYDSVDLRKSCCGIRKVEPLNRALSHADAWMTGQRREQAVTRAELPFEETDESRGIPKFNPLADWTEAEVWAYLSRHNVPVNALHEKGYPSIGCEPCTRAVKAGEDVRAGRWWWESKDSKECGLHEQNIKH

SEQ ID NO: 39764 - DNA, 747 bp, Burkholderia fungorum LB400
  CDS (1)..(747)
atgagcgaagttcaagccctcacgccggaactcgccgcgaaggtcgagcgcctcgacgcgctgctcgattcgatcgccgcgcgtcacgcgaacgtgaagctcgccagcagccttgccgcggaagacatgctgctcacgcacgcgattctttcgcgcggcgtgaagatcggcatcttctcgctgaacacgggccgcttgcatgctgaaacgctgggcatgctcgatcgcgtgaaagagcgctacggttacgagatcgaacagtttcacccgcaacccgccgcggtcgaagagtatgtcggcacgcacggtctgaacgcgttttatgaaagcgtcgatctgcgcaagcgctgctgcgaaattcgcaaggtcgagccgttgaaccgcgcgctgtcggatgtcagcgcatgggtcacgggccagcgccgcgagcagtcggtgacgcgtgcggagctgcatgcggaagagcacgacgccgcgcgtaatatcgccaagttcaatccgctgaccgactggaccgaggccgaagtgtgggcctacctgaaagcgttcgacgtgcccgtcaatccgctgcatgcgcgcggctacccgagtatcggttgcgaaccttgtacgcgcgccgtgcgccccggcgaagatagccgggcagggcgctggtggtgggagtcgcgcgatacgaaggaatgcggactgcacatcacgacgattacgccgatcgcgatcgagcgcaacgcggacgcccaggcctga

SEQ ID NO: 39765 - protein, 248 aa, Burkholderia fungorum LB400
MSEVQALTPELAAKVERLDALLDSIAARHANVKLASSLAAEDMLLTHAILSRGVKIGIFSLNTGRLHAETLGMLDRVKERYGYEIEQFHPQPAAVEEYVGTHGLNAFYESVDLRKRCCEIRKVEPLNRALSDVSAWVTGQRREQSVTRAELHAEEHDAARNIAKFNPLTDWTEAEVWAYLKAFDVPVNPLHARGYPSIGCEPCTRAVRPGEDSRAGRWWWESRDTKECGLHITTITPIAIERNADAQA

SEQ ID NO: 39766 - DNA, 693 bp, Thermobifida fusca
  CDS (1)..(693)
ttgaacatcacggccgacggcgcggcgttcgccgctgaggctgccgcccgcctggaagaagccagcgccaccgagatcatccagtgggccgccgacacgttcggcgaccggctgtgcctgaccgcgtcgatggcggacgccgtcatggtggacctggtctcgaaagtagtcccgggcatcgacgtgatcttcctggacaccggctaccacttcccggagacgctggggacccgcgacgcggtcgcgcagacctacccgatcaacctgatcacggtcacccccagccggaccgtagcggaacaggatcgcgacctcggtccccggctgtacgcccgcaaccccgacctctgctgctacctgcgcaaagtagagccgctgcagcgggcgttgcagtcctacgacgcctggctgaccgggctgcgccgcgacgaggcggtgacccgccgcaccgtgggggtcgtgcagtgggacgcccgcaagaagaagatcaaagtcaatccgatcgcccgctggacccaagagcaggtggactcctacatcgctgagcacggggtgctcgtcaacccgctgcaggacgacggctacccctcgatcgggtgtgcgccgtgcactcagcgggtgccggaaggcgccgacccccgcagcggtcgctgggcgggaacagggaaagtcgaatgcggtctccacagttga

SEQ ID NO: 39767 - protein, 230 aa, Thermobifida fusca
MNITADGAAFAAEAAARLEEASATEIIQWAADTFGDRLCLTASMADAVMVDLVSKVVPGIDVIFLDTGYHFPETLGTRDAVAQTYPINLITVTPSRTVAEQDRDLGPRLYARNPDLCCYLRKVEPLQRALQSYDAWLTGLRRDEAVTRRTVGVVQWDARKKKIKVNPIARWTQEQVDSYIAEHGVLVNPLQDDGYPSIGCAPCTQRVPEGADPRSGRWAGTGKVECGLHS

SEQ ID NO: 39768 - DNA, 708 bp, Geobacter metallireducens GS-15
  CDS (1)..(708)
atgactgcaaccattcagaaaacaatcccccaacttccccaggacgccactccacaggacatcctcagggccggagtgtcggcgaccgagggttctgtcaagctcgcctgctccttctctgtggaggacgtcatcatcatcgacatggcaaaggaactggggtgcccgattgggatattcgccctcgacacggggcgcctccacgaggagacctacgaggtggcagacgccatcacggagcgctaccggatcccgatagactggtatttcccgcggcacgagacggtggaaaagctcgaacgcgacaaggggcttttctctttccgtgaatccctggataaccgccatgagtgctgccacatccgcaaggtggagccacttggccgggcgctcaaggggcttgccggctggatcaccgggctccgccgcgaacagagcgtcacgcggaccggcctcgctcccatcgagagcgacgaagcaaacggcggcatcctgaaaatcaacccgctcctggagtggagtgaggaacaggtctgggagtacgccgaaaagcgccgggtaccggtgaaccgtctccataaacagggatacccttcgatcggctgcgctccctgcacccgccccgtggccccgggcgagcatccccgagccggacgatggtggtgggagaatccggagcataaagagtgcgggttgcaccggcactga

SEQ ID NO: 39769 - protein, 235 aa, Geobacter metallireducens GS-15
MTATIQKTIPQLPQDATPQDILRAGVSATEGSVKLACSFSVEDVIIIDMAKELGCPIGIFALDTGRLHEETYEVADAITERYRIPIDWYFPRHETVEKLERDKGLFSFRESLDNRHECCHIRKVEPLGRALKGLAGWITGLRREQSVTRTGLAPIESDEANGGILKINPLLEWSEEQVWEYAEKRRVPVNRLHKQGYPSIGCAPCTRPVAPGEHPRAGRWWWENPEHKECGLHRH

SEQ ID NO: 39770 - DNA, 813 bp, Novosphingobium aromaticivorans DSM 12444
  CDS (1)..(813)
atggacagcaccgtgacccgcaagatcgacctgctcgacaccgcgccgcgctttaccgagacggacgcgatccgcctcaacaacctgttccggggcaccgacacgcacgacatgctgcgttcggtgatccgcgacgggctggcgggcgacctcgcggtcgtgtcgagcttcggcgcggaaagcgcggtgctgctccacctgatcgccgaagtcgacccttcggtgccggtcctgtttctcgaaacgggcaagcatttccgcgagaccgttgcctatcgcgacgagttgatcggcttcctgggcatgaccaacctgcagatcatcgaacccgacgcggcggtcatcgccaagaaggacgagaacgggctgcgctggtcctgggacccggatggctgctgcgagatccgcaaggtcgagccgctggccagggccctgctccacttcgatgcatcgatcaccggccgcaagggcttccagtcgaagacccgcgcagggcttccacggttcgagatcgaccgttcggacgcgcaaggacggttgaagatcaacccgctcgcgtcatgggacaagaccatgctcgaggcctatttcgcagagcatggcttgccgccgcatccgctggtcgcgcagggctatccctcgatcggctgcgcgccctgcaccagcaaggttgcccccggtgaagacccgcgctcgggccgctggaagggctgggacaagaccgaatgcggcatccattcgcccaccgacgacgaagccgcaggcaagaagcctggcgacgaactgcccccaggatacgaaccggtcttctga

SEQ ID NO: 39771 - protein, 270 aa, Novosphingobium aromaticivorans DSM 12444
MDSTVTRKIDLLDTAPRFTETDAIRLNNLFRGTDTHDMLRSVIRDGLAGDLAVVSSFGAESAVLLHLIAEVDPSVPVLFLETGKHFRETVAYRDELIGFLGMTNLQIIEPDAAVIAKKDENGLRWSWDPDGCCEIRKVEPLARALLHFDASITGRKGFQSKTRAGLPRFEIDRSDAQGRLKINPLASWDKTMLEAYFAEHGLPPHPLVAQGYPSIGCAPCTSKVAPGEDPRSGRWKGWDKTECGIHSPTDDEAAGKKPGDELPPGYEPVF

SEQ ID NO: 39772 - DNA, 738 bp, Ferroplasma acidarmanus
  CDS (1)..(738)
atggaagaatatttggatttacaggatctgaatccggttgaaatgctgggaaaaattgggaaatattatggaaaaggtgctgtgttcacttcaagcctggggctggaagacatggtcatcacagatatgattgccagaaataatattaatgttgaaattgcgactatagatacaggaagactccctgatgaaacataccagcttatggaaacggtaaggtcggagatgggtattgatttaaaaatatatttccctgaaagagaagatgttgaggacatgatcaattccagaggaatcaatcttttctaccattcgttagataaccgccatttttgctgtaatgtgagaaaggtaaaaccacttaaaaatatacttcgcaaaaggtcggtttggatcacaggaataagggcagaacagactgttgcaagaaaaaatgccagaaaagttgaatatgtaagggatcacaatgtctggaaagtcaatccacttctggactggagcagggatgaaatatggtcatatgtgagtattcacaaagttccatacaacattctgtttgaccagaactataagagcataggttgccagccatgtacaaaggcagtgggaaaggatgatgacgaaagatctggaaggtggtggtgggagaacggcgtaaaggaatgcggccttcatttgacaggaggcgtcaatacagatcttaatttgggaaagaattctggtgatattgttgattaa

SEQ ID NO: 39773 - protein, 245 aa, Ferroplasma acidarmanus
MEEYLDLQDLNPVEMLGKIGKYYGKGAVFTSSLGLEDMVITDMIARNNINVEIATIDTGRLPDETYQLMETVRSEMGIDLKIYFPEREDVEDMINSRGINLFYHSLDNRHFCCNVRKVKPLKNILRKRSVWITGIRAEQTVARKNARKVEYVRDHNVWKVNPLLDWSRDEIWSYVSIHKVPYNILFDQNYKSIGCQPCTKAVGKDDDERSGRWWWENGVKECGLHLTGGVNTDLNLGKNSGDIVD

SEQ ID NO: 39774 - DNA, 663 bp, Cytophaga hutchinsonii
  CDS (1)..(663)
atgaataaggaagaaatacatctgaaacttacagaatatcaggaaaaaggcttgaagctttttacaacttcatcttttcaaacacatagtattgtattgttacatatactgagtgaatttgatccgtctattccggtatattttattaatacaggctaccatttccccgaaacggttctttacagagatcagattgcagatctgttcaatcttaaaaatattaaagttgtatcttctgctactccaagaaacatgcagaaagatgctgaaggcagattgctttttacatctgatccggattattgctgctatttaaataaagtacagccgctggatgctgttctaccggattatgatatctggattaatggtgtacgtgccgatcagagtgccgtgcgaaaaagtttctccgttgagcagcctgctccacatgatacgattcgtttccaccccatgctggattgggatgtgcgtatgatcgaaaagtatattaaagagcataaaattccccgtcatccgctggaagaaaaaggttatttaagtatcggctgcgaaccatgtacgcgtaagtttgatcttgaaacatacaacagacaaggccgttggtttggattgaataaaacggaatgtgggttaaatacagaattggttagtaaaaaataa

SEQ ID NO: 39775 - protein, 220 aa, Cytophaga hutchinsonii
MNKEEIHLKLTEYQEKGLKLFTTSSFQTHSIVLLHILSEFDPSIPVYFINTGYHFPETVLYRDQIADLFNLKNIKVVSSATPRNMQKDAEGRLLFTSDPDYCCYLNKVQPLDAVLPDYDIWINGVRADQSAVRKSFSVEQPAPHDTIRFHPMLDWDVRMIEKYIKEHKIPRHPLEEKGYLSIGCEPCTRKFDLETYNRQGRWFGLNKTECGLNTELVSKK

SEQ ID NO: 39776 - DNA, 726 bp, Microbulbifer degradans 2-40
  CDS (1)..(726)
atgagcaacaccatcgacttcaccgatattgatgcgaagctgcaacaagcttcaccgcaagaaatactcgcttacgcgcttgccgaaaacgacaacctcgcaatatcgtttagcggtgcagaagatgttgtactagttgatatggcttctaaaataaaacccggcgttcaggtgttttgtttagatactggcagattacatgcagagacctaccaatttattgagcaagtacgcaaacactacgatattaagctcgacgtgttgtttccagattctgccgcagtacagaagcttgtggcggaaaaaggcctttttagctttttcgaagacaatcaccaagaatgctgtggcatacgcaaagtaggccctctgcgcaaaaaactattggaagtagacgcttgggttacgggccagcgcaaagatcagagccctggcacacgcgcctctattccggtaatccaaaacgatcgtgtttttgcacgcccaggagacaccctaaccaaatttaaccccttggttaattggacatcacaacaggtttgggattacattcgctctgaaggcgtaccatacaacagcctgcacgatcgaggctttgtctctataggctgcgaaccctgcacacgcccaacgggccctggccagcatgagcgtgaaggccgctggtggtgggaagaagccaccaagaaagaatgcggtttacacgccactaacgttaaaaaatag

SEQ ID NO: 39777 - protein, 241 aa, Microbulbifer degradans 2-40
MSNTIDFTDIDAKLQQASPQEILAYALAENDNLAISFSGAEDVVLVDMASKIKPGVQVFCLDTGRLHAETYQFIEQVRKHYDIKLDVLFPDSAAVQKLVAEKGLFSFFEDNHQECCGIRKVGPLRKKLLEVDAWVTGQRKDQSPGTRASIPVIQNDRVFARPGDTLTKFNPLVNWTSQQVWDYIRSEGVPYNSLHDRGFVSIGCEPCTRPTGPGQHEREGRWWWEEATKKECGLHATNVKK

SEQ ID NO: 39778 - DNA, 804 bp, Trichodesmium erythraeum IMS101
  CDS (1)..(804)
atgctacaacagagtttaatcagactcaataaaaatggacaatacaattatcaagattacaggtatttaccagaactagatcttggggttgttaatcaggaacttagtcaagcagatcctcacactttagtacagtgggggttaaaaatttttaaggaaggtctggttatgagtaccagttttggtattcaggctgctgttatgttacacctagttacaagtgttatacctaatattcctgttatctggattgatacaggatatttaccagccgaaacctataaatttgctgaagagttgatagaacgactgaaacttaatgtgaaagtttatcagtcacatattagtccaggtcggatggaagctttatatggcagactttgggcagaaaaagatcttgaggctcttaaccgctatgaccaaattcgcaaagtagaacccatgcaacgagcattgagagagctgaaggccactgcttggttagctgggttaaggggagaacaaaccaagcaccgccaaagtttagatcgcattagtaaacagtcgaatatatataaaattttaccaatactcaattggaatgcacgggatatttatcaatatttaactgctcataatttaccatatcatccattttttgatttgggatacactactgtaggagattggcattctagtcggcctcttactactgatgatcaagatgaacgggatactcgcttttatggtcttaagcaggagtgtgggctacatttgcctcaaacacaagaagaggctcaaagtcttgattctagtttattgtaa

SEQ ID NO: 39779 - protein, 267 aa, Trichodesmium erythraeum IMS101
MLQQSLIRLNKNGQYNYQDYRYLPELDLGVVNQELSQADPHTLVQWGLKIFKEGLVMSTSFGIQAAVMLHLVTSVIPNIPVIWIDTGYLPAETYKFAEELIERLKLNVKVYQSHISPGRMEALYGRLWAEKDLEALNRYDQIRKVEPMQRALRELKATAWLAGLRGEQTKHRQSLDRISKQSNIYKILPILNWNARDIYQYLTAHNLPYHPFFDLGYTTVGDWHSSRPLTTDDQDERDTRFYGLKQECGLHLPQTQEEAQSLDSSLL

SEQ ID NO: 39780 - DNA, 762 bp, Silicibacter sp. TM1040
  CDS (1)..(762)
atgacccgtatagatcaggagatcaggggccatcccgccgctgctggcagcgctgaggccctggccgagcaggttgcggcgctcaatgcccgcttcaaacaccactcggccacctccgtgatggaaggggcgctgcgggatgctggcaatatcgcgctggtgtcgtcctttggggcggaatcggtggtgctgttgcatatggccgccgtgatcgacccctcggtgccggtgctctttgtggacacggaactcttgttcacagagacgctggtctaccagcaagaagtgagcgagcgcctaggcctcaggaatgtgcatgtcatcaaggcggatgacatcgccgaaaaagacccctatggcgcgatgcggttttccgacaccgacgcctgctgcaccctgcgcaagaccattccgctgcaaaaggcgctcgccggctatgacggctggatcaccgggcgcaaacggtttcagtccggcacccgcgccgcgctcgacttctttgaggtcgaggatggcaccggacgaatgaagatcaacccactggcccattgggcgcccgaagacgtgcgcgcctatatggatgaaaaccgcctgccccgtcacccgctggtggccaagggctatccatcgatcggctgcgaaccctgcaccagcccggtcgcagaaggcgaagacccccgcgccggtcgctggcgcaaccagaacaaggaagaatgcggcatccacgttgtggatggcaaattcgtccgtacaggagcttga

SEQ ID NO: 39781 - protein, 253 aa, Silicibacter sp. TM1040
MTRIDQEIRGHPAAAGSAEALAEQVAALNARFKHHSATSVMEGALRDAGNIALVSSFGAESVVLLHMAAVIDPSVPVLFVDTELLFTETLVYQQEVSERLGLRNVHVIKADDIAEKDPYGAMRFSDTDACCTLRKTIPLQKALAGYDGWITGRKRFQSGTRAALDFFEVEDGTGRMKINPLAHWAPEDVRAYMDENRLPRHPLVAKGYPSIGCEPCTSPVAEGEDPRAGRWRNQNKEECGIHVVDGKFVRTGA

SEQ ID NO: 39782 - DNA, 753 bp, Desulfitobacterium hafniense DCB-2
  CDS (1)..(753)
atggacagatcggatttcaatttggatcttgatgagataaaccgagcctttgccggggaagacccccgcaagcttttggcccatgtggtggaaaaaatcggtccggcgcggattgctctggcttccagcctttccattgaggatcaagtactgacccagatgctattaaagatcgatgcccgggcccggatcttctttatcgatacaggccggaattttcagcagacttatgatctgatggaagagaccatgagtcgctatgagtttcattatgaggtatacgcgccggagaattcggagctggagccatttctggcggaatatggccccaacgctttttatgacaaggttgaactgcgccaaaaatgttgtgagctgagaaaagtcaggtccttgcagcgggtcttatctaccgtagatggctggatttgcggactgcgcaaggagcagagccccacccgccaggaaatcggtttgctggaatgggattcccgccacgctatctataaagtgaatcctctggcggcctggagcgaagagcaggtttgggcttatatccgccgggaaaacattccctacagttccctatacaacaaaggtttccgcagcattggctgtcagccctgcacccgggcggtggcccccggggcggatgtacgcagcggcaggtggtggtgggaagatccctctaaaaaagaatgcgggctgcatccatccctgaacccgcctgcaaaggaggaagaaaagcgatga

SEQ ID NO: 39783 - protein, 250 aa, Desulfitobacterium hafniense DCB-2
MDRSDFNLDLDEINRAFAGEDPRKLLAHVVEKIGPARIALASSLSIEDQVLTQMLLKIDARARIFFIDTGRNFQQTYDLMEETMSRYEFHYEVYAPENSELEPFLAEYGPNAFYDKVELRQKCCELRKVRSLQRVLSTVDGWICGLRKEQSPTRQEIGLLEWDSRHAIYKVNPLAAWSEEQVWAYIRRENIPYSSLYNKGFRSIGCQPCTRAVAPGADVRSGRWWWEDPSKKECGLHPSLNPPAKEEEKR

SEQ ID NO: 39784 - DNA, 801 bp, Ralstonia eutropha JMP134
  CDS (1)..(801)
atgagcggcctgagcgacatcgcagtcgtggatggcggcgcgccggcatcggcgctgcgtcccacgctgtggaccatgcccgagtacacgggcagcctggcggacctcgacgagaaggaacgcgagctgtcggcccgcctggccggcattgccgcacgcttcttccgcgcgcgttttgccactagccttgctgccgaagacatggtgctgaccgacgcgatcctgcgcggcacgccggccgtgcgcgcgggcatccgcgtgttcacgctgaacacgggccgcctgcacgccgaaacgctggctgtgctggacgaggtgaaggtgcattacggctacaccgtcgagcagttcacgccggacaccgaggccgtcgagaactacctgaagaagcatggcctgaacgcgttttacgacagcatcgacctgcgcaaggattgctgcggcatccgcaaggtcgagccgctcaaccgcgcgctgtcgcacgcggacgcctggatgaccggccagcgccgcgagcaagccgtcacgcgttccgaactgccgttcgaggaaatggacgaagctcgcgccatcccgaagttcaatccgcttgcggactggaccgaggccgaggtgtgggcatacctgaagcgccacaacgtcccggtgaacgcgctgcatgccaagggctaccccagcattggctgcgaaccttgtacgcgtgcggtgcgcgcgggcgaggacctgcgcgccgggcgctggtggtgggagagcaaggactcgaaagagtgcgggctccacgaacagaacatcaagcattga

SEQ ID NO: 39785 - protein, 266 aa, Ralstonia eutropha JMP134
MSGLSDIAVVDGGAPASALRPTLWTMPEYTGSLADLDEKERELSARLAGIAARFFRARFATSLAAEDMVLTDAILRGTPAVRAGIRVFTLNTGRLHAETLAVLDEVKVHYGYTVEQFTPDTEAVENYLKKHGLNAFYDSIDLRKDCCGIRKVEPLNRALSHADAWMTGQRREQAVTRSELPFEEMDEARAIPKFNPLADWTEAEVWAYLKRHNVPVNALHAKGYPSIGCEPCTRAVRAGEDLRAGRWWWESKDSKECGLHEQNIKH

SEQ ID NO: 39786 - DNA, 756 bp, Rubrobacter xylanophilus DSM 9941
  CDS (1)..(756)
atgccggaggctcccgcgaaggagcgcaagaagcaacgagaggcccgcgaggaggtgttgcgtgccgccggggagctggagggggccgcgccgcaggaggttctgcgttgggcggtcgggttcttcggcaggaggctcaccctctccgtctccttcggggggccggaggggatggtccttctggacatgctctcgcggataaccgacgacgtctgggtcttcacgctggacaccggctttctcttcgaggagaccgtccggttccgggaggaggccatgcgccgctaccggctgccgctccgggtggtgcgtccggagctctccgtggaggagcaggtggaacgctacgggccgcggctctggagctgcgcgccggacatctgctgcgaggtccgcaaggtcgagccgcagcggcggtggctctccaacttcgacgcctgggtcaccggcatccggagggaccagacggcggcgcgggcggacacccccgtcgtcggctgggacgagttcttcggggtgttcaagatagcccccctggcctcctggagcagggagcgggtgctgcggtacgccggggagcacggggtgccgctcaacccgctgctctccagggggtacgccagcatcggctgcgagccgtgcacccgccccgtccgggagggcgaggacgagcgcgccggccggtggccggggatggagaagaccgagtgtggcctgcacatagcaaacgggaaggtgcgtcgtgcggtttcttag

SEQ ID NO: 39787 - protein, 251 aa, Rubrobacter xylanophilus DSM 9941
MPEAPAKERKKQREAREEVLRAAGELEGAAPQEVLRWAVGFFGRRLTLSVSFGGPEGMVLLDMLSRITDDVWVFTLDTGFLFEETVRFREEAMRRYRLPLRVVRPELSVEEQVERYGPRLWSCAPDICCEVRKVEPQRRWLSNFDAWVTGIRRDQTAARADTPVVGWDEFFGVFKIAPLASWSRERVLRYAGEHGVPLNPLLSRGYASIGCEPCTRPVREGEDERAGRWPGMEKTECGLHIANGKVRRAVS

SEQ ID NO: 39788 - DNA, 666 bp, Chloroflexus aurantiacus
  CDS (1)..(666)
atgacaacacaatactgggacgcgaacaccgaccctcgtgatgtcattcgctgggcacttgccggttatcccgatctgctgatgaccagtgcattcaatcttaacggggtcgtgcttattgagctggcagctcaggccggttttgcgggcgaggtggtttttgtggataccggctaccattttccggagacccttgccactcgtgaccatctgatcacgcgctatccccagatgcagtttgtcaccctaagtgccgacctgccacctgaaccgtggggggaagagcaatttcggagcgatcccgatgggtgctgtcgcgtgcgaaaagttgctcccctgcgtgaatatctggcgcgcaagaatccttctgctcttttaaacgctcgcagtcgtgatcaggccgcaacccgccgggatctgggttttgtcgagattggtgagcgggtgcggatcaatccactggcctactggcggcgggagcagatagaggcatttgcgcaagcccatcacctgccggtgaacccattgtactgggccggtttcaagagtatcggctgctggccctgtacacgggccgtgcgccctggtgaagatgtgcgggccgggcgttggtcggggaagggcaagattgaatgtggcctatggatcggtgaacaatcgctgtga

SEQ ID NO: 39789 - protein, 221 aa, Chloroflexus aurantiacus
MTTQYWDANTDPRDVIRWALAGYPDLLMTSAFNLNGVVLIELAAQAGFAGEVVFVDTGYHFPETLATRDHLITRYPQMQFVTLSADLPPEPWGEEQFRSDPDGCCRVRKVAPLREYLARKNPSALLNARSRDQAATRRDLGFVEIGERVRINPLAYWRREQIEAFAQAHHLPVNPLYWAGFKSIGCWPCTRAVRPGEDVRAGRWSGKGKIECGLWIGEQSL

SEQ ID NO: 39790 - DNA, 786 bp, Polaromonas sp. JS666
  CDS (1)..(786)
atgggtgccatttccctttacgccaaggcgtcgccagactttgccgaaaaactcgcgcacagcctggccttgctgaaatcctccgccgcgacctattccccgctgacccaggcctccagcctgggcgctgaagacatggtggtcacgcacctgttgcaggaagccggcattgactgcagcatttttgtgctggacaccggcatgctgcacgccgaaaccgtggcgctgattggccgcatcgaagagcgctaccagcgcaaggtcgacgtgtatcgcccggtcgaaaacgccgcctcggccttcgtgcaaacgaacggcccggatgcgatgtacaaaagcctggaattgcgcaaggcctgctgccacatccgcaagatggagccgctggagcgcgccctcgccggcaaaaacggctggttgaccggcctgcgccgcgagcagtccagcgcccgcgctgaagtgcacgacgtcgagcaacaggccgaacgcgtgaaaatcaatccgctggccgactggacctggggcgatgtatggcactgcatcgcgctgaacgccattccctacaacccgctgcacgaccaattcttccccagcatcggctgcgccccctgcacccgcgccgtcacgctcggtgaagacttccgctccggccgctggtggtgggagcaggaaagcgccaaggagtgcggcctgcatgtggcggccgacggcacccatgaagcccaggagcccgctgcctttgaacccctgtccagcatcattcccatccggcaggtccccacatga

SEQ ID NO: 39791 - protein, 261 aa, Polaromonas sp. JS666
MGAISLYAKASPDFAEKLAHSLALLKSSAATYSPLTQASSLGAEDMVVTHLLQEAGIDCSIFVLDTGMLHAETVALIGRIEERYQRKVDVYRPVENAASAFVQTNGPDAMYKSLELRKACCHIRKMEPLERALAGKNGWLTGLRREQSSARAEVHDVEQQAERVKINPLADWTWGDVWHCIALNAIPYNPLHDQFFPSIGCAPCTRAVTLGEDFRSGRWWWEQESAKECGLHVAADGTHEAQEPAAFEPLSSIIPIRQVPT

SEQ ID NO: 39792 - DNA, 1272 bp, Enteromorpha intestinalis
  CDS (1)..(1272)
atggcgctttcaattcgcgcgaaccgcctacgcgcgggcgcgatgccgctcaagcccgttcgcagtagcactcgtggctcagtgacgctttgcgagcgtgtgcgtgcgcccgtgcgcgcggctgcggccgcggtggccgcgccagagggcgcgaaggcgacggactgggctgcggagacgaaggagctcaacaacaagtcgccgctcgaaatcatggaccacgcactcgcgacgttcggcgacgaggtcgcgatcgcgttctcgggcgcggaggacgtggcgctcatcgaatacgctcacctgaccggccgcaagtaccgcgtcttctcgctggacacgggccgactcaaccccgagacgtaccagctcttcgacgccgtcgagaagcactacaagatcaggatcgagtacacgttcccggacgcgcaggagacgatggacctcgtgcgcgagaagggcctgttctctttctacgaggacggccatcaagagtgctgccgcgtccgcaaggtccggccgctgcgccgccagctcaagacgctgcaggcgtggatcacgggccagcgcaaggaccagtcccccggcacccgcatggaggtccccgccgtgcaagtggaccccgtcttcgagggccagtccggcggcgacggctccctcgtcaagtacaacccgctcaccaacatgacgtccgcggaggtctggaacttcctgcgcatcatgaacgtgcccagcaacaagctccacgagtgcggctacgtctccatcggctgcgaaccctgcacgcggcccgtgctgcccaaccagcaggagcgcgagggccgctggtggtgggaggactccgccgccaaggagtgcggcctgcactctggcaacgtcgtcgactctgctgaggcagaggccaaggcggaggcacccgacctgtggaccggcggggcggtcgaggcgctggacaaggcgacgctcgagaagctcgcaggcggcgaccgcgacaaggacaccatggtggtgttatacgcgccttggtgccctttctgccaggccttcgaacccgattacgagcccgtcgcgcaagagcccggcggagcgggcttcggcgtggccaagtacaacgcggacgctgaccgcgagtactcggagtcgctcggcctgaaaacgttcccgacaatcatcttcctgcccaagggttctgacaaggtggtcaagtttgagtcggatcggcggaccgtcgagtcgatgacgatgtgggcggcagcgctgggcgcacgcgagtga

SEQ ID NO: 39793 - protein, 423 aa, Enteromorpha intestinalis
MALSIRANRLRAGAMPLKPVRSSTRGSVTLCERVRAPVRAAAAAVAAPEGAKATDWAAETKELNNKSPLEIMDHALATFGDEVAIAFSGAEDVALIEYAHLTGRKYRVFSLDTGRLNPETYQLFDAVEKHYKIRIEYTFPDAQETMDLVREKGLFSFYEDGHQECCRVRKVRPLRRQLKTLQAWITGQRKDQSPGTRMEVPAVQVDPVFEGQSGGDGSLVKYNPLTNMTSAEVWNFLRIMNVPSNKLHECGYVSIGCEPCTRPVLPNQQEREGRWWWEDSAAKECGLHSGNVVDSAEAEAKAEAPDLWTGGAVEALDKATLEKLAGGDRDKDTMVVLYAPWCPFCQAFEPDYEPVAQEPGGAGFGVAKYNADADREYSESLGLKTFPTIIFLPKGSDKVVKFESDRRTVESMTMWAAALGARE

SEQ ID NO: 39794 - DNA, 1386 bp, Lycopersicon esculentum
  CDS (1)..(1386)
atggctttgactttcacttcttcatctgcaattcatggctctttgtcttcttcatcttcttcttatgaacaacccaaagtatcccaattgggtacctttcagccattggataggcctcaactattgtcgtcaactgttttgaattctcggaggcgttcggcagtgaagccattgtatgctgaacctaagaggaatgattcaatagttccgtcagcagctaccatcgtggctcctgaggtaggagagagtgttgaggcagaggactttgagaaattggctaaggagcttcaaaatgcttcccctcttgaggttatggacaaagcacttgagaaatttggagatgacattgctattgctttcagtggtgctgaagatgttgctttgatagagtacgcacatttaactggacgaccatacagagtattcagccttgatactgggaggttgaacccggagacataccaattatttgacacagtggagaagcactatggcattcgcattgaatacatgttccctgattcagttgaagttcaggcgttggttaggaccaaagggcttttctctttctatgaggatggccaccaagagtgttgccgtgtaaggaaggttaggcctttgaggagagctctaaagggcttacgcgcctggatcacaggccagcgtaaagatcagtcccctggaactcgatcagaaatccccattgttcaggtggacccttcttttgaggggttggatggcggtgctggtagcttggtgaagtggaaccctgtggctaatgtggacggaaaagatatttggaacttcctgcgtgccatgaatgtgcctgtgaactcattgcattcacaaggatatgtatccattggatgcgaaccttgcacaaggccagttctaccagggcaacacgagagagagggaagatggtggtgggaagatgccaaggccaaggagtgtggcttgcacaagggcaacatcaaggatgaaactgtaaatggcgctgcccaaacaaatggtactgctaccgttgctgatatttttgataccaaggacattgttaccttgagtaagcctggagttgagaacctagtaaaattggaagaccgaagagagccttggctcgttgttctttatgcaccttggtgccaattttgccaggcaatggaaggatcctatgttgaattggctgagaagttggctggttctggtgtgaaagtagggaaattcagggcagatggtgaccagaaagcatttgcacaagaagaattgcagcttggcagcttccctacaatactcttcttcccaaagcactcttcaaaggccattaagtacccttcagagaagagggacgtagactccttgctggcttttgtgaatgctctcagatga

SEQ ID NO: 39795 - protein, 461 aa, Lycopersicon esculentum
MALTFTSSSAIHGSLSSSSSSYEQPKVSQLGTFQPLDRPQLLSSTVLNSRRRSAVKPLYAEPKRNDSIVPSAATIVAPEVGESVEAEDFEKLAKELQNASPLEVMDKALEKFGDDIAIAFSGAEDVALIEYAHLTGRPYRVFSLDTGRLNPETYQLFDTVEKHYGIRIEYMFPDSVEVQALVRTKGLFSFYEDGHQECCRVRKVRPLRRALKGLRAWITGQRKDQSPGTRSEIPIVQVDPSFEGLDGGAGSLVKWNPVANVDGKDIWNFLRAMNVPVNSLHSQGYVSIGCEPCTRPVLPGQHEREGRWWWEDAKAKECGLHKGNIKDETVNGAAQTNGTATVADIFDTKDIVTLSKPGVENLVKLEDRREPWLVVLYAPWCQFCQAMEGSYVELAEKLAGSGVKVGKFRADGDQKAFAQEELQLGSFPTILFFPKHSSKAIKYPSEKRDVDSLLAFVNALR

SEQ ID NO: 39796 - DNA, 786 bp, Corynebacterium glutamicum
  CDS (1)..(786)
atgagctttcaactagttaacgccctgaaaaatactggttcggtaaaagatcccgagatctcacccgaaggacctcgcacgaccacaccgttgtcaccagaggtagcaaaacataacgaggaactcgtcgaaaagcatgctgctgcgttgtatgacgccagcgcgcaagagatcctggaatggacagccgagcacgcgccgggcgctattgcagtgaccttgagcatggaaaacaccgtgctggcggagctggctgcgcggcacctgccggaagctgatttcctctttttggacaccggttaccacttcaaggagacccttgaagttgcccgtcaggtagatgagcgctattcccagaagcttgtcaccgcgctgccgatcctcaagcgcacggagcaggattccatttatggtctcaacctgtaccgcagcaacccagcggcgtgctgccgaatgcgcaaagttgaaccgctggcggcgtcgttaagcccatacgctggctggatcaccggcctgcgccgcgctgatggcccaacccgtgctcaagcccctgcgctgagcttggatgccaccggcaggctcaagatttctccaattatcacctggtcattggaggaaaccaacgagttcattgcggacaacaacctcatcgatcacccacttacccatcagggttatccatcaattggatgcgaaacctgcacccttcctgttgctgaaggacaagaccctagggccggccgttgggctggaaacgccaagacagaatgcggacttcactcatga

SEQ ID NO: 39797 - protein, 261 aa, Corynebacterium glutamicum
MSFQLVNALKNTGSVKDPEISPEGPRTTTPLSPEVAKHNEELVEKHAAALYDASAQEILEWTAEHAPGAIAVTLSMENTVLAELAARHLPEADFLFLDTGYHFKETLEVARQVDERYSQKLVTALPILKRTEQDSIYGLNLYRSNPAACCRMRKVEPLAASLSPYAGWITGLRRADGPTRAQAPALSLDATGRLKISPIITWSLEETNEFIADNNLIDHPLTHQGYPSIGCETCTLPVAEGQDPRAGRWAGNAKTECGLHS

SEQ ID NO: 39798 - DNA, 924 bp, Selaginella lepidophylla
  CDS (1)..(924)
atggcaacgacaacgacggcggctatggcgctagggcaggtatcgtccttgttcaatcaacctcaacatgcacgatcgtctctcagctggaggggcggtgtgcgagtcaacttcgttcaagcttgcgcttctaagagcgctgtcaatgccgccagtgcaaccgaggtgaaggagagcgtcgacatcaagcagtggaatgagcaaatatacgaaggtagacagcagcacttgcaatcgcaggctatggatgcactgaagaagtcactgtcgagcttcaaaaatccgacgttcccgtgtgcgttgattctgggggatgtggttcttttggatcttctacacagagttggtgctttagagaatggagctgtcaaagttgtatttattgacaccttccatttgtttccggagacatatgacttcctgaagactgttgaggaacggtacaagttcaaggcgcatgttttccatgcagcgggcttcaagaatcgggaagagtacgtcgcaaagcatggttccgacctctacatccgagatgttgatgagtacgacaagatctgcaaagttgagccttttaatcgagcactggcaacgctagaggtggatgcgatgataaacgggagacgaagagatcacggtgcagaaagggctcatttggaggttgttcaagacggtaagatggtgagcgttcagcctttggcgtactgggaattcagggactgctggaactatttaacaaagaacaacataccgtatcatccccttcacgataagggctatccaagcgttggagatatccagagcacattgcctgttccgaaagagaaatggttcgagtatggggcagagcggtctggacgttttcagggaatgacgaacaaggatggttcgctgaagactgaatgtggaattcattcgcagaagtag

SEQ ID NO: 39799 - protein, 307 aa, Selaginella lepidophylla
MATTTTAAMALGQVSSLFNQPQHARSSLSWRGGVRVNFVQACASKSAVNAASATEVKESVDIKQWNEQIYEGRQQHLQSQAMDALKKSLSSFKNPTFPCALILGDVVLLDLLHRVGALENGAVKVVFIDTFHLFPETYDFLKTVEERYKFKAHVFHAAGFKNREEYVAKHGSDLYIRDVDEYDKICKVEPFNRALATLEVDAMINGRRRDHGAERAHLEVVQDGKMVSVQPLAYWEFRDCWNYLTKNNIPYHPLHDKGYPSVGDIQSTLPVPKEKWFEYGAERSGRFQGMTNKDGSLKTECGIHSQK

SEQ ID NO: 39800 - DNA, 1371 bp, Ceratopteris richardii
  CDS (1)..(1371)
atggcatcagcgatagggagcgtatccatgaaacttcttcagggctctgtgctcgagcccttctcttcttcagtttcttctccccgtatggctctctcccccccttcttgcgtcgttagggcaggcttgtttggacaacggagttccgaaaacgtttttcaacgcagctgttccgtaccgcagtctgataagcaccgtggctgtcttaatgcagctatcgctactccagaagttgtgcaggaggacataaattatgaagatcttgctttacagctcgtagatgcttcacctcttgagattatggatagggctcttgccatgttccagtctgacatcgccattgctttcagtggtgcagaggatgttgcattgatcgagtatgccaaactgaccggcagaccattccgagtcttcagtctggacacggggcggcttaatcctgagacctataggttctttgatgaagttgagaaacactatggaatcaggattgagtacatgtttcctgatgcatcagaagtggaagcacttgttagaagcaagggaatgttttctttttatgaggatgggcaccaagaatgctgccgtatcagaaaagtgagacccctgagacgagctcttaaaggtttgaaggcgtggattacgggacaaagacgtgaccagtcacctggaacacggtcgaatattccaattgtgcagattgatccgtcctttgaaggcatggatggggggcctggcagtctcataaaatggaatcctgttgccaatgtcacaggcacagacatctggagcttcttgaggactatgaatgtccctgtcaatgtgttacactcgcaaggatatatttcaataggttgtgagccatgtactcgagcagtgcttcctggcatgcatgaaagggaagggcgatggtggtgggaggatgcaaaagcaaaggagtgtggcttgcacaagggaaacattgagactgctgaaactagtaataatggggcacagaatacagcttctgtatcagaactatttctaagcaaagacatcaaagccttttctcgagctgagattgaagaatttgcaaacttggagaaaagagagaattcctggattgtagtcctttatgcgccatggtgcccttattgtcaggcaatggaggcatcattcaatgagctggctgagaagcttggtggtacaaatgtaaaggttgggaagttcaatgctgacaaagaaaacaagccatatgctatggcagagctccagatgaagagtttccctactatcctctttttttcaaagaatttacggaatccaatcaagtatccttccgaacagagggatgtggactcttttcttgctttcataagagcactgcaatga

SEQ ID NO: 39801 - protein, 456 aa, Ceratopteris richardii
MASAIGSVSMKLLQGSVLEPFSSSVSSPRMALSPPSCVVRAGLFGQRSSENVFQRSCSVPQSDKHRGCLNAAIATPEVVQEDINYEDLALQLVDASPLEIMDRALAMFQSDIAIAFSGAEDVALIEYAKLTGRPFRVFSLDTGRLNPETYRFFDEVEKHYGIRIEYMFPDASEVEALVRSKGMFSFYEDGHQECCRIRKVRPLRRALKGLKAWITGQRRDQSPGTRSNIPIVQIDPSFEGMDGGPGSLIKWNPVANVTGTDIWSFLRTMNVPVNVLHSQGYISIGCEPCTRAVLPGMHEREGRWWWEDAKAKECGLHKGNIETAETSNNGAQNTASVSELFLSKDIKAFSRAEIEEFANLEKRENSWIVVLYAPWCPYCQAMEASFNELAEKLGGTNVKVGKFNADKENKPYAMAELQMKSFPTILFFSKNLRNPIKYPSEQRDVDSFLAFIRALQ

SEQ ID NO: 39802 - DNA, 627 bp, uncultured bacterium 463
  CDS (1)..(627)
atggatttggacctagacagcgttaatgcttcactgcgcgatgcaagcgccagtgacatcgtacgctgggccctgagtttgcaggcaaaaactatagccactaccagtatgggcaaaaatgcggcggttatgctgcatttggtgagcgaggtggacaaacgggtccccactatctgggtcgataccggttacaacctgcgagacacctacgtggtagcggagcgtttgattcgcgacctggaattggatattcacgtttactcgccacagatgacctcagagcggcgcaacgcgattatgggcggtgtgcccacggtggacgaggaagagcgccatcaggactttaccgaacaggtcaaactagagccctttgctcgcgcgctgactcagttcaggccggagatttggctgaccggtattcgcgaagaggaaacggagcatcgcaaatccctggatatcgtttccatggataaccgcggaatcgtcaaggtagcccctatatttaattggtcggacgatgatgtagagacctacatggagcaacacgaacttcctacctgccgccattatttcgatcctaccaaggtacacgacgggcgcgagtgcggcttgcatactgcagcttga

SEQ ID NO: 39803 - protein, 208 aa, uncultured bacterium 463
MDLDLDSVNASLRDASASDIVRWALSLQAKTIATTSMGKNAAVMLHLVSEVDKRVPTIWVDTGYNLRDTYVVAERLIRDLELDIHVYSPQMTSERRNAIMGGVPTVDEEERHQDFTEQVKLEPFARALTQFRPEIWLTGIREEETEHRKSLDIVSMDNRGIVKVAPIFNWSDDDVETYMEQHELPTCRHYFDPTKVHDGRECGLHTAA

SEQ ID NO: 39804 - DNA, 1398 bp, Populus alba x Populus tremula
  CDS (1)..(1398)
atggcattgagtgttagttcttcttcttcgatttctgcttctgggttttcacgttctagtcaagaacttaaagcaccccagtttggttcttttaagctgttagatcggccgacaacatttgttaatgtttcttcacaaagacgctgtgctgtaaagcctttaaatgctgagcctaaaaggaatggttctgttgttcctctcgctgcaactatcgctgctccagagattgcagagaaagtagaggtggaggaagattatgagaagttagctaaggagcttgtaaatggttctcctttggaaattatggataaggcacttgagaaatttggggatgacattgctattgctttcagtggtgccgaagatgttgctttgattgagtatgcaaagttgactgggcgaccgttcagggtgttctcactggatacggggcggttgaacccggagacataccatttctttgaccaagttgagaagcactatggcattcgaattgagtacatgtttccagatgctgttgaagttcaagcattagtaaggaacaagggtttattctccttttacgaggatgggcatcaggagtgctgccgtgtcaggaaggtgagacccttgaggcgggctctgaaggggcttcgggcctggatcactggccaaaggaaggatcaatctccagggacgaggtctgaaattccagttgttcaggtggacccggtttttgagggattggatggtggggctggaagccttatcaagtggaatccaatggcaaatgttgagggacaagatgtatggaagttccttcgaactatggatgtgcctgtgaactcattgcattcaaagggatacatctctattggttgcgagccttgcacaaggccagttcttcctggccaacatgagagagaaggacggtggtggtgggaggatgccacagctaaggaatgtggtcttcataaaggaaatctgaaacagggtgatgcagcccaacttaatggcaatggaaacggggctgcccatgcaaatggggctgccactgttgctgatattttcaactccgagaatttggtcaatttgagcaggcccggaatcgagaacttgttaaaattagagaaccgaaaggaaccatggcttgtggtgctctacgccccatggtgccaattttgccaaggtatggaagcatcctatgttgaattggccgataagttagcagggagtggagtaaaggtgggaaaattcagggcagatggcgatcagaagggattctcaaaacaagaattacagctaggaagttttccaacaatccttttcttccctaaacactcatctcgcccaatcaagtacccctctgagaaaagggacgtggattcattgatgacttttgtgaatgctctccggtaa

SEQ ID NO: 39805 - protein, 465 aa, Populus alba x Populus tremula
MALSVSSSSSISASGFSRSSQELKAPQFGSFKLLDRPTTFVNVSSQRRCAVKPLNAEPKRNGSVVPLAATIAAPEIAEKVEVEEDYEKLAKELVNGSPLEIMDKALEKFGDDIAIAFSGAEDVALIEYAKLTGRPFRVFSLDTGRLNPETYHFFDQVEKHYGIRIEYMFPDAVEVQALVRNKGLFSFYEDGHQECCRVRKVRPLRRALKGLRAWITGQRKDQSPGTRSEIPVVQVDPVFEGLDGGAGSLIKWNPMANVEGQDVWKFLRTMDVPVNSLHSKGYISIGCEPCTRPVLPGQHEREGRWWWEDATAKECGLHKGNLKQGDAAQLNGNGNGAAHANGAATVADIFNSENLVNLSRPGIENLLKLENRKEPWLVVLYAPWCQFCQGMEASYVELADKLAGSGVKVGKFRADGDQKGFSKQELQLGSFPTILFFPKHSSRPIKYPSEKRDVDSLMTFVNALR

SEQ ID NO: 39806 - DNA, 735 bp, symbiont bacterium of Paederus fuscipes
  CDS (1)..(735)
atgagccagcctttcgatacctccgccctcgcctctagctactccgacaaatcgccacaagacatcctgaaactcgccttcgaacacttcgtcgatgatctatggatctctttcagcggtgccgaagacgtcgttctggtagatatggcctgtaaactcagtaaaagcatcaaagttttcagcctcgacactggtcgtctgcacccagaaacctatcgcttcatcgatcaggttcgcgagcactatggcatcaccatcgaaatcctttctcccgactcacgcttgctcgaaccattagtgaaggaaaagggcctgttcagcttttataaggacggccatggcgaatgttgcagtatccgcaagatcgaaccactcaagcgcaagcttgccgacgtgcgcgcttgggctaccggccagcgccgtgaccaaagtcccagcacccgcacccatgtggcggtgatcgaactggatagtacgttctccacgccggaaaaaccgttgtacaagttcaacccactatcggccatgaccagcgaggaagtctggacctacatccgcatgctggagctaccctacaatagcctgcacgaacgcggctacatcagcatcggttgcgagccctgcacacgcccggttctacccaaccagcacgagcgcgaaggccgctggtggtgggaagaagctacctacaaggaatgtggcctgcacgccggaaatctgatcagcaaagcctga

SEQ ID NO: 39807 - protein, 244 aa, symbiont bacterium of Paederus fuscipes
MSQPFDTSALASSYSDKSPQDILKLAFEHFVDDLWISFSGAEDVVLVDMACKLSKSIKVFSLDTGRLHPETYRFIDQVREHYGITIEILSPDSRLLEPLVKEKGLFSFYKDGHGECCSIRKIEPLKRKLADVRAWATGQRRDQSPSTRTHVAVIELDSTFSTPEKPLYKFNPLSAMTSEEVWTYIRMLELPYNSLHERGYISIGCEPCTRPVLPNQHEREGRWWWEEATYKECGLHAGNLISKA

SEQ ID NO: 39808 - DNA, 780 bp, uncultured crenarchaeote
  CDS (1)..(780)
atggacctgttaagttctgaccgtgttaaccgttctaaaccatcctttgaccaattaaattcaatatctgaagaaatggaatcaaagtctgctaaagaagtcataaggtgggctttggaatcgtatgcgccaaatgtcgcattggcgtccagttttggtgcagaagatgcagtgttgattgacttaatttgtgagatcgacggtgtgcactctaggatcttcacacttgatacaggcagattaaatcaagagacatacgacgtaatggaggatgtacgaaagagatatggtgtgacgatagaggtattctttccagatagtcctcaagttgaggaaatggttacacagaagggaataaatttgatgtatgggagtatcgagaatagaaagctatgttgtaaaataagaaaggttgacccacttaagagggcactgacaggattggagtgttggatcacgggattaaggcgcgagcaaaccattaccagaaatgaaattaaaaaaatcgaaattgattcagcgcatggaaacattgtaaaattgaatccacttgcagattggactttagaccaaatttggaaatatataaaagataatgagattccgtataataaattacatgaccttggatacccgagcataggatgcgctccttgtaccagggcagtgaagccaggagaagattctcgagctggcaggtggtggtgggagaattcatctcataaagaatgtggcctacattgggatcccgtgaaaaataagtcggacaggtcaagttag

SEQ ID NO: 39809 - protein, 259 aa, uncultured crenarchaeote
MDLLSSDRVNRSKPSFDQLNSISEEMESKSAKEVIRWALESYAPNVALASSFGAEDAVLIDLICEIDGVHSRIFTLDTGRLNQETYDVMEDVRKRYGVTIEVFFPDSPQVEEMVTQKGINLMYGSIENRKLCCKIRKVDPLKRALTGLECWITGLRREQTITRNEIKKIEIDSAHGNIVKLNPLADWTLDQIWKYIKDNEIPYNKLHDLGYPSIGCAPCTRAVKPGEDSRAGRWWWENSSHKECGLHWDPVKNKSDRSS

SEQ ID NO: 39810 - DNA, 708 bp, Streptomyces sp
  CDS (1)..(708)
atgacggtcactcaggacgcgaccgcggccgacctgaaggcactcgccgagcaggccggccgtgatctggaggacgcctccgcgctggagatcctccgctgggccgtggacaccttcggcgaccgcttctgcgtcacctcctccatggaggacgcggtcgtcgcccacctcgcctcccgggtccgccccggcgtggacgtggtcttcctcgacacgggctaccacttcgaggagaccatcggcacccgcgacgccgtggacgccgtcatggacgtcaacgtcatcaccctgaccccccttcagacggtggccgagcaggacgcggagcacggtccgaggctccacgaccgcgaccccgacctgtgctgcgcgctgcgcaaggtcaagccgctggaggacggtctcaccgcctacggcgcgtgggccaccggcctgcgccgcgacgagtcccccacccgggcgaacaccccggtcgtcggctgggacgagaagcggcagaaggtcaaggtctcccccatcgcccgctggacgcaggacgacgtcgacgcgtacgtcacggagcacggcgtcctcaccaacccgctcctcatggacgggtacgcctcggtcggctgcgccccctgcacccggcgcgtcctggagggcgaggacgcccgcgccggacgctgggccggacgggccaagaccgaatgcgggctgcacggatga

SEQ ID NO: 39811 - protein, 235 aa, Streptomyces sp
MTVTQDATAADLKALAEQAGRDLEDASALEILRWAVDTFGDRFCVTSSMEDAVVAHLASRVRPGVDVVFLDTGYHFEETIGTRDAVDAVMDVNVITLTPLQTVAEQDAEHGPRLHDRDPDLCCALRKVKPLEDGLTAYGAWATGLRRDESPTRANTPVVGWDEKRQKVKVSPIARWTQDDVDAYVTEHGVLTNPLLMDGYASVGCAPCTRRVLEGEDARAGRWAGRAKTECGLHG

SEQ ID NO: 39812 - DNA, 726 bp, Xanthomonas oryzae
  CDS (1)..(726)
atgaccgcgctacctgccgcatcgatcacctcttccgcgttggacgatctggacgcgctcaatgcgcagctggaaggcctgcatgccgacgaacgcgtgtcctgggcgctgcagcacggcccgcaggacgcggcgctgtcgtccagcttcggcgcgcaatcggcagtgacgctgcatctgctcagccagcaacgcccggacatcccggtgatcctgatcgacaccggctacctgttcccggaaacctaccgcttcgccgatgccttgaccgaacggctcaagctcaatctcaaggtatatcgcccgctggtcagccgcgcctggatggaagcgcgccacggccgcctgtgggaacaaggcatggtcggcatcgatcagtacaacaacctgcgcaagatcgaaccgatgcgccgcgccttggacgaactcaacgtgggcacctggttcaccggcctgcgccgcagccaatccggcggccgcgcgcagacgccaatcgtgcagaagcgcggtgagcgctacaaaatcagccccatcgccgattggaccgatcgcgacgtgtggcagtacctgcagacgcacgagctgccgtaccacccactgtgggaacaaggctacgtgtccatcggcgatttccacaccacgcgtcgctgggaacccggcatgcgggaggaagacacgcgcttctttggcctgaagcgggagtgcggcatccacgaggatatctag

SEQ ID NO: 39813 - protein, 241 aa, Xanthomonas oryzae
MTALPAASITSSALDDLDALNAQLEGLHADERVSWALQHGPQDAALSSSFGAQSAVTLHLLSQQRPDIPVILIDTGYLFPETYRFADALTERLKLNLKVYRPLVSRAWMEARHGRLWEQGMVGIDQYNNLRKIEPMRRALDELNVGTWFTGLRRSQSGGRAQTPIVQKRGERYKISPIADWTDRDVWQYLQTHELPYHPLWEQGYVSIGDFHTTRRWEPGMREEDTRFFGLKRECGIHEDI

SEQ ID NO: 39814 - DNA, 744 bp, Rhodococcus erythropolis
  CDS (1)..(744)
atgacagtggacatttcgcgagcaaccgccgacgagcttcggtccatcgccgagcgcggtgccgtagaactcgacggagccagcgcacaggaactgttgcagtggaccgaggacacgttcggcgacggggcgagcgcagcgacgggggaacgtagcggttacattgttgcgtcgaacatgcaggatggagtgctggttcaccttgccgcacaggtgcatccgggcgtcgacgtactcttcctcgacaccggctaccacttccccgagaccatcggcacgcgtgacgcggtcgagcaggtctacggcgtcaacgtcatcaatgcacgcgcgctggcaagcgtcgccgagcaggatgtcgccgagggcaaggatctgttcgcccgtgatcccaaccgctgctgcgcattgcgcaaggtcgcacccctcaagcagacactgtccggctacagcgcgtgggtgaccggcatccgccgcgtcgaagcgcccacccgcgccaacgcccccctgatctccttcgacgaggccttcggcctcgtgaagatcaacccgatcgctccgtggtcggacgaggagatgcagaactacatcgacaccaattccatcctcgtcaatcctcttgtcgacgagggctatccgtccatcggctgcgcaccctgcaccagcaagccagcccccggcagcgatccgcgtagcggtcgttgggccggtgcctccaagacagaatgcgggttgcacgcatcatga

SEQ ID NO: 39815 - protein, 247 aa, Rhodococcus erythropolis
MTVDISRATADELRSIAERGAVELDGASAQELLQWTEDTFGDGASAATGERSGYIVASNMQDGVLVHLAAQVHPGVDVLFLDTGYHFPETIGTRDAVEQVYGVNVINARALASVAEQDVAEGKDLFARDPNRCCALRKVAPLKQTLSGYSAWVTGIRRVEAPTRANAPLISFDEAFGLVKINPIAPWSDEEMQNYIDTNSILVNPLVDEGYPSIGCAPCTSKPAPGSDPRSGRWAGASKTECGLHAS

SEQ ID NO: 39816 - DNA, 981 bp, Physcomitrella patens
  CDS (1)..(981)
atggcgatggctatggcggatgctcaccttcgctcctccacgtcctgtgtaccttcgcactgccccgcgctggtgcctgccctggccaccctcacttcgctcaggaaatgtgcttttcataaaccctcgtttccctcccttgtctttcaaagctactgcttgggttgggctagtggaagaggaaagactgcagcatctgcagtgcctgttaccacctcgggttcaagtattgacattaagaagtgtaacgaacaagctcgggatgcccgacttcagcatctagaggcacaggcgttagaaaccttgcagaagactgtggaaaatttcgagaagccagcgtttccatgtgctttgatcgcaggtgatgtggtcatactagatcttcttcacaggataggagcgttttcagataataaagtaaaaataatcttcatcgacacttttcacctcttccctgaaacatataagtttctcagcgaagtggaggagcggtatggattcaaggcacatgtgtttcatgctgcagatgtaaacaacaaagaagcctatgacgccaaatttggttcagatttgttcataactgacatagaagagtacgaccgcatctgtaaagttgagccgttcagccgtgctctgaagacattggaggtagatgctatgatcaatgggcgtagacgtgatcatggcgcagaaagagcccatcttgaggtgttcgaggagggaaaaatggtgaaagtgcaacctcttgcgtattgggaattcagggattgctgggattacttgacgaaatattcgttaccttaccatcctctccacgaccaaggctttccgagcattggagacgtgcagtccacgataccagttcctcgtgagaagtggttcgagtatgccggagaacgatcaggccgctttcagggtttgacgaatccagatgggagtgcaaaaacagagtgtggaattcacgttggtggtagaacataa

SEQ ID NO: 39817 - protein, 326 aa, Physcomitrella patens
MAMAMADAHLRSSTSCVPSHCPALVPALATLTSLRKCAFHKPSFPSLVFQSYCLGWASGRGKTAASAVPVTTSGSSIDIKKCNEQARDARLQHLEAQALETLQKTVENFEKPAFPCALIAGDVVILDLLHRIGAFSDNKVKIIFIDTFHLFPETYKFLSEVEERYGFKAHVFHAADVNNKEAYDAKFGSDLFITDIEEYDRICKVEPFSRALKTLEVDAMINGRRRDHGAERAHLEVFEEGKMVKVQPLAYWEFRDCWDYLTKYSLPYHPLHDQGFPSIGDVQSTIPVPREKWFEYAGERSGRFQGLTNPDGSAKTECGIHVGGRT

SEQ ID NO: 39818 - DNA, 1398 bp, Physcomitrella patens
  CDS (1)..(1398)
atggcgttgaaggttgcatcactggaggcggctgttatggctagtctagcgcccgcggcgtccacttcggcgtctctgtcacgccaatcgattgtttcagggttggcttttagagggcagaatgggtttcaactcggaggattgtcctccgccggggtttcgtcgcgaagcctggcgttgggcggtaagaagatcgaactcgacatcgctcagcctcgcagaatgctgcccgtttcagcaactgctgtggtttctgagtctgtgcaaagcaccgttgatatccccaagctggcggagaaattagactccgcatctcctctagagattatggacaaagctctttcactattcggtgacgacattgccatcgcgttcagtggagctgaagacgtaacgttgatcgagtacgcacaccttacaggccgccccttcagggtattcagcttggagactggaaggctgaaccccgaaaccttgaaattgtttgacgacgtggagaagcgctacaacattcgcattcaatacatgtaccctgacgccgcagaggttgaggagcttacgcggactaagggcttgttctccttctatgaggacgggcaccaagagtgctgtagggtgcggaaagtgaggcctcttcgtcgggctctcaagggattgaaggcatggatcactggacaacgtaaagaccaatcccccggaacgcgtgccaacgttcccgttgtacaggtggatcctgcttttgagggcctggatggcggtcctggaagccttgtgaagtggaacccgctgtcaaatgtttcgggaactgccgtatggtcgttcctgcgcaccatggatgtccctgtcaacgccctgcacttcaagggttacgtatcaattgggtgcgagccatgcacaagggctgtactgccagggcaacatgaaagagaaggcagatggtggtgggaggatgcaaaggccaaggaatgtggtcttcacaagggtaaccttgatggtgttgccgagtcctccaactctctcggagagaaaactgaagttgccgatcttttcattagcgagaatgtggtgacattcggacgggaggatatggaagccttggtgaaaggagagaaccgtgacaagtcatcactagttgtgttgtatgcgccttggtgctccttctctcaggcaatggacgagtcctacaacgacgtggcagaaaagttggcgggatctaatgttgtggtcggcaagttcaatgctgatggagctcagaaagcctacgcaaaggagaacctgcagctgcaaagctacccaaccgtcctcttcctccctaagaacagtagccaaattatcaagtacccatctgaaaaccgcgaggtagatgctttgcttgggtttgtgcaagcattgcaataa

SEQ ID NO: 39819 - protein, 465 aa, Physcomitrella patens
MALKVASLEAAVMASLAPAASTSASLSRQSIVSGLAFRGQNGFQLGGLSSAGVSSRSLALGGKKIELDIAQPRRMLPVSATAVVSESVQSTVDIPKLAEKLDSASPLEIMDKALSLFGDDIAIAFSGAEDVTLIEYAHLTGRPFRVFSLETGRLNPETLKLFDDVEKRYNIRIQYMYPDAAEVEELTRTKGLFSFYEDGHQECCRVRKVRPLRRALKGLKAWITGQRKDQSPGTRANVPVVQVDPAFEGLDGGPGSLVKWNPLSNVSGTAVWSFLRTMDVPVNALHFKGYVSIGCEPCTRAVLPGQHEREGRWWWEDAKAKECGLHKGNLDGVAESSNSLGEKTEVADLFISENVVTFGREDMEALVKGENRDKSSLVVLYAPWCSFSQAMDESYNDVAEKLAGSNVVVGKFNADGAQKAYAKENLQLQSYPTVLFLPKNSSQIIKYPSENREVDALLGFVQALQ

SEQ ID NO: 39820 - DNA, 1398 bp, Arabidopsis thaliana
  CDS (1)..(1398)
atggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaacgattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataa

SEQ ID NO: 39821 - protein, 465 aa, Arabidopsis thaliana
MAMSVNVSSSSSSGIINSRFGVSLEPKVSQIGSLRLLDRVHVAPVSLNLSGKRSSSVKPLNAEPKTNDSMIPLAATMVAEIAEEVEVVEIEDFEELAKKLENASPLEIMDKALEKYGNDIAIAFSGAEDVALIEYAHLTGRPFRVFSLDTGRLNPETYRFFDAVEKHYGIRIEYMFPDSVEVQGLVRSKGLFSFYEDGHQECCRVRKVRPLRRALKGLKAWITGQRKDQSPGTRSEIPVVQVDPVFEGLDGGVGSLVKWNPVANVEGNDVWNFLRTMDVPVNTLHAAGYISIGCEPCTKAVLPGQHEREGRWWWEDAKAKECGLHKGNVKENSDDAKVNGESKSAVADIFKSENLVTLSRQGIENLMKLENRKEPWIVVLYAPWCPFCQAMEASYDELADKLAGSGIKVAKFRADGDQKEFAKQELQLGSFPTILVFPKNSSRPIKYPSEKRDVESLTSFLNLVR

SEQ ID NO: 39822 - DNA, 1242 bp, Chlamydomonas reinhardtii
  CDS (1)..(1242)
atgatgctcactcagggtcgtgctttcgctgctcagcggcctgctgtgcagcagcgccgtatggcggtccgcgccaacgttgcgcgggttccccaggttaacgctgctgctgttgaggccaagcccgactgggcgggccttgctgcggagatggacaacaagtctcccctcgagattatggaccacgccctgaagaccttcggcaatgatgtcgccatcgccttctcgggtgctgaggacgtggctctgattgagtacgcccacctgactggccgcccctaccgtgtattcagcctggacaccggccgcctgaacccggagacctaccagctgtttgacgccgtggaaaagcactacaagatccgcatcgagtacaccttccccgaagcacaggaggtgatggacctggtccgtgccaagggcctgtactccttctacgaggacggccacaccgagtgctgccgcatccgcaaggtcaagcccctgcgcaagcagctgaaggtgtacaaggcctggatcactggccagcgcaaggaccagtcgcccggcacccgcactgaggtgcccgtcgtccaggtggaccccgtgttcgagggtgtgactggcggccccggmtccctgatcaagtacaaccccctgtccaacatgacctcggcggaggtgtggaacttcctgcgcgtcatgaaagtgcccaccaacaagctgcacaactgcggctacatctccattggctgcgagccctgcacccgcccggtgctgcccaaccaagccgagcgcgagggccgctggtggtgggaggacgccgccgccaaggagtgcggcctgcacagcggcaacatcaagaaggccgacggcaccaccgaggagcgcaaggcggagcgcgacctgtggcccgcgggcagcgccgtggcgaccctgagcaaggacgaggtccgcgccctggccgccggcgagcgctcgcagggcaccctggccgtgctgtacgccccctggtgccccttctgccaggccatggaggccaacttcgaggagctggccaagcacatgaccggccacaaggtgcgcgtggccaagtaccaggccgacatcgaccgcgagttctgcaacgagaacctacagctcaagaccttccccaccatcgtctacctgccgcccaacagcaagcaggtgatcaagtaccccagcgagcgccgcgacgtggataccctgtccatgtgggtcaagaccgtggctggccagtaa

SEQ ID NO: 39823 - protein, 413 aa, Chlamydomonas reinhardtii
MMLTQGRAFAAQRPAVQQRRMAVRANVARVPQVNAAAVEAKPDWAGLAAEMDNKSPLEIMDHALKTFGNDVAIAFSGAEDVALIEYAHLTGRPYRVFSLDTGRLNPETYQLFDAVEKHYKIRIEYTFPEAQEVMDLVRAKGLYSFYEDGHTECCRIRKVKPLRKQLKVYKAWITGQRKDQSPGTRTEVPVVQVDPVFEGVTGGPGSLIKYNPLSNMTSAEVWNFLRVMKVPTNKLHNCGYISIGCEPCTRPVLPNQAEREGRWWWEDAAAKECGLHSGNIKKADGTTEERKAERDLWPAGSAVATLSKDEVRALAAGERSQGTLAVLYAPWCPFCQAMEANFEELAKHMTGHKVRVAKYQADIDREFCNENLQLKTFPTIVYLPPNSKQVIKYPSERRDVDTLSMWVKTVAGQ

SEQ ID NO: 39824 - DNA, 1413 bp, Glycine max
  CDS (1)..(1413)
atggctctcgccgtttccactacttcttcctcttcagcagctgctgcagcttctagctccttcttctctcgtctcggatcttcctccgacgcaaaagctcctcaaatcggttcgtttcggtttccggagaggtcgcttgtttcgtctgttgttgtcaatgtaactcaacgacgctccttggtgaggccactcaacgccgaaccgcaacggaacgattctattgttcctcttgcagcaactatcgttgctcctgaggttgagaaggaagaggaagattttgagcaaatagcgaaagaccttgaaaatgcatctcctcttgaaattatggatagggccctcgagaaatttgggaacgacatcgctattgcatttagtggtgctgaagatgttgctttgattgagtatgcacatttgacgggtcgaccctacagagtgtttagtcttgacactgggagactgaatccagaaacctacaaattttttgatgcggttgagaagcattatggaattcacattgagtacatgttccctgatgcggttgaggttcaggcattagtaagaactaaagggctcttctcattttacgaggatgggcatcaagagtgctgccgagtaaggaaggtgaggcccttgaggagagcccttaagggtctcaaagcatggatcactggacagagaaaagatcagtctcctggtactaggtctgaaatccctgttgtccaggttgatcctgtttttgagggactggatggtggaattggcagcctggtgaagtggaacccggttgcaaatgttaatggtctagacatatggagcttccttaggaccatggatgttcctgtaaattcattgcattcccaaggatatgtttcgattggctgtgagccgtgcacaaggccagttttaccgggtcaacatgaaagagaaggaaggtggtggtgggaggatgccaaagccaaggagtgtggtcttcacaaaggtaatataaaacatgaagatgctgcccagcttaatggaaatggggcctcccaagcaaatggatctgccactgtcgctgacattttcaactcccaggatgtggtcagcttgagcaggtctgggattgagaatttggcaaaattggagaaccgaaaagaaccctggcttgttgtgctctatgcaccatggtgccgcttctgtcaggctatggaggaatcatatgttgatttggcagaaaagttagctgggtcaggagtgaaggttgcaaaattcagagcggatggagaccagaaggaatatgcaaagactgaactgcagttgggaagcttccccacaatactactcttccccaaacactcttctcaaccaattaagtacccttcggaaaagagagatgttgattcattgacggcattcgtgaatgctttacggtga

SEQ ID NO: 39825 - protein, 470 aa, Glycine max
MALAVSTTSSSSAAAAASSSFFSRLGSSSDAKAPQIGSFRFPERSLVSSVVVNVTQRRSLVRPLNAEPQRNDSIVPLAATIVAPEVEKEEEDFEQIAKDLENASPLEIMDRALEKFGNDIAIAFSGAEDVALIEYAHLTGRPYRVFSLDTGRLNPETYKFFDAVEKHYGIHIEYMFPDAVEVQALVRTKGLFSFYEDGHQECCRVRKVRPLRRALKGLKAWITGQRKDQSPGTRSEIPVVQVDPVFEGLDGGIGSLVKWNPVANVNGLDIWSFLRTMDVPVNSLHSQGYVSIGCEPCTRPVLPGQHEREGRWWWEDAKAKECGLHKGNIKHEDAAQLNGNGASQANGSATVADIFNSQDVVSLSRSGIENLAKLENRKEPWLVVLYAPWCRFCQAMEESYVDLAEKLAGSGVKVAKFRADGDQKEYAKTELQLGSFPTILLFPKHSSQPIKYPSEKRDVDSLTAFVNALR

SEQ ID NO: 39826 - DNA, 930 bp, Penicillium chrysogenum
  CDS (1)..(930)
atgccggccaagatgcccaactactcttccgagatggagggcgttgacaatcacgataacatgactgagtcgggctatgtcagtgctggttctggctctagcgaggactatgttcccgagattgttttcaccaagccccatcttcagttcctcaaccgccagttgcaattccttgaacctcaagagatcttgagatggtgcattacttcgcttcctcatctcttccagaccactgcctttggtctcacaggtcttgttacattagacatgctgtcgaagctggaggtgcctcgtccccagatggtcgacctcgtcttcctcgacactctctatcacttcgatgagacaatgtccctagtagaccgtgtacgccgcaggtaccccaacaacaatgtgcacatctacaagcccgctggcgttgaaaccactgccgaattcgaagccaagtacggcgctaagctctgggaagtcgacgaccaactctacgactgggtggccaaggttgagcccgctcagcgtgcctaccgtgagatgaatgttcatgccgttctcactggtcgccgccgcagccaaggaggcaaacgtggtgaccttgacatcattgaagtcgacgaggccggcctcatcaagatcaacccaatagccaactggtcctttgaccaggtcaagcagtacgtcaaggagaacgatgtgccctacaacgagctcctcgaccgtggttataagagcattggtgactggcactccacccagcccgttgctgagggagaggacgagcgctctggtcgttggaagggacagcagaagaccgagtgtggtattcacaaccctcggtccaagtatgcccagtacttgatggagatggagcgcaagcgtcaagaggaggccctctcacaggccttgcaaacgcagttgacgcctgttgtctga

SEQ ID NO: 39827 - protein, 309 aa, Penicillium chrysogenum
MPAKMPNYSSEMEGVDNHDNMTESGYVSAGSGSSEDYVPEIVFTKPHLQFLNRQLQFLEPQEILRWCITSLPHLFQTTAFGLTGLVTLDMLSKLEVPRPQMVDLVFLDTLYHFDETMSLVDRVRRRYPNNNVHIYKPAGVETTAEFEAKYGAKLWEVDDQLYDWVAKVEPAQRAYREMNVHAVLTGRRRSQGGKRGDLDIIEVDEAGLIKINPIANWSFDQVKQYVKENDVPYNELLDRGYKSIGDWHSTQPVAEGEDERSGRWKGQQKTECGIHNPRSKYAQYLMEMERKRQEEALSQALQTQLTPVV

SEQ ID NO: 39828 - DNA, 771 bp, Chromatium vinosum
  CDS (1)..(771)
atgactgaacgacgtcagccttccctatcgaccgacaccctgccgacccgtgaagccgccgcgatcgaactcctgtcccaggtctgccgcgagctggattccatcgtgttcgccaccagcctcggcgccgaagacatggtgctgaccgagatcatccggcgcgaacgcctgccgatccgcatcttcactctcgacaccggacggctgccgaccgagaccctggaactcatcgaggtggtcgaacgccactacgggacgcggatcgagcgctacgcgccgcacccggacgccatcgccgattatgtgagccgctacggtctcgacggtttctacgactcggtgcccgcgcgtcaggcctgctgccgggtgcgcaagctcgaacccctgaagcgtgccctggccggtcagtcggcctgggtcacgggtctgcgcgccgagcagtccgtcacccgcgccgagctgccggcgcgcgaatgggatgccgccaacggtctggagaagatcaacccgctcgccgactggagcgagcacgaggtctgggccttcatccggcaccatcgggtgccctacaacccgctgcacaaccagggttatcccagcatcggctgcgccccctgcacccgcgccatcacggtcggcgaggacgtgcgcgccgggcgctggtggtgggaaaaccccgagaccaaggaatgcggactacaccggcgtgagttcgcgccgcgccagccgtccgcccatccagcgatcgaacgcgacaggagcgccgcatga

SEQ ID NO: 39829 - protein, 256 aa, Chromatium vinosum
MTERRQPSLSTDTLPTREAAAIELLSQVCRELDSIVFATSLGAEDMVLTEIIRRERLPIRIFTLDTGRLPTETLELIEVVERHYGTRIERYAPHPDAIADYVSRYGLDGFYDSVPARQACCRVRKLEPLKRALAGQSAWVTGLRAEQSVTRAELPAREWDAANGLEKINPLADWSEHEVWAFIRHHRVPYNPLHNQGYPSIGCAPCTRAITVGEDVRAGRWWWENPETKECGLHRREFAPRQPSAHPAIERDRSAA

SEQ ID NO: 39830 - DNA, 900 bp, Aspergillus terreus
  CDS (1)..(900)
atgcccgcgaagatgcctgacaactaccccactgagtctgaggcctacgatgccaaagatactaccaccgaatccggatatgtcagtggtagctccagcgaggactatctcccggagattgtcttcaccaagcctcatctccagttcctcaaccgccagctgcagttcctcgagcctcaagatgtcctgagatggtgtgtcacatcactgcctcatctctttcagaccaccgccttcggtctgaccggcctggtcacgctggacatgctctccaagctggacgtgccccggccccaggtggtcgacctggtcttcctcgacaccctccaccacttcaaggagaccttggctctggttgacaaggtccgccagcgatacccgaacgtcaccatccacgtctacaagcccaagggcctggagacggaagaggaatttgccaagaagtacggtgcccgtctctgggagcgggatgaccagttctacgactgggtggccaaggtcgagccggctcagcgggcctaccgtgaactcaacgtccacgccgtgctgactggccgtcgtcgcagccagggtggcaagcggggagacctcgacatcatcgaagtcgacgaggctggtctcatcaagatcaacccgctggctaactggacctttgagcaggtcaaggcctacatcaaggagaacaacgtgccctacaacgagctccttgaccgcgggtacaagagcatcggggactaccactccacccagcccgtcagcgagaacgaggatgaacgctcgggccgctggaagggccaggagaagaccgagtgtggcatccacaaccctcgctccaagtacgcccagtacctgctggacatggagcgcaacggcaggaggaggctctctcacaggcgttga

SEQ ID NO: 39831 - protein, 299 aa, Aspergillus terreus
MPAKMPDNYPTESEAYDAKDTTTESGYVSGSSSEDYLPEIVFTKPHLQFLNRQLQFLEPQDVLRWCVTSLPHLFQTTAFGLTGLVTLDMLSKLDVPRPQVVDLVFLDTLHHFKETLALVDKVRQRYPNVTIHVYKPKGLETEEEFAKKYGARLWERDDQFYDWVAKVEPAQRAYRELNVHAVLTGRRRSQGGKRGDLDIIEVDEAGLIKINPLANWTFEQVKAYIKENNVPYNELLDRGYKSIGDYHSTQPVSENEDERSGRWKGQEKTECGIHNPRSKYAQYLLDMERNGRRRLSHRR

SEQ ID NO: 39832 - DNA, 753 bp, Burkholderia cepacia
  CDS (1)..(753)
atgagcaccgcgaccgccaccgcgctgacgccggaactcgccgcgaaggtcgagcgcctcgacgcgctgctcgcgcagatcggcgagcgtcacgacaaggtgaagttcgcgagcagcctcgccgcggaagacatgctgctcacgcacgcgatcctgtcgaagggcgtgccgatcggcatcttctcgctgaacacgggccgcctgcacgcggaaacgctcggcatgatcgaccgggtgcgcgagcgctacggctacgagatcgagcagttccatccgcagcaggacgcggtcgaccggtacgttgccgagcacggcctgaatgcgttctacgagagcgtcgagctgcgcaagtcgtgctgccacatccgcaaggtcgagccgctgaaccgtgcgctggccgacgtcggcgcgtgggtgacgggccagcgccgcgagcagtcggtcacgcgcgcggagctgcacgaggaagaacaggacgaagcgcgcgggatcgcgaagtacaacccgctcgccgactggacggaagccgacgtgtgggcgtaccttaaggcgtttgacgtgccggtcaatccgctgcatgcgcgcggctacccgagcatcggctgcgagccgtgtacgcgtgcgatccgccccggcgaggacagccgcgcgggccgctggtggtgggagtcgcgcgacacgaaggaatgcgggctgcacatcacgacgatcacgccgattcccgcgaatgccgaagccggcgccgcgcactga

SEQ ID NO: 39833 - protein, 250 aa, Burkholderia cepacia
MSTATATALTPELAAKVERLDALLAQIGERHDKVKFASSLAAEDMLLTHAILSKGVPIGIFSLNTGRLHAETLGMIDRVRERYGYEIEQFHPQQDAVDRYVAEHGLNAFYESVELRKSCCHIRKVEPLNRALADVGAWVTGQRREQSVTRAELHEEEQDEARGIAKYNPLADWTEADVWAYLKAFDVPVNPLHARGYPSIGCEPCTRAIRPGEDSRAGRWWWESRDTKECGLHITTITPIPANAEAGAAH

SEQ ID NO: 39834 - DNA, 1380 bp, Lemna minor
  CDS (1)..(1380)
atgtcggccgcagcagcaactatggcgggctcgctctcttcacacacgctctcctcccgcgaattttcaggaggattgcaggtcagctctacgagggtgaggaaattgcagaggggagcgtttgctccgatgcggcctctgtgtgcggtggatccagggaggaagagccagtcgccagtggcgccgctggccgccgtgccgtcgtccacctctgatgccgtgactcttgtccaagcagcagaaacgagcaccgttgacgtggttgattttgagaagctcgcgagcgagctagagcgcgcatcgcctctcgagattatggacaaggctctggagatgttcggtaacgatattgccatcgccttcagcggggcggaggacgttgctctgatcgagtacgcacgcctaaccggacgacctttcagggtgttcagtctcgacaccggcaggctaaacccagagacataccgattcttcgatgaagtagagaagcgctacaacatccgcatcgagtacatgttccccgacgcggtggaagtccaagccctcgtgcgaagcaaaggcctcttttccttctacgaggacgggcaccaggagtgctgcagagtgagaaaggtgaggccccttagaagagctctcagaggcctcagagcctggatcaccggccagcgcaaggaccagtctcccggcacccgagccagcgttcccaccgtccaggtggatccttcgttcgagggatttgaaggcggaacaggcagcttaatcaaatggaaccccgtggcgaacgtagacgggcaggatatctggagattcctgagaacgatggccgttccagtgaactccctccactcccaagggtacgtgtcaatcggctgcgagccatgcacgcggccggtcctaccaggacagcacgagagggaaggaaggtggtggtgggaggacgcgaaagccaaggaatgcgggctccacaagggcaacatcaagcaagacgagtccgtgcctccctccagcaacggcaacggcaccgcgccgtcggatctcttctccgtcgtttctctgagccggccaggcatggagaacttgctccgcctggagagccggaaggactcgtggcttgtcgtgctctatgctccctggtgccgcttctgccaggggatggaggagtcgttcaacgaggtggcaggagtactcggcggcgactcaggagtgaaggtgggcaaattcagagccgacggagacgcgagagctttcgcggaggagatcgggctggtgagttttcccaccatactcttcttcccgaagcacgcgtcgaaaccggtcaagtacccgtcggagcagagagacgtcgactctctgctcgccttcgtcaacgcccttcgctga

SEQ ID NO: 39835 - protein, 459 aa, Lemna minor
MSAAAATMAGSLSSHTLSSREFSGGLQVSSTRVRKLQRGAFAPMRPLCAVDPGRKSQSPVAPLAAVPSSTSDAVTLVQAAETSTVDVVDFEKLASELERASPLEIMDKALEMFGNDIAIAFSGAEDVALIEYARLTGRPFRVFSLDTGRLNPETYRFFDEVEKRYNIRIEYMFPDAVEVQALVRSKGLFSFYEDGHQECCRVRKVRPLRRALRGLRAWITGQRKDQSPGTRASVPTVQVDPSFEGFEGGTGSLIKWNPVANVDGQDIWRFLRTMAVPVNSLHSQGYVSIGCEPCTRPVLPGQHEREGRWWWEDAKAKECGLHKGNIKQDESVPPSSNGNGTAPSDLFSVVSLSRPGMENLLRLESRKDSWLVVLYAPWCRFCQGMEESFNEVAGVLGGDSGVKVGKFRADGDARAFAEEIGLVSFPTILFFPKHASKPVKYPSEQRDVDSLLAFVNALR

SEQ ID NO: 39836 - DNA, 1395 bp, Brassica juncea
  CDS (1)..(1395)
atggcactagcgatcaacgtttcttcatcttcttcttctgcgatctcaacctctagcttcccttcttcagagctcaaagtttcagctccacggatcggttcgttgaggttatcggatcgtgtcaatgtctcatcggtgtctctgagtctatccgggaaacgatcctcggtgaagcctctgaatgtgcagtcaattgcaaaggagtcgtttggttctatggtggcttctgaggttacagagaaacaagatgtggtggaagtggaagactttgaggagctagcaaagagtctagagactgcttctcctcttgagattatggacaaagctcttgagacattcggaaacgacatcgcaatcgcctttagtggagcagaagacgttgctctcatcgagtatgctcatcttactggaagacccttcagggttttcagtttggacacagggagattgaatcccgaaacatacagactctttgataccgtggagaagcactatggtattcgaattgagtatatgtttcccgatgctgttgaggttcaagctttggttaggaacaagggtttgttctctttctacgaagatggtcaccaagagtgttgccggatcagaaaggtgagacctttgaggcgtgcgttgaaggggttacgcgcttggatcactggacaaaggaaagatcaatcaccagggacaaggtctgagattcctgttgttcaagttgatccagtgtttgaagggttagatggtggagctggtagtttggtgaagtggaatccagttgcgaacgtcgagggaaacgatgtttggaacttcttgaggacaatggatgttcctgtgaacacccttcacgctgcggggtatgtttcaatcggatgtgagccgtgcacgagagcggttttgcctggtcagcacgagagagaagggagatggtggtgggaagatgctaaggctaaagagtgtggacttcacaaagggaatatcaaggagagtagcaacggaaacgctaccgctaatgtcaatggcacatcctccacggttgctgatatcttcaaaagcgagaatgttgtgagcttgagcaggcaagggatcgagaatctgatgaagctggagaatcgtaaagaggcttggatcgttgtgctttacgcaccttggtgcccgttttgtcaagcgatggaagcttcttttgatgagttggcggataagttgggtgggagtggcgtgaaggtggccaagtttagagctgatggtgaccaaaaggagtttgctaaaagggagctgcagcttgggagcttcccaacaatacttgtgttcccaaagaactcttcaagaccaatcaagtatccatcagagaagagagatgttgattctttgacatcgttcttgaaccttgttcggtga

SEQ ID NO: 39837 - protein, 464 aa, Brassica juncea
MALAINVSSSSSSAISTSSFPSSELKVSAPRIGSLRLSDRVNVSSVSLSLSGKRSSVKPLNVQSIAKESFGSMVASEVTEKQDVVEVEDFEELAKSLETASPLEIMDKALETFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKESSNGNATANVNGTSSTVADIFKSENVVSLSRQGIENLMKLENRKEAWIVVLYAPWCPFCQAMEASFDELADKLGGSGVKVAKFRADGDQKEFAKRELQLGSFPTILVFPKNSSRPIKYPSEKRDVDSLTSFLNLVR

SEQ ID NO: 39838 - DNA, 1365 bp, Brassica juncea
  CDS (1)..(1365)
atggccttagctgtcacttcttcttcaactgccatctctggatcaagtttctcacgctctggaccttgttctgatcgtaaagctcttcaaatctgttcgtttaggttatctgatctatcccatgtctctcaaagacgttactctctaaaggctgagtcaccacctacacgcaacgactctttggttacccgtgcttcgaccctaatcactcctggagtggaagagaaggaagaagacgttgaggatttcgagcaactcgcgaagaagctcgaagaggcttctccacttgaaatcatggacaaagctctccagagattcggaagcaacatcgcaattgctttcagtggtgcggaagatgttgcactgatcgaatacgctcggttaaccggaaggcccttcagggttttcagcttagacacagggaggttaaaccccgaaacctacaggctcttcgatgccgtggagaagcagtacgggatccgaatcgagtacacgttccctgatgcggtcgaggttcaagctttggtgaggaacaagggtttgttctctttctacgaggacggtcaccaggagtgttgccgtgtgaggaaagtaagacccttgcgccgcgctctcaagggtctcaaagcttggatcactggacagaggaaagatcagtctccagggacgagatcagagatcccgatcgttcaggtcgatccggtgtttgaagggttggatggtggtgttgggagtcttgtcaagtggaatcctttggctaatgtcgaaggtggtgatgtttggaacttcttgaggacgatggacgttccggtgaatgcattgcacgcgcaagggtatgtttctattgggtgtgagccgtgcactaggcccgtgcttccgggtcagcacgagagagaaggaaggtggtggtgggaagatgctaaagctaaagaatgtggtctgcacaaagggaacatcaagaaggaagatgactccaccaccgcggatttagcacctgctattgtgcatgatatcttcgaaagcagcaatgtggttgcattgagcagaggagggattgagaatctgttgaagcttggtaaccgcaaagagccgtggttggttgtgctttacgctccttggtgcccgttttgccaggccatggaagcttcctacgtcgaattggctgagaaactggcggtcaaagggattaaggtggccaagtttcgggctgatggtgaccagaaggagtttgccaagcaagagcttcaattaggaagcttcccgacgatacttctcttcccgaaaagcgctccgcgggcaattaagtacccgtcagagcatagagatgtggattcgcttatgtcatttgtcaatcttctccggtga

SEQ ID NO: 39839 - protein, 454 aa, Brassica juncea
MALAVTSSSTAISGSSFSRSGPCSDRKALQICSFRLSDLSHVSQRRYSLKAESPPTRNDSLVTRASTLITPGVEEKEEDVEDFEQLAKKLEEASPLEIMDKALQRFGSNIAIAFSGAEDVALIEYARLTGRPFRVFSLDTGRLNPETYRLFDAVEKQYGIRIEYTFPDAVEVQALVRNKGLFSFYEDGHQECCRVRKVRPLRRALKGLKAWITGQRKDQSPGTRSEIPIVQVDPVFEGLDGGVGSLVKWNPLANVEGGDVWNFLRTMDVPVNALHAQGYVSIGCEPCTRPVLPGQHEREGRWWWEDAKAKECGLHKGNIKKEDDSTTADLAPAIVHDIFESSNVVALSRGGIENLLKLGNRKEPWLVVLYAPWCPFCQAMEASYVELAEKLAVKGIKVAKFRADGDQKEFAKQELQLGSFPTILLFPKSAPRAIKYPSEHRDVDSLMSFVNLLR

SEQ ID NO: 39840 - DNA, 1398 bp, Arabidopsis thaliana
  CDS (1)..(1398)
atggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatggaattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataa

SEQ ID NO: 39841 - protein, 465 aa, Arabidopsis thaliana
MAMSVNVSSSSSSGIINSRFGVSLEPKVSQIGSLRLLDRVHVAPVSLNLSGKRSSSVKPLNAEPKTKDSMIPLAATMVAEIAEEVEVVEIEDFEELAKKLENASPLEIMDKALEKYGNDIAIAFSGAEDVALIEYAHLTGRPFRVFSLDTGRLNPETYRFFDAVEKHYGIRIEYMFPDSVEVQGLVRSKGLFSFYEDGHQECCRVRKVRPLRRALKGLKAWITGQRKDQSPGTRSEIPVVQVDPVFEGLDGGVGSLVKWNPVANVEGNDVWNFLRTMDVPVNTLHAAGYISIGCEPCTKAVLPGQHEREGRWWWEDAKAKECGLHKGNVKENSDDAKVNGESKSAVADIFKSENLVTLSRQGIENLMKLENRKEPWIVVLYAPWCPFCQAMEASYDELADKLAGSGIKVAKFRADGDQKEFAKQELQLGSFPTILVFPKNSSRPIKYPSEKRDVESLTSFLNLVR

SEQ ID NO: 39842 - DNA, 1365 bp, Arabidopsis thaliana
  CDS (1)..(1365)
atggctttagctgttacttcttcttcaactgcaatctctggatcgagtttctctcgttctggagcttcttctgaatctaaagctcttcaaatatgttcgattaggttatctgatcgaacccatttgtctcagagacgttactctatgaaacctttaaacgctgagtcacattcacgaagcgaatcttgggttactcgtgcttcaactctaattgctcctgaagttgaagagaaaggaggagaagttgaagactttgagcaacttgctaaaaagcttgaagatgcttctccacttgaaatcatggataaagctcttgagagattcggagaccaaatcgcaattgcttttagtggagctgaagatgttgcattgattgaatatgcacgtttaactggaaagccatttagggtttttagtttagatacagggagattaaaccctgaaacgtacaggctctttgacgcagtcgagaagcagtacgggattcgaattgagtacatgtttcctgatgcagttgaggttcaagctttagtgaggaacaagggtttgttctcattctatgaagatggtcatcaagagtgttgccgtgtgaggaaagttagacctttgcgtcgtgctcttaagggtcttaaagcttggattacaggacagaggaaagaccaatctccgggtacgagatctgagatccctattgttcaggttgatccagtgtttgaagggttagatggcggtgttggaagtcttgtgaagtggaatcctttggctaatgttgaaggagctgatgtgtggaactttctgagaactatggatgttccggtgaatgcattgcacgcacaagggtatgtgtcaatcgggtgtgagccgtgtactaggccggtgcttccaggccaacatgagagagaaggaaggtggtggtgggaagatgctaaagctaaagaatgtggtctacacaaagggaacatcaaggaggaagatggtgctgcagactcaaagcctgctgctgtgcaagagatatttgaaagcaacaatgtggttgcattgagcaaaggaggggttgagaatcttttgaagctagagaaccgtaaagaggcgtggttggtcgtactttacgctccttggtgccctttctgccaggcgatggaagcatcgtacatcgaattggctgagaaacttgcgggaaaaggagttaaagtggcgaaattccgagctgacggtgagcagaaggagtttgctaagcaagagcttcagttagggagcttcccgacgatacttctctttccgaaaagagctccacgggctattaagtacccttcagagcatagagatgttgattcactcatgtcgtttgtgaatcttcttcggtag

SEQ ID NO: 39843 - protein, 454 aa, Arabidopsis thaliana
MALAVTSSSTAISGSSFSRSGASSESKALQICSIRLSDRTHLSQRRYSMKPLNAESHSRSESWVTRASTLIAPEVEEKGGEVEDFEQLAKKLEDASPLEIMDKALERFGDQIAIAFSGAEDVALIEYARLTGKPFRVFSLDTGRLNPETYRLFDAVEKQYGIRIEYMFPDAVEVQALVRNKGLFSFYEDGHQECCRVRKVRPLRRALKGLKAWITGQRKDQSPGTRSEIPIVQVDPVFEGLDGGVGSLVKWNPLANVEGADVWNFLRTMDVPVNALHAQGYVSIGCEPCTRPVLPGQHEREGRWWWEDAKAKECGLHKGNIKEEDGAADSKPAAVQEIFESNNVVALSKGGVENLLKLENRKEAWLVVLYAPWCPFCQAMEASYIELAEKLAGKGVKVAKFRADGEQKEFAKQELQLGSFPTILLFPKRAPRAIKYPSEHRDVDSLMSFVNLLR

SEQ ID NO: 39844 - DNA, 1737 bp, Arabidopsis thaliana
  CDS (85)..(1461)
gagaacacaaaattagaaaaaacacaacacaaaaataaaaaaaacttaagaacattgtttcgagagatttggtttggagtgaaaatggcactagcaatcaacgtttcttcatcttcttcttctgcgatctcaagctctagcttcccttcttcagatctcaaagtaacaaaaatcggatcattgaggttattgaatcgtaccaatgtctctgcggcttctctgagtttgtccgggaagagatcctccgtgaaagctcttaatgtgcaatcaattacaaaggaatccattgttgcttctgaggttacagagaagctagatgtggtggaagttgaagactttgaggaactagcaaagagattagagaatgcttctcctcttgagatcatggataaagctcttgagaagtttgggaatgacattgctattgcctttagtggagctgaagatgttgctctgattgagtatgctcatttaactggaagaccttatagggtattcagtttggatacagggagattgaatccagaaacatatagactcttcgataccgtggagaaacattacggtattcggattgagtatatgtttcctgatgctgttgaggttcaagctttagttaggaacaagggtttgttctctttctatgaagatggtcaccaggagtgttgccgtattagaaaggtgagacctttgaggcgtgcgttgaagggtttacgtgcttggatcactggtcagaggaaagatcaatcacccgggacaagatcggagattcctgttgttcaggttgatccagtgtttgaaggattagatggtggagttggtagtttggtgaagtggaatccggttgctaatgttgaagggaatgatgtttggaatttcttgaggacgatggatgttcctgtcaacacgcttcacgctgcgggttatgtttcaatcggatgtgagccatgcacgagagcggttttgccgggtcagcatgagagagaagggagatggtggtgggaagatgctaaggctaaagagtgtggccttcacaaagggaatatcaaggagaataccaatggaaacgcaaccgctaatgtcaacgggacagcctcagtcgcggatatcttcaatagcgagaatgttgtgaacttgagcaggcaagggattgagaatttgatgaagttagagaaccggaaagaggcttggatcgttgtgctttatgcaccgtggtgcccgttttgtcaggcaatggaagcttcattcgatgaattggcggataagctgggaggaagtggtgtgaaggttgctaagtttagagctgatggtgaccagaaggactttgccaaaaaggagttgcagcttggaagctttccaacaatacttgtgttcccaaagaactcttcaagaccaatcaagtatccatcagagaagagagatgttgattctttgacatctttcttgaatcttgttcggtaaatccgcaataaaatccgccgactctacgatgacgaagagatcaataatagaccatccagtctcgttccagattgctagaacagatgaagaaggtgaagatgagaatctctatttggagctttagccttttgtatagctgtggttaaaaataattacgccaaggttttgccttttgtgagtttatttttaccaattttcagtgtattactccttttttgcctttgtgatggatatgaacaagtttgatatgaaagtgactcattactcattagcccc

SEQ ID NO: 39845 - protein, 458 aa, Arabidopsis thaliana
MALAINVSSSSSSAISSSSFPSSDLKVTKIGSLRLLNRTNVSAASLSLSGKRSSVKALNVQSITKESIVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWNFLRTMDVPVNTLHAAGYVSIGCEPCTRAVLPGQHEREGRWWWEDAKAKECGLHKGNIKENTNGNATANVNGTASVADIFNSENVVNLSRQGIENLMKLENRKEAWIVVLYAPWCPFCQAMEASFDELADKLGGSGVKVAKFRADGDQKDFAKKELQLGSFPTILVFPKNSSRPIKYPSEKRDVDSLTSFLNLVR

SEQ ID NO: 39846 - DNA, 918 bp, Pseudomonas aeruginosa
  CDS (1)..(918)
atggtcgacaaactgacgcacctgaaacagctggaggcggaaagcatccacatcatccgcgaggtggccgccgagttcgataacccggtgatgctgtactcgatcggcaaggattccgcggtcatgctgcacctggcccgcaaggccttcttccccggcaagctgcccttcccggtgatgcacgtggacacccgctggaaattccaggagatgtacaggttccgtgatcggatggtcgaggaaatgggcctggatctgatcacccacgtcaacccggacggcgtcgcccagggcatcaacccgttcacccacggcagcgccaagcacaccgacgtgatgaagaccgagggactcaagcaggccctggacaagtacggtttcgacgctgccttcggcggtgcgcgccgcgacgaggagaagtcgcgggccaaggaacgggtctattcgttccgcgacagcaagcaccgctgggacccgaagaaccagcgtcccgagctgtggaacatctacaacggcaaggtgaagaagggcgagtcgatccgcgtcttcccgctgtccaactggaccgagctggacatctggcaatacatctacctggaaggcatcccgatcgtcccgctgtacttcgccgccgagcgcgaggtcatcgagaagaatggcacattgatcatgatcgacgacgagcgcatcctcgagcatctctctgacgaagagaaagcccgcatcgagaagcgcatggtgcgcttccgtaccctcggctgctacccgctcaccggcgcggtcgagtccagcgccaccacgctgccggaaatcatccaggaaatgctcctgacgcgtacttccgaacgccagggccgggtcatcgaccatgaccaggccggttcgatggaagaaaagaaacgtcagggctatttctga

SEQ ID NO: 39847 - protein, 305 aa, Pseudomonas aeruginosa
MVDKLTHLKQLEAESIHIIREVAAEFDNPVMLYSIGKDSAVMLHLARKAFFPGKLPFPVMHVDTRWKFQEMYRFRDRMVEEMGLDLITHVNPDGVAQGINPFTHGSAKHTDVMKTEGLKQALDKYGFDAAFGGARRDEEKSRAKERVYSFRDSKHRWDPKNQRPELWNIYNGKVKKGESIRVFPLSNWTELDIWQYIYLEGIPIVPLYFAAEREVIEKNGTLIMIDDERILEHLSDEEKARIEKRMVRFRTLGCYPLTGAVESSATTLPEIIQEMLLTRTSERQGRVIDHDQAGSMEEKKRQGYF

SEQ ID NO: 39848 - DNA, 918 bp, Pseudomonas putida
  CDS (1)..(918)
atggtcgacaaactgacgcacttgaaacagctggaggcggagagcatccacatcatccgcgaggtggccgccgagttcgacaacccggtgatgctgtactcgatcggcaaggactccgccgtgatgctgcacctggcgcgcaaggccttcttcccgggcaagctgccgttcccggtgatgcacgtcgacacccagtggaaattccaggagatgtacagcttccgcgacaagatggtcgaggaaatgggcctggagctgatcacccacgtcaaccccgagggtgtggcgcaaggtatcaacccgttcacccatggcagttccaagcacaccgacatcatgaagacccaaggcctgaagcaggcgctggacaagcatggtttcgacgctgccttcggtggtgcgcgccgcgacgaagagaagtcgcgggccaaggaacgtgtgtattcgttccgtgacagcaagcaccgctgggacccgaagaaccagcgccccgagctgtggaacgtgtacaacggaaaggtcaacaagggcgagtcgatccgcgtcttcccgctgtcgaactggaccgaactggacatctggcagtacatctaccttgaaggcatcccgatcgtgccgctgtacttcgccgccgagcgtgaagtcatcgagaagaacggcaccctgatcatgatcgacgacgaacgcatcctcgagcacctctccgaggaagaaaaagcccgcatcgtcaagaagaaggtgcgtttccgtaccctcggctgctacccgctgacgggcgctgtcgagtcggaagccgagacgctcaccgacatcattcaggaaatgctcctgacgcgcacttccgagcgccagggccgggtcatcgaccacgatggcgccggttccatggaagacaaaaaacgtcagggctacttctaa

SEQ ID NO: 39849 - protein, 305 aa, Pseudomonas putida
MVDKLTHLKQLEAESIHIIREVAAEFDNPVMLYSIGKDSAVMLHLARKAFFPGKLPFPVMHVDTQWKFQEMYSFRDKMVEEMGLELITHVNPEGVAQGINPFTHGSSKHTDIMKTQGLKQALDKHGFDAAFGGARRDEEKSRAKERVYSFRDSKHRWDPKNQRPELWNVYNGKVNKGESIRVFPLSNWTELDIWQYIYLEGIPIVPLYFAAEREVIEKNGTLIMIDDERILEHLSEEEKARIVKKKVRFRTLGCYPLTGAVESEAETLTDIIQEMLLTRTSERQGRVIDHDGAGSMEDKKRQGYF

SEQ ID NO: 39850 - DNA, 918 bp, Pseudomonas syringae
  CDS (1)..(918)
atggttgacaaactgacgcatctgaaacagctggaggcggaaagcatccacatcatccgcgaggtcgccgccgagttcgataacccggtgatgctgtactcgatcggcaaggattcggccgtgatgctgcacctggcgcgcaaggctttcttccccggcaaactgccattccctgtgatgcatgtcgatacccgctggaaattccaggagatgtatcgctttcgcgaccagatggtcgaggaaatgggccttgacctgatcactcacatcaaccccgatggcgtggcgcagggcatcaaccctttcacccacggcagcgccaaacacaccgacatcatgaagaccgagggcctgaaacaggcgctcgacaagcatggtttcgatgccgctttcggcggcgcccgacgcgacgaagaaaagtcccgggccaaggaacgcgtgtactcgttccgcgacagcaaacaccgctgggacccgaaaaatcagcgtcccgagctgtggaatgtctataacggcaacgtcaacaagggcgagtcgatccgcgtgttcccgttgtccaactggaccgagctggacatctggcagtacatctaccttgaaggcatcccgatcgtgccgctgtatttcgccgccgagcgcgacgtaatcgagaagaacggcacgctgatcatgattgacgacgagcgcatcctcgagcatctcaccgacgaagaaaagtcgcgcatcgtcaagaaaaaggtccgtttccgtaccctcggctgctacccgctgaccggtgctgtcgagtccgaagcgaccagcctgaccgacatcattcaggaaatgctgctgacgcgaacttccgaacgccagggccgggtcatcgaccacgacggtgcaggctcgatggaagaaaagaaacgtcagggttatttctaa

SEQ ID NO: 39851 - protein, 305 aa, Pseudomonas syringae
MVDKLTHLKQLEAESIHIIREVAAEFDNPVMLYSIGKDSAVMLHLARKAFFPGKLPFPVMHVDTRWKFQEMYRFRDQMVEEMGLDLITHINPDGVAQGINPFTHGSAKHTDIMKTEGLKQALDKHGFDAAFGGARRDEEKSRAKERVYSFRDSKHRWDPKNQRPELWNVYNGNVNKGESIRVFPLSNWTELDIWQYIYLEGIPIVPLYFAAERDVIEKNGTLIMIDDERILEHLTDEEKSRIVKKKVRFRTLGCYPLTGAVESEATSLTDIIQEMLLTRTSERQGRVIDHDGAGSMEEKKRQGYF

SEQ ID NO: 39852 - DNA, 702 bp, Bacillus subtilis
  CDS (1)..(702)
atgttaacgtatgataattgggaagaaccaacgattacatttccggaagacgatccttataaaggagcgctgtcagttttaaaatgggcatacggccattacggcgatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagatctcacccttgaggaacaagccgaagaacatggtgacaaactatgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatatacatcccggaatgaactggactacaatccgcttcatgaccaaggctatccaagtattggctgtgcgccttgcacttctcccgcttttacagcagaagatttgcgctcaggcagatggaatggtatggcgaaaacagaatgcggactgcatgaataa

SEQ ID NO: 39853 - protein, 233 aa, Bacillus subtilis
MLTYDNWEEPTITFPEDDPYKGALSVLKWAYGHYGDQLVYACSFGIEGIVLIDLIYKVKKDAEIVFLDTGLHFKETYETIERVKERYPGLNIILKKPDLTLEEQAEEHGDKLWEREPNQCCYLRKVVPLREALSGHPAWLSGLRRDQGPSRANTNFLNKDEKFKSVKVCPLIHWTWKDIWRYTSRNELDYNPLHDQGYPSIGCAPCTSPAFTAEDLRSGRWNGMAKTECGLHE

SEQ ID NO: 39854 - DNA, 711 bp, Bacillus subtilis
  CDS (1)..(711)
atgaacgaaaccatcacatatgacacttggaacgacatgctgtccaaacagataacggatcaattgatcgatgagctcgatgtgttgaaatgggcttaccgaacgtacggagaaaagattgtgtacgcctgcagctttggcgcagaaggaatggtgcttctcgacttaatatcaaaaatcaacaaaaacgcacacatcatctttttggataccgggcttcattttcaggaaacatatgagctgatcgagaccgtcaaagaacgatatccgggatttgcaatccagatgctcgaacccgagctgagcttaacagaacaggggacgaagtacggcggagagctgtggaagcataacccgaacctctgctgccaattgcggaaaatcgaaccgctcaaaaagcacctgtccggcatgacagcttggatttcaggactgcgccgggatcagtcaccaacgagaaagcatattcaatacgtaaacctggaccagaagtttgagctcatcaaaatttgcccgcttatccactggacatgggatgacgtttggacgtacatccgcctgcacaatttgccttataacaaactgcacgatcaacattatccgagcataggctgtgaaatgtgtacactgccttccccggacccgaacgatgagagggctggaagatgggccggacgggagaaaacagaatgcggcctgcatcaagaatag

SEQ ID NO: 39855 - protein, 236 aa, Bacillus subtilis
MNETITYDTWNDMLSKQITDQLIDELDVLKWAYRTYGEKIVYACSFGAEGMVLLDLISKINKNAHIIFLDTGLHFQETYELIETVKERYPGFAIQMLEPELSLTEQGTKYGGELWKHNPNLCCQLRKIEPLKKHLSGMTAWISGLRRDQSPTRKHIQYVNLDQKFELIKICPLIHWTWDDVWTYIRLHNLPYNKLHDQHYPSIGCEMCTLPSPDPNDERAGRWAGREKTECGLHQE

SEQ ID NO: 39856 - DNA, 783 bp, Agrobacterium tumefaciens
  CDS (1)..(783)
atggaaatcccggacgtgacaatgaccatcaattcaacaaatgcttctgccgataccgcatccctcgacgccacgcttgccgggctcgatcttgccggacgtctttctttcgttgccggcctcggcgggcgcgcggtcttcaccaccagcctcggcatcgaggatcaggtcatcaccgccgccatcggtacgcatcgtctgccgattgacgtcgtgacgctggaaaccgggcggctgttcaaggagacagtcgatctcatcgatgaaaccgaagaacgtttcggcatcgaaatccgccgcttccgtcccgaacaagacgatatcgacgcctatgcagcgaagtatggtctcaacggcttttacgagagcgtcgaagcccgccacgcctgctgtcatgtcagaaagctgatcccgcttggcaaggcactggagggtgcagctttctggatcaccgggctccgtcgcggccagtccggcaatcgcgccgcgaccccattcgccgagttcgacgctgagcgtaatcttatcaagatcaatgctttggccgactgggacatcgaacagatcagggcctatgtcgccgaggaaaacatccccgtcaacccgttgcatcagcgcggttacccctccatcggctgcgagccgtgtacgcgcgccatcaagcccggcgagcctgagcgcgccggacgatggtggtgggagaacgacgagaagcgcgaatgcggtcttcacgtcgccggtgcggagcagacaccccccgtttccgccatcccgcaacgataa

SEQ ID NO: 39857 - protein, 260 aa, Agrobacterium tumefaciens
MEIPDVTMTINSTNASADTASLDATLAGLDLAGRLSFVAGLGGRAVFTTSLGIEDQVITAAIGTHRLPIDVVTLETGRLFKETVDLIDETEERFGIEIRRFRPEQDDIDAYAAKYGLNGFYESVEARHACCHVRKLIPLGKALEGAAFWITGLRRGQSGNRAATPFAEFDAERNLIKINALADWDIEQIRAYVAEENIPVNPLHQRGYPSIGCEPCTRAIKPGEPERAGRWWWENDEKRECGLHVAGAEQTPPVSAIPQR

SEQ ID NO: 39858 - DNA, 681 bp, Bacillus anthracis
  CDS (1)..(681)
atgttgacgtatgaaacgtgggaagaaaatgaaacgaaaggcgcgctatcagtattaagttgggcgtataaagaatataaaagtgaaattgtatacgcatgtagcttcggagtggaagggatggtactactggatcttattaaccaagtaaatccatctgctaaagttgtatttttggatacaaacgtacattttcaagaaacgtatgaattaattcaaaaagtgcgggaacgatttccttcattgaatattatagaaaaacagccaaaacttacacttgatgaacaagacaaattgcatggtgacaagctatgggaaagcaatcctaatctctgttgtaagattagaaaaattttaccgttagaagaatcattagcgaatgaaaaagcgtggatatcagggttgaggagagaacaatcagaaacgcgtaagcatacaaagtttataaatcaagatcatcgttttcaatctattaaagtttgtccgctcattcattggacgtggaaagaagtatggcgatatgtatacaagcatagcttgccgtataactcattacatgatattggatatccaagtattgggtgtgagaagtgtacgttgcctgtaggagagggtggcgattcgagagatggtagatgggctgggaaagtgaaaactgaatgtggtcttcattatcaataa

SEQ ID NO: 39859 - protein, 226 aa, Bacillus anthracis
MLTYETWEENETKGALSVLSWAYKEYKSEIVYACSFGVEGMVLLDLINQVNPSAKVVFLDTNVHFQETYELIQKVRERFPSLNIIEKQPKLTLDEQDKLHGDKLWESNPNLCCKIRKILPLEESLANEKAWISGLRREQSETRKHTKFINQDHRFQSIKVCPLIHWTWKEVWRYVYKHSLPYNSLHDIGYPSIGCEKCTLPVGEGGDSRDGRWAGKVKTECGLHYQ

SEQ ID NO: 39860 - DNA, 705 bp, Bacillus cereus
  CDS (1)..(705)
atgttgacgtatgaaacgtgggaagaaaatgttgtttcgttttcggaagaagatgaaacaaaaggtgcgttatcagtattaaattgggcttataaagaatataaagatgaggttgtctacgcatgtagctttggggtggaaggtatggtattgctgcacattataaaccaagtaaatccatctgctaaagttgtatttttggatacaaatgttcattttcaagaaacgtatgaattaattcgaaaagtgcgggaacgatttccttcattgaatattatagaaaaacagccagaacttacacttgatgaacaggcgaagttgcatggtgaaaaactgtgggagagcaatccgaatctttgttgtaagattagaaaaattttacctttagaaaaatcattagtcgtggaaaaagcatggatatcgggcttaagaagggaacaatcagaaacacgtaagcatacaaagtttataaatcaagatcatcgttttcaatctattaaagtttgtccactcattcattggacgtggaaagaagtttggcgatatgtatacaaacatagcttgccgtataacccgttgcatgatgttggctatccaagtattgggtgtgagaaatgtacgttacctgtaggggatggtggcgattcaagagatggtagatgggctggaaaagtgaaaactgaatgtggtcttcattaccaataa

SEQ ID NO: 39861 - protein, 234 aa, Bacillus cereus
MLTYETWEENVVSFSEEDETKGALSVLNWAYKEYKDEVVYACSFGVEGMVLLHIINQVNPSAKVVFLDTNVHFQETYELIRKVRERFPSLNIIEKQPELTLDEQAKLHGEKLWESNPNLCCKIRKILPLEKSLVVEKAWISGLRREQSETRKHTKFINQDHRFQSIKVCPLIHWTWKEVWRYVYKHSLPYNPLHDVGYPSIGCEKCTLPVGDGGDSRDGRWAGKVKTECGLHYQ

SEQ ID NO: 39862 - DNA, 696 bp, Bacillus halodurans
  CDS (1)..(696)
atggaccaatcaatccaagtgaatataaacgaagtcaatcaagccttggagcgtaaagatagcctcgatgtgattaagtgggcgtacaaaacatatggagataagctcgtgtacgcctgtagcatgggggcggaaggaatggttctaatcgatcttattagtaaagtgaggcccgacgctccagtcatttttctcgatacagattttcatttttcagaaacatatgaattgattgaacgggtcaaggagcggtacccgaagcttcagctgaagttagtgaagccggaacttacacctgaggagcaagcagaaacatacggtgatcgcctgtgggaacgtcaaccagacctttgctgtaagttgcggaagctcgtcccgttggagaaggaacttgcccaatacgacgcatggatgtcagggctacgccgagatcaatcaccgactcgaacaaatactcaatttgtgaatgaggatcgccgctttggttcaacgaaaatttgtcctttaatccattggaccagtgaggaaatttggatgtatatcgagcttcatcaattaccgtataatgaccttcatgataagcagtatccaagtatcggctgcgagtattgcacgcgtcctgtaaaagaaggagaagatgaacgagcaggtcgctggtccaacacatcaaaaacagagtgtggattgcaccaataa

SEQ ID NO: 39863 - protein, 231 aa, Bacillus halodurans
MDQSIQVNINEVNQALERKDSLDVIKWAYKTYGDKLVYACSMGAEGMVLIDLISKVRPDAPVIFLDTDFHFSETYELIERVKERYPKLQLKLVKPELTPEEQAETYGDRLWERQPDLCCKLRKLVPLEKELAQYDAWMSGLRRDQSPTRTNTQFVNEDRRFGSTKICPLIHWTSEEIWMYIELHQLPYNDLHDKQYPSIGCEYCTRPVKEGEDERAGRWSNTSKTECGLHQ

SEQ ID NO: 39864 - DNA, 735 bp, Buchnera aphidicola
  CDS (1)..(735)
atgtctaaattctatattgaaaatattaatctgttaaattctgaaaaaaaaaataatatactttctgaattaaatttacttctatccaattattctgcagaagaacgtatttcttgggcattaagccatttaccccatacacaaatcatgtcatcaagcttcggtattcagtcaacagtattattacatcttataatcaaaaaaaaaccggatattcctgttatattaattgatacaggttatttgtttcctgaaacatataattttattgattttttaactaataaatttcatttgaatttgaaagtttttagatcaacaatatcttctgcgtggcaggaagcgcgatatgggaagttatgggaaaaaggtattgaaggaattgatttttataataatattaataaagtacagcccatgaattttgctttgaatgaactatcagtacaaacatggtttgctggattgcgtcatgatcaatcaaaaagtcgaaatttattaccatatctttctattaaaaaaggaatatttaaaattttaccaatactagattggtctaaggataaaataaaagactatttaaaagaaaataatttagatacccatcctttatataataatggatattcgtctgtaggagatacacacactactaaaaaacacatgcctggtatgttagaggaagaaactcgtttttttggattaaaacgcgaatgtggtttacatgaaaattaa

SEQ ID NO: 39865 - protein, 244 aa, Buchnera aphidicola
MSKFYIENINLLNSEKKNNILSELNLLLSNYSAEERISWALSHLPHTQIMSSSFGIQSTVLLHLIIKKKPDIPVILIDTGYLFPETYNFIDFLTNKFHLNLKVFRSTISSAWQEARYGKLWEKGIEGIDFYNNINKVQPMNFALNELSVQTWFAGLRHDQSKSRNLLPYLSIKKGIFKILPILDWSKDKIKDYLKENNLDTHPLYNNGYSSVGDTHTTKKHMPGMLEEETRFFGLKRECGLHEN

SEQ ID NO: 39866 - DNA, 768 bp, Deinococcus radiodurans
  CDS (1)..(768)
gtgatgaccgctgaagtaagaactcccgaacagggcggcgggcctctaacgactgagccgcgcgcgccccgcagcgcaccgggacatgccgacgcttcggcccccgcttttggccccgaaaccgacccgcgcgacatcatccgctgggcgctggccgcgcaccccgacctgctgatgccgagtgcgttcaacctcaacggcgtggtgctgctcgacctcgcggcgcaggcgggctaccggggcgaagtcgtctttgtggacaccggctaccactttcccgaaacgctggcgacccgtgaccggctggaaagccgctaccctgagctgaccttcgtgaccctgaacgcgggcgcctcgccggatgacggacagacgccccccgatctctacgccagcgaccccgatgcctgttgcgcggcccgcaaggtggaccccttgcagcgctacttgaaggagcaaggtccctcggcgctcctcaacgcccgcagccgcgatcaggcgagcacccgcgccgacatcccctttgtggaggaaggcggcgcccggcgccgggtcaacccgctggcccactggacccgcgagcagctcgaggcctacgccgccgagcacgacctgccggtcaacccgctgtacttcgacggctttctgagcatcggctgctggccctgcacccgcgccgtgaaacccggcgaagatgcccgcgccggacgctgggcaggcaaaggcaagaccgaatgcggactgtggcagggcgagaacaagttgtaa

SEQ ID NO: 39867 - protein, 255 aa, Deinococcus radiodurans
MMTAEVRTPEQGGGPLTTEPRAPRSAPGHADASAPAFGPETDPRDIIRWALAAHPDLLMPSAFNLNGVVLLDLAAQAGYRGEVVFVDTGYHFPETLATRDRLESRYPELTFVTLNAGASPDDGQTPPDLYASDPDACCAARKVDPLQRYLKEQGPSALLNARSRDQASTRADIPFVEEGGARRRVNPLAHWTREQLEAYAAEHDLPVNPLYFDGFLSIGCWPCTRAVKPGEDARAGRWAGKGKTECGLWQGENKL

SEQ ID NO: 39868 - DNA, 765 bp, Mycobacterium bovis
  CDS (1)..(765)
atgagcggcgagacaaccaggctgaccgaaccgcaactacgtgagctggccgcgcgcggagctgccgaactcgacggcgccaccgccaccgacatgttgcgctggaccgacgaaaccttcggcgacatcggcggcgccggcggcggcgtgagcggacatcgcgggtggacaacgtgcaactacgtagttgcttccaacatggctgatgcggtgctggtggatctggccgccaaggtgcgaccgggcgtaccggtcatctttcttgataccggctaccacttcgtcgaaacaatcggcaccagagatgcgatcgagtccgtctatgacgtccgggtgctcaatgtcactccggagcacacagtggccgagcaggacgaactgctgggcaaggacttgttcgcccgcaacccccatgaatgctgccggttgcgcaaggtcgttcccctgggcaagacgctgcgtggctactccgcgtgggtgaccgggctacggcgggtcgatgcaccgacccgggccaatgccccgctggtcagcttcgatgagacgttcaaactagtgaaggtcaacccgctggcggcgtggaccgaccaagatgtgcaggaatacattgccgacaacgacgtgctggttaatccgcttgtgcgggaaggctatccgtcgatcggttgcgctccgtgcacagccaaacccgccgaaggcgccgacccgcgcagcggacgctggcaggggctggccaagaccgaatgcgggttgcacgcctcgtga

SEQ ID NO: 39869 - protein, 254 aa, Mycobacterium bovis
MSGETTRLTEPQLRELAARGAAELDGATATDMLRWTDETFGDIGGAGGGVSGHRGWTTCNYVVASNMADAVLVDLAAKVRPGVPVIFLDTGYHFVETIGTRDAIESVYDVRVLNVTPEHTVAEQDELLGKDLFARNPHECCRLRKVVPLGKTLRGYSAWVTGLRRVDAPTRANAPLVSFDETFKLVKVNPLAAWTDQDVQEYIADNDVLVNPLVREGYPSIGCAPCTAKPAEGADPRSGRWQGLAKTECGLHAS

SEQ ID NO: 39870 - DNA, 735 bp, Neisseria meningitidis
  CDS (1)..(735)
atgaaaattttcaaacctgctttatggaaaattccgccgattgaaaatggcagtgaaacggctttggcggaaaaaacggaaaccctcaaacaacgcctgcaccggattgccggcagccaccgggatgcacggtttgccagcagccttgctgcggaagatatggtaattaccgaccttatcgccggagaaaacctcaatatcggtatttttactttggatacggggctgctgcacgcggaaactttaaacctgttggataggattgaacgtgtttatccgcatatgcaaatcaagcgtttccaaccgatacgggaagatgccctgcattatgtggaaagcaaaggcaggtttgccttttacgacagcgttgaagcgcgccgcgaatgctgccgcatccgaaaaaccgaaccgctcgaccgcgccattgccggggcggatgcttggcttaccgggcaacgccgcgaacagtccgccacacgcacggaactgccgtttgccgaatatgatgccgggcgcggcatcgataaatacaacccgattttcgactggtcggaacacgacgtgtgggcatacatccttgccaacaatgtgccttacaacgatttgtaccggcaaggctttcccagtataggctgcgacccctgcacccgccccgtcaaggccggcgaagacatccgcgccgggcggtggtggtgggaagataaaaacagcaaagaatgcgggctgcacaaataa

SEQ ID NO: 39871 - protein, 244 aa, Neisseria meningitidis
MKIFKPALWKIPPIENGSETALAEKTETLKQRLHRIAGSHRDARFASSLAAEDMVITDLIAGENLNIGIFTLDTGLLHAETLNLLDRIERVYPHMQIKRFQPIREDALHYVESKGRFAFYDSVEARRECCRIRKTEPLDRAIAGADAWLTGQRREQSATRTELPFAEYDAGRGIDKYNPIFDWSEHDVWAYILANNVPYNDLYRQGFPSIGCDPCTRPVKAGEDIRAGRWWWEDKNSKECGLHK

SEQ ID NO: 39872 - DNA, 741 bp, Neisseria meningitidis
  CDS (1)..(741)
atggaaacgacactgttcaaacccgccctgtggcagataccgcatatcggatccggcggcgaaaccgcccttgcggaaaaaacggaaaccctcaaacaacgcctgcaccggattgtcggcagccaccgggatgcacggtttgccagcagccttgcggcagaagatatggtgattaccgaccttatcgccggcgaaaacctcaatatcggcatttttaccttggatacggggctgctccacacggaaaccctgaacctgctggacaggctcggacgcgcatatccccatttgcggataaagcgtttccggccggttcgagaagatgccgaccgttatgtggaaagcaaaggcaggtttgccttttacgacagcgttgaagcgcgccgcgaatgctgccgcatccgaaaaaccgaaccgctcaaccgcgccattgcaggcgcggacgcctggcttaccgggcaacgccgcgaacaatccgccacacgcacggaactgccgtttgccgaatacgatgccggacggggcatcggcaaatacaacccgattttcgactggtcggaacacgacgtgtgggcatacatcctcgccaacaatgtgccttacaacgatttgtaccggcaaggatttcccagcataggctgcgacccctgcacccgccccgtcaaggcgggcgaagacatccgcgccgggcggtggtggtgggaaggcagaaacagcaaagaatgcgggctgcacaaataa

SEQ ID NO: 39873 - protein, 246 aa, Neisseria meningitidis
METTLFKPALWQIPHIGSGGETALAEKTETLKQRLHRIVGSHRDARFASSLAAEDMVITDLIAGENLNIGIFTLDTGLLHTETLNLLDRLGRAYPHLRIKRFRPVREDADRYVESKGRFAFYDSVEARRECCRIRKTEPLNRAIAGADAWLTGQRREQSATRTELPFAEYDAGRGIGKYNPIFDWSEHDVWAYILANNVPYNDLYRQGFPSIGCDPCTRPVKAGEDIRAGRWWWEGRNSKECGLHK

SEQ ID NO: 39874 - DNA, 735 bp, Photorhabdus luminescens
  CDS (1)..(735)
atgagccaattcagcttatctcaatgtgttagtatgactgctgaacaacaagagcaatcactggctgagattaatcttcggcttgaaatgatggatgctcaccagagagtaaactgggcattggaaaatttgccaggggagtttgttctttcctccagttttggtattcaggcggcggtatgtcttcatttagtgacacaagaatatcctgatattccggtcatacttactgataccggttatctattccctgaaacttatcaattcatagataaactcacaacgcaactgaaactgaatttgcaagtattcagtgctgagcattccccggcctggcaggaagctcgctatgggaaattgtgggagcaaggcgtagagggaatagagcgttacaatcagattaataaggttgaaccaatgaatcgggctttgaaaaatctgagagcacaaagttggtttgctggtttacgccgtcagcaatctgaaagtcgatcaaaattaccggttttagctgtacagcggggagtatttaagattttgccgattatcgactgggataaccggcgtgtgcatcaatatctgacaaaacatggcttggaatatcatccattatgggaacagggttatctctctgttggtgacatccatacaactcaaaaatgggaaccgggcatgagtgaagaacaaacccgtttttttggcttgaagcgagaatgtgggttacatgagaattaa

SEQ ID NO: 39875 - protein, 244 aa, Photorhabdus luminescens
MSQFSLSQCVSMTAEQQEQSLAEINLRLEMMDAHQRVNWALENLPGEFVLSSSFGIQAAVCLHLVTQEYPDIPVILTDTGYLFPETYQFIDKLTTQLKLNLQVFSAEHSPAWQEARYGKLWEQGVEGIERYNQINKVEPMNRALKNLRAQSWFAGLRRQQSESRSKLPVLAVQRGVFKILPIIDWDNRRVHQYLTKHGLEYHPLWEQGYLSVGDIHTTQKWEPGMSEEQTRFFGLKRECGLHEN

SEQ ID NO: 39876 - DNA, 765 bp, Rhizobium loti
  CDS (1)..(765)
atgctggcgaaaccaaggccgcttgaccatatcggcgatgcagatgacggcgtcgccgccaaggcggcggggctcgatgcgctgtacggccatctgaagccgctcgagatcatcgaacgctcggcccgcgaactgtttcacgacgagatcgctgccgtgtcgtccttcggggcggattcggcggtgctgctgcacatgattgccgagatcgaccgcacgctgccggtcatcttcctcgacaccggcaagcatttcgaggagacgctcggctatcgcgacgcgcttgtcgctgatttcgggctgaccaacatccaggtcatcaagcccgaggaagccgcgctcgcgcggatcgacccgacgggcaatctgcaccagagcaacaccgatgcctgctgcgacgtgcgcaaggtcgagccgctggcacggggcgtggcgccgttccgtgcctggttcaccggccgcaagcgttttcaggcctcgacgcgggcagcgctgccggtgttcgaggcggtcggcgcgcgcatccgcatcaatccgctggcgcactggacgacatcggaccaggccgactacatgcgggcgcatgcgctgcgcgagaatccgctggtcgcctatggctatctgtcgatcggctgtttcccgtgcacgcaaccggtgcagccgggcgaggatgcgcgcagcggacgctgggccggtcatgccaagaccgaatgcggcattcacctgtcggggctggaagtgtcgctgaccgacgcatcactatag

SEQ ID NO: 39877 - protein, 254 aa, Rhizobium loti
MLAKPRPLDHIGDADDGVAAKAAGLDALYGHLKPLEIIERSARELFHDEIAAVSSFGADSAVLLHMIAEIDRTLPVIFLDTGKHFEETLGYRDALVADFGLTNIQVIKPEEAALARIDPTGNLHQSNTDACCDVRKVEPLARGVAPFRAWFTGRKRFQASTRAALPVFEAVGARIRINPLAHWTTSDQADYMRAHALRENPLVAYGYLSIGCFPCTQPVQPGEDARSGRWAGHAKTECGIHLSGLEVSLTDASL

SEQ ID NO: 39878 - DNA, 798 bp, Rhizobium meliloti
  CDS (1)..(798)
atgacgacgcaatccctcaaagcagaagcggtggccctcgaagcagacgtgatggccctcgatgcggaggcgaaggccctcaacgacaagctcgaaagcctggatctcgccggccggctggcgctcattgccgggcttgaaggccgcgcggtctttaccacgtcgctcggcatcgaggaccaggtcattaccgccgcgatcggcagcaaccgtctcgacatcgaagtcgcgacgctgaagacgggccgcctcttcaacgagacggtggcgctgatcgaccagaccgaggaaacctatgacatcctcatcaagcgctattatcctgagaaagccgacatcgacgcctatgtggcgcaatacggcatgaacgggttctacgaaagcgtggaagcccggcatgcctgttgcggcgtgcgcaagctgaagccgcttgcgcgcgcgctcgacggagcaagctattggatcacgggcctgcgccgcgggcagtcgggcaaccgtgccacgacccctttcgctgaagccgacgtcgagcgcggactcatcaagatcaatccgctcgccgactggggcatcgagacgatccaggcccatgtcgcggcagagggcattcccgtcaacccgctgcacagtcgcggctatccgtcgatcggttgcgagccctgcacccgtgccatcaagcccggcgagccggagcgcgccggccgctggtggtgggagaacgacgagaagcgcgaatgcggcctgcatgtgccggaagcggcttcctcgatcatccccaacgccagcaacgcggcctga

SEQ ID NO: 39879 - protein, 265 aa, Rhizobium meliloti
MTTQSLKAEAVALEADVMALDAEAKALNDKLESLDLAGRLALIAGLEGRAVFTTSLGIEDQVITAAIGSNRLDIEVATLKTGRLFNETVALIDQTEETYDILIKRYYPEKADIDAYVAQYGMNGFYESVEARHACCGVRKLKPLARALDGASYWITGLRRGQSGNRATTPFAEADVERGLIKINPLADWGIETIQAHVAAEGIPVNPLHSRGYPSIGCEPCTRAIKPGEPERAGRWWWENDEKRECGLHVPEAASSIIPNASNAA

SEQ ID NO: 39880 - DNA, 738 bp, Shewanella oneidensis
  CDS (1)..(738)
gtgagcagtagcgaacttaaggcgctgctaacggcgcctaagagcgttcagcaagcagaacttgaacgcattaatcgtttcttagccggattaacggctcaagagcgagtgctctggggcttggcctatttgcccggtaatcacgcgctgtcatccagttttgggatccaagcggcggtgatgctgcatatggtgagtcaggtgcaatcggatattccggtgatcttaacggatactggctatttatttcccgagacgtatcagtttattgaccagttgaccgagcgattatccttaaatcttaaggtttaccaagcacctattacctcggcatggcaggaggcgcgctttggccaattgtgggaacaaggggtagagggtcttgaacgttataatcggctgaataaggtggagccaatgcagcgcgccttggccgagcttgaagtcggaacttggtttgctggactacgccgcagccagtcgagcactcgcgaagagttaccgatattggctatccatggttctcgcttcaagttgctgccgattatcgaatggtcgaacaaagatgtgcatctgtatctgacgcaatttgacttgccttatcatcctttatgggagcaaggttatgtttctgttggggatactcattcgagcaaacccttagaattaggtatgacagaggaagaaacgcgctttaatggcttaaaacgtgagtgcggtttgcattacgaaatatag

SEQ ID NO: 39881 - protein, 245 aa, Shewanella oneidensis
MSSSELKALLTAPKSVQQAELERINRFLAGLTAQERVLWGLAYLPGNHALSSSFGIQAAVMLHMVSQVQSDIPVILTDTGYLFPETYQFIDQLTERLSLNLKVYQAPITSAWQEARFGQLWEQGVEGLERYNRLNKVEPMQRALAELEVGTWFAGLRRSQSSTREELPILAIHGSRFKLLPIIEWSNKDVHLYLTQFDLPYHPLWEQGYVSVGDTHSSKPLELGMTEEETRFNGLKRECGLHYEI

SEQ ID NO: 39882 - DNA, 750 bp, Synechocystis sp
  CDS (1)..(750)
atgtcccatactctgactaagctcgatctacccaccttacaaacggagctggaaaatgccaccgcccaacagatcattacctgggcggcccaaacctttggccctggcttggtgatgagtactagttttggcattcaggcggcggtgatgctccatttagtgactagcattgtgcccaatattcctgttatctggattgacacgggctatttaccgctggaaacctatcaatttgcggatcagttgaccggacggctacagctaaatttaaaggtttaccaatctcccctcagcccagctcgcatggaagctctgtacggcaagctctggcaacaaaaagacgtggaatccctcaaccgttatgatcaaatccgcaaagttgaaccgatgcagagggcattaaaagaactagaggcgatcgcctggttgacggggttaaggagggatcaaactcggcaccgccagaatttgaaaccagtggatctccagggtaatcagtataaagttctccccattttggactggaattctaagatggtttacgaatatctcaccgcccacgatttaccctaccatccgttttttgaccagggttacgtctctgtgggggattggcattctagccggcccctgatggcccacgatgaagatgaaagggatacccgtttccacggcctcaaacaggaatgtggtttacatttacccctgtccccggaagctggccagagtttggattccagtgctttgtag

SEQ ID NO: 39883 - protein, 249 aa, Synechocystis sp
MSHTLTKLDLPTLQTELENATAQQIITWAAQTFGPGLVMSTSFGIQAAVMLHLVTSIVPNIPVIWIDTGYLPLETYQFADQLTGRLQLNLKVYQSPLSPARMEALYGKLWQQKDVESLNRYDQIRKVEPMQRALKELEAIAWLTGLRRDQTRHRQNLKPVDLQGNQYKVLPILDWNSKMVYEYLTAHDLPYHPFFDQGYVSVGDWHSSRPLMAHDEDERDTRFHGLKQECGLHLPLSPEAGQSLDSSAL

SEQ ID NO: 39884 - DNA, 720 bp, Thiocapsa roseopersicina
  CDS (1)..(720)
atgagtaagcccgatctcgacgccttcctccacggcgacgacgccgccttgcgagagaccaaccgccggctggagtccatgcccgcggaggaccgcgtgcgctgggccctggagcatctcccgccccagcacgtgctctcctccagcttcggaacacaatcggccgtaatgctgcacctggtcagccgccagatgcccgagatccccgtgattctggtcgacacgggctatctctttcccgagacctatcgactcgtcgacgcgctcacggaccggttcggcctgaacctaaaggtctatcgccccgcgctctccccggcctggcaggaggcgggcctggggcgtctgtgggagcagggagcggacggcatcgagcgctacaatcggctcaacaagatcgacccgatggagcgcgcgctgcgcgacttggacgccggcacctggtttgcggggctgcgtcgacaacaggccaactcccgcgccgagctgccggtacttcgacgccaggacggccgcatcaaattccatccgatcatcgactggcacaggcctcgacgtgcacgctacctgcgccgtcatgatctgcccgaccatccgttgcgggatcaaggctatgtctcgatcggggatgtccacaccacggtgccgctgctgccggggatgttggaggaagagacacgcttcttcggcatcaagcgcgagtgcggattgcatcgttag

SEQ ID NO: 39885 - protein, 239 aa, Thiocapsa roseopersicina
MSKPDLDAFLHGDDAALRETNRRLESMPAEDRVRWALEHLPPQHVLSSSFGTQSAVMLHLVSRQMPEIPVILVDTGYLFPETYRLVDALTDRFGLNLKVYRPALSPAWQEAGLGRLWEQGADGIERYNRLNKIDPMERALRDLDAGTWFAGLRRQQANSRAELPVLRRQDGRIKFHPIIDWHRPRRARYLRRHDLPDHPLRDQGYVSIGDVHTTVPLLPGMLEEETRFFGIKRECGLHR

SEQ ID NO: 39886 - DNA, 762 bp, Vibrio cholerae
  CDS (1)..(762)
atgcctaatcgtaccgttccaacactagaagagttactaacgttaaataaggtgcagcaaacgctgcgcctaacggaagtcaatcagcatctggaatccctcactgcgcaagagcgcgtcgtctggggtctagaaaatctgcagggcaatcatgcactgtcatcgagctttggtatccaagccgcagtgatgcttcatttattaacttcagtgaagagtgacattcctgtcgttttaaccgataccggctatctgttcccagaaacctatcagtttatcgatgagttgactgagcggctcaatctgaacttaaaagtttactccgcgcctgtatcagcggcttggcaagaagctcgctacggaaaactgtgggaacaaggtgttgaaggaatcgaacgctacaaccagattaataaagtagaaccgatgcgtagagcattagatgaactcaacattggcacttggttctcgggcttacgacgtgaacagtcacaatcacgagcaagcctaccgattctatcggtacaaaatggcgtgtttaaattcctgccagtgatcgattggaccaataaagaggtgcactattatctcaaggataacgatctaccttatcacccactttgggaacaaggttatctttcggttggtgatacacacaccacacagaaatggcagccgggaatgaatgaagagcaaactcgcttctttggtttaaagcgtgagtgtgggttacacgaagatcataacgatacacatcaataa

SEQ ID NO: 39887 - protein, 253 aa, Vibrio cholerae
MPNRTVPTLEELLTLNKVQQTLRLTEVNQHLESLTAQERVVWGLENLQGNHALSSSFGIQAAVMLHLLTSVKSDIPVVLTDTGYLFPETYQFIDELTERLNLNLKVYSAPVSAAWQEARYGKLWEQGVEGIERYNQINKVEPMRRALDELNIGTWFSGLRREQSQSRASLPILSVQNGVFKFLPVIDWTNKEVHYYLKDNDLPYHPLWEQGYLSVGDTHTTQKWQPGMNEEQTRFFGLKRECGLHEDHNDTHQ

SEQ ID NO: 39888 - DNA, 780 bp, Vibrio parahaemolyticus
  CDS (1)..(780)
atgcttgattctgtggcttccaaaccggagctggcggagttactgacattaacaaagacggagcaaatactccgtcttgcacaaatcaatgtcgaacttgaaccgctgtcggcacaagagcgagtaaagtgggctttggaaaatctggatggagagtttgcggtatcctcaagctttggtatccaagccgctgtcatgcttcatcttgtgactcaagaaaaacctgacatcccaattattcttacggataccggatatctgtttgcagaaacgtatcgctttattgatgagttgacagaaaaactcaaccttaatctaaaagtttatcgagcggagcaaagtgctcaatggcaagaagcacgttatggcaaattatgggagcagggcgttgaggggatcgagaagtacaacaaaataaataaagtcgagccaatgcgtcgtgcattgaaagaacttaatgttggaacatggttttcaggtttacgtagagagcaaagtaaatcacgagcgggtttaccgatactgtcgattcaaaatggcgtgtttaagtttctgcccgtaatcgattggacgaataaagatgttcactactacctcgagcaacatggtcttacctatcacccactttgggaagaaggttacttgtctgttggggatacacatacgacacgtaaatgggagccaggaatgtcagaggaagagactcgcttctttggtttaaagcgtgaatgtggacttcatgaagatgatggtaatgaacaagatggttcaggtatctag

SEQ ID NO: 39889 - protein, 259 aa, Vibrio parahaemolyticus
MLDSVASKPELAELLTLTKTEQILRLAQINVELEPLSAQERVKWALENLDGEFAVSSSFGIQAAVMLHLVTQEKPDIPIILTDTGYLFAETYRFIDELTEKLNLNLKVYRAEQSAQWQEARYGKLWEQGVEGIEKYNKINKVEPMRRALKELNVGTWFSGLRREQSKSRAGLPILSIQNGVFKFLPVIDWTNKDVHYYLEQHGLTYHPLWEEGYLSVGDTHTTRKWEPGMSEEETRFFGLKRECGLHEDDGNEQDGSGI

SEQ ID NO: 39890 - DNA, 777 bp, Vibrio vulnificus
  CDS (1)..(777)
atgcttgattctgttgcttcaacgctgcagctatcagaattactctcgttaaccaaggcggagcaaagtatccgccttgccgaaatcaacgttgagttagagatgctgtcagctcaagagagggtcgcttgggctctgcaaaatttggaaggggcacacgctgtttcgtcgagttttgggattcaagcggctgtcatgctgcatttggtatcgaagcagcaagccgatattcccgtcattttgaccgatacgggctacctatttcctgaaacgtatcaatttattgatgagttaactaaatctctaaacctaaaccttaaagtataccgagcgaatgagagtgcaaactggcaggaagctcgatacggtaaactgtgggagcaaggtatagaaggaatagaaaaatacaacaagcttaataaagtcgaacctatgcgtcgtgcactgaatgagcttaatgttaaaacctggttttccggattacgccgagagcaatctcagtcccgagcaggcctacctattctgtcgatacaaaatggagtgtttaaattcttgcctgtagttgattggagtaacaaagacgtacactactatttaaaagaacatggtctttcatatcatcccctttgggagcagggctatctttctgtaggagatacgcatacaactcaaaaatgggagccagggatgagtgaagaagaaactcgtttctttggcttgaagcgtgagtgtggacttcacgaagaagataatgaacaagatggttctggtatttaa

SEQ ID NO: 39891 - protein, 258 aa, Vibrio vulnificus
MLDSVASTLQLSELLSLTKAEQSIRLAEINVELEMLSAQERVAWALQNLEGAHAVSSSFGIQAAVMLHLVSKQQADIPVILTDTGYLFPETYQFIDELTKSLNLNLKVYRANESANWQEARYGKLWEQGIEGIEKYNKLNKVEPMRRALNELNVKTWFSGLRREQSQSRAGLPILSIQNGVFKFLPVVDWSNKDVHYYLKEHGLSYHPLWEQGYLSVGDTHTTQKWEPGMSEEETRFFGLKRECGLHEEDNEQDGSGI

SEQ ID NO: 39892 - DNA, 726 bp, Xanthomonas campestris
  CDS (1)..(726)
atgaccgcgctgcctgccacatcgatcgccgctccttcgctggacgacctggacgcgctcaacgcgcacctggagacgctgcgcgccgacgaacgcgttgcctgggcgctgcagcacggcccgcagcaggcggcgctgtcgtccagcttcggcgcgcagtcggcggtgacgctgcacctgctcacccagcagcgcccggacatcccggtgatcctgatcgacaccggctacctgttcccggagacctaccgctttgccgatgcattgaccgaacgcctttcgctcaacctgcaggtgtatcgcccgctggtcagccgcgcctggatggaggcacgccatggccgtctgtgggaacagggcatggtgggcatcgaccagtacaacaacctgcgcaaggtcgaaccgatgcgccgcgcactggacgaactcaacgtcggcacctggttcaccggcctacgccgcagccagtccggtgggcgtgcgcagacgccgatcgtgcagaagcgcggggaccgctacaagatcagcccgatcgccgactggaccgaccgcgacgtctggcaatacctgcaggcgcacgcactgccgtatcacccgctgtgggaacagggctatgtgtcgattggtgacttccacaccacccgtcgctgggagccgggcatgcgcgaagaagacacgcgcttctttgggctcaagcgcgagtgcggcatccacgaagacatctga

SEQ ID NO: 39893 - protein, 241 aa, Xanthomonas campestris
MTALPATSIAAPSLDDLDALNAHLETLRADERVAWALQHGPQQAALSSSFGAQSAVTLHLLTQQRPDIPVILIDTGYLFPETYRFADALTERLSLNLQVYRPLVSRAWMEARHGRLWEQGMVGIDQYNNLRKVEPMRRALDELNVGTWFTGLRRSQSGGRAQTPIVQKRGDRYKISPIADWTDRDVWQYLQAHALPYHPLWEQGYVSIGDFHTTRRWEPGMREEDTRFFGLKRECGIHEDI

SEQ ID NO: 39894 - DNA, 714 bp, Xylella fastidiosa
  CDS (1)..(714)
atgaccgtacttcccgccttacctcctctggacgatctggaaacgctcaacgtccacctagaaacgctgagtgctgaaaatcgcgtgtgctgggcactggagcgcggtcctgaccaccctgcactgtcttccagcttcggcgcgcaatcggccgtcatgctgcatctactcacccggtttgcaccggatattccggtgatcctggtcgacaccggctatcttttcccagaaacctaccgtttcgccgacacgctgaccgaacgactcaagctcaatctgaaggtataccagccgctgcgtagcggcgcttggacggaagcccgtcatggtcgactatgggaacaagggatcgacggaattaatcaatacaacaccctgcacaaggtcgaaccgatgcgcagggcattagaggaattgcaagtcggcacctggtttaccggcctacgtcgcggacaatccagtacccgtacccaaacatcaatcgtgcaacagcgtgacgagcggtacaaaatcagcccaattgcagactggaccgaccgcgatatctgggaatacatgaaacaccatgatctgccctatcacccgctttgggaacagggctacgtttcaatcggcgacattcacacgacacgccccttggaaccaggcatgcgcgaagaagacacacgcttcttcggattcaaacgtgaatgcgggattcacgagaacatctaa

SEQ ID NO: 39895 - protein, 237 aa, Xylella fastidiosa
MTVLPALPPLDDLETLNVHLETLSAENRVCWALERGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQQRDERYKISPIADWTDRDIWEYMKHHDLPYHPLWEQGYVSIGDIHTTRPLEPGMREEDTRFFGFKRECGIHENI

SEQ ID NO: 39896 - DNA, 801 bp, Schizosaccharomyces pombe
  CDS (1)..(801)
atgagctcaatcgatacgcctgctaataaattgcaagcgaaaaccttgtttcacccagaacatctcgaatacatcaacaagcagttatcggagcttagtcctcaagatatcttaaaatggtgccgttggacacttccttctttgtttcaaacatctgcgttaggactgtccgggcttgttattatggacatgttatcgaaaatggatatgaatgttcctctgatttttatcaacacacttcatcatttcccagaaacactggatcttcttgaaaaagtcaaaactaagtatcctaacgtgcctgttcacgtctatcgttgtgctgaagcagccaacgaaaaggaatttgctcagaagtttggtgagaagctttgggagacagatgaatctcggtatgactttttagtcaaagtggaaccagcaagtcgtgcttattctgacttaaatgtacttgctgtgtttactggccgccgccgtagtcaaggtggagagcgcggatctttgcccattgttcagctggatggaccagtattaaagatcaaccccttggctaactggtcttttactgaagttcataattatattattacaaacaacgttccatataatgaacttctgaacaagggttacagatcagttggtgactggcactctactcaaccagttagagaaggtgaagatgaacgtgccggacgttggcgcggtcgagagaaaacagaatgtggattacacagtcatcctcaaagtaaattcgcacaatatatggcggagcttaaaaagaaggagacggctgatcagtga

SEQ ID NO: 39897 - protein, 266 aa, Schizosaccharomyces pombe
MSSIDTPANKLQAKTLFHPEHLEYINKQLSELSPQDILKWCRWTLPSLFQTSALGLSGLVIMDMLSKMDMNVPLIFINTLHHFPETLDLLEKVKTKYPNVPVHVYRCAEAANEKEFAQKFGEKLWETDESRYDFLVKVEPASRAYSDLNVLAVFTGRRRSQGGERGSLPIVQLDGPVLKINPLANWSFTEVHNYIITNNVPYNELLNKGYRSVGDWHSTQPVREGEDERAGRWRGREKTECGLHSHPQSKFAQYMAELKKKETADQ

SEQ ID NO: 39898 - DNA, 786 bp, Saccharomyces cerevisiae
  CDS (1)..(786)
atgaagacctatcatttgaataatgatataattgtcacacaagaacagttggatcattggaatgaacaactaatcaagctggaaacgccacaggagattattgcatggtctatcgtaacgtttcctcaccttttccaaaccactgcatttggtttgactggcttggttactatcgatatgttgtcaaagctatctgaaaaatactacatgccagaactattatttatagacactttgcaccatttcccacaaactttaacactaaaaaacgagattgagaaaaaatactaccagcctaaaaatcaaaccattcacgtatataagccggatggatgtgaatcggaggcagattttgcctcgaaatacggggatttcttatgggagaaagatgatgacaagtacgattatctggccaaagtggaacctgcacatcgtgcctacaaagagctacatataagtgctgtgtttactggtagaagaaaatcacaaggttctgcccgctcccaactgtcgattattgaaatagacgaacttaatggaatcttaaaaataaatccattgatcaattggacgttcgagcaggttaaacagtatatagatgcaaacaatgtaccatacaacgaacttttggaccttggatatagatccattggtgattaccattccacacaacccgtcaaggaaggtgaagatgagagagcaggaagatggaagggcaaggccaagaccgagtgtggaattcatgaagccagccgattcgcgcaatttttaaagcaagatgcctag

SEQ ID NO: 39899 - protein, 261 aa, Saccharomyces cerevisiae
MKTYHLNNDIIVTQEQLDHWNEQLIKLETPQEIIAWSIVTFPHLFQTTAFGLTGLVTIDMLSKLSEKYYMPELLFIDTLHHFPQTLTLKNEIEKKYYQPKNQTIHVYKPDGCESEADFASKYGDFLWEKDDDKYDYLAKVEPAHRAYKELHISAVFTGRRKSQGSARSQLSIIEIDELNGILKINPLINWTFEQVKQYIDANNVPYNELLDLGYRSIGDYHSTQPVKEGEDERAGRWKGKAKTECGIHEASRFAQFLKQDA

SEQ ID NO: 39900 - DNA, 24 bp, Primer
atgtccaaactcgatctaaacgcc

SEQ ID NO: 39901 - DNA, 24 bp, Primer
ttacccttcgtgtaacccacattc

SEQ ID NO: 39902 - protein, 235 aa, consensus
  MISC_FEATURE (1)..(235): consensus for the disclosure of xaa see table XV
DTXXXXXETXXXXXXXXXXXXXXXXXXXXXXXXXXXXXXXXXXXXXXXXXXXXXXXXXXXXXKXXPLXXXXXXXXXXXXXXWXXGXRXXQXXXXRXXXXXXXXXXXXXXXXXXXXXXXXXXXXXXXXXXXXXXXXXXXKXXPXXXWXXXXXXXYXXXXXXPXXXLXXXGYXSXGXXXXTXXXXXXXXXXXXXXXXXXXXXXXXXXXXXXXXXXXXXRXXXXXXXXXXXXXECGXH

SEQ ID NO: 39903 - protein, 99 aa, consensus
  MISC_FEATURE (1)..(99): consensus for the disclosure of xaa see table XV
XXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXR

SEQ ID NO: 39904 - protein, 77 aa, consensus
  MISC_FEATURE (1)..(77): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXGXX

SEQ ID NO: 39905 - DNA, 999 bp, Escherichia coli
  CDS (1)..(999)
atgaaaacgttaggtgaatttattgtcgaaaagcagcacgagttttctcatgctaccggtgagctcactgctttgctgtcggcaataaaactgggcgccaagattatccatcgcgatatcaacaaagcaggactggttgatatcctgggtgccagcggtgctgagaacgtgcagggcgaggttcagcagaaactcgacttgttcgctaatgaaaaactgaaagccgcactgaaagcacgcgatatcgttgcgggcattgcctctgaagaagaagatgagattgtcgtctttgaaggctgtgaacacgcaaaatacgtggtgctgatggaccccctggatggctcgtccaacatcgatgttaacgtctctgtcggtaccattttctccatctaccgccgcgttacgcctgttggcacgccggtaacggaagaagatttcctccagcctggtaacaaacaggttgcggcaggttacgtggtatacggctcctctaccatgctggtttacaccaccggatgcggtgttcacgcctttacttacgatccttcgctcggcgttttctgcctgtgccaggaacggatgcgcttcccggagaaaggcaaaacctactccatcaacgaaggaaactacattaagtttccgaacggggtgaagaagtacattaaattctgccaggaagaagataaatccaccaaccgcccttatacctcacgttatatcggttcactggtcgcggatttccaccgtaacctgctgaaaggcggtatttatctctacccaagcaccgccagccacccggacggcaaactgcgtttgctgtatgagtgcaacccgatggcattcctggcggaacaagcgggcggtaaagcgagcgatggcaaagagcgtattctggatatcatcccggaaaccctgcaccagcgccgttcattctttgtcggcaacgaccatatggttgaagatgtcgaacgctttatccgtgagttcccggacgcgtaa

SEQ ID NO: 39906 - protein, 332 aa, Escherichia coli
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 39907 - DNA, 1220 bp, Danio rerio
  CDS (54)..(1070)
ggggagtttagtgtctgtctttggagctggtcgcactctcggaggctgtgaggatgtcggatcagtctgtgtttgatgtggatgtctggaccctgacgcggtttgtgatggagaccggccgccaggtgaaaggggccaccggtgaactcacacagctcatcaactccttgttgaccgcaattaaagccatttcatctgctgtccgcaaagctggaatagtcaaccttcaaggcatcgccggacaggtgaatgtcacaggcgacgagcagaagaagctggatgtgctttctaatgatttgatcatcaatttgctgcaggcctcctacggcacatgtttgatggtttcagaagaaaacaaagacgccatttacacgcctgcggaaaaacgaggcaagtatatagtgtgctttgatcccctggatggctcctccaacatcgactgtttggcccccattgggaccatctttgccatctacaaaagaatctcagatggagaaccatcagaaaaggatgctctgcagcctgggaatcagatcgtgtgtgcgggttacgctctttacggcagtgccacactggtggctctcagtacaggagctggagtcaacttcttcatgctggatccagcaattggagagttcatcctgacggacagaaatgtgaaaatcaagaaaaaggggaagacgtacagtatcaatgagggctacgctaaatacttcgagcctgcggtcaatgactatttaaagcacaagaaaaacccagaggatggcagtgccccgtatggtgccaggtatgttgggtcgatggtctctgatatacatcgtacactcgcctatggtggcatattcatgtatcctgccaatgaaaagagtccaaaaggaaagctgaggctgctgtacgagtgtaaccccatcgccttcctgatcgagcaggctggaggaacagccaccacaggcactcagcgcgtcctggacgtccttcctgaaacactgcaccagcgggtcccttttgtggtgggatcttcagacgacgtggaggaatacttgtcctttgtcaagaaacatagcaaatagagagatttgatccattgaaaacacacatgacactgagatagcatacacaacatcaccgtagctcttttttaatggtaaaagaatttttttttgtaagcaaaatcacattaaaaatacaaaatcggaaaaaaaaaaaaaaaaaaaaaaaaa

SEQ ID NO: 39908 - protein, 338 aa, Danio rerio
MSDQSVFDVDVWTLTRFVMETGRQVKGATGELTQLINSLLTAIKAISSAVRKAGIVNLQGIAGQVNVTGDEQKKLDVLSNDLIINLLQASYGTCLMVSEENKDAIYTPAEKRGKYIVCFDPLDGSSNIDCLAPIGTIFAIYKRISDGEPSEKDALQPGNQIVCAGYALYGSATLVALSTGAGVNFFMLDPAIGEFILTDRNVKIKKKGKTYSINEGYAKYFEPAVNDYLKHKKNPEDGSAPYGARYVGSMVSDIHRTLAYGGIFMYPANEKSPKGKLRLLYECNPIAFLIEQAGGTATTGTQRVLDVLPETLHQRVPFVVGSSDDVEEYLSFVKKHSK

SEQ ID NO: 39909 - DNA, 1017 bp, Homo sapiens
  CDS (1)..(1017)
atggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtga

SEQ ID NO: 39910 - protein, 338 aa, Homo sapiens [sequence omitted]

SEQ ID NO: 39911 - DNA, 1047 bp, Saccharomyces cerevisiae
  CDS (1)..(1047)
atgccaactctagtaaatggaccaagaagagactctaccgaagggtttgataccgatatcatcactcttcctagattcataatcgagcaccagaagcaatttaagaacgctactggtgatttcacattagtactgaatgccttgcaattcgcgttcaaatttgtatctcacaccatcagacgtgctgaattggttaacttggttgggttagcaggcgcttccaacttcactggtgaccagcaaaagaagttggacgttctaggtgatgaaatatttatcaatgccatgagggctagtgggatcatcaaggtccttgtatctgaagaacaggaagacttgatcgtttttcccacaaacacgggctcatacgcagtgtgttgtgatcctattgatggctcctcaaatttggacgccggtgtctccgttggaactatcgcgtctatattcagactgctaccagactcatcaggtactataaacgacgtactgagatgtggtaaagaaatggtagccgcttgctatgccatgtacggatcctctacgcatctagtattgacattgggtgatggagttgatgggtttaccttagacacaaacttgggcgaattcatcttgactcatcctaacttaagaattccgcctcaaaaggccatctactcaattaatgaaggtaacaccctctactggaacgagactataagaacatttattgagaaagtcaaacaaccccaagcagacaacaacaacaagcctttctcggctaggtatgttggatccatggttgctgatgttcacaggacgtttctttacggtggccttttcgcatacccttgcgacaagaagagccccaacggaaaactgaggttgctttatgaggccttcccaatggctttcttaatggaacaagcagggggaaaagcggtcaacgatcgcggagagagaatcttggatttggtgccaagtcatatccatgacaaatcttctatttggttgggttcttcaggtgaaattgacaaatttttagaccatattggcaagtcacagtag

SEQ ID NO: 39912 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 39913 - DNA, 1008 bp, Agrobacterium rhizogenes
  CDS (1)..(1008)
atgacgatcacaccagacatcgaacttggcgcatatctgctccagaggaaaatcgaccctgccctggcaagcttgattgaaagcatagcagcgtctgcgaccgtcgtagccgatcatctgaaggaagcagcctttcagaaccatatcggcagcgccggcacgacgaatgtccagggtgaagatcagaagctcctcgatgtcctggccgatcgtgtgtttcgcgaaacatgcggcgaggcggtctcgcttgccgcctatgtttctgaggaagcggaggacgtcacctggttgaaagctcccgccgcgggcgacctcattctttacgtggacccactggacggttcatcgaacctcgaggtcaacctctccgtcggttcgatctttgccgtcagccaggtccaggcagacggcgataccaacgttctgcgcaaaggccgggattatctctgcgccggctatgccatctatgggccgtccacgctcttcgtcatcaccttcggcctcggcgtggtcggtttcacgctggatccgtccgacgggcaattcaaactgaccaatgcgcgcatgcgcgtccccacggaaacgaccgagtttgccgtgaactcgtcgcggcaacgtttttgggacgaaccgatccgccggtacgtggacgaatgccttgcagggtccgctgggccacgcggacaggatttcaatatgcgatggacggcctccatggtcgcggatgtgcatcgcattctcacgcgcggaggggtgttcctctatccggcggacgattccaatcgtcgcgccggcggcaagcttcgcctgatgtacgaagccaatcccatggcgttcctcattgaggcggccggcggtgcagcttccaccggaaccgaagacatccttcgcatccaaccgcaggctcatcatcagcgcgtgtcggtcttgctcggctcgagcaacgaaatccaacgcctcgtgcaattccaccaaatccatcactcgcaagaggagatcggctcgtaa

SEQ ID NO: 39914 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 39915 - DNA, 1026 bp, Arabidopsis thaliana
  CDS (1)..(1026)
atggatcacgcagcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttctgaaacctgggaatgaaatggtggctgcaggttattgtatgtacggaagctcctgcatgcttgtgttgagcactggaaccggtgtccacggatttacactggacccatctctaggagagttcattctaactcacccggacattaagattccaaataagggaaacatttattcggtgaatgaaggcaatgcgcagaactgggatggtccaactacaaagtatgtagagaaatgcaagtttcctaaagatggttctcctgcaaagtctctgagatacgtaggaagtatggtagctgatgttcatcgtacactactttatggaggaatcttcttgtacccggctgacaagaaaagccccaatggaaaattgcgtgtcttgtatgaagttttcccgatgtcgtttttgatggagcaagccggaggtcaggcctttacgggaaagaaaagggcgctagaccttgtcccggagaagatccatgagcgttctccgatatttcttggtagctacgatgatgtagaagagattaaagctctctatgctgaggaggaaaagaagaactaa

SEQ ID NO: 39916 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 39917 - DNA, 1215 bp, Arabidopsis thaliana
  CDS (1)..(1215)
atgcaatctcttaccttaactcggtacccaactccaatttccccgccaagactcaatctttacccgctaagacaaatcgcagcttctgttctctctgctccgaccgccggtattaaccgtcgcgatatggcgtctcgccatcagtcaacttcctttaagccccttgccgttggtcggaatttgaccggagatgatgatgatggttactgtactcttatagactttgcaggtagtggaggaggagaagggaaaaatgtaggagaggatcttgtggtgttgctttaccacttacaacatgcttgcaaaagaatcgcttctcttgtcgcctctcctttcaattcttcactcggaaagctctctgttaactcctctagtgggtcagaccgagatgcgcctaagccgctcgatattgtctcgaacgatatcgtcttgtcctctcttagaaactcagggaaagtagcagtaatggcttctgaagaaaacgatagtccaacttggatcaaagatgatggtccttacgttgtggttgtagatcctctagatggatcacggaacatcgatgcttcgattcccacgggaactatatttggaatttacaatcgtctcgttgagcttgatcatttacctgttgaagagaaagctgagctcaattctttgcagagaggcagcaggcttgtagcttccggttatgtgctatactcttcagccactatcttctgtgttacacttggatcgggaacacacgccttcacgctagaccattccacaggagaatttgttcttacccatcaaaacatcaagatcccaactcggggacaaatctactcagtgaacgatgcgaggtactttgattggccagaaggtttaaggaagtacattgacacagtgagacaaggcaaaggtcaaaacccgaaaaaatactctgcgcgttatatttgttctctagtagctgatcttcacaggactctcttatacggtggagtggctatgaatccaagagaccatcttcgtttagtctatgaaggtaaccctttggcttttctcgtggagcaagctggtggcaaatcctctgatggaaaaagagggatactttcgatacaacccgtgaagcttcaccaaagattgcctctgtttcttgggagcttagaggatgttgctgagctagagagctatggagatgtgcagcagactgtgaaccctggctatgaagtttaa

SEQ ID NO: 39918 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 39919 - DNA, 1011 bp, Vibrio cholerae O1 biovar eltor str. N16961
  CDS (1)..(1011)
atgcagaaaatgcgcaccctcggtgaatttattgttgaaaaacaacatgatttcccccacgccagcggtgaactttcctctcttttagcctcaattcgtttggccgccaaaatcgtcaaccgcgaaatcaataaagcgggactggcagatatcattggcgcgtcaggcaatgacaacattcaaggggaagagcaacaaaagctcgacctgtatgccaacgaaaaattcaaagccgcactggaagcacgcgatcaggtgtgtggtgtggcgagtgaagaagaagatgaagcggtcgcattcagtaaagagctcaacaaaaatgccaaatacgtggtgttgatggatccgctcgatggctcttccaatatcgatgtgaacgtatcggttgggaccattttctcgatttaccgccgcgtttcgccagttggcacaccgccgacgcaggaggactttctgcaaccgggtaataaacaagtcgctgccggttatgtgatttacggctcatcgaccatgctggtgtacaccacgggcaatggtgtgaacggctttacctacgatccttcgcttggcaccttctatctctcgcatgagaatatgcgtattccggaaaacggtaagatttactcgatcaacgaaggtaactacatccgcttcccaacgggcgtgaaaaagtacatcaaattctgccaagaaaatgtgccagaagagggacgcccctacacttcacgctacattggttcgctggtggcggatttccatcgtaacttactgaaaggtggcatttacttgtacccaagcacacaaagccatccgaatggtaaattgcgtctgctctatgagtgcaacccgatggcatttttgattgaacaagcgggtggccttgcttcggatggggcgcgtcgcatcatggacatcaaacccaccgaactgcatcaacgcgtaccgttttttgtcggctcaaaaaacatggtgcataaagtcgaaacgtttttagagacttacccagactaa

SEQ ID NO: 39920 - protein, 336 aa, Vibrio cholerae O1 biovar eltor str. N16961
MQKMRTLGEFIVEKQHDFPHASGELSSLLASIRLAAKIVNREINKAGLADIIGASGNDNIQGEEQQKLDLYANEKFKAALEARDQVCGVASEEEDEAVAFSKELNKNAKYVVLMDPLDGSSNIDVNVSVGTIFSIYRRVSPVGTPPTQEDFLQPGNKQVAAGYVIYGSSTMLVYTTGNGVNGFTYDPSLGTFYLSHENMRIPENGKIYSINEGNYIRFPTGVKKYIKFCQENVPEEGRPYTSRYIGSLVADFHRNLLKGGIYLYPSTQSHPNGKLRLLYECNPMAFLIEQAGGLASDGARRIMDIKPTELHQRVPFFVGSKNMVHKVETFLETYPD

SEQ ID NO: 39921 - DNA, 1002 bp, Pasteurella multocida subsp. multocida str. Pm70
  CDS (1)..(1002)
atgaaaacgttggggcaatttattgttgaaaaacaagcagaatatccaaatgcaaaaggggaactcagtgggattttatcctccattcgattggtcgcaaaggtgatccatcgagatatcaataaagcagggttaaccaataacattattggtacatcaggggctgaaaatgtgcagggcgaaacccaaatgaaattggatctgttcgcacataacaccatgaaacaagccttaatcagccgtgaagaagtcgctggttttgcctccgaagaagaagaaaattttgttgctttcgatacagaacgtggacgcaatgctaaatatgtgattttaaccgatcccctcgatggctcttccaacattgatgttaacgttgcagtcggcacaatcttctctatctaccgccgtgtttctcctatcggcacgcctgtgaccttagcagattttatgcaacctggtaatcgacaagtcgccgctggttacatcgtttatggttcttcaaccatgttagtgtataccacaggtaatggtgttaacgggttcacttatgatccatcattaggggtattctgtttatcccatgaaaatattcaaattcctgcgaatggaaaaatttactctatcaatgaaggtcaatatttgaaattcccgcaaggcgtgaaaaaatacattaaatattgccaagaagaagataaagcaacacatcgcccttatacttctcgctatatcggctcactcgtatccgattttcatcgtaacatgctgaaaggtgggatctatatttacccaagcgcaacgaactatccgaacggcaaacttcgtttattatatgaaggtaatccaatggcatttttagcggaacaagcaggcggtatggcgagtgatggttatcagcgtattttagatattcaaccgacggaattacatcaacgcgtgccacttttcctcggttcgaaagagatggtggaaaaagcacaagactttatgaaaacatttggctaa

SEQ ID NO: 39922 - protein, 333 aa, Pasteurella multocida subsp. multocida str. Pm70
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 39923 - DNA, 864 bp, Halobacterium salinarum NRC-1
  CDS (1)..(864)
atggccgacgtcatcgacgccgtcttcgatgcgatcgcggacgccgcccccgaggtccgcgcggggctgcccgaccaccgcgcgacccgtgacgaccagaacgcctccggagacacccaactggaggccgacgtgtgggccgacgacctgctgttcgaccgcaccgagtccatcgagggcgtgaactggtacgccagcgaggagcgcgacgccgtcgtcacggtgggcgacgccgaaggcgggtacgccgtcgcactcgacccccttgacggctcctcgaacgtgaaatccaacaacccctgtggcaccgtcgtcggcatctacgaccagccgctgcccgcgcccggctccagcctcgtcgccgccgggttcgtcctctacggacccacgaccaccatggtcgtcgcgcgcgacgacaccgtccgggagtcactcgtctccgagacgggggccacaaccgacctcggccccgtcgagttgccggccgaccccaccgtctacgggttcggcggccgggtccccgactggacgccggcgttcgagtcgttcgtccgggacgtcgaagacgacctgaagctgcgctacggcggcgcgatgatcgccgacgtgaaccaggtgctggtctacggcggcgtgttcggctaccccggcatggagtccgcgcccgacggaaagctccgcgcgcagttcgaggcactgccgatcgcgtacatcgtcgaaacagccggcggcgcgtcctcggatggcacccagtcgctgctggacgtggcaccgacacgcctccacgagcgcacgcccacgttcgtcggcaccgacgacgtgatcgcggccctcgacgcggcgcttcccgaccacacgaattaa

SEQ ID NO: 39924 - protein, 287 aa, Halobacterium salinarum NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 39925 - DNA, 843 bp, Campylobacter jejuni subsp. jejuni NCTC 11168
  CDS (1)..(843)
atgcaagaagtgatttcttatatacaaaaagcggttttagaaatttctaacgctttaaaatttcccgatacaagctacagtcaaaatcaaaattttacaggcgatacccaactcaaatttgatgttttaagtgatgaaattatcacaaaaaccctaagtcaatgttcaagtattaaagccatcatcagtgaagaaaaagatgaaattttaacgcttaacgagagggcaaattttatcgtagcttatgatcctttagacggttctagcttaatggatgttaattttgccataggttctatttttgctatctatgaagaaaaagcaagtgctaaaaatttaagagctgcgctttatagtatgtatggagcgcgattagaacttgtgatttgcaaagatcagccaaaactttatcgcttaaatgcaaataatgaatttatttttataaaagatcttagaatgaatgaaaaaggcaagattaatgctacaggcggaacgcaaaaattttgggaagaaaaacacgctaaatttatcaaaagtctttttgatgaaggctatcgcttaagatattctggagccatggtaagcgatatcaatcaaattttattaaaagggggtggcatttttagctatcctgcaacacaagatgcgcctaatggcaaacttcgtgccttttttgaagtctttcctctagcctttatcatagaaaaagcaggcggaaaaactacaaatggaaaaaaccgctctttacttgaacttgaatttgataaaatccatgcgacaactccttgtttttttggctcagaatatgaaatttcaaaacttttaaaggcttacaatgaatga

SEQ ID NO: 39926 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 39927 - DNA, 975 bp, Neisseria meningitidis Z2491
  CDS (1)..(975)
atggacacactgacccgattcctccccgaacacctgcaacaaaaccagctgcccgaagcactcggcggcgttttactgtccgttgtttccgcctgcaccgaaatcaacgccaaagtccgcctcggcgcactggccggcgtattgggtatggcgggcacgggcaatattcagggcgaagaccaaaaaaaactggatgttatcgccaacaacatcatgattgacacactcaaagccaaccctgccgttgccggtttggcaagcgaggaagaagactctttcgtaagtgccggtgaaaacggacgctatctcgtcctattcgatcctttagacggatcgtccaatattgatgtcaacatttccgtcggtacgattttctccatccttgaaaaacccgaaggcgcattggcaaccgaatcattccttcaaacgggcagacagcagcttgccgctggttacgttctttacgggcctcaaacccagctcgtattcacattcggacacggcgtatatatgttcacgctcaatgccgaaaacgaatttgtgctgacaaaagaaaaaccgaaagtacccgaaagtaccaaagaatttgccatcaatatgtccaaccgccgccactggctgccccccgtccaacaatacatcgacgagctcttggcgggcgaaaccggcacgcgcggcaaaaactacaatatgcgctgggtagccagcatggttgccgaaatccaccgcatactgatgcgcgggggcgtgttcatgtatccgcaagacaaacgcgacccgtccaaacccggcaaactgcgcctgatgtatgaagccaatcctatggccctgatactcgaacaagccggcgcatcggcaagcaacgcccgtcaggacatactcggcatccgtcccgaaagcctgcaccagcgcgtcgccgtcattatgggcagcagcgaagaagtggattacctcaaccgcctgcattcaaaataa

SEQ ID NO: 39928 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 39929 - DNA, 1014 bp, Yersinia pestis CO92
  CDS (1)..(1014)
atgaaaacgttaggcgaattcatcgtcgagaaacagctcgatttctctcacgccactggcgaactaactgcgttactttcagcaatcaaactcggcgcaaagatcattcaccgcgatatcaacaaagcaggtctggttgatatcttaggtgccagcggcgtttccaatattcagggcgaggaccagatgaaactggatctgtttgccaatgaaaagttgaaagctgcccttaaagcccgtggtgaagttgccggtatagcctccgaagaagaagatgacattgtcatttttgatggcggaagagcagaaaatgccaagtatgtggttttgatggatccactggatggttcttcaaatattgatgtgaatgtttctgttggcacaattttctcaatttatcgtcgtattacgccatttgggacaccaatcactgaagaagacttcctgcaaccgggtaccaaacaagtcacggcaggctatgtcgtttacggttcctcaaccatgttggtctataccacaggttacggtgtccatgcctttacctacgatccttctctgggtgttttctgtttatcccacgaaaaagttcgctatcccgcaaccggttgcatgtattccatcaacgaagggaattacattaaattccctctgggtgtgaaaaaatacatcaagtattgccaggagcaagacgaagccactaagcgcccatatacctcccgttatattggttcattagttgctgattttcatcgtaacctgttgaagggcggtatttatatttacccaagtaccgccagccaccctcaagggaaactgcgtttgttgtatgagtgcaacccaatggccttcctcgcggagcaagccggtggtaaagccaccgatggggtgaaccgtattctggacatcgtgccagagaaactgcatcaacgcgcaccgttcttcgtgggaacaaaatccatggtggaagatgcggaagggtttatcgctaaattcccagatgaagaagccaagtaa

SEQ ID NO: 39930 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 39931 - DNA, 1011 bp, Caulobacter crescentus CB15
  CDS (1)..(1011)
atgggccgctctgctttcggttcgaggacgagaatgactgcttttgtcgacctggccgcccggctcgcggccgagccggcggacgccgccctgaaggacgtggtcctgaccatcgccgagacgtgcgcgcagatcagccgcgtcgtggcctcgggcgccctgtcgggaagcctgggcgcggcgggcagcaccaacgtgcaggacgaagagcagaagaagctcgacgtcatcaccaatgacatgctgagcgacgccctgaaggcctgcggtcccgtggcgggtctggcttctgaagagctggaagaggtcgagcccacgggtcgtgtcggcggctatctcgtcaccttcgatccgctggacggctccagcaatatcgacgtcaacgtctcggttggaacgatcttctcggtcttgcccgcgccggccggccatgcgccgaccgaaggtgacttcctgcagccgggccgcaaccaggtggcggcgggttatgccgtctacgggccccagacgatgctggtcgtcacgctgtcgggcggcgtcaacggtttcacgctcagcgccgacggccgctggttgctgacccacccggacctggccatcaagccggacaccgctgagttcgcgatcaatatgtccaatcagcgccactgggcgccagctgtgcgccgctatatcgacggctgcctgcagggcaaggacggcgcgcggggcaagaacttcaacatgcgctgggtcgcctcgatggtggcagacgtccaccgcatcatgatgcgcggcggggtcttcatgtacccctgggatgcgcgcgagccggacaagcccggcaagctgcgcctaatgtacgaggccaatccgatgagccttctcgccgagcgggcgggcggcaagtcgatcgaaggcctgaacgaaatcctggatatcaacccggccaagctgcaccagcgcgtgcccgtcgtcctgggctcggccaatgaggtcgaggtcatccgggccgagatgcgcgccggctga

SEQ ID NO: 39932 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 39933 - DNA, 1026 bp, Caenorhabditis elegans
  CDS (1)..(1026)
atggcctcggaaaccagtcaattcggaatcgagaccgactcgatcacccttcaacgttacgtgctccaagagcagcgtaagcatgccgatgcaagtggagagcttaccgcgttgctcaccaacatgctcgtcgccatcaaggcaatcgcttcagccacccagaaggcaggactcgcgaaattatacggaatcgctggagccaccaacgtacaaggcgaggaagtgaagaagcttgacgtgctgagcaatgagctcatgatcaacatgctcaagagcagctacacaacatgtctcctagtctccgaggagaacgatgagctcattgaggtggaggagcaacgtcgtggaaagtacattgtgacttttgatccattggatggatcttccaatatcgattgcctcgtctcaatcggaaccatcttcggaatctacaaaaaacgtggagatggtccggcgactgtcgatgatgttctgaagcctggaaaggaaatggtggcagctggttatgctctctatggatctgctactatggtcgttttgtccactggtgatggtgtcaatgggttcactcttgacccttccatcggagagttcatcctaacccacccaaatatgaaatgcaaggaaaagggttcaatctactcgctaaacgaaggatatgctcagacatggagcaagggtttcgccgagtatattcgtacacgaaagtatccagaagccggcaaaaaggcaatgggacagagatatgtcgggtcgatggttgccgatgttcatcgtacaattctcaacggaggaatctttctctatccaccaactgtatcggctccaaatggaaagctccgcttgttgtacgagtgtaatccgatggcttatatcattgaacaggccggaggtctcgccacgactggaaaagaacgtattcttgatattcagccaacacagattcaccaacgcgctccaatcattctcggatcgaaactcgacgtcgaggaggctctcgaatatcttgccaaatatgataattag

SEQ ID NO: 39934 - protein, 341 aa, Caenorhabditis elegans
MASETSQFGIETDSITLQRYVLQEQRKHADASGELTALLTNMLVAIKAIASATQKAGLAKLYGIAGATNVQGEEVKKLDVLSNELMINMLKSSYTTCLLVSEENDELIEVEEQRRGKYIVTFDPLDGSSNIDCLVSIGTIFGIYKKRGDGPATVDDVLKPGKEMVAAGYALYGSATMVVLSTGDGVNGFTLDPSIGEFILTHPNMKCKEKGSIYSLNEGYAQTWSKGFAEYIRTRKYPEAGKKAMGQRYVGSMVADVHRTILNGGIFLYPPTVSAPNGKLRLLYECNPMAYIIEQAGGLATTGKERILDIQPTQIHQRAPIILGSKLDVEEALEYLAKYDN

SEQ ID NO: 39935 - DNA, 1023 bp, Brucella melitensis 16M
  CDS (1)..(1023)
atgacattggtaggtaatttttctcctctggttctggttggcgatagcgatcgcgtggaagccgaaaccgtcggcgcctatctcgatggctgggccgggcatgataaagtgcggctcgccacggccaacgcaatcaaggctattctttccggtgcgggcaggcttgtgggccgtattgcgcgcggatatctgccgggcgatcccggcaagcttgtcggggtcaatagtgaccaggatcagcaaaagagcattgatgtcggatcgcacaatctattcgttgagcttctgattgccgctggcgtggcttccattctttccgaagaagcggatctgcctgtagcgggcaaggccgatgggctggtggctgtcgccatcgatccgctcgacggttcgggcaatgtgggcctcggcgcgccgcttggcacgattttctcgattttccccgccgatgtggaagaacccttcctccagcccggcaatcgccagattgccgccggctatgtttcatacggcaattcggtcgatctcggcttttcggttggggagggcgtgatcttcgcgacgcttgatccggtgagcggccagttccacattacgcggcgcaatgtgaagctgccggaacgcacatccgatctggcgttcaacgcctcggtccagcggcatctgtcggcgggcatgcaggcctatgtcaacgacgccttccttggcaaggatggtccgcgcgggcgtaacttcaacatgcgctggctcggcgctgcggtgggcgacatgcaccgcatcatgcagcgcggcggcctgtttttctatgtgaacgacagccgccccggctatgagaagggccgcctgcggctggtttacgaagccaatccgattgctttcctcgcccgtgaagcggggggcaaggcgacggatggttcgagacctattctcgatatcgttccgcaaacctatcacgagcgcagtgcgctggtgttcggcgtggccgaagaggtggatatcctcggcgaatatttcgtgaaataa

SEQ ID NO: 39936 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 39937 - DNA, 1038 bp, Schizosaccharomyces pombe
  CDS (1)..(1038)
atggatctcgacgaaatcgacactgacattgtcacactttcctcctttattttgcaggaacagcgccgatacaatcagaagcataaaaatgaagaaggaaaaccttgcattattcaagaggctagtggggaattgtcattactgctaaacagtttacaattcagcttcaaattcatcgccaacaccattcgtaaagcagagttggtaaatctcattggtttatcgggaatcgtcaattccactggcgatgaacaaaagaagctagataaaatttgcaatgatatcttcattactgcgatgaagtcgaacggatgctgcaaactcatcgttagtgaagaagaggaggatcttatcgtagttgatagcaacggttcctatgccgtcacttgcgatcccatcgatggctcttccaacattgacgccggtgttagtgtaggtaccatatttggtatctataaactgcgacccggcagtcaaggcgatattagcgatgtcttaaggcctggtaaagaaatggttgctgctggctatactatgtatggtgcttcggctcatttattgcttaccacaggtcatcgtgtcaatggcttcaccttggacactgatattggcgaattcatcttgacccatcgaaacatgaaaatgcctttgcaacatagtatttattccattaatgagggttacactgcattttgggatgaaaaaatcgctcgttttattgctcatctcaaagaaagcacaccagacaaaaaaccatactctgctcgatacattggttctatggtcgccgatatgcaccgtaccattctttatggtgggttgtttgcttatccatgctcaaaaggaaataacggaaagttgagacttctttacgaatgtttccccatggccttccttgttgaacaagcaggaggtattgcggtaaacgacaaaggagatcgcattctggatttggtacccaaaacattacacggaaaaagcagtatttggcttggaagtaaacatgaagtcgaggaatatattaatttcataaaatag

SEQ ID NO: 39938 - protein, 345 aa, Schizosaccharomyces pombe
MDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 39939 - DNA, 1005 bp, Drosophila melanogaster
  CDS (1)..(1005)
atgacccaacagaggccagctttcgactccaatgcgatgacgctgacgcgtttcgtgctgcaggagcagcgaaagttcaagagcgccactggcgatctctcccagctgctcaactccatccagaccgccatcaaggctacatcatccgcggtgcggaaggcaggtatcgccaagctccatggattcgctggcgacgtgaatgtccaaggcgaggaggtcaagaaactggacgtgctctccaacgagctgttcatcaacatgctgaagtcatcctataccacatgtctaatggtttccgaggagaacgagaatgtgatcgaggtggaagtggagaaacagggcaaatacatcgtgtgcttcgatcccttggatggatcctccaacatagactgcctggtgtcgatcggttcaatcttcgccatttaccgcaagaaaagcgatggtccgcccacagtggaggatgcactgcagcccggaaatcagctggtggccgccggctacgcgctatacggttcggccacagcaattgtcctgggtctgggttcgggagtgaatggcttcacttatgacccggccatcggagagttcgtgctgaccgatcccaacatgcgggtgccggagaagggaaagatatactctatcaacgagggatatgcagcggattgggaggatggtgtcttcaactacattgcggccaagaaggatcccgccaagggaaagccctatggagcgcggtacgtgggttccatggtcgcggatgtgcatcgcaccattaaatacggcggcatctttatctatccggcaacaaagtccgctcccagcggaaaacttcgtctgctgtacgagtgcgtgcccatggcctatctgatgatccaggctggaggtctggccagcgacggaaagatcagcattttggacattgtgcccaagaagatccacgagcgcagtcccatattcctaggatccaagtccgacgtggaggaggcacttagctacttaaagtga

SEQ ID NO: 39940 - protein, 334 aa, Drosophila melanogaster
MTQQRPAFDSNAMTLTRFVLQEQRKFKSATGDLSQLLNSIQTAIKATSSAVRKAGIAKLHGFAGDVNVQGEEVKKLDVLSNELFINMLKSSYTTCLMVSEENENVIEVEVEKQGKYIVCFDPLDGSSNIDCLVSIGSIFAIYRKKSDGPPTVEDALQPGNQLVAAGYALYGSATAIVLGLGSGVNGFTYDPAIGEFVLTDPNMRVPEKGKIYSINEGYAADWEDGVFNYIAAKKDPAKGKPYGARYVGSMVADVHRTIKYGGIFIYPATKSAPSGKLRLLYECVPMAYLMIQAGGLASDGKISILDIVPKKIHERSPIFLGSKSDVEEALSYLK

SEQ ID NO: 39941 - DNA, 1011 bp, Xanthomonas axonopodis pv. citri str. 306
  CDS (1)..(1011)
atgtcgcgtccctcgctgacccgcttcctgatcgaagagcaacacgccggccgtatcgatgcggaattgcgccagctgatcaccatcgtctcgcgcgcctgcaagcgcatctccatcgccgtgagcaagggcgctctgggcggcgtgctcggcgatgccggcaccggcaacgtgcagggcgaagcacagaagaaactcgatgtactcagcaacgacatcctgctcgaggccaacgcctggggcggccatctggccgcgtgcgcgtccgaagaaatggaccacagccagccggtgcccgaccaataccccagcggcgatttcctgctgttgttcgatcccttggacggcagctccaatatcgacgtcaatgtctcggtgggcacgatcttctcggtattgcgcgcgcccaagggcaccgaaaagccgggcgacgagcacttcctgcagccgggcacccaacaggtcgccgccggctactgcatctacggccccagcaccatgctggtgctcacgctgggccacggcacccacgccttcaccctggagcgcgaagaaggcagcttcctgctgacccaggccaacatgcgcgtgcccgaagacaccgccgaatacgccatcaacatgtccaaccaacgccactgggaaccggcgatgcaggcctacgtgggcgacctgctggccggcaaggacggcgcgcgcggcaaggacttcaacatgcgctggatcgccagcatggtcgccgacgtgcatcgcatcctcacccgcggcggcatcttcatctacccgtgggacaaaaaagacccgagcaagccgggcaagctgcgcctgatgtacgaagccaacccgatgagcatgctggtggaacaggccggcggcgcggcaaccaccgggcgcgaacgcattctcgacatccagccgacacagctgcaccagcgcgtgccggtgttcctgggctcgaagaacgaagtggccgaagcaacgcggtatcacctggatgccgacaaggcctaa

SEQ ID NO: 39942 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 39943 - DNA, 1002 bp, Chlorobium tepidum TLS
  CDS (1)..(1002)
atgaacaagctcaccaccattgaaagccatttcctgcaattgcagaaacgctatcccgaaatcaacagcgaagtgaccgacctcctcaacgacgtcgccttcgcggccaagctggtgcggcgcgaagtcgtgcgggcgggtctggccgacattctcggccttgccggatcgaccaacgtgcagggcgaagaggtcaagaagctcgacctgttcgccaacgagcggctcatcaacgccatcggtcagcacgggcgcttcgccatcatgggttccgaggagaacgaagagatcatcaagccgcccaagttcgagtcgggcgaatacgtcctgctcttcgacccgctcgatggctcgtcgaacatcgacgtgaacgtcagcgtcggcaccattttctcgatctaccggctcaagagcggcgagccatcgcaggccagcctcgaggactgcctgcagaaaggggctgaccagattgccgccggatacgtcatctacggctcgtcggtgatgatggtttataccacgggccacggcgttcacggtttcacctacgaccagaccgtcggcgagttcctgctctcgcacgagaacatcaccactcccgaacacggtaaatactactcggtcaacgagggctcctggcaggagttcaacgacggcacgaagcgctttctcgactacctcaaggaagaagacaaagcaaccggacgcccctacagcacccgctacatcggttcgttcgtcgccgatttccaccgcaacctgctcaccggcggagtgttcgtctatccggccacaaagaagcacaaaaacggcaagctgcgcctgatgtacgaagccaacccgatggccttcatctgcgaacaggctggaggccgcgccaccgacggataccgccggattctcgacatagagcctaaggagctgcaccagcgcacgccgctctacatcggcagcaaaaacgacgtcctcatcgccgaagagttcgaacaagggaagcgatga

SEQ ID NO: 39944 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 39945 - DNA, 1047 bp, Thermosynechococcus elongatus BP-1
  CDS (1)..(1047)
atgactgactatgcagcccaccaacaggctctcgatcgcgattgtttgaccctatctcgccacgttctccaacaactccaaagctttgacgccgctgcccaagacctcagtgccctgatgaatcgcattgcccttgctggcaagcttattgcccgccgtttgagtcgagcaggtctgatggagggggtcttgggttttacgggagctgtaaatatccaaggcgaagatgtcaaaaaaatggatgtctatgccaacgaggtctttattgcggcctttaagcagagtggcttggtgtgtcgccttgcctccgaggaaatggcgcagccctactatattcctgaaaattgccccatcggccgctacaccctcctctacgaccccctcgatggttcctccaatgtggacattaacctgaatgtgggatcgatttttgccattcgccagcaggaggggactgatctagacagcaccgctgccgatctcctgcaagatggtcaccagcaaattgccgctggctatattctctatggccccagtacgatgctggtctattccctgggcaagggtacccatgtgtttgtccttgaccccagcctcggtgagtttattctggcgatcgagaacctgcaaattcctgccagtggtgccatttacagtgtgaacgaaggcaacttctgggcgtgggaagaaccgattcgtaactacgtccgccatgtccatcgtcagcccggctatagcgcccgctacagtggtgccctggtggctgatattcaccgtattctcatggaggggggcgtctttctctatccgggtacccaaaagaaccccgccggtaagttgcggctcctctacgaagcggctccaattgccttcctggtggaacaagcagggggtaaagccagtaccggtacccaaccgctcctcgatgttgtgcccgatcatctgcacatgcgtacaccactgattgttggcagtcctgagaatgtagccctcgtggaatcctttatccagcaaacccctgcccaaccaaccgtgacacaggtgtaa

SEQ ID NO: 39946 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 39947 - DNA, 1125 bp, Leptospira interrogans serovar Lai str. 56601
  CDS (1)..(1125)
ttgagttttcattttcagactttttatgggatcttttcgcttgaattcacagacccacaaaaaaactctgttggaatcattttcttagaggaatctatgtctgttcatcctacacaaacattgagtctttcccagtatttaatcgaggaacagctcaaattaccccaggctactggagattttaccgccttgatgagccatttggtttatgcagctaaaattgtttccagagaggttcgaaaagcgggacttttagaaaatattttaggtgcgacggaaactgtcaatgttcaaggggaaacccaaatgaaattggacgaatacgcagataaggtttttaatcatacactgactcgttcgggtcatctttgtattttaggaagtgaagaacacgaagaaaccgttcccgttccaaacgggtataaaatcggtaagtatacaatcgcaattgatccgttagacggttcttctaatatagatgccaatgtttctattgggactattttttccgttcatttgagaaaaagtcctgctggaactccaggaacgttaagcgatcttttacaacaaggttctggacaaagggctgcaggttatgttttatatgggtcttctacaatgcttattctttgtaccggcaaaggagtttctggttttacgttagatccttcttgcggtgaatttatactctcgcatccggatatgcagattccggaaacgggtggaatttattctatcaacgaaggaaattataactattggtccgacgaagtaaaaaattatattcgtgacatcaaatcgattgaaggaggtagaaaacctcaatcgggtagatacattggttccttagttgcggattttcatagaaatcttctaaaaggaggaatctttctctatccaaacgatactaagtccacgaaatatccgaacggtaaattaagacttctttatgaagcggctcctatggcttttattgcggaacaagcgggtggtatggctgtgactgtttatggagaaagaattctggatcttactcctaaagagcttcatgaacgtacgactttagttgtgggaagtaaaaaggaagtggaacattttttaaagtttgctcctaaaaaatcttaa

SEQ ID NO: 39948 - protein, 374 aa, Leptospira interrogans serovar Lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 39949 - DNA, 978 bp, Shewanella oneidensis MR-1
  CDS (1)..(978)
atgcagactcttgcccaacacttaacctcaaaggcagtgaacgaatccctcgcgcaactgattttgaccttagccgacacctctaaagccattagccatgccgtacgccacggagccttagccggcgtgttaggcgcgaccgaacaggaaaacgtgcaaggtgaaacccagaaaaaactggatatcatcaccaacgatatgcttaaagatgcgctcaaagccgacggaacagtgcgcggcctcgcctctgaagaagaagatcatgtggttgaagtcagcgccaatggtcaatatctagtgtgtttcgaccctttagatggttcatcgaatatcgatatcaactcgctggtcggcacgattttctccgttttacccgcaccgcagggtgaattaaccgaggcgagcttcctgcaatctggccgcaatcagttagcagcaggttatgtactctacggcccatcgaccatgctcgcgctcaccacaggccaaggcgtgcaactctttaccctgcacccagaaaccaacgaatttttactgaccaacgccaccatgagcatcagccctgacaccagcgaattcgccattaacatgtcgaaccaacgtttttgggaagcgccaatgcagacctatatcgccgatttactgctcggtaaaattggcccgcgcgaaaaatccttcaacatgcgctggattgccgccatggtcggtgacgtgcaccgcgtactttctcgcggcggtatttttacttacccaaccgacaataaagatccgaaaaagccatacaagctacgtttaatgtacgaagccaacccaatggccttcttggtcgagcaagccggtggtaaagcctctaccggttatgaaaccattttggatattcagccaacacaaattcaccaacgtgtagcggttatccttggtagcgccaatgaagtggacgcttgcctaagctaccatggtatcgattctcgtaaataa

SEQ ID NO: 39950 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 39951 - DNA, 1011 bp, Pseudomonas putida KT2440
  CDS (1)..(1011)
atgtcccgcgttaccctgagtcgctatctgattgagcagacccgcagcaacaatacccctgccgatctgcgcttcctgatcgaagtggtagcgcgtgcgtgcaaggaaatcagccaccacgtgtccaaaggcgccctcggtggtgtgctgggcagcatgggcactgaaaacgtgcagggcgaggtccagaagaaactggacgtgatttccaacgatatcctgctggaagccaacgagtggggcggtcacctggctggcatggcttccgaagaaatggacaacgcgtaccagatcccgggcaggtacccgaaaggcgcctacctgctggtcttcgacccgctggacggttcgtcgaacatcgacgtcaacgtgtcggtcggtaccatcttctcggttctgcgttgccctaaccagtacctgagccagaacgaaagcctcaacgaagaagcgttcctgcagccaggtaccgagcaggttgctgccggttatgccatctacggcccgcagaccatgctgatcctgaccctgggcaacggcgtcaagggcttcaccctggatcgcgaactgggcagcttcgtgctgacccacgaaaacatccgcgtaccggagaccaccgccgagttcgccatcaacatgtccaaccagcgtcactgggaagccccggtacagcgctatgtgggcgaactgctggcaggcgagaccggcccgctgaagaagaactacaacatgcgctggatcgcctcgatggtggccgacgtgcaccgcatcctgacccgtggcggcctgttcatgtacccacgtgacgcccgcgaaccaagcaagccgggcaagctgcgcctgatgtacgaagccaacccgatgtcgttcatcatcgaacaggccggtggcgcttccaccaacggttacgatcgcatcctcgacatcaagccagaaagcctgcaccagcgcgtgtcggtgattctcggctcgaaggaagaggtcgagcgcgtcaccgcttaccacaaggagtaa

SEQ ID NO: 39952 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 39953 - DNA, 1038 bp, Bradyrhizobium japonicum USDA 110
  CDS (1)..(1038)
atgaccgggcaactcaggctggacgaccaccttcaacggtactcggagaccgcaccccacgcgctggcggtggcgaccgcggtcgatgccatcgcggcggcggcgatcgagatcgccgacctcatcggcgccggcgatctcgcggacgcctcgggcctgaccacgggccgcaacagcgacggcgacgtccagcgcgatctcgacgtgcaggcggacgcgatcctgcgccgctgtctcggcaagctgtcgatcgcagcgctggcgtcggaggagatgcgcgagccgcagatcggcgaccgcgcggccaggatctgcgttgcgatcgatccgctcgacggctcctccaacatcgacatcaacatgaccgtcggcacgatcttctcgattctgcccgcgcccgacgatctcgcgctcgccttccatcagcgcggctcggcacagttcgcggcgggcttcgtcacctacggtccgcagacctcgctggtgctgacgctcggcgacggcgtcgacatcttcacgctcgaccgcaaggccggctgctttcgcctcgcgcgcagcgccatccagatctccgaggcgggcgaggagttcgcgatcaacgcgtcgaatcgccggcattgggatcctccggtgcgtgccttcatcgacgaatgcctcgccggcgtcgaaggccccgccaatcacgatttcaacatgcgctgggtcggttcgctggtcgcggaggcctatcgcatcctcacccgcggcggcgtgttcctctatccctcggacgcgcggcccggctatggcgacggccgcctgcgcctcacctacgaggcgcatccgatggcctacatcatcgagcaggccggcggctcggcctcgaccggacgcgagcgcatcctcgacctgtcagcgcaaagcctgcaccagcgcgtgccgctgatcatgggctcgagcaacgaggtgcggcgcgtcgaggagctgcattgcgatccgctgctggttgccagcatctcagcgccgctgttcgcgcggcgcggcttcttccggctgtaa

SEQ ID NO: 39954 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 39955 - DNA, 1011 bp, Pseudomonas syringae pv. tomato str. DC3000
  CDS (1)..(1011)
atgtcccgcgtcacactaagtcgttacttgatcgagcagacccgcagcaacaacacccctgccgatctgcgcttcctgatcgaagtggtggcgcgcgcttgcaaggaaatcagccacgccgtctccaaaggcgcgctgggcggcgtactgggcagcatgggcactgaaaacgttcagggcgaagtgcagaaaaaactcgacgtgatctccaacgaaattctgctcgaagccaacgaatggggcggtcacctggccggtatggcgtccgaagaaatggacaacgcctaccagatcccgggcaaatacccgaagggcgcgtacctgctggtgttcgacccactcgacggctcgtcgaacatcgacatcaacgcaccggtcggcaccatcttctcggtactgcgttgcccgaacgagtacctgagccagaacgaagccctgaacgaaaaagctttcctgcagccaggcactgaacaggtcgcggccggttatgccatctacggcccgcagaccatgctggtactgacgctgggtgacggtgtgaaaggctttacgctggaccgtgaaatgggcagcttcgtactgactcatgaagacatcaccattcctgagaccactcaggaattcgccgtcaacatgtccaaccagcgccactgggaagccccggtacagcgctacgtcagcgagttgctggccggtgaagacggtccgctgaaaaagaactacaacatgcgctgggttgccgcgatggttgccgacgtgcatcgcatcctgacccgtggcggcctgttcatgtacccacgcgacagccgcgagccgtccaagccgggcaaactgcgcctgatgtacgaagccaacccgatgtccttcctggttgaacaggctggtggcgcgtccaccgatggccatcagcgcatcctcgacatccagcccgaaggcctgcaccagcgcgtagcggtgtacctgggctcgaaagaagaagtcgagcgcgcaaccgcgtatcacaaagagtaa

SEQ ID NO: 39956 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 39957 - DNA, 999 bp, Salmonella enterica subsp. enterica serovar Typhi Ty2
  CDS (1)..(999)
atgaaaacgttaggtgaatttattgtcgaaaagcagcacgagttctctcaggctaccggtgagctcactgctttgctgtcggcaataaaattgggcgccaagatcatccaccgcgatatcaacaaggccggtctggtcgatatcctgggtgccagctgtgctgagaacgtacagggcgaggttcagcagaaactcgatctgttcgcgaacgagaaactgaaagctgcactaaaagcgcgcgatattgtagcgggcatcgcatcggaagaagaggacgaaattgtcgtctttgaaggctgcgaacacgcgaaatatgtggtgctgatggaccctctggatggctcttctaacatcgacgttaacgtctctgtcggtacgattttctcgatttatcgccgcgtgacgcccgtcggcacgccggtcaccgaagaagatttcctgcaacccggcaacaaacaggtcgctgcgggatatgtcgtgtatggctcgtccaccatgctgatttacaccaccggctgcggcgtacacgctttcacctacgatccgtcgttgggcgtgttctgtctgtgccaagaacgtatgcgtttcccggaaaagggtaaaacctactccattaacgaaggcaactacattaagttcccgaatggcgtgaagaagtacatcaaattctgccaggaagaggatagttcaacaagtcgcccttatacctcacgttacattggctctctggtggccgatttccaccgcaacctgctgaaaggcggcatctatctctaccccagcaccgccagccatccgcaggggaaactgcgtctgctgtatgaatgcaacccgatggcgttcctcgcggaacaggccggtggcaaagcaagcgatggtaaagaacgtattctggatatcattccggaaagcctgcaccagcgccgctcgttcttcgtcggcaaccgccatatggttgacgatgtggaacgctttatccgcgaatacccggacgcgtaa

SEQ ID NO: 39958 - protein, 332 aa, Salmonella enterica subsp. enterica serovar Typhi Ty2
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 39959 - DNA, 1005 bp, Nitrosomonas europaea ATCC 19718
  CDS (1)..(1005)
atgcataccggtactacccttacccagttcatcattgaagagcagcgtcacatcgcgggagcgagcggtgatttcaccgcattgctgaacgatatcgtgactgctatcaagaccatttccaatgcggtgaacaagggggcgctgattggtgtgatgggggcgctggatacagaaaacgttcagggtgaaacccaaaaaaagctggatgtgattaccaatgaaatcatgatccgcaacaatgaatgggctggtcatctttctggcatggcatcggaggaaatggatgatgtctactcgattccgtctccttatccactcggcaaatatctgctggtatttgacccgctggatggttccagtaacgtggatctcaatatttccgtcgggacgattttttcgattttgcgctcgccagtgccaagccgggctgccagtatggaagatttcctgcaacccggcgtcaaacaggtttgtgcaggttatgcattgtatggttcatccaccatgttggtgctgaccacaggccatggtgtcaatggttttacgctggatcgtgatatcggtgaattcgtgctgacacatccaaacatgaggattcccgccgataccagggaatttgccatcaatgcctccaaccagcgtttctgggaagcaccggtacagcgttatgtggcggagtgtctggcaggaagtaccgggccgcgcggtcgcgatttcaatatgcgttgggtggcttcgatggtggcagaggtgcatcgtatcctcactcgcggtggtattttcatgtatccgcgcgataccaaagatccctccaaacccggcagactgcgtctgatgtacgaagccaatccgatgagttttatcgtcgaacaggcaggcgggttatccaccaccggctacgagcgcattctggatgtcgtgccgcaggatctgcatcagcgtgtaccggtgattctgggctcgaagaacgaggtcgaggtggttctggagtatcacaatgcctga

SEQ ID NO: 39960 - protein, 334 aa, Nitrosomonas europaea ATCC 19718
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 39961 - DNA, 840 bp, Helicobacter hepaticus ATCC 51449
  CDS (1)..(840)
atgataagcatcattattgattctttaagagaatctgccctacatattgatagtcttttaaaagacacttccacaagctatctgcaaagcattaatgcaagtggcgatatgcaacttgaaattgatgtaagggttgataaatttttaagcgaaaaattacttaatctaccttgtgtaaaggctatctgtagtgaagagcaagaagaaataatgtattcagaaaataaaaatgcaccctatattattgcttatgaccctcttgatggctcttcgctcattgatagtaacctaagtattggcacaatttttggcatctataacgaagagttaagtgcaaaacatcttattgctagtggatatattatttatggaccgcgtcttgaaatggtagtggctcaagagcaagctctgcattatcgctataatggcaatatgtggcgcaatcttggtgcattagctcttaatacaaaaggtaaaattaacgcgcccggtggcacacaaaagcattgggaaaacaaacacaaagcaatgatagaatccctttttgcacaggggtatcgtttgcgctattctggaggtatggtgccagatttgcatcagattcttattaaaggtggggggctttttagttatcctgccacgagtgatgctcctaatggcaaacttcgcaaactttttgaagtatttccctttgcatttgtgtatgaaaaagctggaggatttgctacaaatggcacttatagaattttagagcttgaagttgctcacctacacgatagcacaccttgtttttttggtagccaaagtgaaatgaaccttgtaaaggaagtctatgagtga

SEQ ID NO: 39962 - protein, 279 aa, Helicobacter hepaticus ATCC 51449
MISIIIDSLRESALHIDSLLKDTSTSYLQSINASGDMQLEIDVRVDKFLSEKLLNLPCVKAICSEEQEEIMYSENKNAPYIIAYDPLDGSSLIDSNLSIGTIFGIYNEELSAKHLIASGYIIYGPRLEMVVAQEQALHYRYNGNMWRNLGALALNTKGKINAPGGTQKHWENKHKAMIESLFAQGYRLRYSGGMVPDLHQILIKGGGLFSYPATSDAPNGKLRKLFEVFPFAFVYEKAGGFATNGTYRILELEVAHLHDSTPCFFGSQSEMNLVKEVYE

SEQ ID NO: 39963 - DNA, 987 bp, Wigglesworthia glossinidia endosymbiont of Glossina brevipalpis
  CDS (1)..(987)
atgatctcattaagagaatttatttttagcaataacgttaataaatacatttctaaagaagatttgtattctttgtttattataatagaattaacttctaaaattattcataattatattattttaaataatataaccagaataaaacaagaaaaaataaagaaaaatatacatggagaacaccaaactaaattagacttattatcaaacaaaaaatttatagatatgataaaaactcattataatattgcaggaatagcttcagaagaagaagcgaaatttatttcttttaaacaagaaaaatatggaaaatatatatttttaattgatccattggatggatctttaagtgcagattgtaatactccagtaggtactatattttctttatattgtagagttactcctataggagtagagataagcgaaaaagattttttacaacctggaaataaacagatattgtctggatatattttatatggatcttcaacaattttagtttttacggtaaaatctggagttcatatttttacttatcatccattttttagtactttttttttatcaaaaaagaactttaattatccaaaaaaaaacaatatttattcaattaatgaagcaaattataataatttttcattaggaataaaaaaatatataatgtcttgtaaaagcaataataatatatcttcaagatatactggttctttagttgctgattttcatagaaatttgataaaaggaggaatatatttatatccaaataccaaaatctataaacatggaaaattaagattaatgtatgaatgcaatcctatcgccttaatatcttcacaagctaatggtagttcaagtgatggtaatataaatattttagacataaatcctaaaattttacaccaatgttctcccttttttgttggtacaaaatctatggttaaattagtaaataaatttattttaggttattataatcataattaa

SEQ ID NO: 39964 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 39965 - DNA, 1020 bp, Bordetella bronchiseptica RB50
  CDS (1)..(1020)
ttgaaacgtaaaacccttacccaatatctggtcgagcagcagcgctcggcccaggcgctcggcccggaagtgcgcctgctgatcgaagtggtggcgcgcgcctgcaaggccatcagccacgctgtcagcaaaggcgcgctgggcggcgtgctcggcagcctggaaagcgagaacgtgcagggcgaagtgcagaagaagctggacgtgctgtccaacgaaatcctgctcgaagccaacgagtggggcggccacctggccgcgatggcgtccgaggaaatggaaaccatccatctgatccccaaccgttatcccaagggcgagtacctgctgctgttcgatccgctggacggctcgtccaacatcgacgtcaacgtgtcgatcggcaccattttctcggtgctgcgcgcgccgcacagggtggccggcgccgacgtctgcgagcaggacttcctgcagccgggcagccagcaggtggcggccggctacgccgtctacggtccgcagaccatgctggtgctgaccatcggcaatggcgtggtggggttcacgctggatcgcgagatgggttcgtgggtgctgacgcacgaatcgatgcgcatccccgaggacaccaaggaattcgccatcaacatgtccaacatgcgccactgggccccgccggtcaagcgctacatcgatgaatgcctggccggcaagacgggcccgctgggcaaggactacaacatgcgctggatcgcctccatggtggccgacgtgcatcgcatcctgacccgcggcggcattttcatgtatccctgggatgcccgcgagccgggcaaggccggcaagctgcgcctgatgtacgaagccaacccgatgggcctgatcgtcgagcaggccggcggcgcggccatcgacggcacggggcgcatcctggatatccagcccgacaagctgcaccagcgcgtgtccgtgatcctgggttcgaagaacgaggtggagcgcgtggggcgctaccacgccgaagcgcacgccagctag

SEQ ID NO: 39966 - protein, 339 aa, Bordetella bronchiseptica RB50
MKRKTLTQYLVEQQRSAQALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLRAPHRVAGADVCEQDFLQPGSQQVAAGYAVYGPQTMLVLTIGNGVVGFTLDREMGSWVLTHESMRIPEDTKEFAINMSNMRHWAPPVKRYIDECLAGKTGPLGKDYNMRWIASMVADVHRILTRGGIFMYPWDAREPGKAGKLRLMYEANPMGLIVEQAGGAAIDGTGRILDIQPDKLHQRVSVILGSKNEVERVGRYHAEAHAS

SEQ ID NO: 39967 - DNA, 1008 bp, Chromobacterium violaceum ATCC 12472
  CDS (1)..(1008)
atgagccgcatcaccctctcccgttttctgatcgaacaacagcgcaaggccggcacgcttccaccggagctgcgcctgctgatcgaaaccgtgggccgcgcctgcaaggccatcagctactcggtgaacaagggcgcgctggccgacgtgctgggcgaggccggcaccggcaacatccagggcgaggcgcagaagaagctggacgtgatcgccaacgacttcctgctggacgccaacgagtggggcggcagcctggccgcgatggcgtcggaagagatggagctgccctaccacatcccgggcgaatacccgaagggcgaatacctgctgatgttcgacccgctggacggttcgtccaacatcgacgtcaacatctccgtcggcaccattttctccatcctgcgctgccccgagggcgtgacgcagccgacagaaaccgatttcctgcagcctggcacccaccaagtcgccgccggctacaccgtgtacggcccgcaaaccatgctggtgctgaccttcggcagcggcgtgcacggctttacgctggaccgcgagcacggctctttcgtgctgacccacccggacatgaaagtgccggaacgcaccgccgaattcgcgatcaacatgtccaatatgcgccactgggaagcgccggtgcgccgctacgtggaggagatgctggccggcaagaccggcccgcgcggccgcgatttcaacatgcgctgggtggcgtcgatggtggccgaagtgcatcgcatcatcacccgcggcggcatcttcatgtatccgaaggacgcgcgcgatccgtccaaggccggcaagctgcggctgatgtacgaaggcaacccgatggccttcatcatcgagcaagccggcggcgcggccaccaacggccaccagcgcatcctggacatcgtgccgaccaagctgcacgagcgcgtggcggtgttcctcggctctaaggaagaagtggaactggtgacgcgctatcatagcgaacagcaataa

SEQ ID NO: 39968 - protein, 335 aa, Chromobacterium violaceum ATCC 12472
MSRITLSRFLIEQQRKAGTLPPELRLLIETVGRACKAISYSVNKGALADVLGEAGTGNIQGEAQKKLDVIANDFLLDANEWGGSLAAMASEEMELPYHIPGEYPKGEYLLMFDPLDGSSNIDVNISVGTIFSILRCPEGVTQPTETDFLQPGTHQVAAGYTVYGPQTMLVLTFGSGVHGFTLDREHGSFVLTHPDMKVPERTAEFAINMSNMRHWEAPVRRYVEEMLAGKTGPRGRDFNMRWVASMVAEVHRIITRGGIFMYPKDARDPSKAGKLRLMYEGNPMAFIIEQAGGAATNGHQRILDIVPTKLHERVAVFLGSKEEVELVTRYHSEQQ

SEQ ID NO: 39969 - DNA, 843 bp, Wolinella succinogenes DSM 1740
  CDS (1)..(843)
atgttagaagctatttttgaaaaaatcaaagagtgcgccccctatatccaaggggttatcggggagagcgcgggcgaatattttgagaccaaaaacgccacgggcgaccagcagctcaaagccgaccttaaagccgacatgatcattgagcaggagttcgccaagattccctctatcaaagggctttgcagcgaggagaaggagggttgcctcatcctcaatcctgaaggtcgctacatgatcgcctacgaccctctggatggctcttcgcttgtggaggtcaacatgagcgtggggactatctttgggatctatgagggagagtttggcgccaaaaacctcatcgcctctgcctacattgtctatggtccaggaattgagctcgtgatcgctcatgaaaaagtggagctctacaccttccagtttggacgctttgagcatcgaaaaaccctcgccctccaagaaaagggcaaaataaacgccccgggtgcgacccaagcctgctggcaccccaagcacaaggagttcatcgattcactctttgccgaggggtatcgcctccgctactctggcggtatggtgcccgacttgcacaatatcctcatcaaagggggcggactctttagctacccaggcgcgagcgacaatcccaagggcaagctccgaatgctctttgaagcactcccttttgccttcatctttgaaaaagcaggcggagcggcgattgatggtaaaaagcggctcttagagcttgaacattcccatttgcatgataccactccttgcttctttggaagcattcatgagatagagcgtgtccgaagcgtctaccaagaactctaa

SEQ ID NO: 39970 - protein, 280 aa, Wolinella succinogenes DSM 1740
MLEAIFEKIKECAPYIQGVIGESAGEYFETKNATGDQQLKADLKADMIIEQEFAKIPSIKGLCSEEKEGCLILNPEGRYMIAYDPLDGSSLVEVNMSVGTIFGIYEGEFGAKNLIASAYIVYGPGIELVIAHEKVELYTFQFGRFEHRKTLALQEKGKINAPGATQACWHPKHKEFIDSLFAEGYRLRYSGGMVPDLHNILIKGGGLFSYPGASDNPKGKLRMLFEALPFAFIFEKAGGAAIDGKKRLLELEHSHLHDTTPCFFGSIHEIERVRSVYQEL

SEQ ID NO: 39971 - DNA, 1110 bp, Oryza sativa (japonica cultivar-group)
  CDS (1)..(1110)
atggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcaggcaagtgtacctggcaataactgtcatctttctcagtttcttgtctctgagattgagataggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaatgtaatagtgttgaggcctggaacagcttcatga

SEQ ID NO: 39972 - protein, 369 aa, Oryza sativa (japonica cultivar-group)
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 39973 - DNA, 1047 bp, Gloeobacter violaceus PCC 7421
  CDS (1)..(1047)
atggacaccacgcccctcaccccgctcaccaagggcatcaccctctaccagcacatcctttcccagcaggcgctcaatcccgacgccaccggcgaatttagcggcctgatggtgcagatcagcctggcggccaaactgatttcgcgtcagctcgcccaggcgggcctggtcgaaaacgtgctgggctttaccggcgagacgaacgtccagggcgaagcggtccgtcacctcgaccagtacgccaacgagacgtttattcgcgtcttccagaacacaaatctggtctgcctgctggtctccgaagaactcgaagaccccctgccgctctccaaccagtgcccgatcggttcctacgctctggtcatcgatccggtggacggctccagcaacatcgatgtgaacgtctcggtggcctcgattttctcggtgcagcggcgcaacccgcgcgccaccgacgagacaagcagcctgctgcaaaaaggcaccgggcaggtggcggcgggctacgtgctctacggccccaacacgatgttcgtctacaccagcagccagggggtgcacggttttaccctcgacgccggtctgggggaattcgtcctctcccacccgaatatccgcatccccgagcgcggcgattactacagcatcaacgacgcctactcggccgaatggcagccgggcacgcgcgcctttatcgactacctcaagcaggccaaaagccggggcgaaaaagcctactccgcccgctacatcggctcgctggccgccgatgtgcaccgcacgctgctcaccgggggcatctttctctacccgggcaccgtcgccaagcccaagggcaagctgcggctgctctacgaagcccagcccctcgcgctcatcgccgagcaggcggggggcaaggcgagcaccggcaccgagcgtatcctcgatatcgagcccaagacactccaccagcgggtgccactcgtcatcggcagtccctacgaagtggatctggcggtggccttcgctcggggcgaaaaacaaaccgtggttgccggttcgtaa

SEQ ID NO: 39974 - protein, 348 aa, Gloeobacter violaceus PCC 7421
MDTTPLTPLTKGITLYQHILSQQALNPDATGEFSGLMVQISLAAKLISRQLAQAGLVENVLGFTGETNVQGEAVRHLDQYANETFIRVFQNTNLVCLLVSEELEDPLPLSNQCPIGSYALVIDPVDGSSNIDVNVSVASIFSVQRRNPRATDETSSLLQKGTGQVAAGYVLYGPNTMFVYTSSQGVHGFTLDAGLGEFVLSHPNIRIPERGDYYSINDAYSAEWQPGTRAFIDYLKQAKSRGEKAYSARYIGSLAADVHRTLLTGGIFLYPGTVAKPKGKLRLLYEAQPLALIAEQAGGKASTGTERILDIEPKTLHQRVPLVIGSPYEVDLAVAFARGEKQTVVAGS

SEQ ID NO: 39975 - DNA, 1005 bp, Photorhabdus luminescens subsp. laumondii TTO1
  CDS (1)..(1005)
atgaaaacattaggcgaattcatcgtcgaaaagcagcaagatttttctcacgctacaggtgaactcactgcattgctttctgctattaagctcggagcaaaaatcattcaccgtgatatcaacaaagccggtttagtggatattttaggaaccagcggtgtgtccaatgtccaaggcgaagtacagatgaaactggatctgtatgctaatgaaaaactcaaagcagcactgaaagcacgcggtgaagttgcaggaatcgcttctgaagaagaagatgatatcgttattttcgaaggcgaccgcgctgaaaacgcaaaatatgttgttttgatggacccattagatggctcttcaaatattgatgtaaacgtttccgtcggtactatcttctctatctaccgccgtattacccccattggtcagccagtaactgaaaaagatttcctgcaaccaggtcatcgtcaagtcgccgccggctatgttgtttatggttcttcaactatgctggtctacaccaccggctgtggggtacacgcctttacttacgatccttctttgggagtattttgtctttcccatgagaaagttcagttcccacccaatggcaatatgtattccatcaacgaagggaattacatcaaattccctatgggggtaaagaaatacatcaaatattgccaggaacaagatgaagcaactcagcgcccttataccacccgttatattggttcgctggttgctgatttccaccgcaatttactgaaaggtggtatctacatttacccaagtaccgccagccacccatcaggaaaattacgcctactgtatgaatgtaacccaatggcattcctggccgaacaagcgggtggtaaagccagtgatggtgccaaccgcattctggatatcactccatccaaactgcaccaacgcgtacctttctttgtgggtagtaaatcgatggtggaaaaggcagagagttttatggctgagttccctgatgagtaa

SEQ ID NO: 39976 - protein, 334 aa, Photorhabdus luminescens subsp. laumondii TTO1
MKTLGEFIVEKQQDFSHATGELTALLSAIKLGAKIIHRDINKAGLVDILGTSGVSNVQGEVQMKLDLYANEKLKAALKARGEVAGIASEEEDDIVIFEGDRAENAKYVVLMDPLDGSSNIDVNVSVGTIFSIYRRITPIGQPVTEKDFLQPGHRQVAAGYVVYGSSTMLVYTTGCGVHAFTYDPSLGVFCLSHEKVQFPPNGNMYSINEGNYIKFPMGVKKYIKYCQEQDEATQRPYTTRYIGSLVADFHRNLLKGGIYIYPSTASHPSGKLRLLYECNPMAFLAEQAGGKASDGANRILDITPSKLHQRVPFFVGSKSMVEKAESFMAEFPDE

SEQ ID NO: 39977 - DNA, 1017 bp, Vibrio vulnificus YJ016
  CDS (1)..(1017)
atgtctggaatgcgcacccttggcgagttcattgttgagaaacaagcggacttcccccacgctagcggtgatctctcttctcttttgtcgtcgattcgcttggcggccaaaatcgttaaccgtgaaatcaacaaagcgggtctcgttgatatcacaggcgcggcaggagtagagaatatacaaggcgaagttcaacaaaagttggacgtgtatgcgaatgaaaaattcaaatcggcactcgaagcacgcgaccaagtgtgtggcgtagcgagtgaagaagaagatgaagcggttgcttttaacaaagagctaaacaaaaacgccaaatacgtggtgttgatggaccctcttgatgggtcatcgaacatcgatgttaacgtttctgttggcaccattttctctatctaccgtcgagtttcccctattggcactcccccgactcaagaagacttcttgcagccaggacacaaacaagtggccgcgggttacatcatttacggctcttccaccatgctggtgtacaccacaggcaatggcgtgaatggtttcacctacgatccatcactcggcaccttctgtctgtcgcacgaaaacatgatgatcccacaaaatggcaacatctattcgatcaacgaaggcaactatattcgcttccctatgggcgtgaaaaaatacattaagtattgtcaggaaaatgtgcctgaagatggccgtccttacacctctcgctacatcggctcgctcgtggcggatttccatcgcaacctgcttaagggcggtatttatctttacccaagcacacaaagccacccacaaggcaaactgcgcttgttgtacgagtgcaacccaatggcgttcttgattgagcaagccggtggtttggcttctgacggggtgaaccgcattcttgatttaaaaccgacagaattgcatcaacgcgtgcctttctttgttggctccaccaacatggtgaagaaagtcgaagagttcctcgaagtctatcgtgacgaagcctaa

SEQ ID NO: 39978 - protein, 338 aa, Vibrio vulnificus YJ016
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 39979 - DNA, 1032 bp, Rhodopseudomonas palustris CGA009
  CDS (1)..(1032)
atggatcagggccaaacgctctcagttcttttggattcgtatgcggtcgatccgcagaaaaaagctgtcgccgccgcggtcggcgcgatcgccgcgggatcgatcgaaatctctgaactgatcgggcagggggctctcgccggcatcaccggcgccgcgcacggtggcagcaatgccgatggcgacgtgcagaaggatctcgacgtcaaggccgagcagatcatcgtcaagtcgctgaaggatgtgccgtacgccgcgctggcgtcggaagaatccgacaccctgctcgacggcgatccgaacgcgccgatttcgatcgcctacgatccgctcgacggctcgtccaacatcgacaccaacatgacggtggggacgatcttctcgatcatcccgaaccagccgggcgtgaagccgttcactgcggccggctcctgccagattgcggcgggcttcgtggtgtatgggccgcagacctcgctggtgctgacgctcggtgacggcgtcaacatcttcacgctcgaccgcaaggccaaggtttaccggctgatccgcgagcgcgtgaaggtgccggccgacaccgccgaatacgccgtcaacgcctccaaccatcgccattgggagcaaccgatccgcgacttcgtcgacgagtgcatcgccggcgccgacggcccgcgcgccaaggatttcaatatgcgctggatcggctctctggtggccgaggtgtatcggatcctcacccgtggcggcgtgttcctgtaccccggcgacaaccgcccgggctacggcaacggccggctgcggctgctctacgaaacccatccgatgtcgttcgtgatggagcaggccggtggcgccgcttcgaccgggcgcgagcgggtgctcgatctcaccgccaagacgatccaccagcggtcgccgctgatcatggggtcgatcgacaaggtcaagcgcatcgaactgctgcacaccgatccgagtgcggcctcgcgttcggcgccgctgttcgcccgccgcggcctgttccgcgtctga

SEQ ID NO: 39980 - protein, 343 aa, Rhodopseudomonas palustris CGA009
MDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 39981 - DNA, 942 bp, Geobacter sulfurreducens PCA
  CDS (1)..(942)
atgccgttcagcgagccgggcaagacgaaattccaggtagacctacgccgtcatctgcgaaatcaggatatcagcgataacctcgtgcacctgatctgcgagattgccgaggcaagcaagtatgtgatcaacgcagtccgcaccggtgatctcggcgtggccggtacctcgaacctctacggtgaggagcagttggccctggacgtgctttcggaccggatcatcagaaaacggctcatccattcaggagttgtctgcaacattgcatccgaggagatggatgagatcttccaggcccaggccgacgccgacggtctctactcggtggcgtacgatcccctcgacggctcgtcgctcgttgatgtgaatcttgccgtgggaaccatcgtgtcgatttacgaagggtgcaacctgctccagaaggggcgtaatcaggtggcagccatgtacatactctacggcccccgtgtttcgctggtgtattccgtgggcaaaggcgttcacgagttcaccatgaaccatctcatggagtacaccctgagccgggagaacgtcaccatgaagccggacggagacatctactcccctggcggactgcgcaaaaagtacctgccggaaacggaaaaattcgtgcagcaccttgagagtaagggatccaagcttcgctattcgggcggctttgtgcccgacatcaaccaggtactgatgaaagggaagggtattttcatgtatcctgccctcaacggttcacctaacggcaaactgcgcgtacttttcgagctgaaccccatggcttacctcatcgaaaatgcaggaggggcggccactgacggcaagacgcccatcctcgacatcgagccgcaatctctcgaccagcgggctcccattttcattggttgctccaatgacgtagccacggccatggagttcatgggcggctga

SEQ ID NO: 39982 - protein, 313 aa, Geobacter sulfurreducens PCA
MPFSEPGKTKFQVDLRRHLRNQDISDNLVHLICEIAEASKYVINAVRTGDLGVAGTSNLYGEEQLALDVLSDRIIRKRLIHSGVVCNIASEEMDEIFQAQADADGLYSVAYDPLDGSSLVDVNLAVGTIVSIYEGCNLLQKGRNQVAAMYILYGPRVSLVYSVGKGVHEFTMNHLMEYTLSRENVTMKPDGDIYSPGGLRKKYLPETEKFVQHLESKGSKLRYSGGFVPDINQVLMKGKGIFMYPALNGSPNGKLRVLFELNPMAYLIENAGGAATDGKTPILDIEPQSLDQRAPIFIGCSNDVATAMEFMGG

SEQ ID NO: 39983 - DNA, 1014 bp, Danio rerio
  CDS (1)..(1014)
atgtcagaccggggttccttcgacactaatgttgtgactttgaccagatttctgcttgaagagggcagaaaagctaaaggcacgggcgagctgacaacacttctgaacgcgatgtgcacggctgtcaaagccatatccagcgccgtcaggaaagcgggcatcgcgcatctgtatgggattgctggaagtaccaatgtgacaggtgaccaggttaaaaagctggacatcctttccaatgacctggtcataaacatgatcaaatcctcattcacgtcatgtgttctggttactgaagaacatgacactgccatcgttgtagagccagatagacggggtaaatatgtggtttgctttgaccctcttgatggttcatccaacattgactgccttgcatcaatcgggaccatctttgccatctacaggaagtgcaccgacagcgagccgtcagaaaaagatgcactgcagcctggcaggaatatagtggctgctggatatgcactgtatggcagtgccaccatgattgtcctctccaccggtcaaggggtgaactgcttcatgttagatccagctattggcgaattcattctggtggacagagatgtgaagattaagaagaaagggaagatctacagtctgaatgaaggctatgccctttattttgaccctgctgtcacagagtacctgcagaagaaaaagtttccagaggatggcagtgcgccctatggagcccgttatgtaggctcaatggtggcagacgtgcatcggacgctggtttacggaggaatcttcctttaccctgcaaatgtgaagagccccaaaggaaagctcagactgctgtatgagtgcaaccccatggccttcatcatggagcaggccggaggaatggccaccacaggcaccaccaacattctggacatccaaccggagaacatccatcagcgggtgccggtggtgatgggttcccctgatgacgtccaagagtacatctccatcttccagaaacaccacaaatga

SEQ ID NO: 39984 - protein, 337 aa, Danio rerio
MSDRGSFDTNVVTLTRFLLEEGRKAKGTGELTTLLNAMCTAVKAISSAVRKAGIAHLYGIAGSTNVTGDQVKKLDILSNDLVINMIKSSFTSCVLVTEEHDTAIVVEPDRRGKYVVCFDPLDGSSNIDCLASIGTIFAIYRKCTDSEPSEKDALQPGRNIVAAGYALYGSATMIVLSTGQGVNCFMLDPAIGEFILVDRDVKIKKKGKIYSLNEGYALYFDPAVTEYLQKKKFPEDGSAPYGARYVGSMVADVHRTLVYGGIFLYPANVKSPKGKLRLLYECNPMAFIMEQAGGMATTGTTNILDIQPENIHQRVPVVMGSPDDVQEYISIFQKHHK

SEQ ID NO: 39985 - DNA, 1029 bp, Eremothecium gossypii
  CDS (1)..(1029)
atggctaccgtgaacccacagagacgcgactccgcagaggctatcgacacggatatcattacgctggcgcgtttcatcctggagtcgcagcgcagctcggccaaaaacgcgacgggcgagttcaacctgctgctcaactcactgtcgtttgcgttcaagttcatctcgcagacgatcagacgcgcggagctggtgaacctgattgggctctccggcgcgtctaacgcgactggggaccagcagaaaaagttggatgtgctgggcgatgagatcttcatcaatgcgatgaaggccagcgggaacgtcaaggtgctggtgtcggaggagcaggaggacctgatcgtgttcccggagaccggtgggacgtatgcggtgtgctgcgacccgattgacgggtcgtcgaacctggacgccggtgtgtcggtgggcacgatcgtttcgattttcaagctgactccggactcgagcgggacaatcaaggatgtgctgcggtcgggccgggagatcgtggcagcgtgttacgcgatgtacggcgcgtccacgcacgtcatgctaacgacggggcagggcgtcaacgggttcacgctggataccagcattggcgagttcatcctgacgtaccgggacctgaagatgccagcgctgcggaacatctactcgatcaacgaggggaacatgcgcttctggaccgacgggattcgcaggttcgtggaggcgctcaaggactccgacaagccgtactccgcgcggtacattgggtccatggtggcggacgtacaccgcacgctgctgtacggggggctgttttcgtatccattggacatgaagaaccccaacggtaaactgtgcctgctgtacgaggcgttccccatggcattcctggtcgagcaggccggcggcaaggccgtgaacgaccgcggcgagcgcattctggaccttactcccgagcacatccacgacaagtcctcgatctggctcgggtccgctggcgaggtcgacaagtatctggcccacatcggccgggcgtag

SEQ ID NO: 39986 - protein, 342 aa, Eremothecium gossypii
MATVNPQRRDSAEAIDTDIITLARFILESQRSSAKNATGEFNLLLNSLSFAFKFISQTIRRAELVNLIGLSGASNATGDQQKKLDVLGDEIFINAMKASGNVKVLVSEEQEDLIVFPETGGTYAVCCDPIDGSSNLDAGVSVGTIVSIFKLTPDSSGTIKDVLRSGREIVAACYAMYGASTHVMLTTGQGVNGFTLDTSIGEFILTYRDLKMPALRNIYSINEGNMRFWTDGIRRFVEALKDSDKPYSARYIGSMVADVHRTLLYGGLFSYPLDMKNPNGKLCLLYEAFPMAFLVEQAGGKAVNDRGERILDLTPEHIHDKSSIWLGSAGEVDKYLAHIGRA

SEQ ID NO: 39987 - DNA, 1017 bp, Xenopus tropicalis
  CDS (1)..(1017)
atgacggaccaggcccccttcaacaccgatgtgattaccctgactcgcttcgttatggaggagggcaggaaagccaaggggaccggagaattaactcaactccttaactcgatgtgcacggctataaaagcaatctcttccgcagtgcgcaaagctggcctggccaacctctatggtattgccggatccactaatgtgacaggggaccaagtgaaaaaactagatgtcctctccaatgaccttgttatcaacatgctcaagtcctcatacagtgcctgtgtcctagtgtcagaagaagaccagcatgctctgattgtggagcctgaaaaacggggtaaatacgtggtgtgctttgatcctttggatggctcttcgaacattgactgcctggcttctattggtacaatattttccatctacaaaaagactacagaaggagagccaactgaaaaagatgctctacaaccaggacgaaacattgttgctgcaggctatgccctatatggcagtgcaacaatgttggttcttgccacagaatgtggtgtcaactgtttcatgttggacccagcaattggagagttcattttagtaaaccaggatgtgaaaatcaaaaagaagggcaacatttacagcctgaatgagggttatgccaagtattctgatgaagcagttactgaatacttacagaaaaagaaatttccagaagatgggagctcaccctacggtgcaaggtatgttggttcaatggtagctgatgtgcatcgtacattggtttatggaggaatctttctatacccagccaatgtaaagagcccaaagggcaagctgaggcttctgtatgagtgcaacccaatggctttcattatggagaaggccggaggaatggctactaatggacttgagtcagttcttgatgtagtacctgagagtatccaccagaggatgccagtagctttgggctccccagatgatgtgcaggaatatattaacatttacaagaaatatgcaaagaaataa

SEQ ID NO: 39988 - protein, 338 aa, Xenopus tropicalis
MTDQAPFNTDVITLTRFVMEEGRKAKGTGELTQLLNSMCTAIKAISSAVRKAGLANLYGIAGSTNVTGDQVKKLDVLSNDLVINMLKSSYSACVLVSEEDQHALIVEPEKRGKYVVCFDPLDGSSNIDCLASIGTIFSIYKKTTEGEPTEKDALQPGRNIVAAGYALYGSATMLVLATECGVNCFMLDPAIGEFILVNQDVKIKKKGNIYSLNEGYAKYSDEAVTEYLQKKKFPEDGSSPYGARYVGSMVADVHRTLVYGGIFLYPANVKSPKGKLRLLYECNPMAFIMEKAGGMATNGLESVLDVVPESIHQRMPVALGSPDDVQEYINIYKKYAKK

SEQ ID NO: 39989 - DNA, 1017 bp, Sus scrofa
  CDS (1)..(1017)
atgacggaccaggcggccttcgacaccaatatcgtcaccctaacccgcttcgtcatggaggagggcaggaaggcccgcggcaccggcgagatgacccagctgctcaactcgctgtgcaccgcggtcaaagccatctccaccgcagtccgcaaggcgggcatcgcgcacctctatggaattgctggctccacgaacgtgacaggtgatcaagtgaagaagttggatgtcctctccaatgacctggttattaacgtgttaaagtcatcttttgccacctgcgttctcgtgtcagaagaagataaaaacgccataatagtagaacctgagaaaaggggtaaatacgtggtctgttttgatcccctcgatggatcgtcgaacatcgactgccttgtgtccattggaaccatctttggcatctacagaaagaattcaactgatgaaccttctgagaaggacgcactgcagccaggccggaacctggtggcagctggctatgcgctctatggcagtgccaccatgttggtcctggccatggtgaatggagtcaattgcttcatgctggacccggccatcggagagttcattttggtggacagggatgtgaagatcaaaaaaaaggggagcatttacagcatcaatgaaggctatgccaaggagttcgaccctgccatcactgagtatatccagaggaagaagtttcccccagacaactcagccccctacggggccaggtacgtgggctccatggtggccgatgtccaccgcacgctggtctatggagggatctttatgtacccagcaaacaagaaaagccccaaaggaaagttaagactgctatacgaatgtaacccgatggcctatgtcatggagaaggcaggaggactggccaccactgggaaggaagctgtgctggacatcgttcccactgacatccaccagagggcgccaatcatcttggggtctcctgaagacgtgactgagctcttggaaatatatcagaagcacgcagccaagtga

SEQ ID NO: 39990 - protein, 338 aa, Sus scrofa
MTDQAAFDTNIVTLTRFVMEEGRKARGTGEMTQLLNSLCTAVKAISTAVRKAGIAHLYGIAGSTNVTGDQVKKLDVLSNDLVINVLKSSFATCVLVSEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 39991 - DNA, 1026 bp, Anopheles gambiae str. PEST
  CDS (1)..(1026)
atgtcggtcgcaatcatgacccagcagggacccgccttcgactcgaactgcatgacgctgacgcgcttcgtgctgcaggagcagaaaaagtacaaacatgcgaccggcgacctgtcccagctgctcaactgcatccagaccgcgatcaaggcgatcagctcggcggtgcggaaggcgggcatcgctaagctgcaaggaatctcaggcgacacgaacgtgcagggcgagcaggtgaaaaagttggacgtgctgtcgaacgaaatcttcatcaacatgctgaaatcgtcgtacgccacctgtctgctcgtgtcggaggagaacgacaacgtgatcgagatcgagacggacaagcggggcaagtacgtggtgtcgttcgatccgctggacggttcctccaacatcgactgtctcgtgtcgattgggtccattttcgccattaccaaacaggtaaaggaaaacacgaccccctcggagcaggacgcactccaaccgggcaacaagattgtggccgccgggtacgcactgtacggctccgccaccatgattgtcatcagcctcggcaacggggtgcacggtttcatgtacgacccctcgatcggcgagtttgtgctgaccgattacaacatgcgcattccggagcggggcaacatttactccatcaacgaggggtacgcgtccacgtgggacgagtcggtgctgaactacgtgaaggacaagaaggacccggcgaagggcaaaccgtacggcgcccggtacgtgggcagcatggtggcggatgtgcaccgcacgatcaagtacggtggcatcttcatctatccggcgacggctgcggccaagaatggtaagctgcgcctgctgtacgagtgcaacccgatggcttacctggtgacgcaggccggcggcaaagcgtacgcgaccaagggcaaggagatactggacgtgatgccgacgtccatccatcagcgatcgcccatctatctcggctcgaagctggatgtggaggaagcgatcagctacatcaagtag

SEQ ID NO: 39992 - protein, 341 aa, Anopheles gambiae str. PEST
MSVAIMTQQGPAFDSNCMTLTRFVLQEQKKYKHATGDLSQLLNCIQTAIKAISSAVRKAGIAKLQGISGDTNVQGEQVKKLDVLSNEIFINMLKSSYATCLLVSEENDNVIEIETDKRGKYVVSFDPLDGSSNIDCLVSIGSIFAITKQVKENTTPSEQDALQPGNKIVAAGYALYGSATMIVISLGNGVHGFMYDPSIGEFVLTDYNMRIPERGNIYSINEGYASTWDESVLNYVKDKKDPAKGKPYGARYVGSMVADVHRTIKYGGIFIYPATAAAKNGKLRLLYECNPMAYLVTQAGGKAYATKGKEILDVMPTSIHQRSPIYLGSKLDVEEAISYIK

SEQ ID NO: 39993 - DNA, 1053 bp, Neurospora crassa
  CDS (1)..(1053)
atgtcgactttcacaacaaacggagctggcgccgagaacgacggtgagaaggtgaacacccacattgtcaccctcaccagattcctcaccgaggagcaagtaaagcacaaggaggccactggagactttaccctcctttgccatgccctccaattctccttcaagtccatcgcctactacatccgccgcgccacgctcgtaaacctcacaggtctcgccggctcctccaacaccacgggcgacgagcaaaagaagctcgacgtcatctccaacgacctctttatcgaagccatgcgctcgtcgggcaagtgcgctttactcgtctcggaagaggaagagcacgtaatctacttcaaggacgccaagaacgcgcgctacgccgttgcctgcgaccccattgacggctcttccaacctggacgccggtgtgtcggtcggcaccatcttcgccatccacaagctggccgaggacagcacgggcacgaaagaggacattctcaagcccggcaccgagctcgtcgcggccggcttcaccatgtacggcgcctcggcccagctggtcatcaccatgaagggcggctccgtcaacggcttcacgctcgaccagggcgtgggcgagttcatcttgacgcaccccaacatgacgatccccaggaagaggagcatctactccgtcaacgagggtaactcgctctactgggaggatgacgtcaaggcgtactttaacagtctgaaggaaacccaggaggacagcggaaagccttatagcgctaggtacatcggttccatggtggccgatgcgtacagaacgctgctctatggtggtatgtttgcgtacccggcagacaagaagagccccaagggcaagctgcgtattctgtacgagtgcgcgcccatggctatgatttttgagaatgctggtggtcaagctgtcgatagcaagatgaaccgcatgctcgaggtcgtaccggagcacatccatgacaaggccggtatcttcatgggttcatatgatgaggttgagaaggtcaagaagtaccacggcaaggcttga

SEQ ID NO: 39994 - protein, 350 aa, Neurospora crassa
MSTFTTNGAGAENDGEKVNTHIVTLTRFLTEEQVKHKEATGDFTLLCHALQFSFKSIAYYIRRATLVNLTGLAGSSNTTGDEQKKLDVISNDLFIEAMRSSGKCALLVSEEEEHVIYFKDAKNARYAVACDPIDGSSNLDAGVSVGTIFAIHKLAEDSTGTKEDILKPGTELVAAGFTMYGASAQLVITMKGGSVNGFTLDQGVGEFILTHPNMTIPRKRSIYSVNEGNSLYWEDDVKAYFNSLKETQEDSGKPYSARYIGSMVADAYRTLLYGGMFAYPADKKSPKGKLRILYECAPMAMIFENAGGQAVDSKMNRMLEVVPEHIHDKAGIFMGSYDEVEKVKKYHGKA

SEQ ID NO: 39995 - DNA, 1035 bp, Magnaporthe grisea 70-15
  CDS (1)..(1035)
atggcggactcgaacaatggcccggagacggaaaaggtcaacaccaacatcgttaccttgacgcgcttcctgactgaggagcaagcaaagcacaaggaggccactggagacttcacattgctgtgccacgccctccagttctccttcaaggccatcgcctactacatccgccgcgccaccctcgtcaacctgaccggccttgccggctcctccaacacgacaggcgatgaccaaaagaagctcgatgtgatcggcaacgacctcttcatcgaggccatgcgcagctcgggcaagtgcgccctgctcgtgtcggaggaggaggaggagatcatcttcttcaccaacggcaacggcagcgcccggtacgccgtggcctgcgaccccattgatggttcgtccaatctcgacgccggagtgtcggtcggcaccatctttggcatccacaagctggccgagggctccaccggctccaaggaggacatcctcaagcccggttccgagctgctggccgccggcttcacaatgtacggcgcctcggcccagctggtcctgaccatgaagaacggcggcgtcaacggcttcacccttgacaacgcctttggtgagttcatcctgactcacccggacatgcgcatgcccaagtcccgcgccatctactcggtcaacgagggtaactcgctctactgggaggaccacgtcaaggagtactttagctcgctcaagcacccccaggagaagagcggaaagccctacagcgccaggtacatcggcagcatggtggcggacgcctaccgtaccctcctatatggcggcatctttgcctaccccgccgacaagaagagccccaagggcaagcttcgtattttgtacgagtgcgcacctatggccatggttttcgagaatgccggcggccaagctatcgatagcaacatgaagcgtatgctcgacgttgtgccagaacacatccatgacaggtcaggtatatttatgggcagctgggatgaggttgaaaaagtaaaggcgtaccacaaataa

SEQ ID NO: 39996 - protein, 344 aa, Magnaporthe grisea 70-15
MADSNNGPETEKVNTNIVTLTRFLTEEQAKHKEATGDFTLLCHALQFSFKAIAYYIRRATLVNLTGLAGSSNTTGDDQKKLDVIGNDLFIEAMRSSGKCALLVSEEEEEIIFFTNGNGSARYAVACDPIDGSSNLDAGVSVGTIFGIHKLAEGSTGSKEDILKPGSELLAAGFTMYGASAQLVLTMKNGGVNGFTLDNAFGEFILTHPDMRMPKSRAIYSVNEGNSLYWEDHVKEYFSSLKHPQEKSGKPYSARYIGSMVADAYRTLLYGGIFAYPADKKSPKGKLRILYECAPMAMVFENAGGQAIDSNMKRMLDVVPEHIHDRSGIFMGSWDEVEKVKAYHK

SEQ ID NO: 39997 - DNA, 1029 bp, Gibberella zeae PH-1
  CDS (1)..(1029)
atgtctaccaccaacagcggacaagaatctgaaaaggttaacactaacattgttacccttacccgcttcctcactgaggagcaggccaagcaccccgaggctactggtgactttaccctgttgtgtcacgctctccagttctctttcaagtccatcgcctactacatccgacgcgccacccttgtaaacctcaccggtctggctggttcttccaacattaccggagacgaccagaagaagctcgatgtcatctccaatgacctcttcattgaggccatgcgctcttcaggcaagtgtgcgctcctcgtttccgaggaggaggacgaaatcatctatttcaaggacgcttcagatgcccgctacgctgtcgcctgcgatcccattgacggttcctccaacttggacgctggtgtctcagtcggtaccatcttcgccattcacaagcttcccgaaggctcaaagggctgcaaggaggacatcctgaagcccggtactgagctactcgccgccggtttcaccatgtacggtgcctcagctcagctcgtcatcaccatgcgcggcggaaccgttaacggcttcactctcgacaacggtgtcggcgagttcatcctgtctcaccccaacatgcgcctgcccaagtctcgcgacatctactcctgcaatgagggtaactcgctatactgggatgacaagaccatcaactacttcaactcgctgaagcaggctcaagaaaacggcaagccttacagcgcgcgttacatcggttccatggttgctgatgcttaccgaactctgctgtacggaggtatctttgcttaccccgccgacaagaagagccccaagggcaagctccgtatcctctacgagtgtgcgcccatggctcttatctttgagaatgccggtggccaagctgtcgacagcaagatgaaccgtctgctcgaggttgtgcccgagcacatccacgacaaggccggtattttcatgggtagttacgacgaggttgagaaggttaagaagttccaccagtaa

SEQ ID NO: 39998 - protein, 342 aa, Gibberella zeae PH-1
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 39999 - DNA, 1047 bp, Ustilago maydis 521
  CDS (1)..(1047)
atgggcgccgaagactactctcctcccgcgaccgatatcatcacactcacacgccatgtcctgaccgagggcttcaagctcaggacagaaagtgctgctagcggcgacctcaccatcctacttagctcactgcagaccacctgtaaatttatcgagagcaacgtgcgaaaggccagcttaatcaacctcatcggcgccgctggcaacaccaacgtacagggcgaggaccagaaaaagcttgatgttctctccaatgagatcatgatcaacgcgttgcgggcttcgggcaagactgcagttctggtatcggaagaggatgacgaggctatctttgtcggtgagaaggaggaaggcggtacctttgagtcgaccaagggcaagtactgcgtcgttttcgaccctctggacggatccagcaacattgatgccggtgtcaatatcggcactatctttggtatctaccttgtgaaggaaggctccaagggcacgcttgaggatgtgctccgacctggccgcgagatggttgctgctggttactgcatgtacggttcgtcggccaacctggtcttgaccactggtaacggcgtcaacggctacacgctcgacaaccagattggtgaattcatcctcacgcaccccaacatccgcctgccaagccgcggcaagatctactcggtcaacgagggcaacagcatgtactattacgagcctgtgctcaagtatctcgacagcatcaagtaccccaagggcgaaggcgccaagccctactctgcccgctacatcggatccatggttgccgacgtccaccgtacgctgttgtacggcggtattttcatctatgcaagcgacaagaagagcaaagacggcaagctccgcatgctttacgaagctttcccgatggcattcatcaccgaacaggcaggtggcctggcgactactggtactcagcgaattctcgacattcagcccactagcattcaccaacgctgccccgtcttcctcggctcgaaggacgacgtcgaggacctcatgaaatgcttccagtga

SEQ ID NO: 40000 - protein, 348 aa, Ustilago maydis 521
MGAEDYSPPATDIITLTRHVLTEGFKLRTESAASGDLTILLSSLQTTCKFIESNVRKASLINLIGAAGNTNVQGEDQKKLDVLSNEIMINALRASGKTAVLVSEEDDEAIFVGEKEEGGTFESTKGKYCVVFDPLDGSSNIDAGVNIGTIFGIYLVKEGSKGTLEDVLRPGREMVAAGYCMYGSSANLVLTTGNGVNGYTLDNQIGEFILTHPNIRLPSRGKIYSVNEGNSMYYYEPVLKYLDSIKYPKGEGAKPYSARYIGSMVADVHRTLLYGGIFIYASDKKSKDGKLRMLYEAFPMAFITEQAGGLATTGTQRILDIQPTSIHQRCPVFLGSKDDVEDLMKCFQ

SEQ ID NO: 40001 - DNA, 1068 bp, Aspergillus nidulans FGSC A4
  CDS (1)..(1068)
atgactacaaacagcactggcaacggcggcgctgtcggacaagagaatatcaacactgatatcgtcacactctctcgattcttcacggaagaacaaaccaaggtccccgaggccactggtgacttcacactcctctgccacgcgctccaattctccttcaaatccatcgcctactatattcgtcgtgcctcgttaatcaacctgaccggtctcgccggttcctcaaacacaaccggtgatgaccagaaaaagctggacgttattggaaatgacctcttcgtgtccgctatgcgcacatccggcaaatgccgcatcctcgtctccgaggaggaggaagaagcgatcatctttgacgaacaccccaatgcccgctacgctgtagtctgcgatcccattgacggctcttccaaccttgacgctggcgtctcggtcggtaccatctttggcatcttcaggctccctgacgacatcctcggccctgggaagaaggtcacagccaaggacgtgctcctcccaggtaccgaaatggttgccgcgggcttcaccatgtacggcgcctcagcccaactcgtcatcacgatgaagaacggcggcgtcaatggattcactctcgagaactctctgggcgagttcatcctcacacaccccaacatgaagttgccccccagccgcgcgatctactccgtcaacgagggtaacagcatgtactgggacgactggtgcaacgcctactttgactctcttaagcgtcccggtgagggcaagaagccctacagcgcgcgttatatcggttccatggttgcagacgcttaccgtactctgctctacggtggagtcttcgcttacccggccgactcgaagagccccaagggcaagctgcgtatcctgtacgagtgtgcgcccatggccatggtcttcgagaatgcaggcggaaaggccgttaactcacgcatggagcgccttctctctgttcagccggagtctatccacgacaagagcggtgttttcctcggctctcgggacgaggtgcagaaggtcatcgatacatacaacaaatacaagaaataa

SEQ ID NO: 40002 - protein, 355 aa, Aspergillus nidulans FGSC A4
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 40003 - DNA, 1020 bp, Gallus gallus
  CDS (1)..(1020)
atgacggaccgctccgccttcgacaccgatgtcatcaccatgacccgcttcgtgatggaagagggccggcgggcgaaaggcaccggggagttcacgcagctcctcaactcgctctgcaccgccgtcaaggccatttccactgccgtacgcaaggccggcatcgccaacctgtatgggattgctggttctaccaatgtgacgggagatcaggtgaagaaactggacatcctttccaatgatctggtgattaacatgctcaagtcatctttcagcacatgcgttattgtgtcagaggaaaacaaggatgctgtcatagtggaagctgacagaaggggtaaatacatagtctgcatagaccctctggatggatcatctaacattgactgtcttgtttccattgggaccatatttggcatctatagaaaggtatcccctgatgaacctactgggaaagatgctttacagcctgggcgtaatcttgtggcagcgggttatgctctctatgggagtgccacaatgctggtactggctacttctgctggaggtgtcaactgttttatgcttgatccggcaatcggagaattcattttggttgatagggatgtgaaaatcaaaaagaaggggaatatctacagtctcaatgaaggctatgctaaatactttgatgctgcggtcaccgagtatctcaggaagaagaaattccctgaggacggcagttcgccatatggtggaaggtacataggatctatggtggctgatgtacatcgcacactggtgtatggaggaatctttctgtatcctgctaactccaaaagtcctaaagggaagctgagactgctctatgaatgcaatcctatggcttttgttattgagaaagctgggggaatagcaacaacagggcatcagtcaatactagatatagtgcctgaggatatccaccaaagagtgcctgttgtcttgggatctcctgatgatgtgaaggagtacctggaaatcgtcaaaaaacatgcagctaagtga

SEQ ID NO: 40004 - protein, 339 aa, Gallus gallus
MTDRSAFDTDVITMTRFVMEEGRRAKGTGEFTQLLNSLCTAVKAISTAVRKAGIANLYGIAGSTNVTGDQVKKLDILSNDLVINMLKSSFSTCVIVSEENKDAVIVEADRRGKYIVCIDPLDGSSNIDCLVSIGTIFGIYRKVSPDEPTGKDALQPGRNLVAAGYALYGSATMLVLATSAGGVNCFMLDPAIGEFILVDRDVKIKKKGNIYSLNEGYAKYFDAAVTEYLRKKKFPEDGSSPYGGRYIGSMVADVHRTLVYGGIFLYPANSKSPKGKLRLLYECNPMAFVIEKAGGIATTGHQSILDIVPEDIHQRVPVVLGSPDDVKEYLEIVKKHAAK

SEQ ID NO: 40005 - DNA, 1038 bp, Candida glabrata CBS138
  CDS (1)..(1038)
atgccagttgctacggaaagaagggcctctatggatgatttcgacaccgatatcatcactttgccaaggtttatcgttgagaatcaaaaaactgtcaagaccgctcgtggtgatttctccctagtgctaaatgctctgggatttgcattcaaattcatttcacaaactatcagacgtgcagaactggttaacttgatcggcctagcaggtgcttccaactctactggtgatgaacaaaaaaaattggatgtcctgggtgatgaaatctttatcaatgccatgaaaggttgcggtttcatcaaactgttggtttccgaggaacaagaagacctaatagtgtttccaacagagacaggtacatatgctatctgctgtgatcctatcgatggctcttccaatttggacgcaggtgtctccgtaggtactattgtctcgatttttaaactgctgccgggatccacaggaagtatcaaggatgttctaaggtcaggccatgacatggtcgcagcatgttatgccatgtacggtgcttcaactcacttgatgttaactatgggtaacggtgtcgacggattcacattggacactaatttgggtgaatttatcctaactcagccaaacttgagaatccctcaactaagaccaatttactccgtgaatgaaggtaatagattgtattgggatgaattgatagtctcttttattgactcattgaaagagggtcaagaatctaataagggtaaaccatactctctgcgttatatcggtgctatggtcgcagatgtccacagaacattcctatacggtggtttgttcagttatccaggagacagattgaaaccagatggaaaattaagattgttatacgaagctttcccaatggcattcctagtcgaacaagccggtggtaaagcagttaatgaccagggcgaacgtatcttggatctggttccaaagcacattcacgacaaatcctccatctggttgggctcatcgggtgaaatcgacaaattcttgaaacatatcgggaaggaatga

SEQ ID NO: 40006 - protein, 345 aa, Candida glabrata CBS138
MPVATERRASMDDFDTDIITLPRFIVENQKTVKTARGDFSLVLNALGFAFKFISQTIRRAELVNLIGLAGASNSTGDEQKKLDVLGDEIFINAMKGCGFIKLLVSEEQEDLIVFPTETGTYAICCDPIDGSSNLDAGVSVGTIVSIFKLLPGSTGSIKDVLRSGHDMVAACYAMYGASTHLMLTMGNGVDGFTLDTNLGEFILTQPNLRIPQLRPIYSVNEGNRLYWDELIVSFIDSLKEGQESNKGKPYSLRYIGAMVADVHRTFLYGGLFSYPGDRLKPDGKLRLLYEAFPMAFLVEQAGGKAVNDQGERILDLVPKHIHDKSSIWLGSSGEIDKFLKHIGKE

SEQ ID NO: 40007 - DNA, 1011 bp, Candida glabrata CBS138
  CDS (1)..(1011)
atgggttctcatgaaggcatcgacactgacgttatctctctaccaagatttattatagaataccagaaacgtgtacataatgccactggtgaatttactctggttctgaatgctctacagtttgcattcaagtttattgcccatgcaatcagacgtgctgaattgatccacctgggcggtctttttggtacatccaatgccactggtgatgaacagaagaaactggatgtcattggtgatgagatctttatcaacacaatggagtccagtaattgtgtcaagatcttggtctctgaagagcaagaagacatgattgtctttgaacacaacactggcaattatgctgtctgctgtgaccctatcgatggttcttccaacttggacgccggtgtctctgtcggtaccattgtgtctcttttcaagctacagccaggctctactggtaaggtcgaggatgttctaagacctggtaccgaaatggttgctgcctgctacgccatgtacggtgcatccactcacttggtcttgaccatgggtgacggtgtcaatggcttcaccttggacactaacttaggtgaattcatcttaacagaaccagatatgagagttccaatgtatagacaaatatactccatcaacgaaggtaacacttactactggaatgacaacatcaagtcttttatcaactttttgaaagaaccacaagatgacggaaagccattcagcgcccgttatgtcggttctatggtctccgatatgcacagaacattcttatacggtggtatttacgcctacccagaggacaagaagaatccaaagggtaaattaagactactatatgaagctttcccaatggctttcttgatggaacaagcgggaggtaaggccgttaccgatagaggtgaacgtatcttagatttgactcctacacatatccacgacaaatcttccatctgggttggttctccaggtgaaatcgacaagtttttgaagcacatcggtaaggcttaa

SEQ ID NO: 40008 - protein, 336 aa, Candida glabrata CBS138
MGSHEGIDTDVISLPRFIIEYQKRVHNATGEFTLVLNALQFAFKFIAHAIRRAELIHLGGLFGTSNATGDEQKKLDVIGDEIFINTMESSNCVKILVSEEQEDMIVFEHNTGNYAVCCDPIDGSSNLDAGVSVGTIVSLFKLQPGSTGKVEDVLRPGTEMVAACYAMYGASTHLVLTMGDGVNGFTLDTNLGEFILTEPDMRVPMYRQIYSINEGNTYYWNDNIKSFINFLKEPQDDGKPFSARYVGSMVSDMHRTFLYGGIYAYPEDKKNPKGKLRLLYEAFPMAFLMEQAGGKAVTDRGERILDLTPTHIHDKSSIWVGSPGEIDKFLKHIGKA

SEQ ID NO: 40009 - DNA, 1068 bp, Kluyveromyces lactis NRRL Y-1140
  CDS (1)..(1068)
atggctggtattaaacacagaagagactcagctgagtctatcaataccgacatcatcacgttgtcccgttttatcttggaccaacagcatctttctgcgaaaaatgccactggggagttttctatgcttttgaactctttgcagtttgcatttaaatttatttctcaaacaattagacgtgctgaattggttaacttgatcggattggctggtgcttcaaatagtaccggtgaccagcaaaagaagttggatgtgttgggtgatgaaatcttcatcaatgctatgaaagcgtctggtaacgtcaaggtacttgtgtctgaagaacaagaagatttgatcgttttccgtaacagccctggtaaatacgcggtatgttgtgacccaattgatggttcgtctaacttggatgctggtgtctcagtgggtaccattgtctctctgttcaagattcatgagaatcagaatggtaactctggggaagaagatagtgagggtaccatcaacgatgttgctcgttgcggtagagaaatggttgctgcttgttacactatgtacggtgcgtccacgcatttggttttaactaccggtgcaggtgtcaatgggttcactttggacaataacttgggtgaatttatcttgacttacccagaattgagactacctgagcaaaaatctatttactccatcaatgaggggaacacctgctattgggaaccaactatcgctgatttcattgccaagttgaaggaaaacagcgaagaaaataacggtaagccttactctgctcgttacatcggttcaatggtcgctgacgtacacagaactttactatatggtggtttattctcttacccaggtgataagaaaaatcctaacgggaagttaagattgttatatgaagcattcccaatggctttccttgttgaacaagctggtggtaaagccgttaatgatagaggtgaacgtatcttggatttggtccctcaacatattcacgacaaaagcagtatctggttaggtagctctggagacgttgataaatatttaaagcatatcggtaagttgtaa

SEQ ID NO: 40010 - protein, 355 aa, Kluyveromyces lactis NRRL Y-1140
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 40011 - DNA, 993 bp, Debaryomyces hansenii CBS767
  CDS (1)..(993)
atgaacgtcgacaccgacatcatcacgttgaccagatttattttgcaagaacagcaaaaagaagccccaaatgctactggtgaattgtcattgttattaaactcgttacaatttgctttcaaattcattgctcacaacattagaagagccgaattggtcaatttgattggtatcagtggtagtgctaactctactggtgatgttcaaaagaaattggatgtgattggagatgaaattttcatcaatgctatgaaatcgtcgaacaacgtcaaagttttagtttcagaggaacaagaagacttgattgttttcgaaggaggtggacgttatgctgtttgtaccgatccaattgacggatcgtctaatattgatgctggtgtttctgttggtactatcttcggtatctatagattgaaggaagattctcagggatccatcaaggatgtgttgagaaagggtaccgaaatggttgctgctggttacactatgtacggtgcttctgctcacttaatgttgaccacaggacaaggtgtcaacggcttcactttggatacacaattgggtgaattcattttgactcaaccacacttgaccattcctaagaccagagctatttactctgtcaacgaaggtaactctcattactgggctgacagtgccaaacaatatatcgcagacttgaagaagccacaagaagatggaaagccttacagtgcaagatacattggttctatggttgctgatattcacagaactatattgtacggtggtattttcgcatatccagctgattctaagctgaaaaatggtaagttaagaattttatatgaatgtttcccaatggctatgttgatggaacaagccggtggtgcagccattaacgataagggtgaaagaatcttagaaattttgccaaaaggaatccatgacaagagtggtatctggttaggctcaaccggtgaagttgatagatacttaacttacctcaaataa

SEQ ID NO: 40012 - protein, 330 aa, Debaryomyces hansenii CBS767
MNVDTDIITLTRFILQEQQKEAPNATGELSLLLNSLQFAFKFIAHNIRRAELVNLIGISGSANSTGDVQKKLDVIGDEIFINAMKSSNNVKVLVSEEQEDLIVFEGGGRYAVCTDPIDGSSNIDAGVSVGTIFGIYRLKEDSQGSIKDVLRKGTEMVAAGYTMYGASAHLMLTTGQGVNGFTLDTQLGEFILTQPHLTIPKTRAIYSVNEGNSHYWADSAKQYIADLKKPQEDGKPYSARYIGSMVADIHRTILYGGIFAYPADSKLKNGKLRILYECFPMAMLMEQAGGAAINDKGERILEILPKGIHDKSGIWLGSTGEVDRYLTYLK

SEQ ID NO: 40013 - DNA, 1032 bp, Oryza sativa (japonica cultivar-group)
  CDS (1)..(1032)
atggatcacgcggcggaggcgcagaggacggacctgatgacgatcacgcggcacgtgctgaacgagcagggccggcacccggagtcgcggggggacttcaccatcctactctcccacatcgtcctcggctgcaagttcgtcgcctccgccgtcaacaaggccggcctcgccaagctcatcggcctcgccggcgacaccaacgtggcggtgcagggtgaggagcagaagaagcttgacgtgctctccaacgaagtcttcgtcaaggcgctcgtcagcagcggccgcacgtgtgttcttgtgtctgaagagaacgaggaggccattatcgtcgacgctcccctccgcggaaagtattgcgtttgttttgatccactggatggctcctcaaatatcgattgtggtgtctccatcgggacgatctttgggatttacatgattaaagacaaggacaacgtgactttggacgatgtactgcaacctggaacagacatgcttgctgctggctactgcatgtacgggagttcatgcacgcttgtgttgagcactggaaatggagtaaacggtttcacccttgatccttcccttggggagttcattctgactcatccaaacatcaagataccaaatagaggaaagatctattcagtgaacgaagggaatgcgaaaaattgggatgctcctacagcgaagtttgtggagaaatgtaaatttccccaggatggttcgccttctaaatccttgagatacatcggaagtatggttgctgatgtccaccgtactttgctatatggaggcatatttttgtaccctgcggatcagaagagcccaaacggaaaacttcgtgttctgtacgaagtgttcccaatgtcattcttgatggagcaagctggaggacaagctttcacaggcaaacaacgggcccttgaacttgttcccagaaagattcatgatagatctccaatattcctggggagctatgatgacgtggaggatatcaaagcattgtacgcttcagagtctatcatcggttga

SEQ ID NO: 40014 - protein, 343 aa, Oryza sativa (japonica cultivar-group)
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 40015 - DNA, 1017 bp, Yarrowia lipolytica CLIB99
  CDS (1)..(1017)
atggaagccaaccccgaagtccagaccgatatcatcacgctgacccggttcattctgcaggaacagaacaaggtgggcgcgtcgtccgcaatccccaccggagacttcactctgctgctcaactcgctgcagtttgccttcaagttcattgcccacaacatccgacgatcgaccctggtcaacctgattggcctgtcgggaaccgccaactccaccggcgacgaccagaagaagctggacgtgatcggagacgagatcttcatcaacgccatgaaggcctccggtaaggtcaagctggtggtgtccgaggagcaggaggacctcattgtgtttgagggcgacggccgatacgccgtggtctgcgaccccatcgacggatcctccaacctcgacgccggcgtctccgtcggcaccattttcggcgtctacaagctccccgagggctcctccggatccatcaaggacgtgctccgacccggaaaggagatggttgccgccggctacaccatgtacggtgcctccgccaacctggtgctgtccaccggaaacggctgcaacggcttcactctcgatgaccctctgggagagttcatcctgacccaccccgatctcaagctccccgatctgcgatccatctactccgtcaacgagggtaactcctccctgtggtccgacaacgtcaaggactacttcaaggccctcaagttccccgaggacggctccaagccctactcggcccgatacattggctccatggtcgccgacgtgcaccgaaccattctctacggaggtatgtttgcctaccccgccgactccaagtccaagaagggcaagctccgacttttgtacgagggtttccccatggcctacatcattgagcaggccggcggtcttgccatcaacgacaacggcgagcgaatcctcgatctggtccccaccgagatccacgagcgatccggcgtctggctgggctccaagggcgagattgagaaggccaagaagtaccttctgaaatga

SEQ ID NO: 40016 - protein, 338 aa, Yarrowia lipolytica CLIB99
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKDYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYLLK

SEQ ID NO: 40017 - DNA, 1008 bp, Pan troglodytes
  CDS (1)..(1008)
atgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggctggcctggcccacctgtatggaatcgcaggaagcgtgaacgtgacgggagatgaggtgaagaaactggacgtgctatccaattctctggtgatcaacatgctccaatcctcctatagtacctgcgtcctggtctcagaagagaataaggacgccatcatcaccgccaaggagaagagggggaaatacgtggtctgctttgacccactggatggatcttccaatatgactgcctggcctccatcggaaccatctttgccatctatagaaagagcttcctgtgtgggctccatatggtccctattcttcccaccactcatgaaaacaccaaagagcaggctcagagtgaccacagccaagccccagctctgccagcaagcccccatcttctcctgctctgatgctcttggtgaatttgtcctggtggaaaaagatgtcaagattaagaagaaaggaaagatttacagcctgaatgagggctatgccaagtattttgatgcagccaccactgaatatgtgcagaaaaagaaattccctgaggatggcagtgctccctatggggccaggtatgtgggctccatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggatgtgaagcccgaggcaattcaccagcgagtccccctcattctggggtcaccagaggatgtgcaggaatatctcacctgtgtgcagaaaaatcaggcaggcagctag

SEQ ID NO: 40018 - protein, 335 aa, Pan troglodytes
MTDRSPFETDMLTLTRYVMEKGRQAKGTGELTQLLNSMLTAIKAISSAVRKAGLAHLYGIAGSVNVTGDEVKKLDVLSNSLVINMLQSSYSTCVLVSEENKDAIITAKEKRGKYVVCFDPLDGSSNMTAWPPSEPSLPSIERASCVGSIWSLFFPPLMKTPKSRLRVTTAKPQLCQQAPIFSCSDALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 40019 - DNA, 1014 bp, Desulfovibrio vulgaris subsp. vulgaris str. Hildenborough
  CDS (1)..(1014)
atgcccgaagttaccgttaccgaacatcttctgctgcatcagaaaaagtctcctgcagctacgggccagtttacgaccctgcttaacgacctcgtcctttccgccaagatcatctcccgcagtgtgacgaaggccggattgctcgatgtccttgggggcaccggcgaagtgaatgtgcaaggcgaacttgtgcagaaactcgacgagttcgcgaaccgtgtgctcatctacagaatggagcgctccggtgccgtatgcgccatggcctccgaagagaacgctgacatcatcaaggtgcccgagaagctgcaccgtggtgattatgtgctcatcttcgacccgctggacggttcctccaacattgacgtcaacatcaatgtcggcaccatcttctcgatcctgcgccgcaagtctcctgcctcggacgacgtgtgtatcgatgatgtcctgcagcccggctatgagcaggtggccgctggctacatcctctacgggccgtcgaccatgctcgtgttcagtaccgggcagggcgttcacgggttcacgctggaccccagcgtgggcgagttccttctgtcgcatcccgacatgagcatccccgaaagagggcgtatctactccatcaacgagtcgtactggaactactgggacgaacctacgagagagatagtctcctacttcaagggtgatcacaacgaacgcggcaagccctattcgttgcgttatgtgggctcgctcgtggcggactttcaccgtacgctgctctatggcggcatcttcatgtaccccatggactatcgccatcccgacaagcctcagggcaagctgcgcctcatgtgcgaggcgtctccgctggcatttctcgctgagcaggccggggggcgcgccatcgacggttcgcggcgtattctcgatgtatgccccggaacgctgcatgagcgcattccgctcttcatcggttcggcccgcgatgtcgacaaggtcgaagagatctacgcccgtcacagggcctga

SEQ ID NO: 40020 - protein, 337 aa, Desulfovibrio vulgaris subsp. vulgaris str. Hildenborough
MPEVTVTEHLLLHQKKSPAATGQFTTLLNDLVLSAKIISRSVTKAGLLDVLGGTGEVNVQGELVQKLDEFANRVLIYRMERSGAVCAMASEENADIIKVPEKLHRGDYVLIFDPLDGSSNIDVNINVGTIFSILRRKSPASDDVCIDDVLQPGYEQVAAGYILYGPSTMLVFSTGQGVHGFTLDPSVGEFLLSHPDMSIPERGRIYSINESYWNYWDEPTREIVSYFKGDHNERGKPYSLRYVGSLVADFHRTLLYGGIFMYPMDYRHPDKPQGKLRLMCEASPLAFLAEQAGGRAIDGSRRILDVCPGTLHERIPLFIGSARDVDKVEEIYARHRA

SEQ ID NO: 40021 - DNA, 1038 bp, Oligotropha carboxidovorans
  CDS (1)..(1038)
atggctcaagggcagacgctgcaccaacacctgaccggttttgccgccacggatccggctcacggacctgtcgccgatgtcgtcgccgcgttcgccatcgctgccaccgagatttccgaactgatctcgggcggtttgttgtccgggatcaccggcgaggggcagacccgcaacagcgacggcgatgtccagaaagatctcgacatcaaggccgaccagatcatccgcgctgcgctggccggaacgtccgtggccgcgcttgcctccgaggaggccgaggagatcgagatttgcgatccagccggcgcggtcagtgtcgctttcgatccgctggatggttcgtcgaacatcaataccaacatgtccgtcggcacgatcttctcgatcgtgcgaacgccgtcgcatgcccgcgcggcgttcacccagccgggatcggcacagttggctgctggctttgtcgtctatggcccgcagaccagtcttgtcctgaccctgggcgacggcgtcgacgtgttcaccctcgatcgcaaggcgaaggtgtttcagaaagtcaggtcgcgagttcagattccggcgcaaacgcccgagtacgcgatcaatgcgtcgaaccgccgattctgggatccgctgatcgtcgccttcatcgaggattgtctcgccggaaaagacggcgtgatgcaggccgatttcaacatgcgctggatcggatcgatggtggcggaagcctaccggattctcgttcggggcggcattttcctttaccccggcgatacccgcgaaggttacggcgagggcaggctgcgcctgctctacgaagcgcatccgatcgctttcatcatggagcaggcgggaggcggcgcgacgaccggacgccagcgcattctcgacattactgcgaatacgccgcaccagcgcgtgccgctgatcatgggttcgatcgacagcgtgcggcgcatcgagcgcatgcacgggtcgccggacatcaaattcgagcgcaatccgccgcttttcgccacccgcggcctattccgcatttga

SEQ ID NO: 40022 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 40023 - DNA, 972 bp, Acinetobacter sp. ADP1
  CDS (1)..(972)
atgtcaaatctcaccttggctcaatatctacaacaaaaaaatgggaatttgacacctgagttagcacaagtaattgaaacgattgctaattcatgtaaaaaaatcgatcatgccattcaaaaaggagcattggcagatctgcttggaagcgcaggcaatgaaaatgttcaaggtgaaacacagaaaaaacttgatgttctttcaaatgattttctgatcgatgcgttgaaagttcatccacacgttggcggtttagcttctgaagagttggatgaatttacacctggccaacaagatggcaaatacctcgtattatttgatccacttgatggttcaagtaacatcgatatcaatatgtgtgtaggtactattttttcaattttacctgcaaaaaacagtattacccaaacccaagatttcatgcaagctgggactgaacaagtcgctgctggctatgtattgtatggtccatctaccatgatggcgcttacctgtggtgaaggtgtcgcattttttacctttgatcctgaaagccaaacatttatcttgacctcagatgcaattcagcttgatgcagatactcaagaatttgcaattaatgcttcaaatcagcgccattgggaagaaccagtaaaacgctatatagatgaattactagcaggtaaaacatccgttcgcggcaaagattttaatatgcgctgggtagcatgtatggtggcagatattcaccgtattttatgccgttctggcatttttatgtatccttatgatttaaaagatccaagtaaagcaggtcgtttacgcttgatgtatgaagcaaatcctatgagttttcttattgaacaagctgggggttctgcaacaacaggtcgggttcgtattatggacattcaacccaatgatctacaccaacgggttcctgtgattattggatcaaaaaatgaagtcgatctagtcaccagttaccactaa

SEQ ID NO: 40024 - protein, 323 aa, Acinetobacter sp. ADP1
MSNLTLAQYLQQKNGNLTPELAQVIETIANSCKKIDHAIQKGALADLLGSAGNENVQGETQKKLDVLSNDFLIDALKVHPHVGGLASEELDEFTPGQQDGKYLVLFDPLDGSSNIDINMCVGTIFSILPAKNSITQTQDFMQAGTEQVAAGYVLYGPSTMMALTCGEGVAFFTFDPESQTFILTSDAIQLDADTQEFAINASNQRHWEEPVKRYIDELLAGKTSVRGKDFNMRWVACMVADIHRILCRSGIFMYPYDLKDPSKAGRLRLMYEANPMSFLIEQAGGSATTGRVRIMDIQPNDLHQRVPVIIGSKNEVDLVTSYH

SEQ ID NO: 40025 - DNA, 1005 bp, Erwinia carotovora subsp. atroseptica SCRI1043
  CDS (1)..(1005)
atgaaaacgttaggcgaatttatcgtcgaaaaacagcacgatttctctcacgccacaggtgagcttaccgcgctgctgtctgctattaaactgggcgccaagattattcaccgtgatatcaataaagcaggtttggttgatatcttgggtgccagcggtatttctaatgttcagggcgaagtgcagatgaagctcgatctgtatgccaatgagaaactgaaagctgcattaaaagcgcgtggtgaagtagcaggtatcgcttctgaagaagaagacgaaatcgtcatctttgaaggtgataaggcagaaaacgctaaatatgtggttctgatggacccgctggacggctcgtcgaatattgatgtgaacgtctctgtcggtacgattttctctatttatcgccgtattacgccgctgggaacctccgtcacggaagctgacttcttgcagccgggtagccagcaggttgctgcgggctacatcgtttacggttcttccaccatgctggtgtacaccacgggtcacggcgttcacgcttttacctacgatccgtcgctcggtgtattctgcctctcgcatgaaaaagtttgcttcccagaaaaagggaatatgtattccatcaacgaaggaaactacatcaagtttccttccggcgtgaagaaatacatcaaatactgtcaggagcaggatgaagagacgcagcgtccttatacgtcgcgttatatcggttcactggtagcggatttccatcgtaacctgctgaaaggcgggatttacctgtatccgagcacggcgagctatccgaaaggcaaactgcgtttgctgtacgaatgcaacccgatggcatttctggcggagcaggcgggtggtaaggctagcgacggtaaacaccgcattctggatatcacgccagagaaactgcatcagcgctcaccgttcttcgtgggaacagaatccatggttgatgacgtcgaacgtttcatccgtgaatttccagatgcttaa

SEQ ID NO: 40026 - protein, 334 aa, Erwinia carotovora subsp. atroseptica SCRI1043
MKTLGEFIVEKQHDFSHATGELTALLSAIKLGAKIIHRDINKAGLVDILGASGISNVQGEVQMKLDLYANEKLKAALKARGEVAGIASEEEDEIVIFEGDKAENAKYVVLMDPLDGSSNIDVNVSVGTIFSIYRRITPLGTSVTEADFLQPGSQQVAAGYIVYGSSTMLVYTTGHGVHAFTYDPSLGVFCLSHEKVCFPEKGNMYSINEGNYIKFPSGVKKYIKYCQEQDEETQRPYTSRYIGSLVADFHRNLLKGGIYLYPSTASYPKGKLRLLYECNPMAFLAEQAGGKASDGKHRILDITPEKLHQRSPFFVGTESMVDDVERFIREFPDA

SEQ ID NO: 40027 - DNA, 1008 bp, Mannheimia succiniciproducens MBEL55E
  CDS (1)..(1008)
atgaaaacattagatgaattcattgtagacagacaagccgaataccccaatgccaaaggtgcgttaacggggattctctcttctatccggcttgtcgccaaagtcattcatcgcgacataaatcgtgcaggtctcacaaataacattctgggtttttccggcatagacaatgtacagggcgagcatcaaatgaaattggatttatttgcccataatatgatgaagcaagccttaatggcgcgggaagaagtggcgggatttgcttccgaagaagaagaaaatttcgttgctttcgatacggagcgaggtcgtaatgccagatatgtaatcttaaccgatcctttagacggttcatcaaatattgatgttaacgtctctgtgggaaccatcttctctatttaccgtcgagtttcgcctattggttcgcccgttaccttagaagactttatgcagccgggaaaccgacaagttgccgcaggctatgtggtttacggttcttccaccatgctggtttataccaccggaaacggtgtaaacggatttacttacgatccgtctttaggcacattctgtttatctcatgaaaatatgcagattcccgccaccggcaaaatttattccattaacgaaggacaatatttaaaattcccgatgggcgtaaaaaaatacattaaatattgccaggaagaagatgcggcaaccaatcgcccttatacttcccgttatatcggctcgttagtagcggattttcaccgcaatctgttaaaaggcggcatttatatttatcctcatgcgacaaattatccgcagggaaaactccgtttactttatgaaggcaaccctatcgcatttttagcggaacaagccggcggtatcgcctctgacggttataatcgggtgctggatattcagccgagtcaattacaccaacgggttcctctttttgtaggttctaaacaaatggttgaaaaagcacaagactttatgcatcagtttaaagaagattaa

SEQ ID NO: 40028 - protein, 335 aa, Mannheimia succiniciproducens MBEL55E
MKTLDEFIVDRQAEYPNAKGALTGILSSIRLVAKVIHRDINRAGLTNNILGFSGIDNVQGEHQMKLDLFAHNMMKQALMAREEVAGFASEEEENFVAFDTERGRNARYVILTDPLDGSSNIDVNVSVGTIFSIYRRVSPIGSPVTLEDFMQPGNRQVAAGYVVYGSSTMLVYTTGNGVNGFTYDPSLGTFCLSHENMQIPATGKIYSINEGQYLKFPMGVKKYIKYCQEEDAATNRPYTSRYIGSLVADFHRNLLKGGIYIYPHATNYPQGKLRLLYEGNPIAFLAEQAGGIASDGYNRVLDIQPSQLHQRVPLFVGSKQMVEKAQDFMHQFKED

SEQ ID NO: 40029 - DNA, 1035 bp, Photobacterium profundum SS9
  CDS (1)..(1035)
ttgatgcaaggattgtacatgcccaatatgaaaactcttggtgagttcatcgtagagaaacaaaatgacttcccccatgctagcggtgatctatcatcactgttaggctcgataaaacttgcagcaaagatcgtcaaccgtgaaatcaacaaagctggattagttgacatcacaggtgccataggcagcgaaaatgttcagggtgaagaacagcaaaaacttgatctgtatgccaacgataaattcaaggcggcaatggaagctcgtgaccaagtctgtggtgtggcgagtgaagaagaagatgaagcggttacgttcaataaagacctaaatcgcaatgctaaatatgtcatcttgatggatccacttgatggatcgtcgaacattgacgtcaatgtgtctgttggtaccattttttccatttatcgtcgtgtttcaccgattggtaccacaccgactcaagacgatttcttgcaaccaggtaatcaacaagttgctgcaggttatgtgatctatggttcatcaaccatgctggtttacaccacaggtaacggtattcatggctttacatatgatccatcattaggtgtgttctgcttatctcatgaaaatatgcagatcccagaagatgggcaaatatactcaataaacgaaggcaactacattcgtttcccacaaggggttaaaaagtacatcaagttctgccaagaagatgtaccagcagataaccgcccttacacttctcgttatattggctctttagtctcagattttcaccgtaatctgctaaagggtggtatttatatgtacccaagtacggcaatgtatccaaacggaaagctccgcttattgtatgaatgcaatccaatggcatttttgatggaacaagccggtggtgttgcttcagatggcaaaaatcgcatcttggatatcacaccaaccgagttgcatcagcgtgttcccttcttcgttggctcaaccaatatggttaagcaagttgaatcatttatagaagaatacccagagcaacactaa

SEQ ID NO: 40030 - protein, 344 aa, Photobacterium profundum SS9
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 40031 - DNA, 876 bp, Haloarcula marismortui ATCC 43049
  CDS (1)..(876)
atgagtaagtcactcgacatttcgaccaccgaagccgagcagacagtcacggaagtcatcgacaccatcgtcgcgacgacaccggacgtccgccgcgctgttgccgactaccgtggccagagcaactccgtcaaccccactggcgacgaccagctcgcggctgacctgcgcgccgacgaactgttcgaacagcgggtgctgggcatcgacggcgttgcctcctacgctagcgaggaacgcgcggacgtgaaaacgacagacggtcgcctgcatgtcgcgatggaccccctcgatgggtcgagcaacctcgaacccaacagcgggatggggacgattttcggcatctacagcgaacagccaccgactgtcggtaccaatctcctcgccgccgggttcgtcatctacggtccgatcacctcgatggtcgttgctcgggacggcagcgtccgcgagtatatccttgaagacggcgacaagcgggtcgtcgacgacgacgtgacagtccctgaagaccccaccgtattcgggtttggcggcggcgtcgactcttggaccgacgagttcgaatcctacgccgaggcggtccgtcacgaactgaaactccgctacggcggggcgatggtcgcggacatcaatcaggtactcacctacggcggcatcttctcgtaccccgcacttgaatcacgccccgaggggaaactccgggtccagttcgagggccacccgatggcctacatccttgagtcagccggcggtcggtcctccgacggcgaccagtcgttacttgagatcgaacccgacgagctacacgagcggacgccgctgtatctcgggaacgacgacctgatcgaccgtctcgaagcgaatatcgactga

SEQ ID NO: 40032 - protein, 291 aa, Haloarcula marismortui ATCC 43049
MSKSLDISTTEAEQTVTEVIDTIVATTPDVRRAVADYRGQSNSVNPTGDDQLAADLRADELFEQRVLGIDGVASYASEERADVKTTDGRLHVAMDPLDGSSNLEPNSGMGTIFGIYSEQPPTVGTNLLAAGFVIYGPITSMVVARDGSVREYILEDGDKRVVDDDVTVPEDPTVFGFGGGVDSWTDEFESYAEAVRHELKLRYGGAMVADINQVLTYGGIFSYPALESRPEGKLRVQFEGHPMAYILESAGGRSSDGDQSLLEIEPDELHERTPLYLGNDDLIDRLEANID

SEQ ID NO: 40033 - DNA, 984 bp, Idiomarina loihiensis L2TR
  CDS (1)..(984)
atgaaacgtttattaccaacactgagagcggatcaaaccagtgaatcgcttatctctgttattaacaccattcaaattgcagccaaggaaatttctttccgtctgcatcagggcgcattagccggtgtattaggctcaactctggacgaaaacattcagggcgaaacgcaaaagaagctcgatgttgtcgccaatcagctgttaaaaactctgttgcttgagtcacctaacgtccatgctgttgcttctgaagaagaagattccattgttgagagcccaaactcaggccattacctggtggcatttgacccactggacggcagctctaacatcgacataaacggtggtgtgggtactattttctctattctgcgtaagcctgaaggcgaagaaaccagcgagaacatgttcctacaaccaggtaaagctcaggttgctgccggttatgtcttgtatggtcctgcaactatgctggttatgacgaccggtaaagcggtgcgaatttacactctggatcagaccgttggtgaattcttattgacccacgagaaagcggaaatcccgaaagataccaaagagtttgccattaatatgtcgaaccgtcgtcactgggctgacccaatccgcgcttacattagcgacttgctggaaggcgaagaaggtccgcgcggcaagaactttaatatgcgctggaatgccgcgatggtctctgatgtacaccgggttatttcgcgtggtggtttattcacttacccctgggatgcccgtaagccggaaaaaccctttaagctgcgccttttatacgaagccgcacctatggcaatgctggtggaaaaagccggcgggaaagccaccgacggttacagccgtttaatggaaattgtgccagaacatattcaccaacgcgtctcggtggttatggggtctgccaatgaggtagatgtgtgcatggattaccataagcaacatccaaaaccctattag

SEQ ID NO: 40034 - protein, 327 aa, Idiomarina loihiensis L2TR
MKRLLPTLRADQTSESLISVINTIQIAAKEISFRLHQGALAGVLGSTLDENIQGETQKKLDVVANQLLKTLLLESPNVHAVASEEEDSIVESPNSGHYLVAFDPLDGSSNIDINGGVGTIFSILRKPEGEETSENMFLQPGKAQVAAGYVLYGPATMLVMTTGKAVRIYTLDQTVGEFLLTHEKAEIPKDTKEFAINMSNRRHWADPIRAYISDLLEGEEGPRGKNFNMRWNAAMVSDVHRVISRGGLFTYPWDARKPEKPFKLRLLYEAAPMAMLVEKAGGKATDGYSRLMEIVPEHIHQRVSVVMGSANEVDVCMDYHKQHPKPY

SEQ ID NO: 40035 - DNA, 1002 bp, Azoarcus sp. EbN1
  CDS (1)..(1002)
atgcgacgcgtcacgctaacccaattcctgatcgagcagcagcgcgccggccgcaccagccctgacctgcgactgctgatcgaagtcgtcgcccgggcggtaaaggcaatcgccgtcaatgtctcgaaaggggcgcttgccgacctgctcggcgaggcgggtaccgacaacgtccagggcgaggcgcaaaagaagctcgacgtgatcgcgaacgagattctgctgcaggccaacgaatggggcgggcacctcgcggcgatggcgtcggaagaggtcgaggaggtccatcagattccgttcgactacccgaagggcggctatctgctgctgttcgatccgctcgacggttcgtcgaacatcgacgtcaatatctcggtcggcacgatcttctcggtactgcgcttccctgaagggatccaggagcccaacgagcagtgcttcctgcagcctggccgcgagcaggtcgctgcggggtacgcgctgtacggcccgtcgaccctgctgatcctcaccgtcggcaacggtgtgcatggcttcacgctggaccgcgagatgggtagcttcgtctatacccacccgttcatgacggtgccggtggatacgcaggaatatgcgatcaacgcctcgaacgcgcgccactgggagccgccggtgcagcgctatgtcgccgaattgcagcagggcaggacggggccgcgcggcaaggatttcaacatgcgctgggtcgcgtcgatggtcgccgatgtgcatcgcgtcctcacgcgcggcggcatcttcatgtacccgctggacgagaagtgccgcgaccagggcggcaagctgcgcctgatgtacgaggcgaatccgatggcgatgatcgtcgagcaggcggggggctcggcgacgaccggtcgccagcggatcctcgacgtgcagccggcaaagctgcaccagcgcgtgccggtgatcctcgggtcgacccacgaagtcgagcgcgtgaccgcctaccatcgcgaaggctga

SEQ ID NO: 40036 - protein, 333 aa, Azoarcus sp. EbN1
MRRVTLTQFLIEQQRAGRTSPDLRLLIEVVARAVKAIAVNVSKGALADLLGEAGTDNVQGEAQKKLDVIANEILLQANEWGGHLAAMASEEVEEVHQIPFDYPKGGYLLLFDPLDGSSNIDVNISVGTIFSVLRFPEGIQEPNEQCFLQPGREQVAAGYALYGPSTLLILTVGNGVHGFTLDREMGSFVYTHPFMTVPVDTQEYAINASNARHWEPPVQRYVAELQQGRTGPRGKDFNMRWVASMVADVHRVLTRGGIFMYPLDEKCRDQGGKLRLMYEANPMAMIVEQAGGSATTGRQRILDVQPAKLHQRVPVILGSTHEVERVTAYHREG

SEQ ID NO: 40037 - DNA, 909 bp, Synechococcus elongatus PCC 6301
  CDS (1)..(909)
atgcagcgcattggccttgccgctaagctaatcgcccgtcgcctcagccacgcggggctggtggatgatgccctcggtttcacgggggaaatcaacgtccagggcgaagccgtcaaacggatggacgtctacgctaaccaagttttcatctcagtttttcggcagagtggcttggtctgtcggctggcttccgaggaaatggagaagccctactacattcctgaaaattgcccgatcggtcgctatacgctgctctacgaccctttagatggctcggccaacgtcgatgtcgatctcaacgtcggttccatttttgcggtgcggcgtcaagagttctacgacgagtcccatgaagccaaggatcttctgcagccaggcgatcgccaaattgctgcgggctatgtcctctatggggccagcaccttgctggtctacagcatgggtcagggcgtccatgtttttgtactggaccccagcttaggtgagtttgtcctcgcgcagtccgacatccagctcccgaactcgggtcagatctacagcgtcaatgaagggaacttttggcagtggcccgagggctatcgccagtacatccgggaaatgcatcgccgcgaaggctacagcggccgctatagcggagcgttggtagctgacttccatcgcattttgatgcagggtggtgtgtttctctatcccgaaaccgtcaagaatcccactggcaagctgcgactgctctacgaagcagcaccgatggcctttctggctgaacaagcaggcggcaaggccagtgacggccagaagcctatcctcttgcgccaaccccaagccctgcacgagcggtgcccgctaattatcggtagcgccgcagatgtggactttgtcgaagcctgcttggctgagtcggtgccctaa

SEQ ID NO: 40038 - protein, 302 aa, Synechococcus elongatus PCC 6301
MQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 40039 - DNA, 1014 bp, Magnetospirillum magnetotacticum MS-1
  CDS (1)..(1014)
atgccgtataagaggatcacgctgacccacttcctgttgcaggaacagcgccgcctgggcgggtcgggttcgttcaccgccctgatgaccgacatcatcttcgcctgcaagatgatctctcatgaggtcaatcgcggtgcgctggccggtaatctgggcgttgccgggtcggagaacgtccagggcgaggagcagaagaagctcgacgttctggccaacgatatcttcctgcacatgaacgcgctgggcgggtcctatgcgggcatggcctcggaagagctggaagacgtgcatgcggtccacggcgccgccgacggcaagtatctgctgctgttcgatcccctggacggatcgtccaacatcgacgtcaacatctcggtgggctctatcttctcgatcctgaagctgcccgagggagccgatgccggatccaaggatgccttcctgcagcccggcgtcaagcaggtggccgccggttatgccctttacggctcctcgaccatgatggtgctgaccaccggcaatggggtcaacggcttcacgctcgacaacaatgtgggcatgttcctgctgacccatcccaatatgaccattcccgccgataccaaggaattcgccatcaacgcgtcgcgcgagcggttctgggagccgccggtgaagcgctatatcgatgaatgccgccagggcaaggaaggcccgcggggcaaggacttcaacatgcgctgggtggcctccatggtggccgaggtgcatcgcatcctgtgccgcggcggcgtattcctctatccggccgataccgagaacatgaagaagggcggcaagctgcgcctgatgtatgaagccaatcccatggccttcatcgtcgagcaggcgggcggtgccgccaccactggccgtggccgcatgatggaggttcagcccaccggactgcatcagcgcgtccccgtcatcctgggctcgaagaccgaggtggagcgcatcggcgcctaccacaccgaatacgacgcaaagtag

SEQ ID NO: 40040 - protein, 337 aa, Magnetospirillum magnetotacticum MS-1
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 40041 - DNA, 1014 bp, Azotobacter vinelandii
  CDS (1)..(1014)
atgtcccgcgtaaccctgagccgctacctgatcgagcagactcgcagtcacaacaccccggccgacctgcgcttcctcatcgaggtggtggcgcgtgcctgcaaggaaatcagccatgcagtgtccaaaggcgcgctgggcggggtgctcggcagcatgggcaccgagaacgtgcagggcgaggtgcagaagaagctcgacgtgatgtccaacgagatcctcctggaggccaacgagtggggcggccacctggccggcatggcttccgaggagatggactccgcctatcagatccccggcaagtatccgaagggcgcctacctgctggtgttcgatccgctggacggctccagcaacatcgacgtcaacgtctcggtcggcaccatcttctcggtgctgcgctgcccggaccagtacctgacccagaacgacagcctcaacgagcaggccttcctccagccgggcacccagcaggtggccgccggttacgccatctacggcccgcagaccatgctcatgctgaccctcggcaatggcgtcaagggcttcaccctcgaccgcgagctgggcagcttcgtgctcacccatgacaacctgtgcgtgccggaaaccaccgccgagttcgctatcaacatgtccaaccagcgccactgggagccgccggtcaagcgctacgtggacgagttgctggccggcaagaccggcccgctggacaaggactacaacatgcgctggatcgcctccatggtggccgacgtgcaccgcatcctcacccgcggcggtatcttcatgtacccgcgcgacgcccgcgaaccgagcaagcccggcaagctgcggctgatgtacgaggccaacccgatgtccttcatcatcgagcaggccggcggcgccgccaccaacggcacccagcgcatcctcgacatccagcccgagtccctgcaccagcgggtcgcggtgttcctcggctcgaaggcggaggtcgagcgcatcaccgactatcatctggaagggtga

SEQ ID NO: 40042 - protein, 337 aa, Azotobacter vinelandii
MSRVTLSRYLIEQTRSHNTPADLRFLIEVVARACKEISHAVSKGALGGVLGSMGTENVQGEVQKKLDVMSNEILLEANEWGGHLAGMASEEMDSAYQIPGKYPKGAYLLVFDPLDGSSNIDVNVSVGTIFSVLRCPDQYLTQNDSLNEQAFLQPGTQQVAAGYAIYGPQTMLMLTLGNGVKGFTLDRELGSFVLTHDNLCVPETTAEFAINMSNQRHWEPPVKRYVDELLAGKTGPLDKDYNMRWIASMVADVHRILTRGGIFMYPRDAREPSKPGKLRLMYEANPMSFIIEQAGGAATNGTQRILDIQPESLHQRVAVFLGSKAEVERITDYHLEG

SEQ ID NO: 40043 - DNA, 1017 bp, Desulfovibrio desulfuricans G20
  CDS (1)..(1017)
atgcgacaggttaccgtgactgaacatctgctgctgcaccagactaaatcgcctgctgcaacggggcagtttacagcactgctgtacgatctgattctggctgccaaaattatatccaagagtgtgaataaagccggtctgctcgacgtgcttggcggcaccggacaggtaaacgtgcagggtgaacacgtccagaagcttgatgaatatgctaacagagtgctcattcacaggatggaacgcaccggtgtgctgtgcgccatggcttctgaagaaaatgcagatctcatcagagtgcccgaacggtttgaggccggagattacattctgatttttgatccccttgacggttcttccaatattgatgtcaacatcaacgtggggacgattttttccatcctcaagcgcaagccgggagcgtcgggaagtaaagacgtgaccttgggcgatgtattgcagagcggggtggagcaggttgccgcagggtatttcctgtacggcccgtctaccatgctggtgtattcttcggggcagggcgtgcacggatttacgctggaccccagtgttggcgagttcctgctgtcccatcccgatattcgctaccccgagcagggcagaatttattcggtgaacgaatcgtactggcactactgggatgaacccacccgcgaggtggtcagttatttcaaagggccggacaatcctctgggcaagccgtattcgctgcgctatgtcggctcgctggtggccgattttcaccgcaacctgttttatggcggtatctttatgtaccccatggactaccggcttcccgaaaagcctcagggcaagctgcgtctgatgtgcgaagcttcgccgctggcttttctggctgagcaggcaggaggtcgtgccacagacgggacaaagcgcattctcgatatcgtacccggggaactgcatcagcgggtgccgctctttatcgggtcggcgggtgatgttgatgcagtggaagcaatttaccggcgtcactcctga

SEQ ID NO: 40044 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 40045 - DNA, 1005 bp, Actinobacillus pleuropneumoniae serovar 1 str. 4074
  CDS (1)..(1005)
atgaaaacactcggcgaatttattattgaaaaacaagcggagtacccggaagcgaaaggcgaattaagcggtattttatcgtctattcgacttgccgctaaaattattcaccgagaaattaaccgcgccggtttaagccaagatattttaggcgtagccggttcggagaatattcaaggcgaagcgcaaatgaaattagacgtattcgctaacgaaacgatgaaaaaggcgttactggctcgtgaagaagttgccggttttgcatccgaagaagacgataattttgtcgcatttgaaaatgatcgcgctaaaaacgctaaatatattctgatgaccgatccgttggacggttcttccaatattgacgtaaacgtttcggtcggtacgattttctctatttataaacgcgtctcgccgatcggctcgccagtgacgatggaagacttcttacaagaaggacgtaaacaagtagcgtcggggtatgtgacttacggttcatcaacgatgttggtatataccaccggtaacggggtaaacggtttcacttacgatccgtcgctcggtttatttatcctttctcatccggatatgaaaataccgacggaaggtaaatactattcgattaatgaaggacaatacgtgacattcccgatgggcgtgaaaaaattcattaaatattgccaagaaagtgacgaagcgactaaacgtccgtattcatcacgttatatcggttcgttagtatcggatttccaccgcaaccttttaaaaggcggtatctatatttatccgacttcaaccgtttatccgaaaggtaaattacgtttattgtatgaaggtaatccgatggcattcttagccgaacaagccggcggtatggcaacagacggttttaatccgattttggatattaaaccgagcgaactgcatcagcgcgtgccgttctttgtcggttcgacctcaatggttaagcaagcggacaaatttatgcaggaatgtgcggaataa

SEQ ID NO: 40046 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 40047 - DNA, 1011 bp, Pseudomonas aeruginosa UCBPP-PA14
  CDS (1)..(1011)
atgtcccgcgttaccctgagccgctatctgatcgagcagacccgcagccacaacaccccggccgacctgcgcttcctcatcgaggtcgtggcgcgtgcctgcaaggaaatcagccatgcggtgtccaagggcgcgctgggcggcgtactcggcagcatgggcaccgagaacgtgcagggcgaggtgcagaagaagctggacgtgatgtccaacgagatcctgctggaagccaacgaatgggccggcaacctggccggcatggcctccgaggagatggaccacccctaccagattccggggcgctacccgaaaggcgcctacctgctggtcttcgacccgctggacggctccagcaacatcgacgtcaacgtctcggtcggcaccatcttctcggtgctgcgctgccccagcgagtacctgaaccagaacgataccctgcgcgaggaggccttcctccagccgggcaccacccaggtcgccgccggctacgccatctacggcccgcagaccatgctgatgctgaccctcggcaacggcgtcaagggcttcaccctggaccgcgagctgggcagcttcgtcctcacccacgacaacatcagcgtgccggaaagcaccgccgagttcgccatcaacatgtccaaccagcgccactgggaagcgccggtgaaacgctacgtggaagaactgctggccggcaaggaaggtccgctgggcaagaactacaacatgcgctggatcgcctcgatggtcgccgacgtccaccgcatcctgacccgcggcggcgtcttcatgtacccgcgcgacgcccgcgagccggagaagcccggcaagctgcgcctgatgtacgaagccaacccgatgtcgttcatcatcgagcaggccggcggcgccgccaccaacggcacccagcgcatcctcgacatcaagccggagaacctgcaccagcgtgtcgcggtgttcctcggctcgaagcaggaagtcgagcgcatcaccggctaccacgcggagtag

SEQ ID NO: 40048 - protein, 336 aa, Pseudomonas aeruginosa UCBPP-PA14
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPSEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 40049 - DNA, 984 bp, Psychrobacter sp. 273-4
  CDS (1)..(984)
atgacaaccttagcacagtatctgaacactaacgccgccagtcctgccctcaatgacgttattacgacggtcaccgatgttggtaaaaccatctcacaactgctcagaaaaggcgctttggcagatatccttggcgaagcaggcaatcaaaacgtccagggtgaagatcagaagaaattagacgtgctggccaatgatttattgttagatgctttagcaaaaaacacccattgtgccggtgttgcttcagaagagctcgatgatgccatccctgccaatgctgagggcagtcttttggtattatttgacccacttgatggctcatccaatatcgatattaatatggcagttggcactatcttttctattttaccgtaccaacaccaaggtaaagtcagcgaaaatagcgatttcttgcaagcgggcaatcagcagctggcagctggttatttactatatggcacctctaccgtgctcgcgctgaccattactgataacgtggtgatgtttagcttagacccagataccaatgattatgtcctaatagaagaaaatgtcacagtcgatgccgataccagtgaatatgctatcaatgcctcaaactatcgctactggcgcgcgccgatgcaacagtatatcgatgagcttatcgctggtgagatcggtgtacgtggtcgcgattttaatactcgctgggttgccgccatggttggtgatgtgcatcgcattctatgccgtggtggtttattcacttatccatttgatactaagtatgccaataaagcaggcaaattacgtctcatgtatgaagccaatccaatgagccttctaattgaacgtgctggcggcggcgcaaccgatgcggtcaatcgtatcttagatatagaaccaactgatattcatcagcgcgtgcctgtggtacttggcagcaaaaatgaagtcgattatgtcaaaaacctacatttaaactatgccgaaaaataa

SEQ ID NO: 40050 - protein, 327 aa, Psychrobacter sp. 273-4
MTTLAQYLNTNAASPALNDVITTVTDVGKTISQLLRKGALADILGEAGNQNVQGEDQKKLDVLANDLLLDALAKNTHCAGVASEELDDAIPANAEGSLLVLFDPLDGSSNIDINMAVGTIFSILPYQHQGKVSENSDFLQAGNQQLAAGYLLYGTSTVLALTITDNVVMFSLDPDTNDYVLIEENVTVDADTSEYAINASNYRYWRAPMQQYIDELIAGEIGVRGRDFNTRWVAAMVGDVHRILCRGGLFTYPFDTKYANKAGKLRLMYEANPMSLLIERAGGGATDAVNRILDIEPTDIHQRVPVVLGSKNEVDYVKNLHLNYAEK

SEQ ID NO: 40051 - DNA, 1089 bp, Dechloromonas aromatica RCB
  CDS (1)..(1089)
atgattggagacaccatgcaattcggccgtacgaccctctcgaaattcgtcatcgaaaacactcgcgccagccatggcgaactcggcgccctgctgatcgacgtcgccgccgccgtcaagaccatctcggcgatggtcgccaagggggcgctggctggccaccatggtgcgctggacagcaccaatgtccagggcgaagtgcagaagaagctcgatgtgctgactaacgatgccatcctgcgtcactgcgagtggggcggccagctggccggcatggcttccgaggaaatggacgacccgtacccgatccctgccgaatacccgcgcggccgctacctgctggtgttcgacccgctcgacggctcgtcgaacagcgacgtcaatgtctcggtcggcactattttttcgatattttcccgcagggccgctggcgatgccgagctcggtgattacctgcggccgggcagcgaacaggtcgccgccggctacgccatctacggcccatcgacgatgatggtgctgacgctgggcaatggcacgcacggcttcacgctggatcgcgagagcggcaatttcatcctgacccacgccaatatccgcgtgccggaagacacccgcgaattcgccatcaatacttccaacgagcgtttctgggagccgccggtgcagcgctacgtcagcgagtgcaaggccggcaaatctggcgtccgtggcgaggatttcaatacgcgctggatcgcttcgatggtcgccgaagtgcaccgcatcctgatccgcggcggcatcttcatgtaccccaaggacagcaaggacccgagcaaaccggggcgcttgcgcctgctctacgaagccaatccgatggccatgctgatcgagcaggccggtggtgccgcgagcactggccgccagcgcatcctcgacgtggtaccggacagcctgcaccagcgcgcgccggtcatcctcggctcgaagaacgaggtcgagcggctggcgcgctatcaccacgaatacgacaccggggctgatcggccgtttgtttcgccgctgttttcggaacgctcgctgttccgcgacgagtcgcgcgcctga

SEQ ID NO: 40052 - protein, 362 aa, Dechloromonas aromatica RCB
MIGDTMQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 40053 - DNA, 1017 bp, Dechloromonas aromatica RCB
  CDS (1)..(1017)
atgacacagcagcgcacgctggctcgctatctcaccgaagaacaacgcaacaagggcgtcatcactggcgacctcaagctgctgattgaagtcgtttcccgcgcctgccaggccatttccattgccatcggcaaaggtgggctgggcggcgtgctcggcgaagccggcagcgacaacgtgcagggcgaagcgcagaagaagctcgacgtgctatccaacgacatcctgctcgacgccaacgaatggggcggtcacctcgccgccatggcctccgaggaaatggacctgccgcacctggtgccgcaccgcttcccgaagggcgaatacctgctgaccttcgacccgctcgacggctcctcgaacatcgacgtcaatgtctcgatcggcaccattttctcggtgctcaaatgccccgaaggcgccgacctgagcaccccggaggctgcggaacaagccttcctgcaaccgggcactgcacaggtggccgccggctatgccgtttacggcccgacgacgctgctggtgttgacggttggtgacggcgtcgcggtctttaccctcgaccgcgagcagggccagttcatcctgaccctggaaaatgtgcagattccggccgacaccaaggaattcgccatcaacatgtccaaccagcgcttctgggaagccccggtccagcgctacgtcgcggaaatgcaggtcggcaaggaagggccgctcggcaaggattacaacatgcgctgggtcgcttcaatggtcgccgacgtgcatcgcatcatgacccgcggcggcattttcatgtacccgatggacagcaagatcaagggccagggcggcaagctgcgcctgatgtacgaagccaacccgatggccatgctgatcgagcaggctggcggcgccgcaaccaccggccgccagcgcatcctcgacatccagccggaaaagttgcaccagcgggtgccggtcatcctcggctcgaaaaacgaagttgagcgcgtcactggctatcacagcgcctga

SEQ ID NO: 40054 - protein, 338 aa, Dechloromonas aromatica RCB
MTQQRTLARYLTEEQRNKGVITGDLKLLIEVVSRACQAISIAIGKGGLGGVLGEAGSDNVQGEAQKKLDVLSNDILLDANEWGGHLAAMASEEMDLPHLVPHRFPKGEYLLTFDPLDGSSNIDVNVSIGTIFSVLKCPEGADLSTPEAAEQAFLQPGTAQVAAGYAVYGPTTLLVLTVGDGVAVFTLDREQGQFILTLENVQIPADTKEFAINMSNQRFWEAPVQRYVAEMQVGKEGPLGKDYNMRWVASMVADVHRIMTRGGIFMYPMDSKIKGQGGKLRLMYEANPMAMLIEQAGGAATTGRQRILDIQPEKLHQRVPVILGSKNEVERVTGYHSA

SEQ ID NO: 40055 - DNA, 1005 bp, Haemophilus influenzae R2866
  CDS (1)..(1005)
atgaaaacattgagtgaatttatcgttgaacgccaagctgaatatccaaacgcaaagggggaattgagtggtattttgtcgtcaattcgtcttttagcgaaaataattcatcgagatattaacaaagcaggtttaacaaatattctcggtcaatctggtattgaaaatgtacaaggcgaaagtcaaatgaaactcgatttattcgcccataacacgatgaaagcggcattaatggctcgtgaagaagtggctgggtttgcatctgaagaagaggaaagttttatcgcatttgatacggaacgtggacgtaatgcaaaatatattattttaacggatccccttgatggctcttcaaatattgatgtaaacgtatccgtcggtacaattttctctatttaccgtcgcgtatctccaattggctcacctgttaccttagaagattttatgcaaccagggaataaacaagttgccgcgggttatattgtttatggttcatcaactatgttggtatataccactggtcacggtgtgaatggtttcacttatgatccgtctatcggtacattctgtctttcccacgaaaatatgcaaatgccaaaagagggcaaaatttattccatcaacgaaggacaatacctgaaattcccacaaggtgtgaaaaaatatattaaatattgccaagaagaagataaagcgactcatcgcccttacgtatctcgctatattggttcacttgtagcagacttccaccgcaacttattaaaaggcggcatttatatttacccaagtgcaaccaactatccaaatggaaaactccgtttattatatgaaggcaatccaattgcatttttagcggagcaagctggtggtgtcgcaacggatggttatcgtcgaattttagatattcaaccaacggaactccaccaacgtgtaccactttttgttggttcagaagatatggtaaaaaaagcgcaagaaatgatggaagaatttaaagaagaataa

SEQ ID NO: 40056 - protein, 334 aa, Haemophilus influenzae R2866
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIQPTELHQRVPLFVGSEDMVKKAQEMMEEFKEE

SEQ ID NO: 40057 - DNA, 1104 bp, Anabaena variabilis ATCC 29413
  CDS (1)..(1104)
atgttgccgcgcaaacttgatccaactaacagcagtcacaagaaagtacataacatggctaaagcctcagaatccttggatttgtctgtcaacgagtctacagacaaagctctagaccgcgactgtacaaccttatcccgtcacgtcctccaacaactccaaagtttttccgcagatgcacaagatttaagtgcgctgatgaaccggattgctttagctggtaaattagttgcccgtcgccttagccgcgctggtttaatggaaggggttctcggatttactggggaggtgaacgtacaaggggaatccgtcaaaaagatggatgtctatgccaatgacgtgtttatctccgtttttaagcaaagcggcttagtttgtcgtcttgcatctgaggaaatggatgaaccatactacattcccgaaaattgccccgtaggtcgttataccttactgtacgaccccatagatggttcctcaaacacagataccaatctcagtttgggttccattttctccatccgtcaacaggaaggtgatgatagtgatggtcaggctaaagacctcctcaccaatggacgcaagcaaattgcggcgggttacattttatatgggcctagcacgatgctagtttatacaatgggtaagggagttcactcatttacccttgaccccagtttaggagaattcatcctcagtgaagaaaatatccgcattcccgaccacggcgcagtttacagcgtgaatgaaggtaacttctggcaatgggaagaatcaatgcgggaatatatccgctatgttcaccgtacagaaggctacactgctcgttatagtggtgcgatggtgagtgatatccatagaatcttggtacaaggtggtgtgtttctctacccagggacagttcaaaaccctgaaggtaaattacggttgttgtatgaatctgctcccctagcctttttaattcaacaagctggtggtcgggcaactacgggattagtagatatcttagatgttgtaccgaaaaaactacatcaacgtacacctctgattattggcagtaaagaagacgtagccaaggttgaatcatttattcagaatggtcattaa

SEQ ID NO: 40058 - protein, 367 aa, Anabaena variabilis ATCC 29413
MLPRKLDPTNSSHKKVHNMAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 40059 - DNA, 1035 bp, Synechococcus elongatus PCC 7942
  CDS (1)..(1035)
atggctcaatccaccacttccgagacccacaccagagatctcgatcgggattgcaccaccctgtcgcgccatgttctcgaacagttgcaaagctttagccccgaagctcaagaccttgcggcgttgatgcagcgcattggccttgccgctaagctaatcgcccgtcgcctcagccacgcggggctggtggatgatgccctcggtttcacgggggaaatcaacgtccagggcgaagccgtcaaacggatggacgtctacgctaaccaagttttcatctcagtttttcggcagagtggcttggtctgtcggctggcttccgaggaaatggagaagccctactacattcctgaaaattgcccgatcggtcgctatacgctgctctacgaccctttagatggctcggccaacgtcgatgtcgatctcaacgtcggttccatttttgcggtgcggcgtcaagagttctacgacgagtcccatgaagccaaggatcttctgcagccaggcgatcgccaaattgctgcgggctatgtcctctatggggccagcaccttgctggtctacagcatgggtcagggcgtccatgtttttgtactggaccccagcttaggtgagtttgtcctcgcgcagtccgacatccagctcccgaactcgggtcagatctacagcgtcaatgaagggaacttttggcagtggcccgagggctatcgccagtacatccgggaaatgcatcgccgcgaaggctacagcggccgctatagcggagcgttggtagctgacttccatcgcattttgatgcagggtggtgtgtttctctatcccgaaaccgtcaagaatcccactggcaagctgcgactgctctacgaagcagcaccgatggcctttctggctgaacaagcaggcggcaaggccagtgacggccagaagcctatcctcttgcgccaaccccaagccctgcacgagcggtgcccgctaattatcggtagcgccgcagatgtggactttgtcgaagcctgcttggctgagtcggtgccctaa

SEQ ID NO: 40060 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 40061 - DNA, 996 bp, Methylobacillus flagellatus KT
  CDS (1)..(996)
atgctgaagctttcggaatttctggtccagcaggaaaggcaacatgccgttgccgataatgtcctgacgctgatacaggatatcgcagccacctgccaagcggtagcccgtgaaatcagatatggtgcattgcggggcaatatgggaagtgctggtcgcgagaatgtgcagggtgaggagcaaaaagcgctggacgtgatcagcaacgacattttcactgcgatggcgtcaaagcagcctcatgtcgcggctgtcgcttccgaggaaatggcgcaggcgcaggtgtttgccggaaagcagggcaaatacctgttggtattcgaccctctggatgggtcgtccaatgtcaacctcaatctctccgtcggcagcattttctccatcttgcccgcgccagaaggctcggtagacgaagcctcgttcctgcaggccggcagtcggcagctggctgccggttatgcgttgtacggcacctctaccatgctggtgttgacgatggggcatggcgtacatggctttaccctggatcctgaccagggcgagttctatttgacgcaccccggcctgaccatcgccgccagcactgaggaatttgcgattaacatgtccaaccagcgcttctggcagccgccggtgcagcgctatatcgcagaatgcattgcgggcagcagcggtccgcgcggcaaggattttaatatgcgttgggtcgctaccatggtcgcggaggtccatcgcttgttggtgcggggaggtgtatttctctatccgctggacagccgcgctgtaggaaggggtggtcgcctgcgccttctttacgaggccaatcccatgagcttgctggtagagcaggcaggagggcttgctacgactgggcacaggcgcatcctggatgtggagcctgcgggtctgcatcaacgtgtggcggtgatgatgggagcgcgcgaagaagtggagcgcctgcaggattatcattcgttcaccgatccgacggcgtag

SEQ ID NO: 40062 - protein, 331 aa, Methylobacillus flagellatus KT
MLKLSEFLVQQERQHAVADNVLTLIQDIAATCQAVAREIRYGALRGNMGSAGRENVQGEEQKALDVISNDIFTAMASKQPHVAAVASEEMAQAQVFAGKQGKYLLVFDPLDGSSNVNLNLSVGSIFSILPAPEGSVDEASFLQAGSRQLAAGYALYGTSTMLVLTMGHGVHGFTLDPDQGEFYLTHPGLTIAASTEEFAINMSNQRFWQPPVQRYIAECIAGSSGPRGKDFNMRWVATMVAEVHRLLVRGGVFLYPLDSRAVGRGGRLRLLYEANPMSLLVEQAGGLATTGHRRILDVEPAGLHQRVAVMMGAREEVERLQDYHSFTDPTA

SEQ ID NO: 40063 - DNA, 1047 bp, Crocosphaera watsonii WH 8501
  CDS (1)..(1047)
atgacaagtgtacaaattcctgtaattcctgaacagagccttgatcgtgaatgtactactctttcacggcacgttttgcaacaacttcaaagtttttcccccgaagcccaggatctcagtgctattatgaatcgtattgccttagctggcaaactgatttcccgccgtctcagtcaggctggtttgatggcggatgttttaggatttacaggagaaaccaatgtgcagggagagtccgtcaaaaagatggatgtatatgccaatgatgtttttatttctgtatttaaacaaagtgggttagtttgtcgtttggcttctgaggagatggacaaaccctattatattcctgaaaattgccctattggtcgttatacattactttatgaccccatcgatggttcatccaatgtggatattaacttgaatgtgggatcaatctttgccattcgtcaacaaagtggggaagacttagacggggaagcaactgatttattacaagatggaaggggacaactggccgcaggttatattgtttatggaccttctactatgttggtctatactatcggtcatggggttcattcttttattcttgaccccagtttaggagagtttattttagcgcaagaaaatatacaaattcccgatcatggtcccgtttatagtaccaacgaaggaaacttctggcagtgggatgaagctattagagactatacccgttatgttcatcgtcatgaaggttataccgcgcgctacagtggggcattggtgggagatattcaccggattttgatgcaagggggcgtatttttataccctggaaccgtcaaaaaacccgaaggaaaattacgcttattatatgaaactgctcccttagcctttttgatggaacaagcaggagggaaagcgagtgacggagttaaacccatattagatgttgttcccgataaactccatgctagaagtcctttggttattggctctaaagaagatgttagtctagttgagtcttttatccaagatcatcaacgtcgtggtaatgcttaa

SEQ ID NO: 40064 - protein, 348 aa, Crocosphaera watsonii WH 8501
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 40065 - DNA, 1011 bp, Rubrivivax gelatinosus PM1
  CDS (1)..(1011)
atgacccgacgcatcagcctcacgcagtacctggtggaggagcagcgcgagcgcggccgcatcccggcgcagttgcgcctgctactggaagtggtagcgcgcgcctgcaagagcatcgcgatcagcgtcaacaagggcgcgctgggtggcgtgctcggcagcgccggcagcgagaacgtgcagggcgaagtgcagaagaagctcgacatcatcgccaacgaggtgctgatcgaggccaacgaatggggcggcgcgctcgcggccatggccagcgaggagatggacagcatctacgtcgtgcccaaccgctacccccagggcgaatacctgctgctgttcgacccgctcgacggctcgagcaacatcgacgtcaacgtcagcatcggcaccatcttctcggtactgaagaagcagagcgataccccgggcgtcagcacccaggatttcctgcagcccggtagcgcccaggtggccgccggctactgcgtctacggcccgcagaccacgctggtactgaccgtcggcgacggcgtcgcgatgttcacgctcgaccgcgagcagggctcgtgggtgctgaccaccgacgaggtgcgcatccccgaggacaccagggagttcgcggtcaacatgagcaaccagcggcattgggcgccgccgatgcaacgctacatcgacgaatgcctgcagggcaaggacggcccgcgcggcaaggacttcaacatgcgctgggtcgccagcatggtggccgacgtgcaccgcatcctgtgccgcggcggcgtcttcatgtacccctgggacaagcgcgaaccggccaaggccggcaagctgcggctgatgtacgaggccaacccgatgggcttcatcgtcgagcaggccggcggcgcggccaccaacggcaagcagcgcgtgctcgacctgcagccgagccagctgcacgagcgcgtcagcgtgatcctgggctcgaagaacgaggtcgagcgcgcgagcgcctaccatcgcgaagcgggctga

SEQ ID NO: 40066 - protein, 336 aa, Rubrivivax gelatinosus PM1
MTRRISLTQYLVEEQRERGRIPAQLRLLLEVVARACKSIAISVNKGALGGVLGSAGSENVQGEVQKKLDIIANEVLIEANEWGGALAAMASEEMDSIYVVPNRYPQGEYLLLFDPLDGSSNIDVNVSIGTIFSVLKKQSDTPGVSTQDFLQPGSAQVAAGYCVYGPQTTLVLTVGDGVAMFTLDREQGSWVLTTDEVRIPEDTREFAVNMSNQRHWAPPMQRYIDECLQGKDGPRGKDFNMRWVASMVADVHRILCRGGVFMYPWDKREPAKAGKLRLMYEANPMGFIVEQAGGAATNGKQRVLDLQPSQLHERVSVILGSKNEVERASAYHREAG

SEQ ID NO: 40067 - DNA, 1074 bp, Rubrivivax gelatinosus PM1
  CDS (1)..(1074)
atgcccactggaggaaagtcgaccctcacgcagttcctcatcgaggaacggcgcaagcaccccgccgcgaccggggagctcaatgcactgatcaccgacgtgtcgctcgcctgcaaggcgatctcgcgcaaggtggcgttcggcggactggccggcgtgctgggcagcgccggctccggcaacgtgcagggcgaggagcagaagacgctcgatgtgctgagcaacacgatgttcctgcgcgccaccgaatggggcgggcacgtggccggcatggtgtccgaggagctggaggcgccgtacacgctgccgccgcagtacgcccggggcaagtacctgctgatgttcgaccccctggacggctcgtcgaacatcgacgtcaatgtcaccgtcggcagcatcttcgcgatccatcgtgcgccgcagccacgccaggacccgcaaccgcaggactacctgcagccgggcacgacgatggtctgcggtggctacgcgatctacgggccgtcgacgatgctggtgctgacgctgggcgacggcacgcacgccttcacgctcgacccgcagctcggcgagtgggtgctgagccatccgaaccttcgcatccccgagaagacccgcgagttcgcgatcaacgcgtcgaacagccgcttctgggagccggccgtcaagcgctacgtcgacgagtgcctggccggcagcaccggcccgcgcggcaccgacttcaacatgcgctggatcgcgtcgctggtcgccgagacccaccgcatcctgatgcgcggcggtgtcttcctctacccgcgtgacagcaaagatccgaacaaggccggccgactgcgcctgctttacgaggccaacccgatctccttcctgatcgagcaggccggcggcatggcgagcacaggccgcaagcgcctgctggaggtgcagccggaagacatccatcagcgcatcggcttcgtgttcggctcgaccgaggaggtggcccgcatcgaggcctaccaccgcgacgaacctccgaccccctacaactcgccgctgttcggcaagcgcggcctgttcgcggaagccggctga

SEQ ID NO: 40068 - protein, 357 aa, Rubrivivax gelatinosus PM1
MPTGGKSTLTQFLIEERRKHPAATGELNALITDVSLACKAISRKVAFGGLAGVLGSAGSGNVQGEEQKTLDVLSNTMFLRATEWGGHVAGMVSEELEAPYTLPPQYARGKYLLMFDPLDGSSNIDVNVTVGSIFAIHRAPQPRQDPQPQDYLQPGTTMVCGGYAIYGPSTMLVLTLGDGTHAFTLDPQLGEWVLSHPNLRIPEKTREFAINASNSRFWEPAVKRYVDECLAGSTGPRGTDFNMRWIASLVAETHRILMRGGVFLYPRDSKDPNKAGRLRLLYEANPISFLIEQAGGMASTGRKRLLEVQPEDIHQRIGFVFGSTEEVARIEAYHRDEPPTPYNSPLFGKRGLFAEAG

SEQ ID NO: 40069 - DNA, 1056 bp, Rubrivivax gelatinosus PM1
  CDS (1)..(1056)
atggaccccatcgagctcgagcaatggctctcggcgcaccctccggcgctggccgacgtgatccggcacgtggcggcggcctgcgcacgcatcagccgggcggccgcgcgcgcgccgctggcggggcagctcggcggcgccggctcgctcaactcgcagggcgagccgcagcagcggctcgacgtgctggccgatgcctgcgtgtcgcaggcgctgtcagcctgcacccatgtggccggctgggtcagcgaggagcacgccgatgtgacggtgtcgcccgagcacggcagcggcggcgcctacctggtggtgttcgatccgctcgacggctcgtcgaacgtcgagaccaacgtggcgatcggcagcatcttctcggtgctgccccacctgttccgcggcacgccggccagcgcggccgccttcatgcagccgggccggcgccaggtggcggccggctacgcgatctacggcccctcgacggtgctggtgctgagcctgggccagggcgtgcacatgttcaccctcgacccggacgcgcccggcgacgccgctcgctgggtgctgacgcgggcggacgtggaagtgccggtgtcgaccaccgagttcgcgatcaacgcctcgaaccagcgcttctgggagaagccggtgcagcgttacgtggccgagtgccttgcgggccagagcgggccacgcggccgcgacttcaacatgcgctgggtggccagcctggtggccgaggtgcaccgcatcctcacgcgcggcggcgtcttcctgtacccgcgcgacagcagggagcccttcaggcccgggcgcctgcggctgctgtacgaggccgcaccgatggcctggctgatggagcaggccggcgcggcggcgaccaccggcaccggcccgctgctggagctggtgcccgacgcgctgcaccacaaggtgccggtgatcctgggatcgcgcgacgaggtcgagcgcatcgtgacctaccatgaggacccgagcgccaatgtgtcctggcagctattcaagacacgctcgctgttcatccagccgcaagcctag

SEQ ID NO: 40070 - protein, 351 aa, Rubrivivax gelatinosus PM1
MDPIELEQWLSAHPPALADVIRHVAAACARISRAAARAPLAGQLGGAGSLNSQGEPQQRLDVLADACVSQALSACTHVAGWVSEEHADVTVSPEHGSGGAYLVVFDPLDGSSNVETNVAIGSIFSVLPHLFRGTPASAAAFMQPGRRQVAAGYAIYGPSTVLVLSLGQGVHMFTLDPDAPGDAARWVLTRADVEVPVSTTEFAINASNQRFWEKPVQRYVAECLAGQSGPRGRDFNMRWVASLVAEVHRILTRGGVFLYPRDSREPFRPGRLRLLYEAAPMAWLMEQAGAAATTGTGPLLELVPDALHHKVPVILGSRDEVERIVTYHEDPSANVSWQLFKTRSLFIQPQA

SEQ ID NO: 40071 - DNA, 1068 bp, Rhodospirillum rubrum
  CDS (1)..(1068)
atgctcgccaccgatcgcaccacgcttgcgcagttccttgtcgaggaatgccggggccgcgccggcgatgattccgagcttcttggtttgttgctcgacgtcgcccaggcctgcaagaccatctcgaagatgacggcgatgggctcgctcgccggggttcatggctataacggcgatgtcaatccccagggcgagaatcaggcgcggctcgacctgatgtccaatcaggccttcgtccgcgccaccgaacgcaccggccatgccgccggtctggccagcgaggagatggaagaggttctgggcttccccgagtcctacgcccggggcaccttgctgctggtcttcgatcccctcgacggatcgtccaacatcgatatcaacggcaccgtcggctcgatcttttcgatcctgccgatgccccgccccggcgaagccccgcagaccgccgacttcctgcaatcgggccgccagcaggtggccgccggctatgccctttatggcccctcgaccatgttcgtgctgaccatcggctcgggcgttcacggcttcaccctcgatccgctgcttggcgatttcattctgacccacccgtcgatgacggtgatccccgaaagcggcgaattcgccatcaacagctcgaacagccgcttctgggaaccgccgatccgcgcctatgtcgatgaattgctggccgggcgctcgggtccgcggtccaaggattacaacatgcgctggatcgccgccctggtggccgatgtccaccgcatcttgctgcgcggcggcatctatctgtatccccgcgacaccaagacccccgatctggccgggcgcctgcgcctgctctatgaagccgccccggtggcctttttgatggaacaggctggcggccgctgcaccaccggcacgcggaccatgctcgacctcgtgcccgggtccttgcacgaacgcgtaccgctgatcttcgggtcggccgtggaagtggagcgggtcgagaccctttaccgcgagccgcaacgccgggaattcgccacgccgttgttcaatcagcgcggcttgttccgcgactaa

SEQ ID NO: 40072 - protein, 355 aa, Rhodospirillum rubrum
MLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 40073 - DNA, 1017 bp, Ralstonia metallidurans CH34
  CDS (1)..(1017)
atgacacgcatcagcctcacccgctatctggtcgaggagcagcgcaagcacaacacgatcgagccggaactccggctgctgatcgaagtggtcgcgcgcgcctgcaaggccatttccaacgccgtcagcaagggcgccctcgcgggtgtgctcggctcggccggcaccggcaacgttcagggcgaaacgcagcagaagctcgatgtgatcgccaatgaggtgctgctcgacgccaatgaatggggtggccatctggctgccatggcgtccgaggaaatggactcgttctacgagatcccgaaccgctacccgaagggcgaatacctgctgctgttcgatccgctcgacggctcgtcgaacatcgacgtgaacgtgtcgatcggcacgatcttctcggtcctgcacatgcacaagcccggtcagaccgtgaccgagcatgacttcatgcagccgggcacccagcaggtggcagccggctatgccgtgtatggcccgcagaccacgctggtgctgaccgtcggcaatggcgtgcacatgttcacgctggaccgcgaggcaggcagcttcgtgctaacccagtccgatgtgatgatcccggaagacaccaaggaattcgcgatcaacatgtccaacatgcgccactgggctccgcccgtgcgccgctacatcgacgagtgcctggccggcgacgaaggtccgcgcggcaagaacttcaacatgcgctggatcgcctcgatggtggccgacgtgcaccgcatcctgacacgcggcggcgtcttcatgtatccgtgggacaagcgcgagcccgagaaaccgggcaagctgcgcctgatgtatgaagccaatccgatggcgttcctggtcgagcaggcgggcggcgcggctaccaatggccagcagcgcattctggacgtggagccgaccaagctccaccagcgcgtatcggtcatcctcggttcgaagaatgaagtcgagcgcgtcacgcggtatcaccaggaagacgccgccaaggcgtaa

SEQ ID NO: 40074 - protein, 338 aa, Ralstonia metallidurans CH34
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 40075 - DNA, 1017 bp, Burkholderia fungorum LB400
  CDS (1)..(1017)
atggctttgcaacgtcgtaccactctcacgaagtacctgatcgagcagcagcgcgagaccaacaatctgccggccgatctgcgccttttgatcgaagtcgtcgcgcgtgcgtgcaaggcgatcagctaccacgtcagcaagggcgcgctgggcgacgcgctcggcacggcgggcagcgagaacgttcaaggcgaagtgcagaagaagctcgacatcctgtcgaacgaaatcctgctcgaagcgaatgaatggggtggcaacctcgcgggcatggcgtccgaggaaatggaacagttcttcccgatcccggcgaactatccgaagggcgaatacctgctcgtgttcgatccgctcgacggctcgtcgaacatcgacgtcaatgtttcgatcggcacgatcttctcggtgttgcgctgcccggacggccagcagcctaccgaacagtcattcctgcaaccgggcacgcagcaggttgccgcgggttatgcggtatatggtccgcaaaccgtgctggtgctgaccaccggcaacggtgtgaactgcttcacgctcgaccgcgaactcggctcgtgggtgctcacgcagagcgacatgcgcattcctgtcgaaacgcgtgaatatgcgatcaacgcttcgaacgaacgtcactggtatccgcctgttcagcaatacatcggcgagttgaaggacggcaaggaaggttcgcgccaaagcgacttcaacatgcgctggatcgcgtcgatggtggcggacgtgcaccgcattctgaatcgcggcggcatcttcatgtatccggccgacaagcgcacgccggacaaaccgggcaagctgcgcctgatgtacgaagccaatccgatggcctttattgtcgagcaggcaggcggtgccgcgaccaatggcgagaagcgcattctggacatccagccgaaaagcctgcatgaacgcgtggcggtattcctcggttcgaagaacgaggtcgaccgggttacccgctaccatctcgaaacaaaaaagtga

SEQ ID NO: 40076 - protein, 338 aa, Burkholderia fungorum LB400
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 40077 - DNA, 1137 bp, Burkholderia fungorum LB400
  CDS (1)..(1137)
atgcaggacggacgtacgaccctttcgaaatttctgatcgacaccctcgaccgccagccctgttcgacggaaacggcgcgcaacgccggcctttcggcgctgctgatcgacgtcgccgccgctatcaagtcgatctccgcgatgctcaccaaaggcgcgctcggcggcaactacggctccgcgcagagcatcaacacgcacggcgaggaacagaagaagctcgacgtcgcgaccaatgaaatcttcgtgcagcaatgcgagtgggacggactgctcgccgcgatggtgtccgaggaaatggagagcgtctatgcgattccgccgggctatccgcgcggcgattatctgctcgctttcgatccgctcgacggttcgtcgaatatcgacatcaacggcgtggtggggtcgatcttttcggtgctgcgcaatggcgagggaaatggaaatgccaatgaaaaaaacggcagcgatccgcgcggcacggtcggcgagtccgcgtttctgcggccgggctgcgagcaggtggccgcgggctacgccgtctacgggccatcgaccatgctcgtgctctcggtcggcaacggcacgcatggtttcacgctggagcgcgagatcggcaacttcgtgctcacgcattcgaacatccgcattcccgaagacaccgtcgagttcgcgatcaacgcctcgaacgaacggttctgggaaccgccggtgcgccgctatgtgcaggaatgcaaggacgggcgcagcggctgccgtgcgagcgacttcaatatgcgctggatcgcgtcgatggtcgccgaggtgcatcgcatcctgatgcgcggcggcgtgttcatgtacccgcgcgactcgaagacgcctgcgatggaagggcgcctgcggctcctgtatgaagccaacccgatgagctttctcgtcgaacaggcgggcggtctttcgatcaccgggcgcgagcggattctcgacgtcgtgccgcgcgcgctgcatggacgcgtgccggtgatcctcggttcgaagcacgaggtggagcgtattggccgctatcacggcgaatacgaccgcggcgaagatcagcccttcacctcgccgctgttcagccggcgctcgctgttcctgccgggtttcacggcctag

SEQ ID NO: 40078 - protein, 378 aa, Burkholderia fungorum LB400
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 40079 - DNA, 945 bp, Geobacter metallireducens GS-15
  CDS (1)..(945)
atgccgttcagtgaaccgggcaagacgaaattccaggtagatttgcgccgtcatctccgtaatcaagggatctgcgacaacctcgtccacctcatctgcgagattgccgaggcgagcaagtatgtgatcaacgctgttcgtaccggtgatctgggcgtggcgggtacctccaacctttacggcgaagagcagcttgccctggacgtcctttcggacaggattatcaagaaacggctcattcactccggcgttgtctgtaacattgcttccgaggaaatggatgaaatcttccaggcccaggccgatgcagatggcctttactcggtggcctatgatcccctcgacggttcgtcgctcgtggatgtgaatctggcggttggcaccatcgtctccatctatgaggggtgcaatctgctccagaaagggcgcaaccaggtcgcggccttgtacatcctctatggcccacgggtctctatggtctactccgtcggcagaggggtgcatgaattcaccatgaaccatctgatggagttcactctttcgcgcgaaaacattgtcatgcaggaagagggaaatatttatgctcctggtggcctgcgcaacaaatatcaagaggggactgaacagttcgttcgttatttggaggagaagggggccaaactccggtactcgggcggttttgtgccggacatcaaccaggttatcatgaaagggaagggcatttttatgtatccggcccttaacggatcccctaacggcaaactgagactcctcttcgagcttaacgccatggcatatctggttgaaaacgccggtggggcagccactgacgggaaacagccgattcttgacctggaaccccactccctcgaccaacgcgcccctgtttacatcggttgcaaggctgacgtggtgaaggcgatggaatttgtcagtcgcaattga

SEQ ID NO: 40080 - protein, 314 aa, Geobacter metallireducens GS-15
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 40081 - DNA, 1041 bp, Cytophaga hutchinsonii
  CDS (1)..(1041)
atggaacgcaatttatcaactgtaaaaaccttagttcaatttattactgaaagtcaaaagcatgtatttggtgcatcaggtgatttgtccaaaatactaaatgacattgctgttgcagctaaaatcatcaatcgtgaagttaataaagctggactgcttgatattttaggaatggaagggggaatgaatgtgcagaatgaagaagtgaaaaaattggatgtgtatgcaaatgatcaatttatctcagctcttcgatctggggggcaatgttgtgctattgcttcggaagaaaatacagatataattccgatcgaaaataatggccattcaaaatcaaattatgttgtacttatagatcctttagatggatcttcaaatattgatgtgaatgtagcaataggtagtattttttcaatttatcgtagagtttctgaatctggtccaggagagactgttgattgtatgcaagtaggtaataagcaagttgctgcaggatacattatttatggctcatctacgatgatggtgtatactacgggtgatggagtgaatggatttacattggatccttcaatcggagagttttgtttatcacaccccaacttgaaaatcccggaagatggttttatttattctgttaatgaaggtaactacgcagattttcctcgcgaaatacaagaatatatttactattgtaaaacacctgattttgaaacaagccgtccatattcatcaagatacataggatctatggttgcagattttcatagaaatttaattaaagggggaatttttatgtatccggcaacggctaaatatccattaggtaaattacgtttgatgtatgaatgcaatccgttggcatttattgtagaacaggctggcgggaaggctatcgatggtgaaggtagaattttagatattgaacctacaaacattcatcaacgcacaggcatcatcatcggttcaaaaaatatggttgaaaaagtagaagcctttatacaaatgaatgtcggactgaatgtgtatcggctaaaatag

SEQ ID NO: 40082 - protein, 346 aa, Cytophaga hutchinsonii
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 40083 - DNA, 969 bp, Microbulbifer degradans 2-40
  CDS (1)..(969)
atgcaaaacttacaaggcatgttgcgcgaccagcgtgtggcgcaagatttacaggaagtaatttttagtattgaacttgcctgtaaagatatagctaaaaaagtgcagctaggtgcgctagctggtgtgctgggtgcgacagaaagcgaaaacgtgcaaggagaaactcaaaagaagctagatgttatatcgaacgatattctaaaagcttcgttggccgccaactccaacgtgttggcacttgcatcggaagaagaagataatgtagtggcagccaatgccggaggccgctatgttgtagcctttgacccattagatggttcttcaaatatcgatattaatggccaaataggtactatttttacaatatttgaagcgctagacggtgtagcagcaaactcgggcaagcattttttacagcagggtaacaagcaggtatgtgcaggctatgtattgtatggcgcatctacgttaatggttattactgtggatggcccaacaagttgcttaaccttagacccagccacacaaactttttcgcttactaatactgcgctgcaagtgccagaccaaacgcaagagtttgctgtgaatttggcaaacgaacgattttggttgcccaaatttaaaagctatgtggctgatttaaaattaggtgaagagggtgtgcggggcaagcgatttaatatgcgttggaatgcatctatggttggcgatgtgcaccgcgtattaatgcgcggtggcatttttatgtacccaagtgatacgcgtaaccctaagcagccagctaaattgcgattattgtacgaggctaacccaatggctttattgattgagcgcgctggcggtaaagcatttaatgaaacacagcgtattcttgatgtgacaccttgtgcgctgcacgagcgtatagcggtcatattagggtctgagcaagaggttgccacttgtttggagtaccttaactag

SEQ ID NO: 40084 - protein, 322 aa, Microbulbifer degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 40085 - DNA, 1101 bp, Trichodesmium erythraeum IMS101
  CDS (1)..(1101)
ttgactggagctactcaagatggagaaactacatatatggtaaatacccaagctcgggaagacctccacattcgtctggaggaaacacagttattggatcgtgactgtactaccttatcacgtcatgtactacagcaacttcatttttcaccggatgctcaagatataagctccttaatgaatagaataggtttggccgggaagttaatcgctcgtcgcctaactcgtgctgggctattagaagatactttagggtttactggcacagttaatgtccagggagagtccgtcaaaaagatggatatctatgccaatgatgtatttatctctgtatttaagcaaagtggccttgtctgccgcttggcatctgaagagatggaaaaaccttattatattccagaaaattgtccaattggccgctatactttgctttatgaccctctggatggttcttctaatctagatacaaatttaaatgtgggatctatattctcagttcgccaacaagaaggtaatgatgaaaatggtttagctcaagatttacttcaaaatggacataaacaaattgctgctggttatattctatatggaccgagcacaatgttggtatattcaataggtcaaggagtacacgcatttactctagacccgagcctaggtgagtttattcttgttaatgagaatattaaaattccagaacatggtccggtctacagtgtgaatgagggtaacttttggcagtgggatgatagtatgcgggattatatccgctatgttcatcgccatgagggttatactgctcgttatggtggcgcattagtgggagatttccatagaattttatatcaaggtggggtatttttgtacccaggtacagttaaaaagccagaaggaaaattacgtctgttatatgaatcagctccaatgggttatctagtggaacaagcaggtgggagagctagcacaggaactgaagaaatattagatgtagtagcagatcaactgcatcaacggacgccattgattattggtagtaaggaagatgtggcgcttgttgagtcttttattaaagaacaaaaacgcatttctaatcaaggttaa

SEQ ID NO: 40086 - protein, 366 aa, Trichodesmium erythraeum IMS101
MTGATQDGETTYMVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 40087 - DNA, 1014 bp, Thiobacillus denitrificans ATCC 25259
  CDS (1)..(1014)
atgcacaccggcaccacccttacccagttcatcattgaagagcaacgtcgcaccgcgggtgcgaccggcgacttcacctcgctgcttaacgacgtcgtcaccgcgtgcaaggcgatttcgaacgccgtcaacaagggcgcgctgctgggcgtgatgggcgcactcgaatccgagaacgtgcagggcgagacgcagaagaaactcgacgtgatcaccaacgacatcatgatccgctcgaacgagtgggccggccacctggccggcatggcgtccgaggaaatggacgacgtctacgccatccccggccagtacccgctcggcaagtatctgctggtgttcgacccgctcgacggatcaagcaacgtcgacgtcaacatctcggtcggcacgatcttctcgatcctcaaggctccggtcgccggccgcgccgcgaaggctgaggacttcctgcaggccggcaccaagcaggtctgcgccggctacgcgatctacggttcgtcgaccatgctggtcctgaccttcggccacggcaccaacggcttcacgctcgaccgcgacgtcggcgagttcgtgctgacccatcccgccatgaaaatcccgaccgaaaccaaggaattcgcgatcaacgcgtcgaacatgcgtttctgggaaaagcccgtgcagcgctacgtcgacgaatgcctcgccggcaagaccggtccgcgcggcaaggacttcaacatgcgctgggtcgcgtcgatggtcgccgaagtgcaccgcatcctgacccgcggcggcatcttcatgtaccccaaggacaccaaggacccgtccaaggccggcaagctgcgcctgatgtacgaagcgaatccgatggcgttcatcgtcgagcaggccggcggcgcggcgacgaccggctaccagcgcatcctcgacatcgccccggaaggcctgcaccagcgcgtgccggtgatcctcggctcgaagaccgaagtcgacacggtgacgggctaccaccacgaaaaggcggcgtaa

SEQ ID NO: 40088 - protein, 337 aa, Thiobacillus denitrificans ATCC 25259
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 40089 - DNA, 936 bp, Polaromonas sp. JS666
  CDS (1)..(936)
ttgcggctgctgcttgaagtggtggcccgcgcctgcaaaggcatcagccagtccgtcaacaaaggcgcactgggcggcgtgctcggcacggccggcagtgaaaacgtgcagggcgaagtccagaaaaagctcgacatcatcgccaacgaagtgctgatcgaagccaacgaatggggtggccacctggccgccatggcctcggaagaaatggacagcatctacctggtgcccaaccgttatccgcaaggtgaatacctgttgctgttcgacccgctcgacggctccagcaacatcgacgtgaatgtcagcatcggcaccatcttcagcgtgctcaaaaagcccgacgaccatgccggcgttgaagaaaaagactttttgcagccgggcaacaaacaggtggccgccggctactgcgtctatggcccccaaaccacgctggtgctgaccgtgggcgacggcgtggccatgttcaccctcgaccgcgagcagggctcctttgtgctcatcgaggaaaacgtgcgcatccccgaagacaccaaggaattcgccatcaacatgagcaacatgcgccactgggatgcgccggtgaagcgctacatcgacgaatgcctgcagggcaccgaaggcccgcgcggcaaggacttcaacatgcgttgggttgcctccatggtggccgacgtacaccgcatcctgagccgcggcggcatcttcatgtacccctgggacaaacgcgagcccgaaaaggccggcaaactgcgcctgatgtacgaagccaaccccatgggctggatcgtcgagcaggccggcggctccgccaccaacggcaaacagcgcattctggacatccagcccggcaagctgcacgagcgggtcagcgtcatcctcgggtccaaaaatgaggtagagcgggtgaccggctaccactccgggctataa

SEQ ID NO: 40090 - protein, 311 aa, Polaromonas sp. JS666
MRLLLEVVARACKGISQSVNKGALGGVLGTAGSENVQGEVQKKLDIIANEVLIEANEWGGHLAAMASEEMDSIYLVPNRYPQGEYLLLFDPLDGSSNIDVNVSIGTIFSVLKKPDDHAGVEEKDFLQPGNKQVAAGYCVYGPQTTLVLTVGDGVAMFTLDREQGSFVLIEENVRIPEDTKEFAINMSNMRHWDAPVKRYIDECLQGTEGPRGKDFNMRWVASMVADVHRILSRGGIFMYPWDKREPEKAGKLRLMYEANPMGWIVEQAGGSATNGKQRILDIQPGKLHERVSVILGSKNEVERVTGYHSGL

SEQ ID NO: 40091 - DNA, 1056 bp, Leishmania major
  CDS (1)..(1056)
atggacgtcagacgcacccccactcccactactctcacccagtacatcatcaagagccaaccgccgcacagtcgtggcgacttcacgctcttgatgatggcgattcagacgtcggtgaaggtgattgagaagaacatccgacgtgctggcatgaagggcatgctgggctacattgctgggcagtcggcgaacgcgacgggcgaccatcaggcgaagctggatgtgatctcgaacatagcgttcaaggcgtacctgctgagctccaccagcgtgtgcgtgctcggcagcgaggaggaagagcagatgatcatcgccgagagcggccgccgtggcgactacctcatcttcttcgaccctcttgacggcagcagcaacattgatgccaacgtctccgtaggctctatctggggcgtgtggcggctgcccaaggacaccaccataaacagcgtcgaagacgccaacgccgtgatccgcatgcttaagggaacagacatggtttctgccgggtacgccgtgtacggcagtgccacgaacctcgtgctgacgagcggacacggcgtggacggcttcacactggaccccaacattggcgagttcatcctgacacacccgcacatcagcatcccgaaaaagcggagcatctacagcgtcaacgagggcaattacggcaagtgggagccgtggtttaaggagtatatcgactacctcaagatgaacaagacaacccgctacagcgcgcgttacatcggctccatggtcggcgacatccaccgcacgctcctctacggcggtatattctgttaccccaaggacgcaaaccaggtggaggggaagctgcgccttctgtacgaggccgcaccgatggcgatgatcgtggagcaggcaggcgggaaggcggtgggcagcaacggccgtatcctggagcagtccatcactcgccttcatcagcgcacgccggtctacttcggcagccgccaggaggtggacctgtgcatggccttccgcgaccgcaacgtgaagacggaggcactagcaccgacttccagcaagctctaa

SEQ ID NO: 40092 - protein, 351 aa, Leishmania major
MDVRRTPTPTTLTQYIIKSQPPHSRGDFTLLMMAIQTSVKVIEKNIRRAGMKGMLGYIAGQSANATGDHQAKLDVISNIAFKAYLLSSTSVCVLGSEEEEQMIIAESGRRGDYLIFFDPLDGSSNIDANVSVGSIWGVWRLPKDTTINSVEDANAVIRMLKGTDMVSAGYAVYGSATNLVLTSGHGVDGFTLDPNIGEFILTHPHISIPKKRSIYSVNEGNYGKWEPWFKEYIDYLKMNKTTRYSARYIGSMVGDIHRTLLYGGIFCYPKDANQVEGKLRLLYEAAPMAMIVEQAGGKAVGSNGRILEQSITRLHQRTPVYFGSRQEVDLCMAFRDRNVKTEALAPTSSKL

SEQ ID NO: 40093 - DNA, 1206 bp, Oryza sativa
  CDS (1)..(1206)
atgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcgaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtga

SEQ ID NO: 40094 - protein, 401 aa, Oryza sativa
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 40095 - DNA, 1020 bp, Xenopus laevis
  CDS (1)..(1020)
atgtcagatcgaagcccctttgaaacggacatgttaacccttacccgctatgtcatggaaaggggaaggcaagctaaaggcaccggggaactgacacaacttctgaactccattctgactgctataaaagccatctcctctgctgtaaggaaggcaggcattgcacatatgtatggcatttctggaagcgtgaatgtgactggggatgaagtgaagaaactggacgtgttatctaatgatcttgtaattaacatgctcaaatcatcctatggtacttgtgccttggtttctgaggagaacaaagacgttattatcataccaaaagatttacggggtaaatacattgtctgttttgatccccttgatggttcttctaacatagactgcttagcatctattggaacaatatttgccatatacaggaagacaacagatacagagccctgtgaaaaagatgcccttcagccaggacggaacattgtagcggcaggctatgccctgtatggaagtgcaacccttgtggcgctctctacaggccaaggtgtggattgcttcatgctggatcctgcacttggagaatttgttttggttgacaaaaatgtgagaattaagaagaaaggcaagatttacagtcttaatgaaggctatgcaaaatattttgatccagcaataacagaatacctacataataagaaattcccccaggatggaagttccccatacagttcaagatatgtgggttccatggttgctgatgtccatagaaccctggtgtatggtggaatttttatgtatccagccaatgagaagagtcctaaaggaaagctccgacttctatacgagtgcaatccaatgtctttcatcatagagcaggctggagggatggcaaccacaggaacccaaccagtgctagatgtacaacctgagaccatccatcagagggtgcccctgattctcggctctccagatgatgtagaggagtatttggcctgtgttaagaaacaccaaaaaagcagctaa

SEQ ID NO: 40096 - protein, 339 aa, Xenopus laevis
MSDRSPFETDMLTLTRYVMERGRQAKGTGELTQLLNSILTAIKAISSAVRKAGIAHMYGISGSVNVTGDEVKKLDVLSNDLVINMLKSSYGTCALVSEENKDVIIIPKDLRGKYIVCFDPLDGSSNIDCLASIGTIFAIYRKTTDTEPCEKDALQPGRNIVAAGYALYGSATLVALSTGQGVDCFMLDPALGEFVLVDKNVRIKKKGKIYSLNEGYAKYFDPAITEYLHNKKFPQDGSSPYSSRYVGSMVADVHRTLVYGGIFMYPANEKSPKGKLRLLYECNPMSFIIEQAGGMATTGTQPVLDVQPETIHQRVPLILGSPDDVEEYLACVKKHQKSS

SEQ ID NO: 40097 - DNA, 1041 bp, Dictyostelium discoideum
  CDS (1)..(1041)
atgtcatcaaataatttaattacattacatagatggttattatcagatactcataagaatatggagaataaattagaaatggcaaatttattctcaggtatagcattggcatgtaaaattacaaataatgcaataaagagagcaggttttgaaagtaatttcggtttagcaggtataaccaatgttcatagtgaagatgtaaagaaattagatgtcattgcaaacgatgccttcaagatggcattaaaatcaacgcgtgaagtattttgcatggtatcagaggaagaagattcaatcattccagtatcacaatcacaagcaggtaaatatgttgttgcattcgatccattagatggctcaagtaatttagattgtaatgtctctgttggctcgatcttttcaatttggccaaaggcatcaaaggatcacaactattcaaacgatgatgtacttagaaagggtcgtgacatgactgctgccggctatgccctctatggcagtgccaccatgttggtattgacatttggccaaggtgtctatggcttcactttggataaccatattggtgaatttgttttaactcatgtcgaaatgagaattcgtaccaaaggttcaatctattcaatcaatgaaggtaattcagtcttttgggataaagccacccaagaatacgttaaagctattaaatctggtgctgatggtcgtgctccttactcttcaagatacattggtagtatggtctctgatattcatcgtactctcctctatggtggtatctttatgtatccaggtgataccaaatctccaaatggtaaattaagatatctctacgaagttgctccactctctttcattatggaacaagcagctggtaaatcaactaatggttcttcaccttgtcttgacatgattccaaaatcaattcatgaaagagtaccagttttcatgggttctccagcttgtatagatgaacttttagcttttcaaaagaaatttaatcataatcatagtactacttcacaacatgaaaaagataattaa

SEQ ID NO: 40098 - protein, 346 aa, Dictyostelium discoideum
MSSNNLITLHRWLLSDTHKNMENKLEMANLFSGIALACKITNNAIKRAGFESNFGLAGITNVHSEDVKKLDVIANDAFKMALKSTREVFCMVSEEEDSIIPVSQSQAGKYVVAFDPLDGSSNLDCNVSVGSIFSIWPKASKDHNYSNDDVLRKGRDMTAAGYALYGSATMLVLTFGQGVYGFTLDNHIGEFVLTHVEMRIRTKGSIYSINEGNSVFWDKATQEYVKAIKSGADGRAPYSSRYIGSMVSDIHRTLLYGGIFMYPGDTKSPNGKLRYLYEVAPLSFIMEQAAGKSTNGSSPCLDMIPKSIHERVPVFMGSPACIDELLAFQKKFNHNHSTTSQHEKDN

SEQ ID NO: 40099 - DNA, 1017 bp, Xenopus laevis
  CDS (1)..(1017)
atgacggaccaggcccccttcaacactgatgtcattaccctgactcgcttcgtcatggaagagggcaggaaagccaaggggaccggggagatgacccaactgctgaactctatgtgcacggctgtgaaagccatctcttctgcagtgcgcaaggctggactggccaacctctatggcattgctggctccactaatgtgacaggggaccaagtgaaaaaactagatgtcctctccaatgaccttgtcatcaacatgctcaagtcctcctacggttcctgtgtcctggtgtcagaagaagacccgcatgctctgattgtggagcctgataaacggggtaaatacgtggtgtgctttgatcctttggatggctcctcgaacattgactgcctggcttctattggtacaatattcgccatctacaaaaagacttctgatggagagccaaccgaaaaagatgctttacaaccaggccgaaacattgttgcagcaggctatgctctatatggcagtgcaacaatgttggttcttgccgcagaatgtggtgtcaactgtttcatgttggacccagcaatcggagagttcattttagtgaaccaggatgtgaagatcaaaaagaagggtaacatatacagcctgaatgagggttatgccaagtattttgatgaagcagttaccgaatacttacagaagaagaaatttccagaagatggaagctcaccttatggtgcaaggtatgttggttcgatggtagctgatgtgcatcgtacattggtgtatggaggaatctttctgtacccagccaatgtaaagagcccaaagggcaagctgagacttctgtatgagtgcaacccaatggcttacattatggagcaggctggaggaatggctactaatggacttgagtcagtgcttgatatagtacccgagagtatccaccagaggatgccaatagctttggggtctccagatgatgtacaggaatatatgaacatttacaagaaatatgcaaagaaatga

SEQ ID NO: 40100 - protein, 338 aa, Xenopus laevis
MTDQAPFNTDVITLTRFVMEEGRKAKGTGEMTQLLNSMCTAVKAISSAVRKAGLANLYGIAGSTNVTGDQVKKLDVLSNDLVINMLKSSYGSCVLVSEEDPHALIVEPDKRGKYVVCFDPLDGSSNIDCLASIGTIFAIYKKTSDGEPTEKDALQPGRNIVAAGYALYGSATMLVLAAECGVNCFMLDPAIGEFILVNQDVKIKKKGNIYSLNEGYAKYFDEAVTEYLQKKKFPEDGSSPYGARYVGSMVADVHRTLVYGGIFLYPANVKSPKGKLRLLYECNPMAYIMEQAGGMATNGLESVLDIVPESIHQRMPIALGSPDDVQEYMNIYKKYAKK

SEQ ID NO: 40101 - DNA, 1263 bp, Chlorarachnion sp
  CDS (1)..(1263)
atgaacgtagttctgggactcaccatggctgccgtgctctttcgcggaggtgtgctgtcttccaccatgactgcggctcgcacattcgcagcgccatctgtgcacacccgtggcatgcacatgtcagtcaagagcagtaaccctttctctcaggctggtcgtcgtgctgctgttagatccagtgtcgcaccctcccctgtccaagactctgctggtactatcgttgatgacggaactgtcacattaacaagattcatgattgaggaggcaatgaagagcaagactcctgggcaggaggacatggttcgtttgatttcttccatctcagttgcatgcaaacgcattgcatccatggtgcaaactgcaggaatctccggatctacaggtctggctgaaggtggtggatcagtcaacgttcaaggcgaggaacagaagaaacttgatgtcatttctaacgatgtactaaagtctgcccttcgtccttctggaaaacttggagtaattgcctctgaggaggaagataatccagttgtcgttgatgaactttactccggcgaatatgttgctactttcgatccgctcgatggatcttccaatattgatgctgcaatttccactggaactatcttcggagtgttcaaagctccagaagagtgcttgatcggggattctgataatctcagtattgcagagcagcaatgtttggaggcaacacttcaacctggaactaaccttgttgctgctggatactgcatgtattcgtcctccaccatccttgttctcaccaccggagacgggctcaatggatttactcttgacccttccattggagagttcatcctcacccatcctaatatccagattcctagccgtggaaagatctattctatgaacgaagcaaactacttcgattgggaccctaagcttcagacctacgttgataaccttaagaaggcagaaggtcaaactggagaaaagtacagctctcgctacatcggatccatggtcggagatgtgcaccgtacccttctctatggaggcatcttcgcttaccctggagataagaagaacgtcaacggaaaacttcgccttctgtacgaagctgctccaatgtcccttatcttcgaacaagcgggtggaaaatctattactggacctggtggacgtgtgttggacttagttcctgataaggttcaccagcgttgtcctgtgttcattggatcccctgatgatgtggatgaagttgaaaaggctctcgcataa

SEQ ID NO: 40102 - protein, 420 aa, Chlorarachnion sp
MNVVLGLTMAAVLFRGGVLSSTMTAARTFAAPSVHTRGMHMSVKSSNPFSQAGRRAAVRSSVAPSPVQDSAGTIVDDGTVTLTRFMIEEAMKSKTPGQEDMVRLISSISVACKRIASMVQTAGISGSTGLAEGGGSVNVQGEEQKKLDVISNDVLKSALRPSGKLGVIASEEEDNPVVVDELYSGEYVATFDPLDGSSNIDAAISTGTIFGVFKAPEECLIGDSDNLSIAEQQCLEATLQPGTNLVAAGYCMYSSSTILVLTTGDGLNGFTLDPSIGEFILTHPNIQIPSRGKIYSMNEANYFDWDPKLQTYVDNLKKAEGQTGEKYSSRYIGSMVGDVHRTLLYGGIFAYPGDKKNVNGKLRLLYEAAPMSLIFEQAGGKSITGPGGRVLDLVPDKVHQRCPVFIGSPDDVDEVEKALA

SEQ ID NO: 40103 - DNA, 1017 bp, Yarrowia lipolytica
  CDS (1)..(1017)
atggaagccaaccccgaagtccagaccgatatcatcacgctgacccggttcattctgcaggaacagaacaaggtgggcgcgtcgtccgcaatccccaccggagacttcactctgctgctcaactcgctgcagtttgccttcaagttcattgcccacaacatccgacgatcgaccctggtcaacctgattggcctgtcgggaaccgcaaactccaccggcgacgaccagaagaagctggacgtgatcggagacgagatcttcatcaacgccatgaaggcctccggtaaggtcaagctggtggtgtccgaggagcaggaggacctcattgtgtttgagggcgacggccgatacgccgtggtctgcgaccccatcgacggatcctccaacctcgacgccggcgtctccgtcggcaccattttcggcgtctacaagctccccgagggctcctccggatccatcaaggacgtgctccgacccggaaaggagatggttgccgccggctacaccatgtacggtgcctccgccaacctggtgctgtccaccggaaacggctgcaacggcttcactctcgatgaccctctgggagagttcatcctgacccaccccgatctcaagctccccgatctgcgatccatctactccgtcaacgagggtaactcctccctgtggtccgacaacgtcaagaactacttcaaggccctcaagttccccgaggacggctccaagccctactcggcccgatacattggctccatggtcgccgacgtgcaccgaaccattctctacggaggtatgtttgcctaccccgccgactccaagtccaagaagggcaagctccgacttttgtacgagggtttccccatggcctacatcattgagcaggccggcggtcttgccatcaacgacaacggcgagcgaatcctcgatctggtccccaccgagatccacgagcgatccggcgtctggctgggctccaagggcgagattgagaaggccaagaagtaccctctgaaatga

SEQ ID NO: 40104 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 40105 - DNA, 942 bp, Rhizobium sp
  CDS (1)..(942)
atgacggatatccgcgagtggacgtccacggtcggactggaaaacgaacttggggaagtcctttcggggctggcgaacgcgtgcgcgaccatagcccgaacgttgcgtacagccccgctggcccagctctccgggtcggcgggcagcctgaatgttcaaggggaggcgcagaagcctctggacatcatttcgaatgaggtcttcgtcaacgcctgtcgggaactcgcacagatttccctggcagtttccgaagaggaggaagacccgattccgatctccgcgaccggcagttacgcggtcgtgttcgatccgctcgacggatcgtccaatcttgacgtcaatgtcaccgtgggttccatcttctcggtggtctcggccacaacgccgaagcacattttgccgggagggcggccgcaacacatcgccggctttgcatcctatgggccgtccaccgatctgacggtcctggcaaagggacgagtggcgcgcttcaccctggatgcgagcgatacttggcggctcgtggaactggacatgcgtctacctgatcgcttccccgaaatcgccatcaatgccgcgcgtgctgatagctgggacgatgtcatccgcggcttcgtgaacgacgccttccacgggaacgagataaggtacaatgcgaggtgggttgcgtcgctcgttgctgagacgcaacgcattctcagcagaggcgggctgtttctgtatccggcggattcatcgggtaggggacgccttcggcttctctacgaggctcgcccgatcgccgcaattgtcgaggcggccggaggaaggtgctccacggggttcatgccaatcctcgaggtgaacgctgagacactccacgatcgcgtccccctgatctttggtggagcgtcgcaggttgaagcgctcgaggcggcatatcgggcagacaaggaaaactga

SEQ ID NO: 40106 - protein, 313 aa, Rhizobium sp
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 40107 - DNA, 1002 bp, Phytophthora infestans
  CDS (1)..(1002)
atggccaaccaagtggaccactcgaaccccatcacgctctcgcgcttcattttggccgagaaggagatccagggcaatgctgacctgagcgtgctcttcacgtctatcgagctggcctgtaaggtcatcgccagctcggtgcgtcgtgctggtctcacgggcctctacggccttgacggctcggagaactcgaccggagatcaggtgaagaagctggacgtgttggccaacgacattttcatcaactcgcttaagttctcgaccaagatcgaggtcatggtctccgaggaggaggagaagcctatcgtcgtgcagaacgactccagtggcaccaagtactgcatcgccttcgacccgttggacggctcatccaacattgactgcaacgtgtccactggcacaatctttgctatttaccagcgcgacgcctcgtccgaaggaggctacaaggacattctgcagcctggcagcaagctggtgtcggccggttactgcatgtacggtagctctacgcagctggtgctgacgtggggcaagggcgtgcactgcttcacgctggatccgacgattggagccttcatgctctcccatcaggacatccgcattccggacgagcccaaggccatttattcgtgcaatgagggcaactatgcccaatgggacagtgccaccaaggcctttgtggacgaatgcaagaccggatccaaggcgtacgcggctcgttatgtcggtagtatggtgtccgatatccaccgaaccatcctgtacggaggcatctacctgtacccgggcagcacgaaggccaaggacggcaaactgcgtcttctgtacgagtgcaaccccatgtctttcatcgtggagcaggctggcggcatggcgaccactggcacggagcggatcctcgacctcgtccccacggacatccaccagcgctcgccaatcttcctgggttgcaagcgcgacgtcgagcgcgtcattgcgctgtacaaggagcacaactaa

SEQ ID NO: 40108 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 40109 - DNA, 1146 bp, Toxoplasma gondii
  CDS (1)..(1146)
atgcgtcaatgctttattgatgaggattttcgactgtcgttacggtttctagccactacttctaccgtgttttttcgacgtcattgtcacaccatggcagcgagtggacacccgatcccggaactcggagagttcatcattgcaaacaaggagaagcttcgcaatactggacaggagtcagagatgaacaggctcttgactgcgattaagctcgcagcaaaagtcgtgaatcgagagatcaacaaggcgggtcttgccgatatcttgggtgcagccgggaaccagaacgtgcagggcgaggaacagcagaagctggacgttttcgccaaccacaagttcatccaggctctcgtcaaccgcgaagtcgtgtgcggtatttgcaccgaggaagatgatgactttatcgaggtcaacagggatgcacacttcgtgatgctgatggaccctcttgatggctcctcaaacatcgacgtcaatgtctccgtgggaaccatcttctccatctaccagcgcgtgtcacctctgggctctcctcccgagctgcgcgatttcttgcagccgggaaatgcacaaattgccgccggttatgtcctctacggatcctctacgatgctggttatgacgacaggtgacggcgtgaacggattcacattggatccttctctcggcacatttttcctttcccacagaggcatgagattcccggagaaagcgcgtatctacagtgtgaacgaaggcaactacaaggcgttcccggacggtgtaaagaagttcctcgaggaatgccatgacgacaagactggaccgttctcactgcgttacatcggcagtctggtctcagatttccaccggaacctgctgcagggaggaatatacatgtacccaccaaccaagaaagataagaagggcaaattgcgactgttgtacgaggcaaaccctatggcgttccttgctgaacaggcgggggggaaggcgacagacgggtttgatcgcatcatggatatccaaccatcagagctacatcaacgcgttcctctaatgatcgggactgcgagactggtagaccgtgtcgatgcactcatggtcgagcacagtccggagtgccgactgcatgcaaactgcctcgttggcaagaacagttcatag

SEQ ID NO: 40110 - protein, 381 aa, Toxoplasma gondii
MRQCFIDEDFRLSLRFLATTSTVFFRRHCHTMAASGHPIPELGEFIIANKEKLRNTGQESEMNRLLTAIKLAAKVVNREINKAGLADILGAAGNQNVQGEEQQKLDVFANHKFIQALVNREVVCGICTEEDDDFIEVNRDAHFVMLMDPLDGSSNIDVNVSVGTIFSIYQRVSPLGSPPELRDFLQPGNAQIAAGYVLYGSSTMLVMTTGDGVNGFTLDPSLGTFFLSHRGMRFPEKARIYSVNEGNYKAFPDGVKKFLEECHDDKTGPFSLRYIGSLVSDFHRNLLQGGIYMYPPTKKDKKGKLRLLYEANPMAFLAEQAGGKATDGFDRIMDIQPSELHQRVPLMIGTARLVDRVDALMVEHSPECRLHANCLVGKNSS

SEQ ID NO: 40111 - DNA, 1026 bp, Pisum sativum
  CDS (1)..(1026)
atggatcatgctggggatgcaatgcgtacggacttgatgaccataacacggtatgtgttgaatgagcagtccaaacgccccgagtctcgtggtgatttcacaattcttctcagtcacattgttcttggctgcaaatttgtttgctctgctgttaacaaggctggtcttgccaagctcataggacttgcaggggagactaacattcagggtgaagagcaaaagaagctagatgtgctctcaaatgaagtttttgttaaggctttgacaagtagtggccgaacttgcatccttgtgtctgaagaggacgaggaggcaacattcattgagccatctctgcgtggaaagtattgtgttgtatttgaccctctggatggatctttcaacattgactgtggtgtttcaattggcacgatatttgggatttacatggtcaaagattttgaaactgcgactcttgaagatgtcctgcaacctggaaagaatatggtagctgctggttattgcatgtatgggagctcttgcacgcttgttttgagcactggaagcggtgttaatgggtttactctagatccatctcttggagaatatattttaactcatccagacatcaagattccaaacaagggtaagatctattcagtgaatgaaggcaatgcaaagaattgggatggcccaacaacaaagtatgtggaaaaatgtaagttcccgacagatggttcatcacccaagtctctcagatacattgaaagtatggtagctaatgttcatcgcactttactatatggtggcatctttttgtaccctggtgataagaagagccccaacggaaaactaagagttctctacgaggtctttccaatgtccttcttaatggaacaagctggcggacaagcttttaccggcaaacaacgggcacttgacttgatcccgacaaaaatacatgaacgctcaccagtattcctcggcagctatgatgatgttgaagacatcaaagccctctatgctgctcaagagaagacggcctga

SEQ ID NO: 40112 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 40113 - DNA, 1020 bp, Mus musculus
  CDS (1)..(1020)
atgacggacagaagcccctttgagacagacatgctgaccctgacccgttacgttatggaaaaggggcgacaggccaaagggaccggagaactcacccagctgctcaactcgatgctgactgccatcaaagccatctcttccgcagtgcgcaaggccggcctggccaacctgtatgggatttcggggagcgtgaatgtgacaggagatgaggtgaagaaactggacgtgctgtccaactccctggtcatcaacatgcttcagtcctcctacagcacctgtgtgctcgtctccgaagagaataaagaggcggtgatcacagcccaggagaggagggggaaatatgtggtttgctttgaccctctggatggatcttcaaacattgactgcctggcctccatcggaactatatttgctatttacagaaagaccacggaggatgagccttctgagaaggatgccttgcagcctggccgcaacatcgtggctgcgggttatgcactgtatggtagtgcaaccctggtcgctctttccacaggacaaggagtagatctcttcatgctggacccggctcttggagaattcgtgctagtggaaaaagatgtccggattaagaagaaagggaaaatttttagcctcaacgagggctatgccaagtattttgatgctgctactgctgagtatgtacagaaaaagaaattccccgaggatggcagtgcgccttatggagccaggtacgtgggttccatggtggctgatgtgcatcgcaccttggtctatggaggaatcttcatgtacccagccaaccagaagagtcctaatggcaagctccggctcctgtatgaatgcaatcctgtggcctatatcatcgagcaagcaggaggtatggcaaccacaggcacccagccagtactggatgtgaaacctgagagtattcaccagcgagtccccctcattctggggtcccctgaggatgtgcaagagtatctcagctgtgtgcagagaaaccaggcaggcaggtag

SEQ ID NO: 40114 - protein, 339 aa, Mus musculus
MTDRSPFETDMLTLTRYVMEKGRQAKGTGELTQLLNSMLTAIKAISSAVRKAGLANLYGISGSVNVTGDEVKKLDVLSNSLVINMLQSSYSTCVLVSEENKEAVITAQERRGKYVVCFDPLDGSSNIDCLASIGTIFAIYRKTTEDEPSEKDALQPGRNIVAAGYALYGSATLVALSTGQGVDLFMLDPALGEFVLVEKDVRIKKKGKIFSLNEGYAKYFDAATAEYVQKKKFPEDGSAPYGARYVGSMVADVHRTLVYGGIFMYPANQKSPNGKLRLLYECNPVAYIIEQAGGMATTGTQPVLDVKPESIHQRVPLILGSPEDVQEYLSCVQRNQAGR

SEQ ID NO: 40115 - DNA, 1053 bp, Trypanosoma brucei
  CDS (1)..(1053)
atgcctgactacagccgcgtcccctctacgttgatgcagttcttaatgcataaccaaccaaagggcagccgtggggcgttcacattactcatgatggcgattcaaacgtccgtaaaagtgattgagatgaacatccgcagcgcaggtgcgcaaggtctctttggtcatcttaatgatggacgggccaacgccacgggtgacgcgcaggcgaagttagacgtggttgcaaataacgccttcaaggcttatctgatgtcctctgccagcgtgtctttcatggggagtgaggaggacgagtcaattgtggtagtcagttccggacagcagggcgactacgttgtattctttgaccctctggacggcagcagtaatatcgacgcaaacatatctattggctcagtgtggggcatctggtgcctaccgaagggaacgaaagtgcgaactacaaaagacgctcttaaggtgctcccgcgcctctcaggaagatacctcgtttcctcaggttatgccatgtatggcaccgctaccaaccttgttattaccactggcagtggtgtaaacggctttacgcttgacacgactgttggtgagttcatccacacccatccaaacatcacacttccacaatcacgacccatttacagtgtgaacgaaggtaacctccgtcactgggacgcgtggttcaagcaatatttgcatcatatcaaaaacgaaggagaaaaggcgtacaccgctcgctatattggttctatggttgcggacatccaccggaccctgttatatggcgggatcttctgctacccgggggataagaagaaaccaggagggaagttacggctcatgtatgaggctgcacccatggcgttccttattgaacaagcaggtggcttggcgttgacgggcgacgggcggttgcttgatgtcgttccgaaggaaattcaccagcgtgctcccgtttttatgggtagcaggcgtgaagtggagctgtgtatgtctttcaaacaaaagtacaatgatcgtgggggagtccaaagggagaggagcaagctttaa

SEQ ID NO: 40116 - protein, 350 aa, Trypanosoma brucei
MPDYSRVPSTLMQFLMHNQPKGSRGAFTLLMMAIQTSVKVIEMNIRSAGAQGLFGHLNDGRANATGDAQAKLDVVANNAFKAYLMSSASVSFMGSEEDESIVVVSSGQQGDYVVFFDPLDGSSNIDANISIGSVWGIWCLPKGTKVRTTKDALKVLPRLSGRYLVSSGYAMYGTATNLVITTGSGVNGFTLDTTVGEFIHTHPNITLPQSRPIYSVNEGNLRHWDAWFKQYLHHIKNEGEKAYTARYIGSMVADIHRTLLYGGIFCYPGDKKKPGGKLRLMYEAAPMAFLIEQAGGLALTGDGRLLDVVPKEIHQRAPVFMGSRREVELCMSFKQKYNDRGGVQRERSKL

SEQ ID NO: 40117 - DNA, 1023 bp, Hansenula anomala
  CDS (1)..(1023)
atgtctcacaaagcttcagacgaacaccacgttgatactgatttgatcactttatcaagatttatcttgacttcacaacaaaaagtggctgctcaagctactggtgaattaactctattgttaaactctttacaatttgcattcaaattcattgctaataacatccgtaaagctgaattggttaaccttatgggtttagctggtgcttcaaactctactggtgatgctcaaaaaaaattagatgtcattggtgatgaaatcttcataaatgccatgaaagctagtggtaacgttaaagttttagtttctgaagaacaagaagatttgatcgtctttgatggtccaggtaattatgctgtcgtttgtgatccaattgatggttcttcaaatatagatgctggtgtttctgttggtacaatttttggtatttacaaattactcccgggatcaaaaggttctataaaagatgtcttgagaccaggtactgaaatggttgcagctgggtatactatgtatggtgcatctgctcatttgatgttgactaccggtcaaggtgttaatggtttcactttagatgcttcattaggtgaattcattttgacacatccaaatttgacaatcagtgatgaaaaacacattttctctgtcaacgaaggtaacaccacttactggacaccagaagttcaacaattcattgcagatttgaagaaacctcaattcaatggtaaaccatacagtgcaagatatattgggtcaatggttgctgatgttcatagaactttactatatggtggtttattcgcatatccagctgacgccaaatcaaaggctggtaaattaagaatcttgtatgaatgtttcccaatggctttcttgtttgaacaagctggtggtaaagctgttactgataacggtgaccgtattttggaattgaaaccaaaagctatccatgacagatcaggtatttggttgggtagtaaggttgaaatcgatagatttttaaaagccactggtaaaatttag

SEQ ID NO: 40118 - protein, 340 aa, Hansenula anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 40119 - DNA, 1026 bp, Beta vulgaris subsp
  CDS (1)..(1026)
atggatcatgcagcggatgcaactcgtacagacttgatgaccataacacgtttcgtattgaatgaacagtcgaaacgtcctgagtctcgtggtgacttcaccattcttatgagtcacattgttcttggctgcaaatttgtctgctctgctgttaataaggctggtcttgccaagctcataggacttgcaggggagacaaatattcagggtgaagagcaaaagaagttggatgttctttcaaatgaagttttcattaaggccttgataagtagtggcagaacttgcattcttgtgtctgaggaggatgaggaggcaacattcgttgagccatctctacgtggaaagtattgtgttgtttttgaccctttggatggatgttccaacattgactgtggtgtatcgattggcactatctttgggatttacatggtgaaagatcttaataatgcaactcttgatgatgtcctccaacctggaaaaaatatggtagctgctggttattgcatgtatgggagctcttgcacgcttgtcatgagcactggaagcggtgtcaatggtttcactcatgacccatctcttggagagtttattttaactcatccggacatcaagatcccaaagaagggtaagatctattctgtgaatgaaggcaatgcaaagaactgggatggcccaacaacaaagtacgtggagaaatgtaagttccctaaggatggttcatcaccaaaatctctcagatacatcggaagtatggtagcggatgttcatcgcactctactttatggtggcatctttatgtaccctggtgataagaagagccctaacggaaaactacgagttctttatgaggtctttcccatgtcattcttaatggagcaagcaggtggacaagcttttactggcgaacaacgggcacttgacttggtcccaaagaacatacatgatcgttcaccagtattccttggcagctatgacgacgttgaagacatcaaagcactctatgctgctgaacagaagaatgcttga

SEQ ID NO: 40120 - protein, 341 aa, Beta vulgaris subsp
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 40121 - DNA, 1068 bp, Aspergillus oryzae
  CDS (1)..(1068)
atgtctggacacgagaacaacggtgctccccccgtgggaaaggagaagatcaacaccgacatcgtcaccctcacaaggtttctgacagaagaacaaaccaaggtgccagaagccactggtgacttcacactcctctgccacgctcttcagttctccttcaagtccatcgcctactatatccgttgcgcattcttaatcaacctgacaggactggcgggttcctcaaacaccacaggcgatgaccagaagaagctcgacgtaatcggcaatgatatcttcatctccgccatgcgcggctcaggtaaatgccgtatcctcgtctcggaagaagaagaagaagccatcatcttcgacgagcacccctacgcccgctacgcagtcgtctgcgaccccatcgacggatcctccaacctggacgctggcgtctcggtaggaaccatcttcggcatcttcaagctgcccgactccgtcctgggtcccgagaacaaggtctcccccaaggatctcctcctccccggtactgagatggtcgcctccggtttcaccatgtacggtgcctccgcccaactcgtcatcaccatgcgcaatggcggcgtcaacggcttcaccctggagaactccctgggtgaattcatcctcactcaccccaacatgaccctccccgccaagcgcgccatctactccgtcaacgagggtaacagcagctactgggaggagtggaccaacgcttacttccactcgctgaagttcccccccgagggccagaagccttacagtgctcgctacattggtagcatggtggctgatgcttaccggacactgctctacggtggtgtcttcgcttacccggccgacaagaaggcccccaagggtaagctgcgtattttgtacgaatgcgcgcccatggctatgctgtttgaaaacgccggtggtctcgctgtgaactcccgcatggagcgccttctgggcgttgtcccggagcacattcacgacaagagtggtgtgttcctcggctcgaaggatgaagtacagaagatcatcgacacatataacaagtacaagaaataa

SEQ ID NO: 40122 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 40123 - DNA, 1023 bp, Zaocys dhumnades
  CDS (1)..(1023)
atgtcggatcaaagcccctttgaaacagatatgataaccctgaaccgatatgtcatggagaaaggacgacgggtgaaaggggcaacgggagaattgacccagcttttgaactcaacgctcactgccatcaaggccatctcatcagcagtccgaaaggcaggtcttgctcatatgtatggaattgcaggaagcgtgaatgtgactggggacgaacagaaaaaactggatgtgttgtccaattctctggttatcaacatgctccagtcctcctacagcacttgcgtcctggtctctgaagagaataaagaagcactaatcactccaaaagaaaaaaggggtaaatatgtggtgtgctttgatccactagatggctcttccaatatagactgtttagcctcaataggaacaatatttgcaatttacaagaagaccactgaagatgagccttctgaaaaggatgctttacaacctggacgcaacattgtggctgcaggctatgctctgtatggcagcgcaacgctggttgccctttcaacgggtcaaggagtggacagctttatgttggatccgggtcttggtgaattcattttggtggaaaaagatgtgaaaatcaagaagaaaggaaaaatctacagtcttaatgaaggttatgcaaagtattttgatcctgctgtgactgagtatttacacaagaagaaatttcctgaggaaggtaaatctccttatggagccagatatgtaggctccatggtggctgatgttcaccgtaccctggtgtatggtggcatatttttatatccagctaaccagaaaagtcccaaaggaaagctgcggctcttgtacgaatgcaaccccatcgcttttatcatcgaacaggccagtggaatagctaccacgggtacagaaccagtgctggatgtaaagccagagtctattcatcagagagtcccttttgttgctggttctcctgaggatgttcaagaatatcttgcatttgtacagaaacaccagaaaagcagctag

SEQ ID NO: 40124 - protein, 340 aa, Zaocys dhumnades
MSDQSPFETDMITLNRYVMEKGRRVKGATGELTQLLNSTLTAIKAISSAVRKAGLAHMYGIAGSVNVTGDEQKKLDVLSNSLVINMLQSSYSTCVLVSEENKEALITPKEKRGKYVVCFDPLDGSSNIDCLASIGTIFAIYKKTTEDEPSEKDALQPGRNIVAAGYALYGSATLVALSTGQGVDSFMLDPGLGEFILVEKDVKIKKKGKIYSLNEGYAKYFDPAVTEYLHKKKFPEEGKSPYGARYVGSMVADVHRTLVYGGIFLYPANQKSPKGKLRLLYECNPIAFIIEQASGIATTGTEPVLDVKPESIHQRVPFVAGSPEDVQEYLAFVQKHQKSS

SEQ ID NO: 40125 - DNA, 1080 bp, Pseudomonas hydrogenothermophila
  CDS (1)..(1080)
atgtcttgggcccacacgccaacgctcacgcaatacctgatcgaggagcggcgccgctacccacaagcaagcggcgacttcaacgcgttgattctcgacatggcgcgcgcctgcaaagcgatcgcgcggcaagtggcctacggggcgctcgccaagtccaaccatgccgtgaccaccaccatcaacgtgcagggcgaagaacaaaaaccgctcgacgtgatcagcaacgaatgcttcatgcgtctcaccgagtggggggggtacctcgccgcgatggcctcggaagagatggacgaaccctacctcattccggaacaatatccgcgcgggcgctatctcctcctcttcgatccgctcgacggttcgtccaacatcgacgtcaacgtctcggtgggatcgatcttctcggtcctgcgcgccccagaaggcaaaacggagatcaccgtcgacgacttcctgcaacccggcacacaacaggtggcggccgggtacgcgatctacggcccgacgacgatgctcgttctcaccgtcgggcggggggtcgtcggcttcacgctcgaccccgatttcggcgaattcatgcttacccacccgaacattcggattcccgaaagcaccaaggagttcgcgatcaacacctccaacgcccgcttctgggaaccaccggtgaagcgctacgtcgatgagtgcctcaaagggaaaaccggcccccgcggcaaagacttcaacatgcgctgggtcgcgtcgcttgttgcggaaacgcaccggatcctctcccggggtggggtctttctctacccgcgcgacaacaaggaacccaagaaaccggggcggctgcggcttctctacgaatgcaacccgatcgggatgatcgtcgaacaggctggcggacgcgcctcgaccggttacggtccggtgctcgaagtgcagcccaccgaactccatcagcgcatcggtttcgtcttcggttcccgcgaagaggtcgaacggatcgaacagtaccacaacgacccggacgcgagcccggtcgatctgccgctctttgccgaacgaaccctctttcgcgacgaaaccctctaa

SEQ ID NO: 40126 - protein, 359 aa, Pseudomonas hydrogenothermophila
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 40127 - DNA, 1020 bp, Oryctolagus cuniculus
  CDS (1)..(1020)
atgacggacagaagccccttcgagaccgacatgctcaccctgacccgctacgtcatggagaaggggcggcaggccaaaggcaccggagagctcacccagcttctgaactccatgctgacggccatcaaagccatctcctcggccgtgcgcaaggccggcctggcccacctgtatggaatcgcgggcaccgtgaacgtgacgggagacgaggtgaagaagctggatgtgttgtccaatgccctggtgatcaacatgctgcagtcctcctacagcacctgcgtgctggtctcggaggagaacaaagaggccatcatcaccgccaaggagagacgggggaaatacgtggtctgctttgacccgctggatggatcttccaacattgactgcctggcctccattgggaccatatttgccatctacaggaagaccacagaggacgagccttccgacaaagacgccctgcagcctggccgcaatatcgtggccgcaggctacgcgctctacggcagcgcgaccttggtggctctttccacgggacagggagtggacctcttcatgctggacccagctcttggtgagtttgtcctggtggagaaagatgttaagattaagaagaaggggaagattttcagcctcaacgagggctatgccaagtatttcgacgcagccaccacggagtatgtgcagaagaagaaattccccgaggacggcagtgcgccctatggggccaggtacgtgggctccatggtggctgatgtgcaccgcaccctggtctatggagggatcttcctgtacccagccaaccagaaaagtcctaaaggcaagctccggctcctgtatgagtgcaatcccgtggcctacatcatcgagcaggcaggaggcctcgccaccactggcacgcagccagtcctggatgtgaagcccgagtccattcaccaacgagtccccctcatcctgggctccccagacgatgtacaggagtatctcgcctgtgtacagaagaaccaggcaggcaggtag

SEQ ID NO: 40128 - protein, 339 aa, Oryctolagus cuniculus
MTDRSPFETDMLTLTRYVMEKGRQAKGTGELTQLLNSMLTAIKAISSAVRKAGLAHLYGIAGTVNVTGDEVKKLDVLSNALVINMLQSSYSTCVLVSEENKEAIITAKERRGKYVVCFDPLDGSSNIDCLASIGTIFAIYRKTTEDEPSDKDALQPGRNIVAAGYALYGSATLVALSTGQGVDLFMLDPALGEFVLVEKDVKIKKKGKIFSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPESIHQRVPLILGSPDDVQEYLACVQKNQAGR

SEQ ID NO: 40129 - DNA, 963 bp, Candida albicans
  CDS (1)..(963)
atgagtggcccagttaattccgtttccaagcaaatgaatgtcgataccgacatcatcacgttgacccgttttattttacaagaacagcaaactgttgctcccaccgccaccggtgagttgtcgttgttgttgaatgcgcttcaatttgcattcaagtttattgcccacaatatcagaagagctgagttggtcaaccttattggtgtttctggctctgccaactctaccggtgatgttcagaagaaattggatgtgattggtgatgagatctttatcaatgccatgagatcttccaacaacgtcaaggttttggtttctgaagagcaagaagaccttattgtgttcccaggtggtggcacatatgctgtttgtactgatccaattgatgggtcgtccaatatcgatgctggtgtttctgttggtacgatttttggtgtgtacaagttgcaagaggggtctactggtggcatcagcgatgtcttgcgtcctggtaaggagatggtcgctgcggggtacaccatgtacggtgcatctgcccatttggcattgactacaggtcacggtgtcaatctttttactttggatactcagttgggtgaatttatcttgacccatccaaacttgaagttgccagatactaagaacatctactcgttgaatgaagggtactcgaacaaattcccagaatacgttcaagattatttgaaggacattaaaaaggaagggtacagtttgagatacattgggctgatggttgctgatgtccatcgtactcttttgtatggtggtatttttgcttaccctacattgaagttgagagtgttgtatgaatgtttccccatggccttgttgatggaacaagcaggcggttctgctgtcaccatcaagggtgagaggatcttggatatcttgccaaaaggtatacacgacaaggagttctattgtgttgggatccaagggtga

SEQ ID NO: 40130 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 40131 - DNA, 1035 bp, Porteresia coarctata
  CDS (1)..(1035)
atggatcacgaggcggacgcgtaccggacggacctgatgacgatcacgcggtacgtgctgaacgagcagagccgcaacccggaggcccgcggcgacctcaccatcctcctctcccacatcgtgctcggctgcaagttcgtcgcctccgccgtcaacaaggccgggctcgccaagctcatcggcttggccggcgagaccaacgttcagggagaggagcagaagaagctggacgtgctgtccaacgaggtgttcgtaaaggctctcgtcagcagcggccgcacctgcgttctcgtgtccgaggaggacgaggaagcaacgtttgtggaccctgcgctgcgtggaaagtattgcgtctgctttgatccactcgacggctcctccaacatcgactgtggcgtctccatcggaacgatctttgggatctatatgatcaaagataaggataatgtgactcttgaggacgtgttacagcccggaaaaaatatggttgctgctggatactgcatgtacggcagttcctgcacgcttgtgctgagtactggaaatggtgtcaatggattcacactcgatccatctcttggggagttcatattaactcatccagacatcaagatacctaagaaagggaagatttattcagtgaatgaagggaatgcgaaaaattgggacgagcctaccgcgaagtttgtggagaagtgcaagttccctaaggatggttcatcacctaaatccttgagatacattggaagtatggttgctgatgtccaccgtacgttgctatatggaggcgtatttttgtaccctgcagacaagaagagcccgaatggaaaactccgtgttctgtatgaagttttccccatgtcattcctgatggagcaggctggaggccagtctttcacaggcaaagaacgggctcttgacctcgttcctaccaagattcatgagagatccccaatatttctcggaagcttcgaagatgtggaggagatcaaagggttgtacgctgcacaggcgaagctcgagcacaatcactag

SEQ ID NO: 40132 - protein, 344 aa, Porteresia coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 40133 - DNA, 1074 bp, Pisum sativum
  CDS (1)..(1074)
atggctgtgaaggaagcaactagtgagacaaagaaaagaagtggatatgagattataacactgactagttggttgttgcagcaagaacaaaaacccattattgatgcagaacttactattgtactttctagtatttctatggcatgtaaacaaattgcttctttggttcaaagagccaatatttctaacctcactggtactcaaggtgctgtaaatattcaaggggaagaccagaaaaaacttgatgttatctcaaatgaggtattctcaaattgcttgaggtcaagtgggaggacagggataatagcgtcagaggaagaggatgtgccagtggcagtagaagagagttattcaggaaactacattgttgtatttgatccacttgatggttcatccaatcttgatgctgcagtctcaactggttccattttcgggatttacagccccaatgacgagtgtcttcctgattttggtgatgactctgatgacaacacacttggcacagaagaacaaaggtgcattgtgaatgtgtgtcaaccaggaagcaaccttctagcagctggctactgcatgtattctagttcagtaatttttgttcttaccataggcaaaggagtgtttgtattcacattagatccattgtacggagaattcgttttgactcaagagaatctccaaataccgaaatcagggaaaatctattctttcaatgaagggaattacaagttgtgggatgaaaacttgaagaaatatattgatgatcttaaggaaccaggtcctagtggcaagccttattcagcaaggtatattggtagtttggttggtgattttcacaggacactgttatatggtggcatttatggataccctagggacaagaaaagtaagaatgggaagcttaggcttttatatgaatgtgctccaatgagcttcattgttgaacaggctggtggaaaaggttcagatggtcatcaaagagtacttgacattcaacccacagaaattcatcaacgtgttccactttacattgggagcacagaagaggtggagaaggttgaaaagtacttagcttaa

SEQ ID NO: 40134 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 40135 - DNA, 996 bp, Candida albicans
  CDS (1)..(996)
atgagtggcccagttaattccgtttccaagcaaatgaatgtcgataccgacatcatcacgttgacccgttttattttacaagaacagcaaactgttgctcccaccgccaccggtgagttgtcgttgttgttgaatgcgcttcaatttgcattcaagtttattgcccacaatatcagaagagctgagttggtcaaccttattggtgtttctggctctgccaactctaccggtgatgttcagaagaaattggatgtgattggtgatgagatctttatcaatgccatgagatcttccaacaacgtcaaggttttggtttctgaagagcaagaagaccttattgtgttcccaggtggtggcacatatgctgtttgtactgatccaattgatgggtcgtccaatatcgatgctggtgtttctgttggtacgatttttggtgtgtacaagttgcaagaggggtctactggtggcatcagcgatgtcttgcgtcctggtaaggagatggtcgctgcggggtacaccatgtacggtgcatctgcccatttggcattgactacaggtcacggtgtcaatctttttactttggatactcagttgggtgaatttatcttgacccatccaaacttgaagttgccagatactaagaacatctactcgttgaatgaagggtactcgaacaaattcccagaatacgttcaagattatttgaaggacattaaaaaggaagggtacagtttgagatacattgggctgatggttgctgatgtccatcgtactcttttgtatggtggtatttttgcttaccctacattgaagttgagagtgttgtatgaatgtttccccatggccttgttgatggaacaagcaggcggttctgctgtcaccatcaagggtgagaggatcttggatatcttgccaaaaggtatacacgacaagagttctattgtgttgggatccaagggtgaagttgaaaagtatttaaagcatgtaccaaaatag

SEQ ID NO: 40136 - protein, 331 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 40137 - DNA, 1026 bp, Musa acuminata
  CDS (1)..(1026)
atggatcacgaggcggaggcgcatcggacggacctgatgacgatcacgaggtacgtgctgaacgagcagtcgaggcaccaggaatcacgcggcgacttcaccatcctgctttcccacatcgtcctcggctgcaagttcgtctgttccgccgtcaacaaggctgggctggctaagctcataggacttgctggagagacgaatgttcagggagggagcaaaaggaagcttgatgtgctttcgaatgaagtctttgtcaaagctttgataagcagtggccggacttgcatcctggtgtcggaggaggatgaagaggcaacttttgtggatccatcgctacgtggaaaatattgtgttgtctttgatcctctagatggttcttcgaacattgattgtggtgtctctattggaacgatatttggcgtttacatggttaaagataaggacaatgtaaccctagacgaggtactgcaaccagggaagaatatgctagcagctggctattgcatgtatggaagttcttgcacgcttgtactgagcaccgggagtggtgtcaatggtttcactctagatccatctcttggggaattcatactgacccatccagatattaagataccgaagaagggcaaaatatattcagtgaatgaaggaaatgccaagaattgggatgggcctacaacaaagtatgtggagaaatgcaagttccccaaggatggagactcaccaaaatctctgagatatattggaagcatggttgccgatgtacatcgtacactgctttatggaggcatctttttataccctgcggataagaagagtccaaatgggaaactacgtgttctatatgaagtatttccaatgtcattcctgatggaacaagcagggggtcaagcttttactggcaagcaacgggctctcgatttggttcccacgaagatacatcagaggtcgcccatctttcttggcagctatgatgaggtcgaggaaatcaaagcactgtatgctgctgaggagaacactgcttaa

SEQ ID NO: 40138 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 40139 - DNA, 1227 bp, Solanum tuberosum
  CDS (1)..(1227)
atggcagcatcagcagccacagcaacagcaacaacttcatatttaagtgctctagacaaaaagactccatttttatttgccttagacaaaaagactccatttttatgcccaaaaagcagcacgaagagaaggtcatttaatggaggagtaaagtgcatggcaatagagacaacttcaggttttacagcaaccaagaaaaggagtggctatgagctgcaaactttaacaagttggctattaagacaagaacaagctggagtgattgatgctgaacttaccatagttatttcaagtatttcaatggcttgtaaacagattgcttccttagtccaaagagctggaatttctaaccttactggagttcaaggtgctgtcaatattcaaggagaagatcagaagaaacttgatgttgtctctaatgaggttttctcaaattgtctaagatcaagtggaaggactgggattatagcatcagaagaagaggatgtacctgtggcagtggaagagagttactcaggcaactacattgtggtgtttgatcctcttgatggatcatcaaacattgatgctgctgtgtctaccggttctatctttggaatatacaacccgaatgatgagtgcctcgctgatcatggagatgattccacgcttgacaatatagagcagaagtgcattgtgaatgtatgtcaaccagggacaaaccttcttgcagcaggatactgcatgtactcaagctctgtgatattcgtactcaccttgggaaatggcgttttttcctttaacttggatccgatgtacggagaatttgttctgactcaagaaaatgtccaaataccaaagtctggaaagatctattcattcaatgaaggaaactaccagctctgggatgacaagttgaagaaatatatcgatgacttgaaggaccctggccctagtggcaagccttactctgcaaggtacattggtagtttggttggtgacttccatagaactcttctatatggtggcatttatggttatcctagagaccaaaagagcaagaatggaaagttgaggcttttgtacgagtgtgctcccatgagcttcattgtggaacaagctggtggtaaaggatccgatggtcaccaaagagttctcgatatccaaccaactgaggtacatcaacgagttccattgtacattggaagcacagaagaagttgaaaaattggagaagtacttgtcttaa

SEQ ID NO: 40140 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 40141 - DNA, 990 bp, Pisum sativum
  CDS (1)..(990)
atgaccataacacggttcgtattgaatgaacaatcaaagcgccctgaatcacgcggcgatttcaccatcttgctcagtcacattgttctgggatgtaaattcgtttgttctgctgttaacaaggctggtcttgctaagctcattggacttgctggagagacaaatatacagggtgaagaacagaagaagctggatgttctttccaatgatgtattcatcaaggctttgataagcagtggcagaacatgtattcttgtttctgaagaagatgaggaggcaacatttgtggaaccctcgctgcgtggaaagtattgtgttgtttttgatccattggatggctcctctaacattgattgtggtgtttccattggaactatttttgggatttatatggtgaaagataaccatgcaccaaccctcgatgatgtcctgcaacctggcaagaacatgttggcagctggttattgtatgtatggaagctcttgcacgcttgtgctaagcaccggaagtggtgttaatggtttcacccttgacccttctctcggtgaattcatcttaactcaccctgacattaagatcccaaagaagggaaagatttattcagtgaatgaagggaatgccaagaactgggatggccctactaccaagtatgtggagaaatgcaagtttcccacagatggttcatcaccaaagtctctaagatatattggaagcatggtagctgatgttcatcgcacattgctttatggaggtatctttttgtaccctgctgacaaaaagagtccaaatggaaaacttcgtgtattgtatgaagtcttcccaatgtccttcttgatggaacaggccggaggacagtctttcaccggcaagcaaagggcacttgatttaataccaaccaagattcatgaacgttctcccatatttcttggtagctatgacgatgtcgaagaaatcaaagcactctatgctgctgaacagaagaatgcttag

SEQ ID NO: 40142 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 40143 - DNA, 1254 bp, Brassica napus
  CDS (1)..(1254)
atggcagcaaccgccgcgacaacgtcatcgtctcatcttcttctctcaagctctcgccacgtggcagcctcatctcagccacaaatccttttccagagatctctgttttccggcgggaaacgatcggcagctggaaaaaaccatcatgctagtggtggagtgaggtgtatggcggttgcagcggatgcttcggcggaggctaagccggcggcagcgaggaagaagagtgggtacgagcttcagacgctgacgggttggttgctgagacaagagcagaaaggagagatagatacagagctgacgatagtgatgtcgagcatagcgatggcttgtaagcagatcgcttcgcttgtacagcgcgccggaatctctaatctgaccggcgttcaaggagccgttaacattcagggagaggatcagaaaaagctcgacgtcgtctctaatgaggtattttcaaactgtttgagatcaagtggaaggacagggatcattgcgtcagaggaagaggacgtccccgtagcagttgaagagagttactccggaaactacattgtcgtctttgatcctctcgacggttcctccaacatcgacgctgcagtctccactggttcaatcttcggtatctacagccccaatgacgagtgtatcgttgacgactccgacgatatctcctctcttggttcagaagaacaaaggtgtatagtaaacgtgtgtcaaccagggaacaacttgctcgcagctggctactgtatgtactcgagctcagtcatcttcgttctcaccttaggcaagggcgttttctccttcacactcgacccaatgtacggcgagttcgtcctcactcaagagaacattgagatccccaaagcagggaaaatctactctttcaacgaagggaactaccagatgtgggacgagaaactgaagaagtacattgatgatcttaaggaccctggtccaagtgggaagccttactctgcaaggtacattggtagtttggtcggagactttcacagaactttgttgtacggtgggatttacgggtaccctcgtgacgccaagagcaaaaacggtaagcttaggcttttgtatgagtgtgcaccgatgagtttcatcgttgaacaagctggaggaaaaggatcagatggccaccaaagagtactagatatccaacccaccgagatacatcagagggttccactttacattggaagcaaagaagaagtagagaagctggagaagtacttggcttga

SEQ ID NO: 40144 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 40145 - DNA, 1050 bp, Rhizobium meliloti
  CDS (1)..(1050)
atgtcaggcgcaactttagaggcataccttgcttcatgcacgacccatggcgacgagctctcacgggacgtcgccgccgtgatccagagactggcaaaggctgccctcgacattcgcaaactcgttaatcagggagcgctcggcaccgtcttcaatggaatgcatagcggcagcaacacggatggcgatgttcagaaggacctggacatcctgtgcgacgaccagttcctctcgtgtctgcaaggcgccccggtcgcatgctacgcctcggaagaactcgaaaatccagttctgctcgatccggctgcacgcctcgctgttgccatcgatccgctcgacggctcatcgaacatcgacaacaacatctccatcggaacgatattttccgtgcttcccgccgccaaggggccggacgttgacccctcccattccttcctgcaacccggaaaccggcaactggcggcgggcttcttcgtttacgggccgcaaaccgctcttgtgctttcgctcggtagaggcacggatattttcatcttctccagtcggctcggatgttttgtcgatgcgtacaaatcggtcggcattccggatcgcgcgaacgaattcgccattaacatgtccaactaccgccattgggaagaagcgatccggctctatgtcgacgactgcctggccggctccgaggggccgcgggagcgggacttcaacatgcgctggattgcctcgctcgtcgccgaagcctatcggatcctcgtccgcggcgggatcttcctctaccccgccgacagccgcaagggctacagccatggccggatacggctggtctacgaggccaacccgatcgccttcatcgtagagaatgcgggcggctcggccacgacatccgtcgaccgcatactcgatctcgttccagaaagcctgcaccagcgcgtgccgctggttttcggttcacgccgcgaggtggggcgcatcacccgttatcacgtcgatccgaacatgatcggggaacgcgctccgctcttcggcaagcgcggtttgttccgggcctga

SEQ ID NO: 40146 - protein, 349 aa, Rhizobium meliloti
MSGATLEAYLASCTTHGDELSRDVAAVIQRLAKAALDIRKLVNQGALGTVFNGMHSGSNTDGDVQKDLDILCDDQFLSCLQGAPVACYASEELENPVLLDPAARLAVAIDPLDGSSNIDNNISIGTIFSVLPAAKGPDVDPSHSFLQPGNRQLAAGFFVYGPQTALVLSLGRGTDIFIFSSRLGCFVDAYKSVGIPDRANEFAINMSNYRHWEEAIRLYVDDCLAGSEGPRERDFNMRWIASLVAEAYRILVRGGIFLYPADSRKGYSHGRIRLVYEANPIAFIVENAGGSATTSVDRILDLVPESLHQRVPLVFGSRREVGRITRYHVDPNMIGERAPLFGKRGLFRA

SEQ ID NO: 40147 - DNA, 1095 bp, Alcaligenes eutrophus
  CDS (1)..(1095)
atgcctgaagtccaaaggatgaccctgacgcagttcctgatcgaggaacgccgccgctatccggatgccagcggcggcttcaacggcctgattctcaacgtcgccatggcctgcaaggaaatcgcgcgcgcggttgccttcggcgcgctggggggcttgcacggcaaggccagcaatcaagccggagaagcaggggccgtcaacgtgcagggcgaaatccagcagaagctggacgtgctgagcaataccaccttcctgcgcgtcaacgagtggggcgggtacctggccggcatggcgtcggaggagatggaggcgccttaccagatcccggatcactacccgcgcggcaagtacctgctggtgttcgatccgctcgacggctcatccaacatcgacgtcaatgtctcggtgggcagcatcttctcggtgctgcgcgcgcctgagggcgcaagcgccgtcaccgagcaggatttcctgcagcccggcagcgcccaggtggcggccggctacgcgctctacggtcccaccaccatgctggtgctgaccgtgggcaatggcgtcaacggcttcacgctcgatcccaacctgggcgagttcttcctcacgcaccccaacctgcaggtgccggccgatacccaggaatttgccatcaatgcgtcgaacagccgcttctgggaagcgccggtgcagcgctacatcgccgagtgcatggccggcaagagcgggccgcgcggcaaggatttcaatatgcgctggatcgcgtcgatggtggccgaggcgcaccgcatcctgatgcgtggcggcgtcttcatgtacccgcgcgactccaaggatcccgccaagccgggccgcctgcgcctgctgtacgaggccaatccgatcgccttcctgatggagcaggctggcgggcgcgccagcacgggccggcagacgctgatgtcggtggcgccgggtgcgctgcaccagcgcattggcgtgatcttcggctcgcgcaatgaagtggaacggatcgagggctaccacaccgaccagaccgatcccgaccttccgagtcccctgttcaacgagcgcagcctgttccgcgcgtctgcctga

SEQ ID NO: 40148 - protein, 364 aa, Alcaligenes eutrophus
MPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 40149 - DNA, 1050 bp, Anabaena sp
  CDS (1)..(1050)
atggctaaagcctcagaatccttggatttgtctgtcaacgagtctacagataaagctctagaccgcgattgtacaaccttatcccgtcacgtcctccaacaactccaaagtttttccgcagatgcacaagatttgagtgcattaatgaatcggattgctttagcaggtaaattagttgcccgtcgccttagccgcgctggtttaatggaaggggttctcggatttactggggaggtaaatgtacaaggtgaatccgtcaaaaagatggatgtctatgccaatgacgtgtttatctcagtgtttaagcaaagcggcttagtttgtcgtcttgcatctgaggaaatggatgaaccatattacattcccgaaaattgccccataggtcgttacaccttactgtatgacccaatagacggttcctcaaacacagatacaaatctcagtttgggttccattttctctatccgtcaacaggaaggtgatgatagtgatggccaagctaaagacctcctcaccaacggacgcaagcagattgcggcgggttacattttatatgggcctagcacgatgctagtttatacaatgggtacgggagttcactcatttacccttgatcccagcttaggagaattcatcctcagcgaagaaaatatccgcattcccgaccacggcgcagtttacagcgttaatgaaggtaacttctggcaatgggaagaatcaatgcgggaatatatccgctatgttcaccgtacagaaggttacacagctcgttacagtggtgcaatggtgagcgatatccatagaattttggtacaaggtggtgtgtttctctacccagggacgattcaaaaccctgaaggtaaattacggttgttgtatgaatctgctcctttagcctttttaattcaacaagctggtggtcgggcaactacgggattagtagatatcttagatgttgtaccgaaaaaactacaccaacgtacacctctgattattggtagtaaagaggacgtagccaaggttgaatcatttattcagaatggtcattaa

SEQ ID NO: 40150 - protein, 349 aa, Anabaena sp
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 40151 - DNA, 1254 bp, Arabidopsis thaliana
  CDS (1)..(1254)
atggcagcaaccgccgcaacaacgacgtcgtctcaccttcttctctcaagctcacgtcacgtggcatcatcatcccagccttcaatcctttcaccgagatctctcttctccaacaacgggaaacgagcaccaactggagtgaggaaccatcagtatgcgagtggagtgaggtgtatggccgtagcggcggatgctgctgagacgaaaacggcggcgaggaagaagagtggatacgaacttcaaacgttgacgggctggttgctgagacaagagatgaaaggagagatagatgcagagctgacgatagtgatgtcgagtatatcattggcttgtaagcagatcgcttcacttgttcaacgtgccggaatctctaacctgaccggagttcaaggcgccgttaatattcagggagaggatcagaagaagcttgacgtcatctctaatgaggtgttttccaactgtttgagatcaagtggaagaacgggaatcatagcctcggaggaagaggacgtgccagttgcggtggaggagagttactccggcaactacgtcgtcgtgtttgaccctcttgatggttcctccaacattgacgctgccgtctctactggttctatcttcggtatctatagccccaatgacgaatgcattgtcgacgactccgacgatatctcagctcttgggtcagaagaacaaaggtgtatagtaaacgtgtgccagccagggaacaacttgttagcagccggctactgtatgtactcgagctcggtcatcttcgttcttactctaggcaaaggcgttttctccttcacgctcgatccaatgtacggtgagtttgtcctcacgcaagaaaacattgagatccccaaagccgggagaatctactctttcaacgaagggaattaccagatgtgggacgataaactaaagaagtacattgatgatcttaaggaccctggtccaactgggaagccttactccgcaaggtacattggaagtttggttggagattttcacaggactttattgtatggtgggatttacgggtaccctcgtgacgcaaagagcaaaaatggaaaacttaggctgttgtatgagtgtgcaccaatgagtttcattgttgaacaagctggagggaaaggttctgatggacattcgagagtactagatatccaaccgactgagatacatcagagggttcctctatacattggaagcacagaggaagtagagaagctggagaagtacttggcttga

SEQ ID NO: 40152 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 40153 - DNA, 1236 bp, Brassica napus
  CDS (1)..(1236)
atggcagcaaccgccggagcaacaccgtcgtctcatcttcttctctcaagctctcgccatgtggcggcctcacctcagccacgaatccttttcccatctctgagcgggaaacgagtagcagttgggaaaaaccatcatgctactggagtgaggtgtatggcggttgcggcggatgctacggcggagactaaaccggctgcaaagaaaaagagtgggtatgagcttcaaacactgacgagctggttgctgagacaggagatgaaaggggagatagatacagagctgacgatagtgatgtcgagcatagcgatggcttgtaagcagatcgcttcgttagttcagcgggctggaatctctaatctgacgggcgttcaaggagctgttaacattcagggagaggatcagaaaaagcttgacgtcgtctccaacgaggtgttttcgaactgtttgagatcaagtggaagaacgggaatcatagcgtcggaggaagaggatgtgccagtggcggtggaagaaagttactctggcaactatgtagtcgtgttcgaccctcttgacggttcctccaacattgacgcagccgtctccacgggttccatcttcggtatctacagccccaatgatgagtgtctccccgactccgacgatacctccgctcttgggtcagaagaagaaaggtgtatagtaaacgtatgccagccagggaataacttgctagcagctggctactgtatgtactcaagctcagtcatcttcgttcttactttaggcaaaggcgttttcgccttcaccctcgacccaatgtatggcgagttcgtcctcacgcaagagaacattgagattccgaaagccgggaaaatctactctttcaacgaagggaactaccagatgtgggatgagaatctaaagaagtacattgatgatctcaaggaccctggtccaagtgggaagccttactcagcaaggtacattggaagtttggtcggtgattttcataggactttgttgtacggtgggatttacgggtaccctcgtgacgccaagagcaaaaacggcaagcttaggcttttgtatgagtgtgcacctatgagtttcattgttgaacaagccggagggaaaggatcagatggacaccatagagtcctagatatccaaccgaccgagatacatcagagggttccactctacattggaagcaaagaagaagtggagaagctggagaagtacttggcttga

SEQ ID NO: 40154 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 40155 - DNA, 1035 bp, Nitrobacter vulgaris
  CDS (1)..(1035)
atgagccaagagctgacactgcagcaaaggatggatggcgaggcgggatcggatccgctccgccaggcagtgaaggaagcagtagctgcgcttgcgcgggctgcggtcgatatttccgatctgacctgccgcggagcgttggccgggatcaccgggcaggcacaaggtcgcaacaccgacggggacattcaaaaggatcttgatgttcgcgccgatcaaattattcgcgacgctctcggcaagctgccgatcgcagcgcttgcctccgaggaaatggcggatctggatattttgaatccggccgcgccgatctgcgttgcattcgatccgttggacggttcgtcgaacatcaacacgaacatgtcggtaggtacgattttttcaatcatgccgacgccttccgatgtcaatgcggccttcaggcaagcaggaagtgcgcagcttgcggccggtttcgttgtctatggtccgcagacctctctcgttctcacgctcgggcggggtgtcgacatcttcacgcttgaccgagccgacagggtgttcaagctcaccggatcgtcagtgcaaattccgacggacgcaaacgagttcgcgatcaatgcatcgaacaggcggcactgggacctgccggttcgcgcctatatcgatgagtgccttgcgggagccgatggcccctgcggcaagaatttcaacatgcgctggatcggttcgctcgtcgcggaggctttccgcattcttattcgcggcggtattttcctctatcccggagacgctcgggacggctatgaggaagggcgcctcgtggtttacgaggcgcacccgatggctttcatcgtcgagcaggcgggcggcggcgcttcgaccggacgaaagcgggttctcgatatcgtacccgacagccttcatcagcgagtgccgctgattatgggttcgatcaagaatgtccagcggctcgaacatatgcatacggtccccgacgtcgctctggaagcgaatgcgccgttgttcgggaaccgcggtctgtttcgcgtttga

SEQ ID NO: 40156 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 40157 - DNA, 1050 bp, Nostoc punctiforme
  CDS (1)..(1050)
atggctaaaacgccagaatccttagaatcgtctatcaatgaaattacagatagagctttagatcgtgattgtacaaccttatcgcgtcacgttctccagcaacttcagagtttttcgccagatgcacaagatttgagtgcgctgatgaatcgcatcgccttagcaggtaaactagttgcacgccgtatgagtcgcgctggtttaatggaaggcgttctcggttttaccggggaagttaatgtccaaggagaatccgtcaaaaagatggatgtctacgccaatgatgtgtttatctcagtgtttaagcaaagcggcttagtctgtcgcctcgcctctgaggaaatggaaaatccctactatatccccgaaaattgccccattggtcgctataccctgttgtatgacccaattgatggctcatccaacacagataataatctcagcttgggttctattttcgccattcgccaacaagaaggaactgatagcgatggtaaggcaaccgatctcctcgccaacggacggaagcaacttgctgccggatacatcctgtatgggccatgcacaatgctggtttatactataggtaaaggcgttcattcctttgtcctcgatcccagcttaggagaatttattctcacagaagagaatattcggattcctaaccacggttccgtttacagcgtgaatgagggtaacttctggcagtgggaagaatcgattcgagaatatatccgctacgttcatcgcacagaaggctacagcgctcgttatagcggtgcaatggtgagcgacatccatagaattttggttcaaggcggtgtgttcctctacccaggtacaattcaaaacccagaagggaaattgcgcttgctttatgaaactgctcctctcgcctttttgattgagcaagcaggcggccgtgctacgacaggattggtaaacatcttggatgtagtgccaaaaaaactacatcagcgcacacctttaattattggcagtaaagaagatgtcgcaaaggtagagtcttttattcaaaacggacactag

SEQ ID NO: 40158 - protein, 349 aa, Nostoc punctiforme
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 40159 - DNA, 1221 bp, Oryza sativa
  CDS (1)..(1221)
atggccgccgcagccacgacatcctcccacctgctcctgctctcccgccagcaggcggcggcctcgctccaatgcggcctctccttccggaggcagcccggcaggctcgccggtgggtcgtcggccccgagcgtgcggtgcatggcggccgtcgacacggcctcggcgcccgccgcgacggaggctagcaagaagagcagctacgagatcaccacgctgacgacgtggctgctgaagcaggagcaggccgggaccatcgacggcgagatgaccatcgtgctggccagcatctccacggcgtgcaagcagatcgcctcgctggtgcagcgcgcgcccatctccaacctcaccggcgtccagggcgccgtcaacgtgcagggcgaggaccagaaaaaactcgacgtcgtctccaacgaggtgttctccaactgcctcaaatcgagcgggcgcaccggcgtgatcgcgtcggaggaggaggacgtgccggtggccgtggaggagagctactcgggcaactacatcgtggtgttcgacccgctcgacggctcctccaacatcgacgccgccgtctccaccggctccatcttcggcatctacagccccaacgacgagtgcctagccgacatcgccgacgaccaaaatcttgaccaggtggagcagaggtgcatcgtgagcgtgtgccagccggggagcaacctgctcgccgccggctactgcatgtactcgagctcggtcatcttcgtgctcaccatcgggacaggggtgtacgtgttcacgctggacccgatgtacggcgagttcgtgctgacgcaggagaaggtgcagatccccaaggcaggcaagatctatgccttcaacgagggcaactacgcgctctgggacgacaagctcaagagctacatggacagcctcaaggagcccgggccgtccgggaagccatactccgcgcgctacatcggcagcctcgtcggcgacttccaccgcacgctgctctacggcggcatctacggctaccccagggaccagaagagcaagaacggcaagctgcggctgctgtacgagtgcgcgccgatgagcttcatcgtcgagcaggccggcggcaagggctccgatggccaccagaggatacttgacatcatgcctacggagatccatcagagagtgccgctgtacatcgggagcgtggaggaagtggagaaggtcgagaagttcttggcttga

SEQ ID NO: 40160 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 40161 - DNA, 1224 bp, Pisum sativum
  CDS (1)..(1224)
atggcagcagcaacagcctcatctcagttaatattctcaaaaccttactctccttcacgtctttgccccttccaactctgtgtctttgatgcaaaatcagtgttatcaagttcaaggagaaagcatgtgaatggctctggtgttagatgtatggctgtgaaggaagcaactagtgagacaaagaaaagaagtggatatgagattataacactgactagttggttgttgcagcaagaacaaaaagggattattgatgcagaacttactattgtactttctagtatttctatggcatgtaaacaaattgcttctttggttcaaagagccaatatttctaacctcactggtactcaaggtgctgtaaatattcaaggggaagaccagaaaaaacttgatgttatctcaaatgaggtattctcaaattgcttgaggtcaagtgggaggacagggataattgcgtcggaggaagaggatgtcgcggtggcagtagaagagagttattcaggaaactacattgttgtatttgatccacttgatggttcatccaatcttgatgctgcagtctcaaccggttccattttcgggatttacagccccaatgacgagtgtcttcctgattttggtgatgactctgatgacaacacacttggcacagaagaacaaaggtgcattgtgaatgtgtgtcaaccaggaagcaaccttctagcagctggctactgcatgtattctagttcagtagcttttgttcttaccataggcaaaggagtgtttgtattcacattagatccattgtacggagaattcgttttgactcaagagaatctccaaataccgaaatcaggggaaatctattctttcaatgaagggaattacaagttgtgggatgaaaacttgaagaaatatattgatgatcttaaggaaccaggtcctagtggcaagccttattcagcaaggtatattggtagtttggttggtgattttcacaggacactgttatatggtggcatttatggataccctagggacaagaaaagtaagaatgggaagcttaggcttttatatgaatgtgctccaatgagcttcattgttgaacaggctggtggaaaaggttcagatggtcatcaaagagtacttgacattcaacccacagaaattcatcaacgtgttccactttacattgggagcacagaagaggtggagaaggttgaaaagtacttagcttaa

SEQ ID NO: 40162 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 40163 - DNA, 1002 bp, Rhodobacter sphaeroides
  CDS (1)..(1002)
gtgaagccctttcccacccaccccgatgccataccggccgagttgcaggacgtgatggaccgtctgggctcggtcgcgatcgaagtcgcgaaccggatcgcccgcgggggtatcgacgaggatctcgccggtctctgcggaaccaacaccgacggggacgggcagaaggcgctcgacgtaatcgccgacgacgccttccgcgtggcactggaaggctcggcggtccgcttctacgcctccgaggagcaggacacggcggtgacgctgaacgaggccgggacgctggccctcgccatcgatccgctggacggctcgtccaacatcgacaccaacctctcggtcggcacgaccttcgccatctggcctgccgcgccacggccgaacccgagcttcctgcgcctgggctccgagctcatcgccgcgggctatgtcatctacggcccgcaagtctgcatgatggtgagcttcgggaaggggacgcagaaatatgtgctcgatcccggcagccgcagcttcgtgctggtcgaccgtgccgtgaaggtgccgcccagctcgaccgaattcgcgatcaacgcctcgaactaccgccactggccgaagccgatccgcgcctatatcgacgattgcgtggcgggtaccgaggggccgcggggacgcaacttcaacatgcgctggctggcctcgctggtggccgagacccaccgcatcctcgcgcggggcggcgtgttcctctatccgcgcgacagccgcaagggctacgagcagggtcgcctgcgctatctctacgaatgcgcgcccatcgccttcgtcatcacccaggcgggcggcggggccaccgacggcgagaatccgatcctcggacagacgccctcgcggcttcatgcccgcacgcccttcgtcttcgggtccgccgagaaggtggcccgcatcaccgcgtatcacgacctgcccgagcaggagacgtcggccctcttcggcaatcgcggcctgttccggagctga

SEQ ID NO: 40164 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 40165 - DNA, 1209 bp, Glycine max
  CDS (1)..(1209)
atggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggagcaagctggggtgattgatgcagaactcactattgtgctgtctagcatttccatggcatgcaaacagattgcttctttggtgcaaagagctaacatttccaacctcactggggttcaaggtgctgtcaatgttcaaggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagcgtcaactgggtccaatttttggatatacagccccaatgatgagtgtcttgctgacattgatgatgaccccacccttgacacaacagaacaaagatgtattgtgaacgtgtgccaacctggaagcaaccttcttgcagctggttactgcatgtattctagctcaataatctttgttctcacacttggaaatggagtgtttgtgtttacattggacccgatgtatggcgaattcgttttgactcaggaaaacctccagatacctagagcaggcaaaatctatgcattcaatgaaggtaattatcagttgtgggatgagaagctaaagaaatatattgatgatctcaaggacccaggtcaaagcggcaagccttattctgcaaggtacattggtagcttggtaggagatttccacaggacactgctatatggtggcatttacgggtaccccagggacaagaaaagcaagaatgggaaactaaggctcctgtatgaatgtgctcctattaacttcattgtagaacaagctggtggaaaaggtacagatggccttcaagtactccggcttcaagggacagagattcatcaacgtgtgccactgtacattggggaagaggtagagaaggtggaaaagtacttggcttaa

SEQ ID NO: 40166 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 40167 - DNA, 1248 bp, Spinacia oleracea
  CDS (1)..(1248)
atggcatcaataggaccagcaacaacaactgcagtaaaactgcgtagctcaatcttcaatcctcagtcatctactctttccccgtctcaacaatgcattacatttacaaagtcccttcactcgtttcctactgccacccgacataatgtggcttccggggttcgttgtatggcagccgtaggagaggcggctacagaaacaaaggcaaggactagaagtaagtacgaaattgaaacactaacaggctggctgcttaaacaagaaatggcaggtgttattgatgctgaacttaccatcgttctttctagcatttcattggcttgtaaacaaattgcttccttggttcaacgagctggtatttctaacttgactggaattcaaggtgctgtcaatatccaaggagaggatcagaagaaacttgatgttgtctccaatgaggtgttttcgagctgcttgagatcgagtggaagaacaggaataatagcatcagaagaagaggatgtaccagtggcagtggaagagagttactctggaaactatattgttgtgtttgatccacttgatggttcatccaacattgatgcagctgtctccactggttccatctttggcatttatagccctaacgatgagtgcattgttgactctgatcacgacgatgagtcacagctaagtgcagaagaacagaggtgtgtagtgaatgtatgtcaaccaggggataacctattagcagcagggtattgtatgtactcaagctctgttatcttcgtacttacaattggtaaaggtgtgtatgcattcacattagatccaatgtatggtgaattcgtactcacttcagagaaaatccaaatcccaaaagctgggaagatctattcattcaatgaaggtaactacaaaatgtgggatgataaattgaagaagtacatggatgatcttaaagagccaggagagtcacagaaaccgtactcgtctcgttacatagggagtttagttggggactttcatagaacacttttatatggtgggatttatggttacccaagagatgcaaagagtaagaatgggaaattgaggcttttgtatgaatgtgcacctatgagttttattgttgaacaagctggtggtaaaggttctgatggtcatcaaagaattcttgacattcaacccaccgagatacatcaacgtgtgccactgtacatcgggagtgtggaggaagtagagaaattagagaagtacttagcataa

SEQ ID NO: 40168 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 40169 - DNA, 1044 bp, Synechocystis sp
  CDS (1)..(1044)
atgaccgttagtgagattcatattcctaactctttactagaccgggattgcaccaccctttcacgccacgtactccaacaactgaatagctttggggccgatgcccaggatttgagtgccatcatgaaccgcattgccctagcgggaaaactgattgcccgtcgcctgagtcgagctgggttaatggccgatgtgttgggcttcactggggaaaccaacgtccagggggaatcggtgaaaaaaatggacgtatttgccaatgatgtttttatttctgtctttaagcaaagtggcttggtttgtcgtctggcttcggaggagatggaaaaaccctactatattcctgaaaattgccccattggtcgctatactttgctgtacgaccccattgatggttcctccaacgtggacattaacctcaacgtgggttccatttttgccattcggcaacaggaaggggacgatctagacggcagtgcgtcagatttattggctaacggagacaagcaaattgctgctggttatatcctctacggcccctccaccatcctggtttattccctcggctccggagtgcatagctttatcctcgatcccagtttgggggaatttattttagcccaggaaaatatccgcattcccaaccacggccccatttacagcaccaatgaaggtaacttttggcaatgggatgaagccctgagggattacacccgttacgtccatcgccacgaaggttacactgcccgttatagcggtgctctggtgggggatattcaccggattttgatgcaagggggagtgtttctttatcctggtacggaaaaaaatcccgacggcaaattgcgtttgctctatgaaactgcgccgctggcctttttggtggaacaggctgggggaagggctagtgacggccaaaaacgtttactggacttaattccttctaaattacatcagcgtacccccgccattattggcagcgcagaagatgtgaaattggtggaatctttcatcagcgaccacaaacaacggcagggtaattag

SEQ ID NO: 40170 - protein, 347 aa, Synechocystis sp
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 40171 - DNA, 1230 bp, Triticum aestivum
  CDS (1)..(1230)
atggccgccgcgaccaccaccacctcccgcccgcttctgctgtcccgccagcaggcggcggctagctccctccaatgccgcctccccaggaggcccggaagcagcctctttgccggccagggccaggcgtcgactccgaatgtgcggtgcatggcagtcgtggacacggcctcggcgccggcgccggcggcggctaggaagaggagcagctacgacatgatcacgctgacgacgtggctgctgaagcaggagcaggagggggtcatcgacaacgagatgaccatcgtgctgtccagcatatccacggcgtgcaagcagatcgcctcgttggtgcagcgcgcgcccatctccaacctcaccggcgtccagggcgccaccaacgtgcagggcgaggaccagaagaagctcgacgtcatctccaacgaggtgttctcgaactgcctgaggtggagtggccgcaccggcgtgatcgcatcggaggaggaggacgtgccggtggcggtggaggagagctactcgggcaactacatcgtggtgttcgacccgctcgacggctcctccaacatcgacgccgccgtctccaccggctccatcttcggcatctacagcccatccgacgagtgccacattggcgacgacgcaacccttgacgaagtgacgcagatgtgcatagtgaacgtgtgccagccagggagcaacctgctcgccgccggctactgcatgtactcgagctcggtcatcttcgtgctcaccatcggcaccggggtgtacgtgttcacgctggacccgatgtacggcgagttcgtgctgacgcaggagaaggtgcagatcccaaagtcgggcaagatctactccttcaacgagggcaactacgcgctctgggacgacaagctcaagaagtacatggacagcctcaaggagcccggcacctccggcaagccctactccgcgcgctacatcggcagcctcgtcggcgacttccaccgcaccatgctctacggcggcatctacgggtaccccagcgaccagaagagcaagaacggcaagctgcggctgctctacgagtgcgcgcccatgagcttcatcgccgagcaggccggcggcaaaggctccgacggccaccagagggtactcgacatcatgcccacagcggtccatcagagagtgcctctgtacgtcgggagcgtggaggaagtggagaaggtggagaaattcttgtcttcagagtag

SEQ ID NO: 40172 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 40173 - DNA, 1095 bp, Xanthobacter flavus
  CDS (1)..(1095)
atgttggagccgaacgcagaccatcgggccgcagttgcccaggctgcaggtgtcgcagcctcgcgtatcacgctcaccgtcatgctcgacgagtgggcgggtgcggatgcccgccgccgtgccgtcgcggataccgtctgcgccctcgccaccggttgcgcgtcgctggccgcagccatcgccgaggggccgctcgccggcgatctcgcccgcaccctctcctccggcgaggccggcgaaggccagaaggcgctggacgtcatctccaacgacatcgtcatcggcgcgctgaaggcggcgccggtcgcggcggtcgcatccgaggagaacgacgccccggtcctgctcgatcccaccgcgccgctgctcgtcgccatcgatccgctggacggctcgtccaacatcgacaccgacatctcggtcggcaccatcttcgccgtcttcccgcgtcccgaaggcgccgacgcgtccgaaccctctgccttcctgcagaacgggcgggacatgctggccgccggttatgtgatctacggcccccacaccgcgatgatgctgacgctcggcgccggcacctggcacttcgccctcgaccgcgccggcctcttccgcctggtcgatgcagaggtgaaggtgaaggagggcgcggccgagttcgccatcaacatgtccaactaccaccactgggacgtgccggtgcgtgactatgtggatgactgcctcgccggcaagaaggggccgcgggagcgcgacttcaacatgcgctgggtggcctccatggtggcggacgcgcatcgcatcttccagcgcggcggcatctatctctatccgggcgatggccggaagggctacacgcacggccgcctgcgcctcctctacgaggccttccccgtcgccttcctgatggagcaggcgagcggttcggcaaccgacggccggggcgccattctggacctttccgccaccggcctgcaccagcgcgtgccgttcatcttcggctcccgcgacgaggtggcccgggtctcccgctatcacctggagccgaacggccatggcgagcgctcgccgctgttcgcgcggcgcggactgttcatctga

SEQ ID NO: 40174 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 40175 - DNA, 990 bp, Beta vulgaris
  CDS (1)..(990)
atgaccataacacgtttcgtattgaatgaacagtcgaaacgtcctgagtctcgtggtgacttcaccattcttatgagtcacattgttcttggctgcaaatttgtctgctctgctgttaataaggctggtcttgccaagctcataggacttgcaggggagacaaatattcagggtgaagagcaaaagaagttggatgttctttcaaatgaagttttcattaaggccttgataagtagtggcagaacttgcattcttgtgtctgaggaggatgaggaggcaacattcgttgagccatctctacgtggaaagtattgtgttgtttttgaccctttggatggatgttccaacattgactgtggtgtatcgattggcactatctttgggatttacatggtgaaagatcttaataatgcaactcttgatgatgtcctccaacctggaaaaaatatggtagctgctggttattgcatgtatgggagctcttgcacgcttgtcatgagcactggaagcggtgtcaatggtttcactcatgacccatctcttggagagtttattttaactcatccggacatcaagatcccaaagaagggtaagatctattctgtgaatgaaggcaatgcaaagaactgggatggcccaacaacaaagtacgtggagaaatgtaagttccctaaggatggttcatcaccaaaatctctcagatacatcggaagtatggtagcggatgttcatcgcactctactttatggtggcatctttatgtaccctggtgataagaagagccctaacggaaaactacgagttctttatgaggtctttcccatgtcattcttaatggagcaagcaggtggacaagcttttactggcgaacaacgggcacttgacttggtcccaaagaacatacatgatcgttcaccagtattccttggcagctatgacgacgttgaagacatcaaagcactctatgctgctgaacagaagaatgcttga

SEQ ID NO: 40176 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 40177 - DNA, 1020 bp, Brassica napus
  CDS (1)..(1020)
atggatcacgaagcagatgctttccgtgatttgatgaccatcacgagattcgtgctgaatgagcaatcaaagtatccagagtctcgtggggatttcacgattttgctcagcaacatcgttttgggatgcaaattcgtctgcagtgccgtcaacaaggctggtttggccaagcttattggacttgcaggggacacaaatatccagggtgaagagcaaaagaaactggatgtgctctctaacgatgtttttgtcaaagctttggttagcagcggcagaacttctgttcttgtctcggaagaagatgaggaagctacgtttgtggagtcatccaagtgtggaaagtactgtgttgtttttgatccacttgatggatcctcaaacattgactgtggtgtctccattggaacaatctttggaatttacacaatggaacacagtgatgagccgactactaaagatgttctgaaacctgggaatgaaatggttgcagcgggttactgtatgtacggaagctcctgcatgcttgtgttgagcacaggaacaggtgtccacggatttaccctggacccatctctaggagagttcatattaactcacccagacattaagattccaaagaagggaaacatatactcagtgaatgaaggaaatgctcagaactgggatggtccaaccacaaaatatgtagagagatgcaagtatcccaaagatggttctcccgcaaagtcactgagatatgtcggaagtatggtagccgatgttcatcgcactctgctttatggaggaatcttcctgtacccggctgacaagaaaagccccaatgggaaattgcgtgtcctgtatgaagtcttcccaatggcgttcttgatggagcaagctggaggtcaggccttcactggcaagaaaagggcactggaccttgtcccgaaaaagatccatgagcgttctcccatatttcttggtagctatgacgatgtagaggagattaaggctctgtatgcggaggaggagaagaactaa

SEQ ID NO: 40178 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 40179 - DNA, 1020 bp, Oryza sativa
  CDS (1)..(1020)
atggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaa

SEQ ID NO: 40180 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 40181 - DNA, 996 bp, Rhodobacter capsulatus
  CDS (1)..(996)
atggcgatcgagcttgaaggtctcgggcttagcccggaactggcggatgtgatgacccggctggcgcgtgtgggggcggatctggcccgcaccattgcccgcaacggggtggaaacggacctggcggcgggcgtcggcaccaatgccgggggcgatggtcaaaaggcgctcgacgtgatggcggacgacgccttccgcgaggcgctgacgggcaccgccgtcgcttattatgcttccgaagaacaggacgaagtggtgacgctgggcaaaggtacgctcgccttggccatcgatccgctcgacggctcctcgaacatcgatgtgaacgtgtcgatcggcacgatcttctcgatcttcccggcgaccgacgatccgaacaccagcttcctgcgcaagggctcggaacagatcgcgggcggctatatcatctacgggccacaatgcgcgctggtgtgcagcttcgggcgcggcgtgcatcactgggtgcttgatctcgacagccgcagcttcaagcgcctgcccgacatcaaggcattgccgcaagacacgtcggaatatgcgatcaacgcctcgaactaccggcattggccctcgccgatccgcgccttcatcgacgatctggtggcgggcgccgaggggccgcgcgggcgcaacttcaacatgcgctggatcgcctcgctcgttgccgaaacccaccgcatcctgatgcgcggcggcgtgttcctctatccgggcgacgaacgcaagggctatgcccgcggccgtctgcgccatgtctatgaatgtgcgccgatcgcctttctgatcacgcaagtgggcggcggcgccaccgacggctgcgaggacatcctctccgccctgcccgacaagctgcatgcgcgcacgcccttcgttttcggctgcgcggccaaggtggcccgcgtcaccgcctatcacgacctgcccgggcaggagacctcggcacccttcaacacccgcggtcttttccggagctga

SEQ ID NO: 40182 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 40183 - DNA, 996 bp, Saccharum hybrid
  CDS (1)..(996)
atgaccatcacgcggcacgtgctgaacgagcagagccggaaccccgagtcccgcggcgacttcaccatcctgctctcccacatcgtcctcggctgcaagttcgtcgcctccgccgtcaacaaggccggactcgcgcagctcattggactcgccggagagaccaacgtgcagggagaggagcagaagaagctggacgtcctgtccaacgaggtgttcgtcaaggccctcgtcagcagcggtcgcacctgcgtccttgtgtccgaggaggacgaggaaacaacgttcgtggaccctaagctacgtgggaagtactgtgtttgctttgatcccctcgacggttcctccaacatcgactgtggcgtctccatcggaacgatctttgggatttacatgatcaaggacaaggacaatgtcactctgtccgacgtactgcaacctggcaaggacatgcttgccgctggatactgcatgtatggcagttcctgcacgcttgttctgagcactggaactggtgtcaatggcttcacacttgatccttcacttggcgagttcatactaactcatccagacatcaagatacctaagaaggggaagatttattcagtcaatgaagggaacgccaaaaattgggacgtgcctgttgcaaagtttgtggagaagtgcaaataccccaaagatggttcgccaccaaaatctttgagatacattggaagtatggttgctgatgtgcaccgtaccttgctatatggaggtgtatttttgtaccctgctgaccagaagagcccaaatggaaagctccgtgtcctttatgaagttttccccatgtcattcctaatggagcaggctggaggtcagtccttcacaggcaaagaacgggctcttgatctggtcccaaccaagatccacgagagatccccgatattcctcggcagctacgacgatgtggaggaaatcaaagcattgtacgccgagcaggcaaagtcaagctcagcttga

SEQ ID NO: 40184 - protein, 331 aa, Saccharum hybrid
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 40185 - DNA, 1023 bp, Solanum tuberosum
  CDS (1)..(1023)
atggatcacgcggcggatcgacaccggacggatttgatgacaataacaaggtttgtgttgaatgagcagacgaagcaccctgaatcccgtggagacttcagtattttgctcagtcacattgttcttggctgcaagttcgtatgcactgctgttaacaaggcaggtttagccaaacttctaggacttgctggtgagactaatgtgcagggagaagatcaaaagaaacttgatgtactctcaaatgaagtgtttatcaaggctttggttagcagtaaccgaacatgcattcttgtctctgaagaagatgaagaagccacatttgttaggccagctaaccgtggaaaatactgtgtagtttttgatcctctggatggatcatcgaacattgattgtggtgtttctattggaacgatctttggaatttacatgatcaaagacggtcatgaaccaacactagatgatgtcttgcaacctgggatgaacatgttagctgctggttactgcatgtatggaagttcttgtacgctagttttgagcactggatctggagttaatggttttacccttgatccctctcttggcgagttcatcctaactcatcctgacatcaagattcctaagaaagggaagatttattcagtgaatgaaggaaatgccaagaactgggacagtccaacatccaaatatgtgcagagctgcaagtatcccgctgatggttcttcaccaaaatctttgagatatattggaagtatggttgctgatgttcatcgtacattactctatggaggcatcttcttgtaccccggagataagaaaagccccaacgggaaactgagggttctctatgaagtatttcccatgtcatttctgatggaacaagcaggaggccaagcatttactgggaagcaacgggcacttgacttagttccagagaagatacacgaacgctctcctatatttcttggtagttatgatgatgttgaggagatcaaaaagctctacgctgctgaagagcaaaactga

SEQ ID NO: 40186 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 40187 - DNA, 1026 bp, Spinacia oleracea
  CDS (1)..(1026)
atggatcatgctggggatgcaatgcgtacggacttgatgaccataacacggtatgtgttgaatgagcagtccaaacgccccgagtctcgtggtgatttcacaattcttctcagtcacattgttcttggctgcaaatttgtttgctctgctgttaacaaggctggtcttgccaagctcataggacttgcaggggagactaacattcagggtgaagagcaaaagaagctagatgtgctctcaaatgaagtttttgttaaggctttgacaagtagtggccgaacttgcatccttgtgtctgaagaggacgaggaggcaacattcattgagccatctctgcgtggaaagtattgtgttgtatttgaccctctggatggatcttccaacattgactgtggtgtttcaattggcacgatatttgggatttacatggtcaaagattttgaaactgcgactcttgaagatgtcctgcaacctggaaagaatatggtagctgctggttattgcatgtatgggagctcttgcacgcttgttttgagcactggaagcggtgttaatggtttcactctagatccatctcttggagagtatattttaactcatccagacatcaagattccaaacaagggtaagatctattcagtgaatgaaggcaatgcaaagaattgggatggcccaacaacaaagtatgtggaaaaatgtaagttcccgacagatggttcatcacccaagtctctcagatacattggaagtatggtagctgatgttcatcgcactttactatatggtggcatctttttgtaccctggtgataagaagagccccaacggaaaactaagagttctctacgaggtctttccaatgtccttcttaatggaacaagctggcggacaagcttttaccggcaaacaacgggcacttgacttgatcccgacaaaaatacatgaacgctcaccagtattcctcggcagctatgatgatgttgaagacatcaaagccctctatgctgctcaagagaagacggcctga

SEQ ID NO: 40188 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 40189 - DNA, 1095 bp, Alcaligenes eutrophus
  CDS (1)..(1095)
atgcccgaagtccagcggatgaccctgacgcagttcctgatcgaggaacgccgccgctatccggacgccagcggtggcttcaacggcctgattctcaacgtcgccatggcctgcaaggaaattgcgcgcgcggttgccttcggcgcgctggggggcttgcacggcaaggccagcactcaagctggagaagagggggccgtcaacgtgcaaggcgagatccagcagaagctggacgtgctgagcaataccactttcctgcgcgtcaacgagtggggcggctacctggccggcatggcgtcggaggagatggaggcgccttaccagatcccggagaactacccgcgcggcaagtacctgctggtgttcgatccgctcgacggctcgtccaacatcgacgtcaatgtctcagtgggcagcatcttctcggtgctgcgcgcgcccgaaggcgccgacaccgtcaccgagcaggatttcctgcagcccggcagcgcccaggtggcggccggctacgcgctctacggtcccaccaccatgctggtgctgaccgtgggcaatggcgtcaacggcttcacgctcgatcccaacctgggcgagttcttcctgacgcacccccacctgcgggtgccgcccgatacccaggaatttgccatcaacgcgtcgaacagccgcttctgggaagcgccggtgcagcgctacatcggcgagtgcatggctggcaagagcgggccgcgcggcaaggatttcaatatgcgctggatcgcatcgatggtggccgaggcgcaccgcatcctgatgcgcggcggtgtcttcatgtacccgcgcgacaccaaggatcccgccaagccgggccgccttcgcctgctgtacgaggccaacccgatcgccttcctgatggagcaggccggcgggcgcgccagcacgggccggcagacgctgatgtcggtggcgccgggcgcgctgcaccagcgtatcggcgtgatcttcggctcgcgcaatgaagtggaacggatcgagggctaccacaccaaccagaccgaccccgaccttccgagtcccctgttcaacgagcgcagcctgttccgcgcgtccgcctga

SEQ ID NO: 40190 - protein, 364 aa, Alcaligenes eutrophus
MPEVQRMTLTQFLIEERRRYPDASGGFNGLILNVAMACKEIARAVAFGALGGLHGKASTQAGEEGAVNVQGEIQQKLDVLSNTTFLRVNEWGGYLAGMASEEMEAPYQIPENYPRGKYLLVFDPLDGSSNIDVNVSVGSIFSVLRAPEGADTVTEQDFLQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 40191 - DNA, 996 bp, Rhodobacter sphaeroides
  CDS (1)..(996)
atggccatcgagctggaggacctggggctgagccccgatgtggcggacgtgatgcagcgtctggcgcgcgtgggggcaggcatcgcccgcatcatctcgcgcaacgggctcgagcgcgatctgggcgcgggcgtcggcaccaatgccggaggagacgggcagaaggcgctcgacgtgatcgcggacgacgcgttccgcgcggcgctcgaaggctctgcggtggcttattacgcctccgaggagcaggacgaagtggtgacgctgggcgagggaagcctcgcgctcgccatcgacccgctggacggctcgtccaacatcgatgtgaacgtgtcgatcgggacgatcttctcgatcttcccggcggcggctggccccgaggccagcttcctgcgcccgggcaccgagcagattgccggcggctacatcatctacgggccgcaatgcgcgctggtctgcagcttcgggcagggcgtgcagcactgggtgctcgacctcgatgcgggcatcttccggcggatgcccgacatccgcccgctgccggccgagacgtccgagtttgcgatcaacgcctcgaactaccgccactggccgcagccgatccgcgccttcgtcgacgatctggtcgccggggccgaggggccgcgcggcaagaacttcaacatgcgctggatcgcctcgctggtggccgagacgcaccgcatcctgatgcggggcggggtgtttctctatcccggcgacgagcgcaagggctacgagcggggccggctgcgccatgtctacgaatgcgcgcccatcgccttcctgatcgcgaatgtcggggggggcgccaccgacggctgcgccgacatcctgaccgcgctgcccgaccggctgcacgcccgcacccccttcgtcttcggctgcgcgagcaaggtcgcccgcgtcgccgcctatcacgatctggcctgcgaagagacgtccgctctcttcggcagccggggcctgttccggagttaa

SEQ ID NO: 40192 - protein, 331 aa, Rhodobacter sphaeroides
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 40193 - DNA, 27 bp, Primer
atgaaaacgttaggtgaatttattgtc

SEQ ID NO: 40194 - DNA, 21 bp, Primer
ttacgcgtccgggaactcacg

SEQ ID NO: 40195 - protein, 334 aa, consensus
  MISC_FEATURE (1)..(334): consensus for the disclosure of xaa see table XV
KXXXXXXXXXXXXXXXXXXXXXXGXXGXXNXXXXXXXXGXXXXKLDXXXXXXXXXXXXXXXXXXXXXSEEXXXXXXXXXXXXXXXXXXXXGXYXXXXDPLDGSSNXDXXXXXGXIFXXXXXXXXXXXXXXXXXXXXXXXXXXXXXXXXXXXXGXXXXAAGYXXYGXXXXXVXXXGXGXVXXFXLDXXXXXXXGXFXLXXXXXXXXXXXXXXXXXNXXXXXXXXXXXXXXXXXXXXXXXXXXXXXXXXRXXXSXVXDXHRXLXXGXGXXXYPXXXXXXXXXXGKLRXXYEXXPXXXXXEQAGGXXXXGXXXXXLXXXPXXXHXRXXXXXGSXXXV

SEQ ID NO: 40196 - protein, 80 aa, consensus
  MISC_FEATURE (1)..(80): consensus for the disclosure of xaa see table XV
XXXXXXXDXXXXXXXXXXXXXXXXXXXXXXEXXXXXXXXXXXXXXXXXXXXXXXXXXXXDPXDGXXXXXXXXXXGXXXXX

SEQ ID NO: 40197 - protein, 78 aa, consensus
  MISC_FEATURE (1)..(78): consensus for the disclosure of xaa see table XV
XXXXXXXXXXXYXXXXXXXXXXXXXXXXXXXXXXXXXXXXXXXXXXXXXXXXXXXXXXXXXXXXXXXXXXXXXXXXXX

SEQ ID NO: 40198 - protein, 90 aa, consensus
  MISC_FEATURE (1)..(90): consensus for the disclosure of xaa see table XV
XXXRXXXXXVXXXXXXXXXGXGXXXXPXXXXXXXXXXXXLRXXXEXXPXXXXXXXXXXXXXXXXXXXXXXXXXXXXXXXXXXXXGXXXXX

SEQ ID NO: 40199 - DNA, 648 bp, Escherichia coli; identical to SEQ ID NO: 38273
  CDS (1)..(648)

SEQ ID NO: 40200 - protein, 215 aa, Escherichia coli; identical to SEQ ID NO: 38274

SEQ ID NO: 40201 - DNA, 621 bp, Agrobacterium rhizogenes; identical to SEQ ID NO: 38275
  CDS (1)..(621)

SEQ ID NO: 40202 - protein, 206 aa, Agrobacterium rhizogenes; identical to SEQ ID NO: 38276

SEQ ID NO: 40203 - DNA, 618 bp, Mesorhizobium loti MAFF303099; identical to SEQ ID NO: 38277
  CDS (1)..(618)

SEQ ID NO: 40204 - protein, 205 aa, Mesorhizobium loti MAFF303099; identical to SEQ ID NO: 38278

SEQ ID NO: 40205 - DNA, 735 bp, Mesorhizobium loti MAFF303099; identical to SEQ ID NO: 38279
  CDS (1)..(735)

SEQ ID NO: 40206 - protein, 244 aa, Mesorhizobium loti MAFF303099; identical to SEQ ID NO: 38280

SEQ ID NO: 40207 - DNA, 588 bp, Bacillus halodurans C-125; identical to SEQ ID NO: 38281
  CDS (1)..(588)

SEQ ID NO: 40208 - protein, 195 aa, Bacillus halodurans C-125; identical to SEQ ID NO: 38282

SEQ ID NO: 40209 - DNA, 633 bp, Pseudomonas aeruginosa PAO1; identical to SEQ ID NO: 38283
  CDS (1)..(633)

SEQ ID NO: 40210 - protein, 210 aa, Pseudomonas aeruginosa PAO1; identical to SEQ ID NO: 38284

SEQ ID NO: 40211 - DNA, 639 bp, Pseudomonas aeruginosa PAO1; identical to SEQ ID NO: 38285
  CDS (1)..(639)

SEQ ID NO: 40212 - protein, 212 aa, Pseudomonas aeruginosa PAO1; identical to SEQ ID NO: 38286

SEQ ID NO: 40213 - DNA, 633 bp, Neisseria meningitidis Z2491; identical to SEQ ID NO: 38287
  CDS (1)..(633)

SEQ ID NO: 40214 - protein, 210 aa, Neisseria meningitidis Z2491; identical to SEQ ID NO: 38288

SEQ ID NO: 40215 - DNA, 606 bp, Mycobacterium tuberculosis CDC1551; identical to SEQ ID NO: 38289
  CDS (1)..(606)

SEQ ID NO: 40216 - protein, 201 aa, Mycobacterium tuberculosis CDC1551; identical to SEQ ID NO: 38290

SEQ ID NO: 40217 - DNA, 618 bp, Clostridium acetobutylicum ATCC 824; identical to SEQ ID NO: 38291
  CDS (1)..(618)

SEQ ID NO: 40218 - protein, 205 aa, Clostridium acetobutylicum ATCC 824; identical to SEQ ID NO: 38292

SEQ ID NO: 40219 - DNA, 642 bp, Agrobacterium tumefaciens str. C58; identical to SEQ ID NO: 38293
  CDS (1)..(642)

SEQ ID NO: 40220 - protein, 213 aa, Agrobacterium tumefaciens str. C58; identical to SEQ ID NO: 38294

SEQ ID NO: 40221 - DNA, 651 bp, Sinorhizobium meliloti 1021; identical to SEQ ID NO: 38295
  CDS (1)..(651)

SEQ ID NO: 40222 - protein, 216 aa, Sinorhizobium meliloti 1021; identical to SEQ ID NO: 38296

SEQ ID NO: 40223 - DNA, 654 bp, Salmonella typhimurium LT2; identical to SEQ ID NO: 38297
  CDS (1)..(654)

SEQ ID NO: 40224 - protein, 217 aa, Salmonella typhimurium LT2; identical to SEQ ID NO: 38298

SEQ ID NO: 40225 - DNA, 663 bp, Salmonella typhimurium LT2; identical to SEQ ID NO: 38299
  CDS (1)..(663)

SEQ ID NO: 40226 - protein, 220 aa, Salmonella typhimurium LT2; identical to SEQ ID NO: 38300

SEQ ID NO: 40227 - DNA, 555 bp, Listeria innocua Clip11262; identical to SEQ ID NO: 38301
  CDS (1)..(555)

SEQ ID NO: 40228 - protein, 184 aa, Listeria innocua Clip11262; identical to SEQ ID NO: 38302

SEQ ID NO: 40229 - DNA, 615 bp, Agrobacterium tumefaciens str. C58; identical to SEQ ID NO: 38303
  CDS (1)..(615)

SEQ ID NO: 40230 - protein, 204 aa, Agrobacterium tumefaciens str. C58; identical to SEQ ID NO: 38304

SEQ ID NO: 40231 - DNA, 597 bp, Bacillus anthracis str. A2012; identical to SEQ ID NO: 38305
  CDS (1)..(597)

SEQ ID NO: 40232 - protein, 198 aa, Bacillus anthracis str. A2012; identical to SEQ ID NO: 38306

SEQ ID NO: 40233 - DNA, 657 bp, Yersinia pestis KIM; identical to SEQ ID NO: 38307
  CDS (1)..(657)

SEQ ID NO: 40234 - protein, 218 aa, Yersinia pestis KIM; identical to SEQ ID NO: 38308

SEQ ID NO: 40235 - DNA, 630 bp, Brucella suis 1330; identical to SEQ ID NO: 38309
  CDS (1)..(630)

SEQ ID NO: 40236 - protein, 209 aa, Brucella suis 1330; identical to SEQ ID NO: 38310

SEQ ID NO: 40237 - DNA, 633 bp, Pseudomonas putida KT2440; identical to SEQ ID NO: 38311
  CDS (1)..(633)

SEQ ID NO: 40238 - protein, 210 aa, Pseudomonas putida KT2440; identical to SEQ ID NO: 38312

SEQ ID NO: 40239 - DNA, 582 bp, Pseudomonas syringae pv. tomato str. DC3000; identical to SEQ ID NO: 38313
  CDS (1)..(582)

SEQ ID NO: 40240 - protein, 193 aa, Pseudomonas syringae pv. tomato str. DC3000; identical to SEQ ID NO: 38314

SEQ ID NO: 40241 - DNA, 651 bp, Pseudomonas syringae pv. tomato str. DC3000; identical to SEQ ID NO: 38315
  CDS (1)..(651)

SEQ ID NO: 40242 - protein, 216 aa, Pseudomonas syringae pv. tomato str. DC3000; identical to SEQ ID NO: 38316

SEQ ID NO: 40243 - DNA, 672 bp, Pseudomonas syringae pv. tomato str. DC3000; identical to SEQ ID NO: 38317
  CDS (1)..(672)

SEQ ID NO: 40244 - protein, 223 aa, Pseudomonas syringae pv. tomato str. DC3000; identical to SEQ ID NO: 38318

SEQ ID NO: 40245 - DNA, 600 bp, Vibrio parahaemolyticus RIMD 2210633; identical to SEQ ID NO: 38319
  CDS (1)..(600)

SEQ ID NO: 40246 - protein, 199 aa, Vibrio parahaemolyticus RIMD 2210633; identical to SEQ ID NO: 38320

SEQ ID NO: 40247 - DNA, 615 bp, Streptomyces avermitilis MA-4680; identical to SEQ ID NO: 38321
  CDS (1)..(615)

SEQ ID NO: 40248 - protein, 204 aa, Streptomyces avermitilis MA-4680; identical to SEQ ID NO: 38322

SEQ ID NO: 40249 - DNA, 582 bp, Bacillus cereus ATCC 14579; identical to SEQ ID NO: 38323
  CDS (1)..(582)

SEQ ID NO: 40250 - protein, 193 aa, Bacillus cereus ATCC 14579; identical to SEQ ID NO: 38324

SEQ ID NO: 40251 - DNA, 573 bp, Bacillus cereus ATCC 14579; identical to SEQ ID NO: 38325
  CDS (1)..(573)

SEQ ID NO: 40252 - protein, 190 aa, Bacillus cereus ATCC 14579; identical to SEQ ID NO: 38326

SEQ ID NO: 40253 - DNA, 588 bp, Bacillus cereus ATCC 14579; identical to SEQ ID NO: 38327
  CDS (1)..(588)

SEQ ID NO: 40254 - protein, 195 aa, Bacillus cereus ATCC 14579; identical to SEQ ID NO: 38328

SEQ ID NO: 40255 - DNA, 573 bp, Bacillus anthracis str. Ames; identical to SEQ ID NO: 38329
  CDS (1)..(573)

SEQ ID NO: 40256 - protein, 190 aa, Bacillus anthracis str. Ames; identical to SEQ ID NO: 38330

SEQ ID NO: 40257 - DNA, 606 bp, Mycobacterium bovis AF2122/97; identical to SEQ ID NO: 38331
  CDS (1)..(606)

SEQ ID NO: 40258 - protein, 201 aa, Mycobacterium bovis AF2122/97; identical to SEQ ID NO: 38332

SEQ ID NO: 40259 - DNA, 615 bp, Bordetella parapertussis 12822; identical to SEQ ID NO: 38333
  CDS (1)..(615)

SEQ ID NO: 40260 - protein, 204 aa, Bordetella parapertussis 12822; identical to SEQ ID NO: 38334

SEQ ID NO: 40261 - DNA, 663 bp, Bordetella bronchiseptica RB50; identical to SEQ ID NO: 38335
  CDS (1)..(663)

SEQ ID NO: 40262 - protein, 220 aa, Bordetella bronchiseptica RB50; identical to SEQ ID NO: 38336

SEQ ID NO: 40263 - DNA, 648 bp, Chromobacterium violaceum ATCC 12472; identical to SEQ ID NO: 38337
  CDS (1)..(648)

SEQ ID NO: 40264 - protein, 215 aa, Chromobacterium violaceum ATCC 12472; identical to SEQ ID NO: 38338

SEQ ID NO: 40265 - DNA, 612 bp, Chromobacterium violaceum ATCC 12472; identical to SEQ ID NO: 38339
  CDS (1)..(612)

SEQ ID NO: 40266 - protein, 203 aa, Chromobacterium violaceum ATCC 12472; identical to SEQ ID NO: 38340

SEQ ID NO: 40267 - DNA, 642 bp, Photorhabdus luminescens subsp. laumondii TTO1; identical to SEQ ID NO: 38341
  CDS (1)..(642)

SEQ ID NO: 40268 - protein, 213 aa, Photorhabdus luminescens subsp. laumondii TTO1; identical to SEQ ID NO: 38342

SEQ ID NO: 40269 - DNA, 627 bp, Rhodopseudomonas palustris CGA009; identical to SEQ ID NO: 38343
  CDS (1)..(627)

SEQ ID NO: 40270 - protein, 208 aa, Rhodopseudomonas palustris CGA009; identical to SEQ ID NO: 38344

SEQ ID NO: 40271 - DNA, 642 bp, Mycobacterium avium subsp. paratuberculosis str. k10; identical to SEQ ID NO: 38345
  CDS (1)..(642)

SEQ ID NO: 40272 - protein, 213 aa, Mycobacterium avium subsp. paratuberculosis str. k10; identical to SEQ ID NO: 38346

SEQ ID NO: 40273 - DNA, 648 bp, Treponema denticola ATCC 35405; identical to SEQ ID NO: 38347
  CDS (1)..(648)

SEQ ID NO: 40274 - protein, 215 aa, Treponema denticola ATCC 35405; identical to SEQ ID NO: 38348

SEQ ID NO: 40275 - DNA, 582 bp, Bacillus cereus ATCC 10987; identical to SEQ ID NO: 38349
  CDS (1)..(582)

SEQ ID NO: 40276 - protein, 193 aa, Bacillus cereus ATCC 10987; identical to SEQ ID NO: 38350

SEQ ID NO: 40277 - DNA, 657 bp, Bacillus cereus ATCC 10987; identical to SEQ ID NO: 38351
  CDS (1)..(657)

SEQ ID NO: 40278 - protein, 218 aa, Bacillus cereus ATCC 10987; identical to SEQ ID NO: 38352

SEQ ID NO: 40279 - DNA, 588 bp, Bacillus cereus ATCC 10987; identical to SEQ ID NO: 38353
  CDS (1)..(588)

SEQ ID NO: 40280 - protein, 195 aa, Bacillus cereus ATCC 10987; identical to SEQ ID NO: 38354

SEQ ID NO: 40281 - DNA, 588 bp, Desulfovibrio vulgaris subsp. vulgaris str. Hildenborough; identical to SEQ ID NO: 38355
  CDS (1)..(588)

SEQ ID NO: 40282 - protein, 195 aa, Desulfovibrio vulgaris subsp. vulgaris str. Hildenborough; identical to SEQ ID NO: 38356

SEQ ID NO: 40283 - DNA, 573 bp, Bacillus thuringiensis serovar konkukian str. 97-27; identical to SEQ ID NO: 38357
  CDS (1)..(573)

SEQ ID NO: 40284 - protein, 190 aa, Bacillus thuringiensis serovar konkukian str. 97-27; identical to SEQ ID NO: 38358

SEQ ID NO: 40285 - DNA, 642 bp, Erwinia carotovora subsp. atroseptica SCRI1043; identical to SEQ ID NO: 38359
  CDS (1)..(642)

SEQ ID NO: 40286 - protein, 213 aa, Erwinia carotovora subsp. atroseptica SCRI1043; identical to SEQ ID NO: 38360

SEQ ID NO: 40287 - DNA, 582 bp, Bacillus licheniformis ATCC 14580; identical to SEQ ID NO: 38361
  CDS (1)..(582)

SEQ ID NO: 40288 - protein, 193 aa, Bacillus licheniformis ATCC 14580; identical to SEQ ID NO: 38362

SEQ ID NO: 40289 - DNA, 585 bp, Bacillus cereus ZK; identical to SEQ ID NO: 38363
  CDS (1)..(585)

SEQ ID NO: 40290 - protein, 194 aa, Bacillus cereus ZK; identical to SEQ ID NO: 38364

SEQ ID NO: 40291 - DNA, 573 bp, Bacillus cereus ZK; identical to SEQ ID NO: 38365
  CDS (1)..(573)

SEQ ID NO: 40292 - protein, 190 aa, Bacillus cereus ZK; identical to SEQ ID NO: 38366

SEQ ID NO: 40293 - DNA, 873 bp, Bacillus cereus ZK; identical to SEQ ID NO: 38367
  CDS (1)..(873)

SEQ ID NO: 40294 - protein, 290 aa, Bacillus cereus ZK; identical to SEQ ID NO: 38368

SEQ ID NO: 40295 - DNA, 672 bp, Burkholderia pseudomallei K96243; identical to SEQ ID NO: 38369
  CDS (1)..(672)

SEQ ID NO: 40296 - protein, 223 aa, Burkholderia pseudomallei K96243; identical to SEQ ID NO: 38370

SEQ ID NO: 40297 - DNA, 648 bp, Nocardia farcinica IFM 10152; identical to SEQ ID NO: 38371
  CDS (1)..(648)

SEQ ID NO: 40298 - protein, 215 aa, Nocardia farcinica IFM 10152; identical to SEQ ID NO: 38372

SEQ ID NO: 40299 - DNA, 585 bp, Geobacillus kaustophilus HTA426; identical to SEQ ID NO: 38373
  CDS (1)..(585)

SEQ ID NO: 40300 - protein, 194 aa, Geobacillus kaustophilus HTA426; identical to SEQ ID NO: 38374

SEQ ID NO: 40301 - DNA, 615 bp, Idiomarina loihiensis L2TR; identical to SEQ ID NO: 38375
  CDS (1)..(615)

SEQ ID NO: 40302 - protein, 204 aa, Idiomarina loihiensis L2TR; identical to SEQ ID NO: 38376

SEQ ID NO: 40303 - DNA, 618 bp, Azoarcus sp. EbN1; identical to SEQ ID NO: 38377
  CDS (1)..(618)

SEQ ID NO: 40304 - protein, 205 aa, Azoarcus sp. EbN1; identical to SEQ ID NO: 38378

SEQ ID NO: 40305 - DNA, 612 bp, Bacillus clausii KSM-K16; identical to SEQ ID NO: 38379
  CDS (1)..(612)

SEQ ID NO: 40306 - protein, 203 aa, Bacillus clausii KSM-K16; identical to SEQ ID NO: 38380

SEQ ID NO: 40307 - DNA, 588 bp, Bacillus clausii KSM-K16; identical to SEQ ID NO: 38381
  CDS (1)..(588)

SEQ ID NO: 40308 - protein, 195 aa, Bacillus clausii KSM-K16; identical to SEQ ID NO: 38382

SEQ ID NO: 40309 - DNA, 654 bp, Azotobacter vinelandii; identical to SEQ ID NO: 38383
  CDS (1)..(654)

SEQ ID NO: 40310 - protein, 217 aa, Azotobacter vinelandii; identical to SEQ ID NO: 38384

SEQ ID NO: 40311 - DNA, 606 bp, Desulfitobacterium hafniense DCB-2; identical to SEQ ID NO: 38385
  CDS (1)..(606)

SEQ ID NO: 40312 - protein, 201 aa, Desulfitobacterium hafniense DCB-2; identical to SEQ ID NO: 38386

SEQ ID NO: 40313 - DNA, 579 bp, Desulfitobacterium hafniense DCB-2; identical to SEQ ID NO: 38387
  CDS (1)..(579)

SEQ ID NO: 40314 - protein, 192 aa, Desulfitobacterium hafniense DCB-2; identical to SEQ ID NO: 38388

SEQ ID NO: 40315 - DNA, 774 bp, Desulfitobacterium hafniense DCB-2; identical to SEQ ID NO: 38389
  CDS (1)..(774)

SEQ ID NO: 40316 - protein, 257 aa, Desulfitobacterium hafniense DCB-2; identical to SEQ ID NO: 38390

SEQ ID NO: 40317 - DNA, 618 bp, Desulfitobacterium hafniense DCB-2; identical to SEQ ID NO: 38391
  CDS (1)..(618)

SEQ ID NO: 40318 - protein, 205 aa, Desulfitobacterium hafniense DCB-2; identical to SEQ ID NO: 38392

SEQ ID NO: 40319 - DNA, 621 bp, Desulfitobacterium hafniense DCB-2; identical to SEQ ID NO: 38393
  CDS (1)..(621)

SEQ ID NO: 40320 - protein, 206 aa, Desulfitobacterium hafniense DCB-2; identical to SEQ ID NO: 38394

SEQ ID NO: 40321 - DNA, 1230 bp, Nostoc punctiforme PCC 73102; identical to SEQ ID NO: 38395
  CDS (1)..(1230)

SEQ ID NO: 40322 - protein, 409 aa, Nostoc punctiforme PCC 73102; identical to SEQ ID NO: 38396

SEQ ID NO: 40323 - DNA, 1212 bp, Anabaena variabilis ATCC 29413; identical to SEQ ID NO: 38397
  CDS (1)..(1212)

SEQ ID NO: 40324 - protein, 403 aa, Anabaena variabilis ATCC 29413; identical to SEQ ID NO: 38398

SEQ ID NO: 40325 - DNA, 771 bp, Ralstonia eutropha JMP134; identical to SEQ ID NO: 38399
  CDS (1)..(771)

SEQ ID NO: 40326 - protein, 256 aa, Ralstonia eutropha JMP134; identical to SEQ ID NO: 38400

SEQ ID NO: 40327 - DNA, 720 bp, Ralstonia eutropha JMP134; identical to SEQ ID NO: 38401
  CDS (1)..(720)

SEQ ID NO: 40328 - protein, 239 aa, Ralstonia eutropha JMP134; identical to SEQ ID NO: 38402

SEQ ID NO: 40329 - DNA, 636 bp, Methylobacillus flagellatus KT; identical to SEQ ID NO: 38403
  CDS (1)..(636)

SEQ ID NO: 40330 - protein, 211 aa, Methylobacillus flagellatus KT; identical to SEQ ID NO: 38404

SEQ ID NO: 40331 - DNA, 597 bp, Dechloromonas aromatica RCB; identical to SEQ ID NO: 38405
  CDS (1)..(597)

SEQ ID NO: 40332 - protein, 198 aa, Dechloromonas aromatica RCB; identical to SEQ ID NO: 38406

SEQ ID NO: 40333 - DNA, 606 bp, Burkholderia cepacia R18194; identical to SEQ ID NO: 38407
  CDS (1)..(606)

SEQ ID NO: 40334 - protein, 201 aa, Burkholderia cepacia R18194; identical to SEQ ID NO: 38408

SEQ ID NO: 40335 - DNA, 642 bp, Burkholderia cepacia R1808; identical to SEQ ID NO: 38409
  CDS (1)..(642)

SEQ ID NO: 40336 - protein, 213 aa, Burkholderia cepacia R1808; identical to SEQ ID NO: 38410

SEQ ID NO: 40337 - DNA, 573 bp, Bacillus cereus G9241; identical to SEQ ID NO: 38411
  CDS (1)..(573)

SEQ ID NO: 40338 - protein, 190 aa, Bacillus cereus G9241; identical to SEQ ID NO: 38412

SEQ ID NO: 40339 - DNA, 609 bp, Pseudomonas fluorescens PfO-1; identical to SEQ ID NO: 38413
  CDS (1)..(609)

SEQ ID NO: 40340 - protein, 202 aa, Pseudomonas fluorescens PfO-1; identical to SEQ ID NO: 38414

SEQ ID NO: 40341 - DNA, 633 bp, Pseudomonas fluorescens PfO-1; identical to SEQ ID NO: 38415
  CDS (1)..(633)

SEQ ID NO: 40342 - protein, 210 aa, Pseudomonas fluorescens PfO-1; identical to SEQ ID NO: 38416

SEQ ID NO: 40343 - DNA, 654 bp, Rhodospirillum rubrum; identical to SEQ ID NO: 38417
  CDS (1)..(654)

SEQ ID NO: 40344 - protein, 217 aa, Rhodospirillum rubrum; identical to SEQ ID NO: 38418

SEQ ID NO: 40345 - DNA, 729 bp, Ralstonia metallidurans CH34; identical to SEQ ID NO: 38419
  CDS (1)..(729)

SEQ ID NO: 40346 - protein, 242 aa, Ralstonia metallidurans CH34; identical to SEQ ID NO: 38420

SEQ ID NO: 40347 - DNA, 615 bp, Burkholderia fungorum LB400; identical to SEQ ID NO: 38421
  CDS (1)..(615)

SEQ ID NO: 40348 - protein, 204 aa, Burkholderia fungorum LB400; identical to SEQ ID NO: 38422

SEQ ID NO: 40349 - DNA, 660 bp, Burkholderia fungorum LB400; identical to SEQ ID NO: 38423
  CDS (1)..(660)

SEQ ID NO: 40350 - protein, 219 aa, Burkholderia fungorum LB400; identical to SEQ ID NO: 38424

SEQ ID NO: 40351 - DNA, 702 bp, Thermobifida fusca; identical to SEQ ID NO: 38425
  CDS (1)..(702)

SEQ ID NO: 40352 - protein, 233 aa, Thermobifida fusca; identical to SEQ ID NO: 38426

SEQ ID NO: 40353 - DNA, 648 bp, Geobacter metallireducens GS-15; identical to SEQ ID NO: 38427
  CDS (1)..(648)

SEQ ID NO: 40354 - protein, 215 aa, Geobacter metallireducens GS-15; identical to SEQ ID NO: 38428

SEQ ID NO: 40355 - DNA, 633 bp, Microbulbifer degradans 2-40; identical to SEQ ID NO: 38429
  CDS (1)..(633)

SEQ ID NO: 40356 - protein, 210 aa, Microbulbifer degradans 2-40; identical to SEQ ID NO: 38430

SEQ ID NO: 40357 - DNA, 567 bp, Pediococcus pentosaceus ATCC 25745; identical to SEQ ID NO: 38431
  CDS (1)..(567)

SEQ ID NO: 40358 - protein, 188 aa, Pediococcus pentosaceus ATCC 25745; identical to SEQ ID NO: 38432

SEQ ID NO: 40359 - DNA, 594 bp, Moorella thermoacetica ATCC 39073; identical to SEQ ID NO: 38433
  CDS (1)..(594)

SEQ ID NO: 40360 - protein, 197 aa, Moorella thermoacetica ATCC 39073; identical to SEQ ID NO: 38434

SEQ ID NO: 40361 - DNA, 687 bp, Polaromonas sp. JS666; identical to SEQ ID NO: 38435
  CDS (1)..(687)

SEQ ID NO: 40362 - protein, 228 aa, Polaromonas sp. JS666; identical to SEQ ID NO: 38436

SEQ ID NO: 40363 - DNA, 624 bp, Agrobacterium tumefaciens; identical to SEQ ID NO: 38437
  CDS (1)..(624)

SEQ ID NO: 40364 - protein, 207 aa, Agrobacterium tumefaciens; identical to SEQ ID NO: 38438

SEQ ID NO: 40365 - DNA, 660 bp, Xanthomonas maltophilia; identical to SEQ ID NO: 38439
  CDS (1)..(660)

SEQ ID NO: 40366 - protein, 219 aa, Xanthomonas maltophilia; identical to SEQ ID NO: 38440

SEQ ID NO: 40367 - DNA, 660 bp, Xanthomonas maltophilia; identical to SEQ ID NO: 38441
  CDS (1)..(660)

SEQ ID NO: 40368 - protein, 219 aa, Xanthomonas maltophilia; identical to SEQ ID NO: 38442

SEQ ID NO: 40369 - DNA, 633 bp, Pseudomonas fluorescens; identical to SEQ ID NO: 38443
  CDS (1)..(633)

SEQ ID NO: 40370 - protein, 210 aa, Pseudomonas fluorescens; identical to SEQ ID NO: 38444

SEQ ID NO: 40371 - DNA, 639 bp, Erwinia amylovora; identical to SEQ ID NO: 38445
  CDS (1)..(639)

SEQ ID NO: 40372 - protein, 212 aa, Erwinia amylovora; identical to SEQ ID NO: 38446

SEQ ID NO: 40373 - DNA, 660 bp, Xanthomonas maltophilia; identical to SEQ ID NO: 38447
  CDS (1)..(660)

SEQ ID NO: 40374 - protein, 219 aa, Xanthomonas maltophilia; identical to SEQ ID NO: 38448

SEQ ID NO: 40375 - DNA, 645 bp, Proteus mirabilis; identical to SEQ ID NO: 38449
  CDS (1)..(645)

SEQ ID NO: 40376 - protein, 214 aa, Proteus mirabilis; identical to SEQ ID NO: 38450

SEQ ID NO: 40377 - DNA, 651 bp, Klebsiella pneumoniae; identical to SEQ ID NO: 38451
  CDS (1)..(651)

SEQ ID NO: 40378 - protein, 216 aa, Klebsiella pneumoniae; identical to SEQ ID NO: 38452

SEQ ID NO: 40379 - DNA, 651 bp, Enterobacter aerogenes; identical to SEQ ID NO: 38453
  CDS (1)..(651)

SEQ ID NO: 40380 - protein, 216 aa, Enterobacter aerogenes; identical to SEQ ID NO: 38454

SEQ ID NO: 40381 - DNA, 633 bp, Pseudomonas putida; identical to SEQ ID NO: 38455
  CDS (1)..(633)

SEQ ID NO: 40382 - protein, 210 aa, Pseudomonas putida; identical to SEQ ID NO: 38456

SEQ ID NO: 40383 - DNA, 642 bp, Pseudomonas putida; identical to SEQ ID NO: 38457
  CDS (1)..(642)

SEQ ID NO: 40384 - protein, 213 aa, Pseudomonas putida; identical to SEQ ID NO: 38458

SEQ ID NO: 40385 - DNA, 663 bp, Escherichia coli; identical to SEQ ID NO: 38459
  CDS (1)..(663)

SEQ ID NO: 40386 - protein, 220 aa, Escherichia coli; identical to SEQ ID NO: 38460

SEQ ID NO: 40387 - DNA, 633 bp, Neisseria gonorrhoeae; identical to SEQ ID NO: 38461
  CDS (1)..(633)

SEQ ID NO: 40388 - protein, 210 aa, Neisseria gonorrhoeae; identical to SEQ ID NO: 38462

SEQ ID NO: 40389 - DNA, 576 bp, Bacillus subtilis; identical to SEQ ID NO: 38463
  CDS (1)..(576)

SEQ ID NO: 40390 - protein, 191 aa, Bacillus subtilis; identical to SEQ ID NO: 38464

SEQ ID NO: 40391 - DNA, 25 bp, Primer
atggcacgaaaaaccaaacaagaag

SEQ ID NO: 40392 - DNA, 23 bp, Primer
ttattcgttagtggcaggattac

SEQ ID NO: 40393 - protein, 36 aa, consensus; identical to SEQ ID NO: 38467
  MISC_FEATURE (1)..(36): consensus for the disclosure of xaa see table XV

SEQ ID NO: 40394 - protein, 47 aa, consensus; identical to SEQ ID NO: 38468
  MISC_FEATURE (1)..(47): consensus for the disclosure of xaa see table XV

SEQ ID NO: 40395 - DNA, 747 bp, Escherichia coli
  CDS (1)..(747)
atgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaa

SEQ ID NO: 40396 - protein, 248 aa, Escherichia coli
MKNIATGDVLERIRRLAPSHVTAPFKTVAEWREWQLSEGQKRCEEINRQNRQLRVEKILNRSGIQPLHRKCSFSNYQVQNEGQRYALSQAKSIADELMTGCTNFAFSGKPGTGKNHLAAAIGNRLLKDGQTVIVVTVADVMSALHASYDDGQSGEKFLRELCEVDLLVLDEIGIQRETKNEQVVLHQIVDRRTASMRSVGMLTNLNYEAMKTLLGERIMDRMTMNGGRWVNFNWESWRPNVVQPGIAK

SEQ ID NO: 40397 - DNA, 783 bp, Escherichia coli
  CDS (1)..(783)
atgcagcatgaaggccatgtgagaatcctcaaatccttgaaactctttggcatggcacacgccattgaggagttgggcaatcagaattcaccagcatttaatcaagccttgcccatgctggacagcttgattaaagctgaagtggcagagcgtgaagtacgttcggtgaactatcaattgcgggtggccaagttccccgtgtatcgggacttggtgggctttgacttcagtcaaagcctggttaatgaggccacggtcaaacaattgcaccggtgcgacttcatggaacaagcccagaacgtggtgctgattggtgggccaggcacaggcaagactcacctggccacagccattggtacacaagcagtgatgcacttgaaccgacgggtgcgtttcttctccaccgtggatttggtcaatgcactggagcaagagaaatcatctgggcgtcagggacaaatcgcaaaccgtctgttgtatgccgatttggtgattctggatgagctgggatatttgccttttagccaaaccggtggggcactgctgtttcacctgctctcaaagctgtacgaaaaaaccagcgtgatactgaccaccaacttgagcttctcggaatggagccgagtgtttggcgatgaaaagatgacaacagcgttgttggaccgactaacccaccactgccacatcctggaaaccggcaatgaaagttaccgcttcaaacacagttcaactcagaataagcaggaggaaaaacagacccgcaaactgaaaatcgagacataa

SEQ ID NO: 40398 - protein, 260 aa, Escherichia coli
MQHEGHVRILKSLKLFGMAHAIEELGNQNSPAFNQALPMLDSLIKAEVAEREVRSVNYQLRVAKFPVYRDLVGFDFSQSLVNEATVKQLHRCDFMEQAQNVVLIGGPGTGKTHLATAIGTQAVMHLNRRVRFFSTVDLVNALEQEKSSGRQGQIANRLLYADLVILDELGYLPFSQTGGALLFHLLSKLYEKTSVILTTNLSFSEWSRVFGDEKMTTALLDRLTHHCHILETGNESYRFKHSSTQNKQEEKQTRKLKIET

SEQ ID NO: 40399 - DNA, 783 bp, Streptococcus thermophilus bacteriophage 7201
  CDS (1)..(783)
atgagtttagaaaagacagctaagcaaatgagacagatgtatatgaccgctgacaacaaatactgcgacaagcaccaacgacattttgtaactattcagctaccaaacagcaagccatacactgtatgtgagagttgtcatcgtgaagagttagaacggatgaatgctttcaaagctcaagaacagtatgagcgtgagcaagagcagaaacgattatactttctcaaagatttcagcttgatggatgatgacttgaaaaatgccaatttcgacaattacaaggcagtaaccagaaatcagaaagaagacttgaagaatgttcgaagtcaactcagaggctatctcgatggccaggactacaacattgttcttatcggcaatactggagtaggcaagagccatctagcttattctgcgctcaaagccttgtctgaccatacgaaaaagatgggtgtattcatcaacgtagttgacctattagccaaaatcaaagaggatttcaaccttgaagctgagtatatcagacggatttcggaagctgaatggctagtgctcgatgatttgggaaccgagaaggtgacagagtggtctagcggtatcttgtacagcatactgaataaacgtacaaagacaataatcactaccaacctaagtccacaggacattttgggaacatatggtaaacgtgtctattcaaggatttttaagaagacaggacttggaacgactaatgaacacgtttatcaatttaaaacacaacaagataaaaggatgatgctttaa

SEQ ID NO: 40400 - protein, 260 aa, Streptococcus thermophilus bacteriophage 7201
MSLEKTAKQMRQMYMTADNKYCDKHQRHFVTIQLPNSKPYTVCESCHREELERMNAFKAQEQYEREQEQKRLYFLKDFSLMDDDLKNANFDNYKAVTRNQKEDLKNVRSQLRGYLDGQDYNIVLIGNTGVGKSHLAYSALKALSDHTKKMGVFINVVDLLAKIKEDFNLEAEYIRRISEAEWLVLDDLGTEKVTEWSSGILYSILNKRTKTIITTNLSPQDILGTYGKRVYSRIFKKTGLGTTNEHVYQFKTQQDKRMML

SEQ ID NO: 40401 - DNA, 786 bp, Plasmid R100
  CDS (1)..(786)
atgatgcagcatgaaggccatgtgagaatcctcaaatccttgaaactctttggcatggcacacgccattgaggagttgggcaatcagaattcaccagcatttaatcaagccttgcccatgctggacagcttgattaaagctgaagtggcagagcgtgaagtacgttcggtgaactatcaattgcgggtggccaagttccccgtgtatcgggacttggtgggctttgacttcagtcaaagcctggttaatgaggccacggtcaaacaattgcaccggtgcgacttcatggaacaagcccagaacgtggtgctgattggtgggccaggcacaggcaagactcacctggccacagccattggtacacaagcagtgatgcacttgaaccgacgggtgcgtttcttctccaccgtggatttggtcaatgcactggagcaagagaaatcatctgggcgtcagggacaaatcgcaaaccgtctgttgtatgccgatttggtgattctggatgagctgggatatttgccttttagccaaaccggtggggcactgctgtttcacctgctctcaaagctgtacgaaaaaaccagcgtgatactgaccaccaacttgagcttctcggaatggagccgagtgtttggcgatgaaaagatgacaacagcgttgttggaccgactaacccaccactgccacatcctggaaaccggcaatgaaagttaccgcttcaaacacagttcaactcagaataagcaggaggaaaaacagacccgcaaactgaaaatcgagacataa

SEQ ID NO: 40402 - protein, 261 aa, Plasmid R100
MMQHEGHVRILKSLKLFGMAHAIEELGNQNSPAFNQALPMLDSLIKAEVAEREVRSVNYQLRVAKFPVYRDLVGFDFSQSLVNEATVKQLHRCDFMEQAQNVVLIGGPGTGKTHLATAIGTQAVMHLNRRVRFFSTVDLVNALEQEKSSGRQGQIANRLLYADLVILDELGYLPFSQTGGALLFHLLSKLYEKTSVILTTNLSFSEWSRVFGDEKMTTALLDRLTHHCHILETGNESYRFKHSSTQNKQEEKQTRKLKIET

SEQ ID NO: 40403 - DNA, 774 bp, Staphylococcus aureus prophage phiPV83
  CDS (1)..(774)
atgaaaccgttattcaacgaaaaaataaacgaaagtttaaaaaagtatcaaccaatcgaagtaatactaagacagaattgcgataaatgtgggcgtcaatacgacttatataagtttgaaaatggatatgaatacaaagacggttgcgaatgcgaaattcaaagattggcttatgaagaatacaaaaggaataaacaaaagaaacttgattatattttcaatcaatcaaatgtcaatccgtcattaagagatgcaacagtcaacaactataagccacaaaatgaaaaacaagtacaagctaaacaaacagcaatagagtacgtacaaggcttctctacaaaagaaccaaaatcattaatattgcaaggttcatatggaactggtaaaagccacctagcatacgctatagcaaaagcagtcaaagctaaagggcatacagttgcttttatgcatatccaaatgttgatggatcgtatcaaagcggcatacaacaaaaatgcagttgaaactacagacgagctagtcagattgctaagtgatattgatttacttgtactagatgatatgggtgtagaaaacacagaacacactttaaataaactttttagcattgttgataacagagtaggtaaaaacaacatctttacaactaactttagtgataaagaactaaatcaaaatatgaactggcaacgtatcaattcaagaatgaaacacaatgcaaggaaagttagagtaatcggagacgatttcagggagcgagatgcatggtaa

SEQ ID NO: 40404 - protein, 257 aa, Staphylococcus aureus prophage phiPV83
MKPLFNEKINESLKKYQPIEVILRQNCDKCGRQYDLYKFENGYEYKDGCECEIQRLAYEEYKRNKQKKLDYIFNQSNVNPSLRDATVNNYKPQNEKQVQAKQTAIEYVQGFSTKEPKSLILQGSYGTGKSHLAYAIAKAVKAKGHTVAFMHIQMLMDRIKAAYNKNAVETTDELVRLLSDIDLLVLDDMGVENTEHTLNKLFSIVDNRVGKNNIFTTNFSDKELNQNMNWQRINSRMKHNARKVRVIGDDFRERDAW

SEQ ID NO: 40405 - DNA, 780 bp, Staphylococcus aureus temperate phage phiSLT
  CDS (1)..(780)
atgaaaccactattcagcgaaaagataaacgaaagcttgaaaaaatatcaacctactcatgtcgaaaaaggattgaaatgtgagagatgtggaagtgaatacgacttatataagtttgctcctactaaaaaacacccgaatggttacgagtataaagacggttgcaaatgtgaaatctatgaggaatataagcgaaacaagcaacggaagataaacaacatattcaatcaatcaaacgttaatccgtctttaagagatgcaacagtcaaaaactacaagccacaaaatgaaaaacaagtacacgctaaacaaacagcaatagagtacgtacaaggcttctctacaaaagaaccaaaatcattaatattgcaaggttcatacggaactggtaaaagccacctagcatacgctatcgcaaaagcagttaaagctaaagggcatacggttgcttttatgcacataccaatgttgatggatcgtatcaaagcgacatacaacaaaaatgcagtagagactacagacgagctagtcagattgctaagtgatattgatttacttgtactagatgatatgggtgtagaaaacacagagcacactttaaataaacttttcagcattgttgataacagagtaggtaaaaacaacatctttacaactaactttagtgataaagaactaaatcaaaatatgaactggcaacgtatcaattcaagaatgaaacacaatgcaagaaaagtaagagtaatcggagacgatttcagggagcgagacgcatggtaa

SEQ ID NO: 40406 - protein, 259 aa, Staphylococcus aureus temperate phage phiSLT
MKPLFSEKINESLKKYQPTHVEKGLKCERCGSEYDLYKFAPTKKHPNGYEYKDGCKCEIYEEYKRNKQRKINNIFNQSNVNPSLRDATVKNYKPQNEKQVHAKQTAIEYVQGFSTKEPKSLILQGSYGTGKSHLAYAIAKAVKAKGHTVAFMHIPMLMDRIKATYNKNAVETTDELVRLLSDIDLLVLDDMGVENTEHTLNKLFSIVDNRVGKNNIFTTNFSDKELNQNMNWQRINSRMKHNARKVRVIGDDFRERDAW

SEQ ID NO: 40407 - DNA, 885 bp, Bacteriophage bIL309
  CDS (1)..(885)
atgcagtcaatggcagatggaatccgagagttccataaaaagagagaagttaaaacaggtctattttgtgaaaaacatcaacaaaccgaacttgttagatataaacatccagtaagtatagattatgatccgttgattcatggcgagttagttgatggtttgcaggtaacctcaatgagttattgtacagaatgtgctaaagagggaatataccaacatcaccaacaatcaagtgctgaaataaaagcaaatgaagatttcttgaataaaagtaagtatggaaaatatagcttgcttaaaacacaaagccttgtgggcaaaaaatcgctctggtttgcacgtttcaatacttttaaggtaaatggcttagaagagcaaaacgtgttgaatcaggcccaaagaatagccagagagtacactcaaggtcagaggtttaacactgtgtttgttggcggagctggtagagggaaatctcacttagcaatggccattttgcaagaagttaacgagaatctcaaagatgataaattctcaacactatttatcaatattagtgaattgattcgagagataaaaaatagttggaattactctgataccaaggcggaagaagagcgactgacaacattaatgcgaacagttgatttgcttgttattgatgatttaggaactgaaagcacgttttctaaagataatagctgggtacaaggtgttatttacaatatttacaatgcaagagaaggcaatacgattatcacgtcaaaccttactggtaaagaaatgcgttcatcttatgacgataaaatagtttctcgaatcatggaaggctcaaaaaatagtgttgttaaatttgagggaattactgacaagaggaaaagtaaatga

SEQ ID NO: 40408 - protein, 294 aa, Bacteriophage bIL309
MQSMADGIREFHKKREVKTGLFCEKHQQTELVRYKHPVSIDYDPLIHGELVDGLQVTSMSYCTECAKEGIYQHHQQSSAEIKANEDFLNKSKYGKYSLLKTQSLVGKKSLWFARFNTFKVNGLEEQNVLNQAQRIAREYTQGQRFNTVFVGGAGRGKSHLAMAILQEVNENLKDDKFSTLFINISELIREIKNSWNYSDTKAEEERLTTLMRTVDLLVIDDLGTESTFSKDNSWVQGVIYNIYNAREGNTIITSNLTGKEMRSSYDDKIVSRIMEGSKNSVVKFEGITDKRKSK

SEQ ID NO: 40409 - DNA, 804 bp, Bacillus halodurans C-125
  CDS (1)..(804)
atgggtcaaaggttcaaaacaataggagaagttatggctcatctacaaaaacggatggaagagattcaatctcgttctatgaaccaggaaaatgggacaacgtcgacctcgacgacatcgaatgaagaaaaatacgactgtccgaagtgtaaagatattggttttattattactggtcgaaatacagcacgtgaatgtgaatgcgtggttcaaaggcggatcaaccgtctgtttaaagcgtcacaaatcacggatgaatttaaaaaactatcgttcaaaaactttattactaaaggaaaaccgcaggttattgttgatgcctataagtgtgcggctaattactgcaaagtgtttcctgaaatcagaaatactcgtcacaattcgatttgtttgcttggtcagcctggatctgggaaaacgcatctcttaatcgcggcatcaaattatttacttaaacgcggagttagtgttttgtattttccttaccgagaagggttcgatgaaattaaagatgatttggacgcgttggaagaaaaggcgagtcgcatgaaagaggtagatgttttgtttattgacgacctgtataaacgcggagcgacggagtttgaaattaaaactatgttttctgtgattaattaccgttatttgaatcataagccgattatggtctcctctgagcttttagaggacgaccttctcgatatcgacgaagctctcggctctcggatcttggaaatgggaaaagattttacggttgcgattaccggtgatagaaaactgttaaatcatcgcttagcaaaatag

SEQ ID NO: 40410 - protein, 267 aa, Bacillus halodurans C-125
MGQRFKTIGEVMAHLQKRMEEIQSRSMNQENGTTSTSTTSNEEKYDCPKCKDIGFIITGRNTARECECVVQRRINRLFKASQITDEFKKLSFKNFITKGKPQVIVDAYKCAANYCKVFPEIRNTRHNSICLLGQPGSGKTHLLIAASNYLLKRGVSVLYFPYREGFDEIKDDLDALEEKASRMKEVDVLFIDDLYKRGATEFEIKTMFSVINYRYLNHKPIMVSSELLEDDLLDIDEALGSRILEMGKDFTVAITGDRKLLNHRLAK

SEQ ID NO: 40411 - DNA, 747 bp, Escherichia coli O157:H7
  CDS (1)..(747)
atgaaaaacattgcggcagccggggttcttgaacgtattcgcagacttgcaccacaggcgtcggttccaccgtaccggacggtggaggagtggcgggaatggcaacttgctgaaggacgaaaacgcagcgaggagattaaccgccagaatcaccagttgcgggtggaaaaaatcctgaatcgttcgggcatccagcctctgcacagcaaatgctcgtttgcgaattatcaggtgcagaacgacgggcaaaaatacgcgctgagccaggccaaatccatagctgacgaactgatgaccgggtgcacgaattttgtgttcagcggtaaaaccggcaccgggaaaaatcaccttgcagcggcgatgggtaaccggctgatggcgaaggggcgcagcgtgattatcgtcaccgtgtctgatgtcatgagcgtgttgcatgacagctacgacaacggcaaatccggggaaaaatttttacaggagctttgcagtgttgatttgctggtcctggatgaaataggcgttcagcgggagacgaaaaacgagcaggtggtattacaccagataattgatcgccggacagcatcactgtgcagtgtcgggatgttaacaaacctgaatcatgccgcaatgagtacacttcttggtgagaggattatggaccgcatgaccatgaacggtggtcgatgggtgacgtttaactgggatagctggcgtccaaatgtcagcaatatgagggttgtgaagtaa

SEQ ID NO: 40412 - protein, 248 aa, Escherichia coli O157:H7
MKNIAAAGVLERIRRLAPQASVPPYRTVEEWREWQLAEGRKRSEEINRQNHQLRVEKILNRSGIQPLHSKCSFANYQVQNDGQKYALSQAKSIADELMTGCTNFVFSGKTGTGKNHLAAAMGNRLMAKGRSVIIVTVSDVMSVLHDSYDNGKSGEKFLQELCSVDLLVLDEIGVQRETKNEQVVLHQIIDRRTASLCSVGMLTNLNHAAMSTLLGERIMDRMTMNGGRWVTFNWDSWRPNVSNMRVVK

SEQ ID NO: 40413 - DNA, 1386 bp, Mycoplasma pulmonis UAB CTIP
  CDS (1)..(1386)
atgagtaaaaaaagccttgacaaaatagatttactagcttataacaagacattgcaagatatttttgagtcaaaaataaacgattcaatgctctatcaaaatatttttaagtttctagaaattactaaagtaacttttgaccaagtcaaaattgcagcacctaatcaagatgtgataaatcacttaaattctgatttcaaagaagatataaaagattgtattttccaactttttggagaaaatagagaaataacttttacaagtggaaaaaaagactcttctgaatctcctaaaaaaagcgaagagaatattcaattggtagaagagagccaaaataatgatgaacttatcaaaaaatttacttttgataattttattcaatcaaaatttaatgaaaatgcctttttaattggtaaggaaataattgaaaatcctggtatttataatccagttttaataagtggggattctggattaggaaaaactcaccttttaaatgcaattggtaatgaatttttgaaaaaatatcctaaaagcattgtcaaatttttgactccaagtgatttttatagaaaaatcatgcctattctttcatcaaataacattaatgaaaatgctaaaaaattcaaagaattaactgaagctgacttggttatgtttgatgattttcaaatttttagtattggaaacaaaagagcaactctaaattttatctttgaaatactagataaaagaataatgaacaataaagttaccattttaactagtgataaagacttaaaattcatggcttctttgtttgaacaaagactttatacccgtctttcttcaggtttgagtgttgaaattgaacaaccaaacaaagaagacatgcttaaaattcttaaattccagctaaaaatcaagaatttaagtccagaaaaatgagaaaaagatgctcttgattttatggttagaaacttttctaaatcaataaggtttttagaaggagctcttgataaagtgcactttttccaactaaaaaaacaaataaatgaatttaataagctaactattagcaatatttttaaaaatgttgaaatcaccaaggaaaacacaactcctgaacgaatcattgaacatgtggctaattactacaaacttccaaagcatgaattaatcagtaaatctagaaaaagtaacttagttgtggctagagatatggctatttatttaattcgagaagatttaaattactctttttctaggattggcctaattttttcgaacagagatcattcaacaatcttcaattctcatcgaaaaatatcacaaagcattaatagccatgattcaactaagtacacaattactaccttaaggtcaaaaatcaacaaactaagttag

SEQ ID NO: 40414 - protein, 461 aa, Mycoplasma pulmonis UAB CTIP
MSKKSLDKIDLLAYNKTLQDIFESKINDSMLYQNIFKFLEITKVTFDQVKIAAPNQDVINHLNSDFKEDIKDCIFQLFGENREITFTSGKKDSSESPKKSEENIQLVEESQNNDELIKKFTFDNFIQSKFNENAFLIGKEIIENPGIYNPVLISGDSGLGKTHLLNAIGNEFLKKYPKSIVKFLTPSDFYRKIMPILSSNNINENAKKFKELTEADLVMFDDFQIFSIGNKRATLNFIFEILDKRIMNNKVTILTSDKDLKFMASLFEQRLYTRLSSGLSVEIEQPNKEDMLKILKFQLKIKNLSPEKWEKDALDFMVRNFSKSIRFLEGALDKVHFFQLKKQINEFNKLTISNIFKNVEITKENTTPERIIEHVANYYKLPKHELISKSRKSNLVVARDMAIYLIREDLNYSFSRIGLIFSNRDHSTIFNSHRKISQSINSHDSTKYTITTLRSKINKLS

SEQ ID NO: 40415 - DNA, 849 bp, Clostridium acetobutylicum ATCC 824
  CDS (1)..(849)
atggaccaactaaacaagataacaccgacagggacagagaaggtatcggaatcaagctgtaataagcttgaagaaacttgcactaagtgtggtaagaatatttataagaaagtaactatcttaggtatagataggattgttaagacaatgtgtgagtgtgagagtaaagcatggcatgaaaaaagacaacatgaagaaatgcttaaaaagcaaaacaggcttaatgagttaataacaaatagtttgatggatgaaaagtttagagaaagtaatttcgaaaactgggattttaataaaggttccagaagcatgtataacttagggagaagatatgcagataattttaaagaatgtaagcaacaaggattgggattattaatttacggtagcgctggaaatggaaagacttatcttgcaagtgcaatagcaaatgagcttttaaagcagtatataccagttgtatgtgttagcataaatggacttttaagcaggatacaaaagacatacaacagctgggggaaagaagctgaaagcgatattattagaagttttataaatgcagatttattaattatcgacgatttaggaactgaaaagagttcggaatggtccaggagcatgatctataacatagttgatagcagatatagaagcaagttaccacttataattacatcaaatttagaaataaatccaagcaaaagacatggggtattagcggaccaataccatgagcgcacagaaagtagaatatttgaaatgtgtacgccggttgaaaatacatccaaaagtataaggatagaggaagctaagaagaaaacagaacttcttagaaaaatattgtattga

SEQ ID NO: 40416 - protein, 282 aa, Clostridium acetobutylicum ATCC 824
MDQLNKITPTGTEKVSESSCNKLEETCTKCGKNIYKKVTILGIDRIVKTMCECESKAWHEKRQHEEMLKKQNRLNELITNSLMDEKFRESNFENWDFNKGSRSMYNLGRRYADNFKECKQQGLGLLIYGSAGNGKTYLASAIANELLKQYIPVVCVSINGLLSRIQKTYNSWGKEAESDIIRSFINADLLIIDDLGTEKSSEWSRSMIYNIVDSRYRSKLPLIITSNLEINPSKRHGVLADQYHERTESRIFEMCTPVENTSKSIRIEEAKKKTELLRKILY

SEQ ID NO: 40417 - DNA, 990 bp, Clostridium acetobutylicum ATCC 824
  CDS (1)..(990)
gtgacgatgattaaaggatattctgaaaaagtagaaaaaatttattctaaactaagaaaaactgaagaagataacttaaaaagcagaagagaagaaattaaagacaaattaccaaagataataaagatagattccgagataagtagactttgcctaaaattatctacaaatatatttaaaaagataaataatcgtgatgaatatataaagtccttaaaaaatgaaataacaaacttaagaatggaaagatctgaacttctagtttctaatggataccctatggattatcttcaaatgcattataactgcagtaaatgtaaagatacaggatatataggtgcacataaatgttcctgctataaaaaatacttagttcaactttactatgataattctgatcttaaaagtcttttaaacgaaaataactttgagaattttaatataaactattattcaaatagaaaatcagaagatgagccaagaactcctagaaagaatatggaaaagattctttctttatctttaaattacatcaaaaattttagcgattcaaacgaaaacctattgttctatggcaattcaggaacaggaaaaacctttttatcacattgtatagcaaaagatttattagaaagaggttttctagtaatttataaaacctcagcagatttagcacaagagcttaaacagcttcagtttgaacctaatcctactctagaagatttaataataaactgtgatttacttataattgatgatttgggtacagaacagataagtgcattctcaaaaacttgcttctttaatctaataaataaaaagttgctttcgcaaaagaaaatgcttatatcttcaaattataatttagaagaactgacaagattatattcagaaagaattacctctagattatttggcgatttcaccctatgtaaattttatggtgacgatataagaataaatagaaacttaaaaaataaaaagatataa

SEQ ID NO: 40418 - protein, 329 aa, Clostridium acetobutylicum ATCC 824
MTMIKGYSEKVEKIYSKLRKTEEDNLKSRREEIKDKLPKIIKIDSEISRLCLKLSTNIFKKINNRDEYIKSLKNEITNLRMERSELLVSNGYPMDYLQMHYNCSKCKDTGYIGAHKCSCYKKYLVQLYYDNSDLKSLLNENNFENFNINYYSNRKSEDEPRTPRKNMEKILSLSLNYIKNFSDSNENLLFYGNSGTGKTFLSHCIAKDLLERGFLVIYKTSADLAQELKQLQFEPNPTLEDLIINCDLLIIDDLGTEQISAFSKTCFFNLINKKLLSQKKMLISSNYNLEELTRLYSERITSRLFGDFTLCKFYGDDIRINRNLKNKKI

SEQ ID NO: 40419 - DNA, 738 bp, Sinorhizobium meliloti 1021
  CDS (1)..(738)
atgcttgcccatccaacactggataaattgaatgccatgggcctggccggcatggcaaaggcctttggcgaacttgttgccaacggcgaagccgaacatctctcgcacgccgaatggctcggactgctgctcgaacgggagtggagctcccgttacgatcggaagcttgcggcacgcctcaggtttgccaagcttcgccaccaggccaccccagaagatgtcgactatcgcgccgaccgcggcctcgaccgtgctctcttcatgaagctgctcggtggcgactggatcaacgcccatgacaatctggccatttgcggaccctcgggtgtcggaaagagttggttggcttgcgctctcggccacaaggcttgccgagacgatcgctcagttctctatcagcgtgtcccaaggctgtttgcccagcttgcgctcgcgcgtggtgatggccgctacgcccggctgcaacgaaccttgggccatgttcagctcctgatactggatgattgggggctcgagccgctcaacgaacaggcccgccacgacctgctggaaatcctcgaagatcgctatggccgtcgatccacgatcatcaccagccagcttcccgtatccgcatggcacagcgtcataggagacccgacttacgccgatgccatcttggatcgcctcgtccacaatgcccaccgtgtcgaattgagcggcgacagtctgcgccgaaacctaccgcgaaaagcttga

SEQ ID NO: 40420 - protein, 245 aa, Sinorhizobium meliloti 1021
MLAHPTLDKLNAMGLAGMAKAFGELVANGEAEHLSHAEWLGLLLEREWSSRYDRKLAARLRFAKLRHQATPEDVDYRADRGLDRALFMKLLGGDWINAHDNLAICGPSGVGKSWLACALGHKACRDDRSVLYQRVPRLFAQLALARGDGRYARLQRTLGHVQLLILDDWGLEPLNEQARHDLLEILEDRYGRRSTIITSQLPVSAWHSVIGDPTYADAILDRLVHNAHRVELSGDSLRRNLPRKA

SEQ ID NO: 40421 - DNA, 747 bp, Salmonella enterica subsp. enterica serovar Typhi str. CT18
  CDS (1)..(747)
atgaaaaatattgcgacaggaggcgttctggagcgtatccgcagactgaccccaccacatgtaaccgccccattcagaacggttgcggagtggcgcgagtggcaacttgctgaaggccagaaacgttgcgaggagatcaaccgcctgaatcgtcagttgcgggtggaaaaaatcctgaatcgctctggcatccagccgttgcaccgcaaatgctcgtttgcgaattaccaggtgcagaacgaagggcagcgatacgcgttaagccaggcgaaatccatcgccgatgaactgatgaccgggtgtacaaattttgcgttcagcggaaaacctggtaccgggaagaatcacttagcggcagctatcgggaatcgcctgctgaaagacggtcagacagtgattgtggttaccgtggctgatgtcatgagcgccctgcacaccagctatgacgacgggcagtcaggcgaaaaatttttgcgggagctgtgcgaagtggatctgctggttcttgatgaaattggcattcagcgcgagacgaaaaacgagcaggtggtactgcaccagattattgatcgacggacagcgtcgatgcgtagcgtgggaatgctgacaaacctgaactatgaggccatgaaaacattgctcggcgagaggattatggatcgcatgaccatgaacggcgggtgttgggtgaattttaactgggagagctggcgtccgaatgtcgtccagccaggaattgcgaagtga

SEQ ID NO: 40422 - protein, 248 aa, Salmonella enterica subsp. enterica serovar Typhi str. CT18
MKNIATGGVLERIRRLTPPHVTAPFRTVAEWREWQLAEGQKRCEEINRLNRQLRVEKILNRSGIQPLHRKCSFANYQVQNEGQRYALSQAKSIADELMTGCTNFAFSGKPGTGKNHLAAAIGNRLLKDGQTVIVVTVADVMSALHTSYDDGQSGEKFLRELCEVDLLVLDEIGIQRETKNEQVVLHQIIDRRTASMRSVGMLTNLNYEAMKTLLGERIMDRMTMNGGCWVNFNWESWRPNVVQPGIAK

SEQ ID NO: 40423 - DNA, 750 bp, Salmonella typhimurium LT2
  CDS (1)..(750)
atgaaaaacgtaatcggtactggcagtgcgcttgatcgcctgaaaagaattatcccagccagtgtgcagccgaaattctcgactgctgatgagtggcgggcatggcaggaagccgaagggcgtaaacgcagtgaagagcttgacaggatgaatcagaaatcccgcaccgagaagattttcgggcgatctggcattcaggatctccatcgtagctgtacgtttgctaactacgaagtaagcggggaggggcagcgaaaagcgtacacgatggcaaaaagttatgcccagaacttcggtagtggatttgcgagctttgtgttcagcggtggtccgggaaccgggaaaaaccatcttgcggcggcaatcggaaatcatctgctggccggcggtcatagcgttctggtggtaactattcctgacctgatgctcagggttcgtgagtgctacgacggtgggcaatcagaagcgtccctgcttgatgacctttgtaaagttgacctgctggtactggatgaagtcggtattcagcgcggaagcagtggtgagaaggtcattctcaatcaggttatcgatcgccgtctctcatcgatgcgacctgttggcgttctgacgaatcttaaccacgaggggctgttggattcactgggcgcgagggttatcgatcgcctccagatggacggagggatgtgggtgaattttgactgggaaagctaccggaaaaacgttagccacctccggattgtgaaataa

SEQ ID NO: 40424 - protein, 249 aa, Salmonella typhimurium LT2
MKNVIGTGSALDRLKRIIPASVQPKFSTADEWRAWQEAEGRKRSEELDRMNQKSRTEKIFGRSGIQDLHRSCTFANYEVSGEGQRKAYTMAKSYAQNFGSGFASFVFSGGPGTGKNHLAAAIGNHLLAGGHSVLVVTIPDLMLRVRECYDGGQSEASLLDDLCKVDLLVLDEVGIQRGSSGEKVILNQVIDRRLSSMRPVGVLTNLNHEGLLDSLGARVIDRLQMDGGMWVNFDWESYRKNVSHLRIVK

SEQ ID NO: 40425 - DNA, 738 bp, Salmonella typhimurium LT2
  CDS (1)..(738)
atgaaaaatgttggcgacctgatgcagcgtctacaaaaaatgatgcctgcgcatattacgccggcgtttaaaacgggcgaagaattgctggcgtggcagaaagagcaaggcgagatccgggcggcagcgctggcgcgggaaaaccgggcgatgaaaatgcagcgcacctttaaccgttccggcattcgaccgctgcatcagaactgttcgtttgataactatcgggttgagtgcgacggacaaatgaacgcgttaagcaaagcccgacagtacgttgatgagtttgacggcaatatcgccagctttgtcttttccggcaagccgggaaccggtaaaaaccatctcgccgcggctatttgtaacgagctgctgctgcgcggaaagtcggtactgattatcaccgtagcggatattatgtcagcgatgaaagacacgttcagcaatcgggaaaccagcgaagagcagttgcttaacgatctgagtaacgttgatctgctggtgatcgacgagatcggcgtgcagaccgaatcccgctatgaaaaagtgatcatcaatcaaattgtcgatcgtcgttcctcgtcaaaacgtcccaccggcatgttgacgaacagcaatatggaagagatgacgaaaatgcttggcgaacgcgtcatggaccgtatgcgtctcggcaacagtttatgggttaattttacctgggacagttaccgcagccgggtgacgggtaaagagtattaa

SEQ ID NO: 40426 - protein, 245 aa, Salmonella typhimurium LT2
MKNVGDLMQRLQKMMPAHITPAFKTGEELLAWQKEQGEIRAAALARENRAMKMQRTFNRSGIRPLHQNCSFDNYRVECDGQMNALSKARQYVDEFDGNIASFVFSGKPGTGKNHLAAAICNELLLRGKSVLIITVADIMSAMKDTFSNRETSEEQLLNDLSNVDLLVIDEIGVQTESRYEKVIINQIVDRRSSSKRPTGMLTNSNMEEMTKMLGERVMDRMRLGNSLWVNFTWDSYRSRVTGKEY

SEQ ID NO: 40427 - DNA, 864 bp, Listeria innocua Clip11262
  CDS (1)..(864)
ctgaagcagatgaacaagaaaaaaactggaatggtggtgctaaaaagaatgcgcgagcagaaccagcaaaacaagaaattaaaatcagcgaccaatataatttcggagctacaagaacggattgatagacatacgcttaccgaagcagatgagcaaaaaatccgaaaacagattgcaaaagaagatgccgagctggcagctaaagcacttgactctgatagaaatcaccagttaaacaaaatattttctaatagcatgattaataaaaagcttgaaaatgcgagttttgaaaactatcacgcagagaacgaagagaatgcaaaagctctagcagtttgtagacggtttgtagaaacgtttaatcttaatcagcctagaagcttgctactaacaggtgcatatggtgttggcaaaagtcatttagcggcttccattatgcgagatattagtgaaatagatattgtactaaaaagagacaatgaacgtgatgtcgtgttaaagacgagaaaaccaacgatgatttttattaacacgcctaagttattaacaaaaattagatcatcttttagtaagacgagtgagtttactgaagcagatttgttaaatgaaatcgaaagcgtagacctcctggtcttagatgattttggaagtgaaatcaaagaagcaaataacgattttgcagtacaaaagattttcgaaattgtagaaggccgtgttgggaaacacactgtttatactacgaactttaacgtagatgaactttttaatttctatggagaacgtaattttagcagaattatggaagatggaaatttaattcaaatgtcaggagaaaattatagattgcgaggatttaaaaaatga

SEQ ID NO: 40428 - protein, 287 aa, Listeria innocua Clip11262
MKQMNKKKTGMVVLKRMREQNQQNKKLKSATNIISELQERIDRHTLTEADEQKIRKQIAKEDAELAAKALDSDRNHQLNKIFSNSMINKKLENASFENYHAENEENAKALAVCRRFVETFNLNQPRSLLLTGAYGVGKSHLAASIMRDISEIDIVLKRDNERDVVLKTRKPTMIFINTPKLLTKIRSSFSKTSEFTEADLLNEIESVDLLVLDDFGSEIKEANNDFAVQKIFEIVEGRVGKHTVYTTNFNVDELFNFYGERNFSRIMEDGNLIQMSGENYRLRGFKK

SEQ ID NO: 40429 - DNA, 780 bp, Bacteriophage phi ETA
  CDS (1)..(780)
atgaaaccactattcagtgaaaagataaacgaaagtttgaaaaaatatcaacctactcatgtcgaaaaaggattgaaatgtgagagatgtggaagtgaatacgacttatataagttcgctcctactaaaaaacacccggatggttacgagtataaagacggttgcaaatgtgaaatctatgaggaatataagcgaaacaagcaacggaagataaacaacatattcaatcaatcaaacgttaatccgtctttaagagatgcaacagtaaacaactacaagccacaaaatgaaaaacaagtacacgctaaacaatcagcaatagagtatgtacagggtttctctacaaaagaaccaaaatcattaatatttcaaggttcatatggaactggtaaaagccacctagcatacgctatcgcaaaagcagttaaagctaaagggcatacagttgcttttatgcatataccaatgttgatggatcgtatcaaagcgacatacaataaaaatgcagtagagactacagacgaactagtcaaattacttagtgagattgatttacttgtactagatgatatgggtgtagaaaacacagaacacactataaataaacttttcagcattgttgataacagagtaggtaaaaacaacatctttacaactaactttagtgataaagaattaaatcaaaatatgaactggcaacgtataaattcgagaatgaaaaaaagagcaagaaaagtaagagtaatcggagacgatttcagggagcgagatgcgtggtaa

SEQ ID NO: 40430 - protein, 259 aa, Bacteriophage phi ETA
MKPLFSEKINESLKKYQPTHVEKGLKCERCGSEYDLYKFAPTKKHPDGYEYKDGCKCEIYEEYKRNKQRKINNIFNQSNVNPSLRDATVNNYKPQNEKQVHAKQSAIEYVQGFSTKEPKSLIFQGSYGTGKSHLAYAIAKAVKAKGHTVAFMHIPMLMDRIKATYNKNAVETTDELVKLLSEIDLLVLDDMGVENTEHTINKLFSIVDNRVGKNNIFTTNFSDKELNQNMNWQRINSRMKKRARKVRVIGDDFRERDAW

SEQ ID NO: 40431 - DNA, 759 bp, Bacteriophage P27
  CDS (1)..(759)
atgcgcgaagggcacggatactgcgaaaaacatggcgaataccatgcgcatattctggtgtggagcgctcgtaatggcgaggacagagaaaaaatttcatgctgccctgactgcttgatcgctgaggccaacgatttgaccatggagctgtcgtccctcaaggcggaagagctgactgataacgcaggaattgccctgcgttttcgggactgtgagtttgataattatctggaggttaatcctgatgcagccagaaatcttgcggcctgtcgccgctatgcggagaactggccagatatgctggagaacggtaccagtcttgttatgaccggtagttgcggaaccgggaaaaatcatctggcggtatcaatggcaaaacacatcatccgtaactatctggccagtgtggagatcaccgacgtgatgcgccttacccgtgctgtgaaaaactgctggcggaatgacagcgaaaaaacagcggatgaagttattgagcattatgcgtcaatggatttgctgatcatcgacgaagtcggcgttcagtttggtagtgcggctgaaatggcaattcttcaggaaatcatcaatgcccggtacgaaagtatcttgcccaccatcctgatcagcaacctttcaccggaagagttgtgggcgttcatcagcccccgcattgccgacaggatcacagatggggggcgcaactggttgtcgttcaactggcccagctaccgtgcgcatattggaggtgtggcagcatga

SEQ ID NO: 40432 - protein, 252 aa, Bacteriophage P27
MREGHGYCEKHGEYHAHILVWSARNGEDREKISCCPDCLIAEANDLTMELSSLKAEELTDNAGIALRFRDCEFDNYLEVNPDAARNLAACRRYAENWPDMLENGTSLVMTGSCGTGKNHLAVSMAKHIIRNYLASVEITDVMRLTRAVKNCWRNDSEKTADEVIEHYASMDLLIIDEVGVQFGSAAEMAILQEIINARYESILPTILISNLSPEELWAFISPRIADRITDGGRNWLSFNWPSYRAHIGGVAA

SEQ ID NO: 40433 - DNA, 996 bp, Clostridium perfringens str. 13
  CDS (1)..(996)
atgattaaaggttataaaagtcaattgatggatatgtatgaaaaaatccgtcaaaaagaaaaatcaaatctagctaatagacaaaaagagttaaaagaaaagctacctcaagtttttgagtatgaaagagaaataaataagctttctttaaaactttcaatgcttgctttaagaaaacatgaaaaagatagttttgaaaaattaaaaaaagaaattgaaaatcttagagatgaaaaagatcaactacttgctatgagtggatatccaaaagattatttagatatgcattatacctgtccatcttgcaaagatacaggatatataggcactaaaaaatgtatttgttataagaaaaaacttgtagacatatactatgagaattctcatatggctgatgctttaaaactaaataatttttcaaaatttgatataaatgttttttctcctttaaataatggtaatgaaaagtattctccaagagaaaatatgcaaataatcattgataagatggttaatggatatatccctaaatttgataagcataatgaaaatatacttttctatggtagtcctggaactggaaaaacatttttaacttattgcatagctaaagaattattagataatggatttcttgtagtttatagaacatcagatgaacttattagaaatcttagagaaatacgatttaataatgatcatgaattagaagatttgcttataaattgtgacttacttgttatagatgacttaggcgcagaacaaataactgatttctctacaactgagttatttacccttctaaacaaaaaaatattattaaataaaaagatgattatatctacaaatttaaatcttcctgaattgaagcaagcttatgcagaaagaataacttctagattgctaggaaactttcttctatttaaaacttacggagatgacataagaataaagaaaaatcttcaaaaaagaaaaaatacaccttatcttacttaa

SEQ ID NO: 40434 - protein, 331 aa, Clostridium perfringens str. 13
MIKGYKSQLMDMYEKIRQKEKSNLANRQKELKEKLPQVFEYEREINKLSLKLSMLALRKHEKDSFEKLKKEIENLRDEKDQLLAMSGYPKDYLDMHYTCPSCKDTGYIGTKKCICYKKKLVDIYYENSHMADALKLNNFSKFDINVFSPLNNGNEKYSPRENMQIIIDKMVNGYIPKFDKHNENILFYGSPGTGKTFLTYCIAKELLDNGFLVVYRTSDELIRNLREIRFNNDHELEDLLINCDLLVIDDLGAEQITDFSTTELFTLLNKKILLNKKMIISTNLNLPELKQAYAERITSRLLGNFLLFKTYGDDIRIKKNLQKRKNTPYLT

SEQ ID NO: 40435 - DNA, 735 bp, uncultured bacterium
  CDS (1)..(735)
atgctgaaccagcagacccaaagcaagctccagcaattgcaactgtccggcatggccaaggcctaccgcgaccagcttgagcaaccgcgcatgcaggaattgccctttgatgaccgcttgggcctgatggtggatcgtgaactcagcgagcgcgagaaccgcaaactgtcgcggctactgaaacaggcgaagctgcgctatgccgcgcacctggaagatatggactatcgcagtagtcgcggcctggataagcaagtgatcgccggcctggcgggctgcgcctggatcggtcagcaacagaacctgctgctgactggagccaccggcacaggtaaaagctggctcgcctgcgcatttggcagccaggcgtgccgacagggctattcggtgatctacaaaagtgcctcgaagctctatgaagagctgcaaattgccattggcgatgggtctctacccaagtaccgaacggctttgagcaaagtccatttactcatcctcgatgacttcggactagctccagtagaacccacggtgggatataccttgctggatattgtcgatcagcgcatgcagaccggttcgctgatcatcaccagtcagttccctacagagcattggcacagcatgttcagcgacgccacgctggccgaggccatcttggatcgtatcgttcaccgctcgcaccgtatcgggctcaagggcgagtccctgcgcaaacaggctgccaaggcataa

SEQ ID NO: 40436 - protein, 244 aa, uncultured bacterium
MLNQQTQSKLQQLQLSGMAKAYRDQLEQPRMQELPFDDRLGLMVDRELSERENRKLSRLLKQAKLRYAAHLEDMDYRSSRGLDKQVIAGLAGCAWIGQQQNLLLTGATGTGKSWLACAFGSQACRQGYSVIYKSASKLYEELQIAIGDGSLPKYRTALSKVHLLILDDFGLAPVEPTVGYTLLDIVDQRMQTGSLIITSQFPTEHWHSMFSDATLAEAILDRIVHRSHRIGLKGESLRKQAAKA

SEQ ID NO: 40437 - DNA, 774 bp, Methanosarcina acetivorans C2A
  CDS (1)..(774)
atgaacaacttcacctatgagagacttcacaataacctgcaatacctgaaacttaattctatcaaagagcttctggataactaccttgaaattgctgcaagggacaacaagacaacaatggaagtccttgattatctgtttgaacaggaaaagaaacacagagaagctgttgcaattgagagaaggatgaaaagtgcagtttttcccgttaaaaagactcttgaggaattcgattttgaatttcagaaatccattgataaaaaagcaatcgaagaccttgcaaccttgagatttgttcataattcagagaatgtcgttttccttggtcctcccggagttggaaagtctcatcttgcaatcgctcttgggattgaagtagcaaaagcagggatttcggtttactttaccaatacaggaaaccttatcgagaagttgaaaatagcaaatcgagaaggaatgcttgaaaagaaactaagggacttgatgaaatataaagtgctgataattgacgaaatagggtatctcccatttgacgaagaaggagctcactgcctatttcagctgatctcaagacggtatgaaaagagttcaacgatcttgacatcaaataaatcatatggagaatggggagagatattcaaggaccatgtaatagcggctgctgtacttgataggattctccaccattcaactacgattaacatcaaaggggaaagttacaggctgaaagaaaggaagaaacagggaataaaaacaggaaatatatgccagtaa

SEQ ID NO: 40438 - protein, 257 aa, Methanosarcina acetivorans C2A
MNNFTYERLHNNLQYLKLNSIKELLDNYLEIAARDNKTTMEVLDYLFEQEKKHREAVAIERRMKSAVFPVKKTLEEFDFEFQKSIDKKAIEDLATLRFVHNSENVVFLGPPGVGKSHLAIALGIEVAKAGISVYFTNTGNLIEKLKIANREGMLEKKLRDLMKYKVLIIDEIGYLPFDEEGAHCLFQLISRRYEKSSTILTSNKSYGEWGEIFKDHVIAAAVLDRILHHSTTINIKGESYRLKERKKQGIKTGNICQ

SEQ ID NO: 40439 - DNA, 984 bp, Thermoanaerobacter tengcongensis MB4
  CDS (1)..(984)
atgaatgaaaatataattcatgagatacttaaagagtatgaaatgaaaagagataaggcagagagagaagcccttctaagaagaaaccgactgtacaaagaaatacccgaacttgaaaaaatagatgacaagataaaagagataggcattcaaataactcaggcaatattcaaagaaccagaaaaaggcaaagaattgttgaactccctgagagaaaaattaaattttttaaaaaaaaagaaaacagaaatactaaaatctcatgggtatcctgaagactatttggagccaaaatacgagtgcaacatatgcaaagacacaggctatgtaaatggaaagcgctgcaaatgttttaatcaaaagctcataaatatctactacaagcagtccagcatagcagaaattctccagaaagaaaacttctccaactttaactttgaatattattcagataaaccctacggggacaagccctctccccgcgccaatatgagaaccatagtggaatttgccttaaacttcatcaaacactttgacaccattgaagaaagcctctttttctacggcaattcaggattgggcaaaacttttctcgccaactgtatagcaaaagagcttctagacagaggaaaaagcgtaatttacagaactgctcccgacttaattgaaggcttgaggataaacaaattaaaccccgatagtgaaatttacaatgaatatctggaacttctgaaggagtgtgaccttttaataatagacgatttgggaacagagccaataacggctttcagccttcaagaatttttcaacatcttaaacacaagacttctgctaggaaaaaaatttataatctctactaatctgcctttatcagaaataatggctatatacccggaaagaatttattcgcgcatctttggtcatttcaagctcctcaacttttacggagaggacataaggttaaagaaaaagatgataatctaa

SEQ ID NO: 40440 - protein, 327 aa, Thermoanaerobacter tengcongensis MB4
MNENIIHEILKEYEMKRDKAEREALLRRNRLYKEIPELEKIDDKIKEIGIQITQAIFKEPEKGKELLNSLREKLNFLKKKKTEILKSHGYPEDYLEPKYECNICKDTGYVNGKRCKCFNQKLINIYYKQSSIAEILQKENFSNFNFEYYSDKPYGDKPSPRANMRTIVEFALNFIKHFDTIEESLFFYGNSGLGKTFLANCIAKELLDRGKSVIYRTAPDLIEGLRINKLNPDSEIYNEYLELLKECDLLIIDDLGTEPITAFSLQEFFNILNTRLLLGKKFIISTNLPLSEIMAIYPERIYSRIFGHFKLLNFYGEDIRLKKKMII

SEQ ID NO: 40441 - DNA, 588 bp, Methanosarcina mazei Go1
  CDS (1)..(588)
atgaaaaatgaaggttttcctgtgaaaaagacgcttgaagaattcgattttgagtttcagttatctattgataaaaaagtcatagaagaccttgcaaccttgagatttgttcataatgcagaaaacgttgttttgctcggtcctcctggcgttggaaagtcgcatcttgcaattgctcttggaattgaagcggtaaaagcaggaatttcggtttactttaccaatacaggaaaccttattgaaagattgaaattagcaaatagagaaggaatgcttgaaaagaaactcagagacttgatgaagtataaagtgctgatgatcgatgaaataggatatctcccatttgacgaagaaggagctcactgcttatttcagctaatctccagacgttatgaaaagtgttcaacaatcctgacatcgaataagtcatatggagaatggggagagatattcaaggaccatgtaatagcggctgccttgcttgatcggatactccatcattgtactactattaacatcaaaggggaaagttacaggctgaaagaaaggaaaaaacagggtataaaaacggtaaatatctatcagtaa

SEQ ID NO: 40442 - protein, 195 aa, Methanosarcina mazei Go1
MKNEGFPVKKTLEEFDFEFQLSIDKKVIEDLATLRFVHNAENVVLLGPPGVGKSHLAIALGIEAVKAGISVYFTNTGNLIERLKLANREGMLEKKLRDLMKYKVLMIDEIGYLPFDEEGAHCLFQLISRRYEKCSTILTSNKSYGEWGEIFKDHVIAAALLDRILHHCTTINIKGESYRLKERKKQGIKTVNIYQ

SEQ ID NO: 40443 - DNA, 798 bp, Methanosarcina mazei Go1
  CDS (1)..(798)
atgaacaacttcacttatgagaagcttcacaataaccttcagtacctgaaactgaatacaattgaagagctccttgataactgccttgaaattgctgcaagggacagcaagacaacaatggaagtccttgattatctgtttgaacaggaaaagaaacacagagaagctgctgcaattgagagaaggatgaaaagtgcaggttttcctgtgaaaaagatgcttgaagaattcgattttgagtttcagtcatctattaataaaaaagtcatagaagaccttgcaacattgagatttgttcataatgcagagaatattgttttactcggtcctccaggcgttggaaagtctcatcttgcaattgctcttgggattgaagcagtaaaagcaggaatttctgttcactttaccaatacaggaaaccttattgagaggttgaaaatagcaaatagagaaggaatacttgaaaagaagatcagagacttgatgaaatttaaagtgctaataattgatgaaattggatatctcccatttgatgatgaaggagctcactgcctatttcagctaatctccagacgttatgaaaagagttcaacaatcctgacatcgaataagtcatatggagaatggggagagatattcaaggaccatgtaatagcggctgccttgcttgataggatactccatcattgtacaacgattaatatcaaaggggaaagttacagactgaaagaaaggaaaaaacagggtataaaaacaggacttatacgtcataattctacagaaattttagaaaattga

SEQ ID NO: 40444 - protein, 265 aa, Methanosarcina mazei Go1
MNNFTYEKLHNNLQYLKLNTIEELLDNCLEIAARDSKTTMEVLDYLFEQEKKHREAAAIERRMKSAGFPVKKMLEEFDFEFQSSINKKVIEDLATLRFVHNAENIVLLGPPGVGKSHLAIALGIEAVKAGISVHFTNTGNLIERLKIANREGILEKKIRDLMKFKVLIIDEIGYLPFDDEGAHCLFQLISRRYEKSSTILTSNKSYGEWGEIFKDHVIAAALLDRILHHCTTINIKGESYRLKERKKQGIKTGLIRHNSTEILEN

SEQ ID NO: 40445 - DNA, 831 bp, Bacillus anthracis str. A2012
  CDS (1)..(831)
atggctctagtaaaggtaacagatatagcaaagaccctttcgaagaagatgatcttcctttctgatacttgtgaggtttgtaaaaaagaacgaaaacgtactgttcgattcatgaagataaatggtgaagtagtttgtccggtatgtaagttggcggaagacaatcataagttagaagctgaaatgaatgtatttcgagatgagaaggaacagagaaaacgtaaaagtatgttttacgataagagcttgattaaagatgaaacaattaaacttgctagattctcaacttttaaatctgattgtgaagaggatgaaaagaattacaccttagcaaaacgagcacttgaagattacttggatgatgtgaggtttaatttaattctagtaggaaaagtgggtgctggtaaaagtcatcttgcttattcaattgctcatgaaatgaatgagaatagcgcaggaacggttctttatgtttctgtatcagaactatttgactacataagttctacgttcaatggtcaatctgaggaatctgagcatagcattgttaatttactaattagtgcagatttattagtcattgatgatttgggtgctgagttaggtgatatggatgctgctgatccgaaggcgactgcatttgtgaatcgtgtactgtttaaagtctttgatggaagacagggaaagaaaacgatcattacaacaaacctaacaggtgaagctgtgatgaaagcttacgacgaacgtattacgtcacgtatgttcaatacatacagacatattgagtttaagtatacaagagataagcggaaaagaaagttacctttttaa

SEQ ID NO: 40446 - protein, 276 aa, Bacillus anthracis str. A2012
MALVKVTDIAKTLSKKMIFLSDTCEVCKKERKRTVRFMKINGEVVCPVCKLAEDNHKLEAEMNVFRDEKEQRKRKSMFYDKSLIKDETIKLARFSTFKSDCEEDEKNYTLAKRALEDYLDDVRFNLILVGKVGAGKSHLAYSIAHEMNENSAGTVLYVSVSELFDYISSTFNGQSEESEHSIVNLLISADLLVIDDLGAELGDMDAADPKATAFVNRVLFKVFDGRQGKKTIITTNLTGEAVMKAYDERITSRMFNTYRHIEFKYTRDKRKRKLPF

SEQ ID NO: 40447 - DNA, 894 bp, Rhizobium etli
  CDS (1)..(894)
atgaagaacgcccacgttatcgatgaagcacgcctcggcatcatgctcaacgagctccggctgccgacgatcaaaatgctgtggccacgatttgccgaagaggcggaccgggaaggatggccggcagctcgcttcctgtcggctattgccgagcacgagctggcagagcgtgccaatcgcaggattgaacggcatctcgccgaagcgcacctgccgcccggaaagaccttagacagcttcgcctttgacgctgtacccatgatctcgaaggcgcaggtcatggcaatcaccgccggcgacagctggcttgccaagggagctaacatcctcatgttcggtccgcccggcggaggaaagagccatcttgctgctgccatcggccttgcgctgatcgagaacggatggcgggtcctgttcacccggaccaccgatcttgtgcagaagcttcaggtcgcccgaagggaactgcagcttgagtctgccatcgacaaactcaacaggtacgacttgctcatcctcgatgacctcgcctacgtcaccaaggaccaggcggaaacaagcgtgctattcgagctgatctcggcacgatacgagcaccggtcgatcctgatcaccgccaaccagccgttcggagagtggaaccgggtctttcccgaccctgccatgacactcgcagcagtcgaccggctcgtgcaccatgccacgatcttcgagatgaacgtcgaaagctatcgccgcagaactgcgcttgaggaaaaacgccagcgcggccgaccggcctcgtttgcgacaatcaggacatcaacgctgtctgtcgcggagcggcaatcagaaaacgacgaagaacttgtcagcggcaatcagcatgataatttgatcccgaccgcgacctaa

SEQ ID NO: 40448 - protein, 297 aa, Rhizobium etli
MKNAHVIDEARLGIMLNELRLPTIKMLWPRFAEEADREGWPAARFLSAIAEHELAERANRRIERHLAEAHLPPGKTLDSFAFDAVPMISKAQVMAITAGDSWLAKGANILMFGPPGGGKSHLAAAIGLALIENGWRVLFTRTTDLVQKLQVARRELQLESAIDKLNRYDLLILDDLAYVTKDQAETSVLFELISARYEHRSILITANQPFGEWNRVFPDPAMTLAAVDRLVHHATIFEMNVESYRRRTALEEKRQRGRPASFATIRTSTLSVAERQSENDEELVSGNQHDNLIPTAT

SEQ ID NO: 40449 - DNA, 1362 bp, Streptococcus agalactiae 2603V/R
  CDS (1)..(1362)
atgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcagatag

SEQ ID NO: 40450 - protein, 453 aa, Streptococcus agalactiae 2603V/R
MTENEQLFWNRVLELSRSQIAPAAYEFFVLEARLLKIEHQTAVITLDNIEMKKLFWEQNLGPVILTAGFEIFNAEITANYVSNDLHLQETSFSNYQQSSNEVNTLPIRKIDSNLKEKYTFANFVQGDENRWAVSASIAVADSPGTTYNPLFIWGGPGLGKTHLLNAIGNQVLRDNPNARVLYITAENFINEFVSHIRLDSMEELKEKFRNLDLLLIDDIQSLAKKTLGGTQEEFFNTFNALHTNDKQIVLTSDRNPNQLNDLEERLVTRFSWGLPVNITPPDFETRVAILTNKIQEYPYDFPQDTIEYLAGEFDSNVRELEGALKNISLVADFKHAKTITVDIAAEAIRARKNDGPIVTVIPIEEIQIQVGKFYGVTVKEIKATKRTQDIVLARQVAMYLAREMTDNSLPKIGKEFGGRDHSTVLHAYNKIKNMVAQDDNLRIEIETIKNKIR

SEQ ID NO: 40451 - DNA, 891 bp, Bacteriophage r1t
  CDS (1)..(891)
atggaaagtatcggagatgttattggaaaatttgttgatatgaataaatttaatgcaatgactgataaagttatcactcgtccagaaatagaaaaattcatttcggataataagatgactagcgatgaagtttcaaaaagttattctaaattctacgaatatcttaaagagaaaaataaatttgataataacgaaaaaacagcattgagtggacatgaaccttttttgattatgaactgtggttatgccgatgttgtctatcgtgagactgaagaagtgattaaacgtaggaaaaaagctgagtttgtcaaaagacttaatcgcaatagcattgtgagagatatgacaataaaaaaagcaagttttgaaaattttaatgcagtaactgacgaagaaaagagagctttggcgttcgcaaaagaagtatctgaatattattatactggcggtgagggaaatactgtagtaagcgggccagcaggaacagggaaaagtcacctagccatgagcatcttaaaagattgtttgcagcatactgatttaaccgttatttttgcaagttggtcagaggttcttcacttaatcaaagatagttttgataataaagacagcttttattcaactgaatacttcatggaagtttttagaaatactgacttattagttattgatgatattggaagcgagaaaataacagaatggtcgatgtctttactgacagaagttttggatgcaaggactaagactattattaccactaatctaaaaagtgatgaaataagaaaaaaatatcataacaggacatatagccgtttgttcagaggtattggaaaaaaagcattcaattttgaaaatattaaagataagcgtgttagtcagttgccattctag

SEQ ID NO: 40452 - protein, 296 aa, Bacteriophage r1t
MESIGDVIGKFVDMNKFNAMTDKVITRPEIEKFISDNKMTSDEVSKSYSKFYEYLKEKNKFDNNEKTALSGHEPFLIMNCGYADVVYRETEEVIKRRKKAEFVKRLNRNSIVRDMTIKKASFENFNAVTDEEKRALAFAKEVSEYYYTGGEGNTVVSGPAGTGKSHLAMSILKDCLQHTDLTVIFASWSEVLHLIKDSFDNKDSFYSTEYFMEVFRNTDLLVIDDIGSEKITEWSMSLLTEVLDARTKTIITTNLKSDEIRKKYHNRTYSRLFRGIGKKAFNFENIKDKRVSQLPF

SEQ ID NO: 40453 - DNA, 879 bp, Shigella flexneri 2a str. 301
  CDS (1)..(879)
atgatgacgtttaacctgcgtgaacaacaaaaaagactacaggcgcgaatggatgagttacgggcagagattgcatttgctcagaagggcgaaaagccatggccttatcgttcctgcctgatgcgtgaaggtcgcggatattgcgaaaaacatggcgaatatcacacgcatatactggtgtggagcgatcgtaatggcgaggacagagaagaaatttcatgctgccctgactgcttaatcgctgaggccaacgatttgaccatggagctgtcgtccatcaaggcggaagagctgactgataacgccggaattgccctgcgttttcgggactgcgagtttgataattatctggaggttaatcctggcgcagccagaaatcttgcggcctgtcgccgctatgcggagaactggccagatatgctggagaacggtaccagtcttgttatgaccggcagttgtggtaccggaaaaaatcatctggctgtggctatggcaaaacacatcatccgtaactatctggccagtgtggagatcaccgacgtgatgcgccttacccgtgctgtgaaaaattgctggcggaatgacagcgaaaaaacagcggatgaagttattgagcgttatgcgtcaatggatttgctgatcatcgacgaagttggcgttcagtttggcagcgcggctgaaatggctattttgcaggaaattatcaacgccaggtacgaaagtatcttgcccaccattctgatcagtaacctctcaccggaagagttgtgggcgttcatcagtccccgaattgccgacaggatcacagacgggggacgcaactggttgtcgtttaactggcccagttaccgttctcgtatcagaggtgtggctgcatga

SEQ ID NO: 40454 - protein, 292 aa, Shigella flexneri 2a str. 301
MMTFNLREQQKRLQARMDELRAEIAFAQKGEKPWPYRSCLMREGRGYCEKHGEYHTHILVWSDRNGEDREEISCCPDCLIAEANDLTMELSSIKAEELTDNAGIALRFRDCEFDNYLEVNPGAARNLAACRRYAENWPDMLENGTSLVMTGSCGTGKNHLAVAMAKHIIRNYLASVEITDVMRLTRAVKNCWRNDSEKTADEVIERYASMDLLIIDEVGVQFGSAAEMAILQEIINARYESILPTILISNLSPEELWAFISPRIADRITDGGRNWLSFNWPSYRSRIRGVAA

SEQ ID NO: 40455 - DNA, 705 bp, Pseudomonas putida KT2440
  CDS (1)..(705)
atgctgatggggcgcgagattgttggccgctgccctgagtgcgaaaaggccgccattgccgagcgccaggccaagcaacaggccgaggaaacccgcctgaagcgcgaggccatgacccgcaagctgggttcagcgctgataccgaagcgtttcgccgagcgaaccctggccaactaccgtgtcgagcacgaaggccagcgcaaggccctggcctactgcacgcgttacgtggccgcgttcgaggagatcgagcgcaccgggcgttgcctgatgctgctgggcagggtcggcaccggcaagacccacctgggcgccggtatggccaacgagctgatgcgcaacacctcggctaccgccgtgtaccgcacggtgggcgctgtcctgcagtccatccgggcgacctacgaccgccacagcgagcagtccgaggccgacatcctgtccagcctgatcgagccatcgctgctggtgctggacgaagtcggcgtcagcaaggagcagccgagcgagttcgagctgaccaccctgttttcgatcatcaacgggcgctacgagcaaatgcgccccacggtggtgatttccaacctggaagccagccaactgcgccacgccatgggcgagcggtgttatgaccgcctgcgcgagggcggcggtgtggtggtgcccttcgagtgggagtctcaccgtggcaaggaggagttctga

SEQ ID NO: 40456 - protein, 234 aa, Pseudomonas putida KT2440
MLMGREIVGRCPECEKAAIAERQAKQQAEETRLKREAMTRKLGSALIPKRFAERTLANYRVEHEGQRKALAYCTRYVAAFEEIERTGRCLMLLGRVGTGKTHLGAGMANELMRNTSATAVYRTVGAVLQSIRATYDRHSEQSEADILSSLIEPSLLVLDEVGVSKEQPSEFELTTLFSIINGRYEQMRPTVVISNLEASQLRHAMGERCYDRLREGGGVVVPFEWESHRGKEEF

SEQ ID NO: 40457 - DNA, 786 bp, Pseudomonas resinovorans
  CDS (1)..(786)
gtggcgccgattactacacccaagaggagctgttcgatgatgacccaacacaccctgagccaattgcaccaactgcggctgggcggcatggcccgagcactggaagaacaatggacgctgccggccagccacagcctgagcttcgatgagcgcctcggcctgctgctcgaccgcgagctggcctggcgcgacgacaagcgcctggagcggctgcgtaaacaggccaagctcaagtacgccagcgcctgcctggaagacctcgaccggcgccgtggccgcacgctggacgagcgcctgatcgcgaccctggccagtggtgactggatccgtcaacggcacaacctgctgctgaccggcccgaccggcgtcggcaagacctggttcgcctgcgccctgggccaccaagcctgtcgccagggctacagcgcgctgtacctgcgcaccccgcgcctgctggagcaactgcgcatcgcccacggcgacggtagcttcgggcgcaccctgcaacagctggccaaggtcgatgtcttgattttggacgactggggcctggcggcgctggaggaaaatgcccggcatgacctgctggaagtgatcgacgaccgcgccggcagccgctccaccatcctgaccagccagcttcccgtcgagcactggcacggctggatcaacgaccccacgctggccgacgccttgctcgatcgcctggtacacaacgcctaccgaatcgtgatgaaaggcgagtcactacggaggaaaaacacggaggaagaagccgcatcgtga

SEQ ID NO: 40458 - protein, 261 aa, Pseudomonas resinovorans
MAPITTPKRSCSMMTQHTLSQLHQLRLGGMARALEEQWTLPASHSLSFDERLGLLLDRELAWRDDKRLERLRKQAKLKYASACLEDLDRRRGRTLDERLIATLASGDWIRQRHNLLLTGPTGVGKTWFACALGHQACRQGYSALYLRTPRLLEQLRIAHGDGSFGRTLQQLAKVDVLILDDWGLAALEENARHDLLEVIDDRAGSRSTILTSQLPVEHWHGWINDPTLADALLDRLVHNAYRIVMKGESLRRKNTEEEAAS

SEQ ID NO: 40459 - DNA, 990 bp, Clostridium tetani E88
  CDS (1)..(990)
atgataaaaagctatcaagaacaagttatgaagacctatgaggaaatgcgtgatatggaagctaattccttatctaaaagaaaaaatgaaatttctaaaagagttcctcgtataatggaaatagataatgaaatagctaaactttctttagaattgtcattaaatatattaaaaagcaaacaaaataatttggacaattatatgtccaatataaaaaatagaattacagacttaagagtaaaaaaatctgaactcttagtagcaaatggatacactgctgattatttagatatgcattataattgccctaaatgtcaagacactggttttaataaaactagtagatgctcttgctataaatcagttttaactaaagtattatataaaaattctgagctaagacatatattagaacaaaataactttgatcattttaactttgattatttttccaactatagaagtcctaaagaacctcaaagtccaaaagaaaatatacaaagtataatgagtatagcttggaactttattcagaactttgattcttctactgaaaacttattgttttttggaaactcaggtaccggaaaaagttttttagctcattgtatagccaaagaactcatagataatggatatatggttgtttataaaactgctgtagagttaataaatgagcttagagaaattagatttaatccaaatcagaacttggaaaatatacttataaactgtgatcttctcataatagatgatttaggtacagaaccattaactgaattctccaaagtagaattttttaatttactaaatagaaaattattaaaaagaaaaaaaatgatagtttctaccaatttttctatagaaggattattaaaaacttattcggaaagaatttcttctagacttttaggaaactttacactatgtaaattctttggtgaagatataagagttaagataaacttagaaagaaaaggaacaacttaa

SEQ ID NO: 40460 - protein, 329 aa, Clostridium tetani E88
MIKSYQEQVMKTYEEMRDMEANSLSKRKNEISKRVPRIMEIDNEIAKLSLELSLNILKSKQNNLDNYMSNIKNRITDLRVKKSELLVANGYTADYLDMHYNCPKCQDTGFNKTSRCSCYKSVLTKVLYKNSELRHILEQNNFDHFNFDYFSNYRSPKEPQSPKENIQSIMSIAWNFIQNFDSSTENLLFFGNSGTGKSFLAHCIAKELIDNGYMVVYKTAVELINELREIRFNPNQNLENILINCDLLIIDDLGTEPLTEFSKVEFFNLLNRKLLKRKKMIVSTNFSIEGLLKTYSERISSRLLGNFTLCKFFGEDIRVKINLERKGTT

SEQ ID NO: 40461 - DNA, 843 bp, Enterococcus faecalis V583
  CDS (1)..(843)
atgcatgcgacagatcaaacttttcaaatactattgagtcaattgttagaaaaagttgaagaccgttgtcctgaatgtggcagtgaacaatatgtttggcaacaaaaaaataaagatggcacagaacgttgtgccccaacttgttggtcgtgtgggtataaaatgctaaaaaaacatgaacaacaagccaatcaacaacgttctcaagagagttttatggcacgtacacaaaaattttttcatcaagggtccttaattgctgatgatgcgctacggcaatgtcgtttaaccaattaccaaaccactgaattagaaacaagacaagcaaaagaacgggccttagcagcagtttcagcgattgttgaaggaaagccaatccacgttattttttcagggaaacctggtgtcggtaaaagtcatttggctatcagtattttagttgaagtcttagaacgctctgcatatcaaaagtattgtttatttgtcagctactctgagttattagaaaaactaaaaatgtccatgaatgaatcggccaaaagccaagcaaaggctcaagcgtatattactagaatgaaaaaagcagacgttttggttttagatgatttaggtgctgaattaggaattaaaaataaagttagtacggattttaataatgacatcttaaaccgaattttagaagctagacagaataaagcaactatttttactactaatttttctggaaaacaactggtggaggcctatggaacacgcattatttctcgtctaatgaagcacgccaatggctatgttttccaatataaagacacaacagacaaacgaatgaggagtgtgaaataa

SEQ ID NO: 40462 - protein, 280 aa, Enterococcus faecalis V583
MHATDQTFQILLSQLLEKVEDRCPECGSEQYVWQQKNKDGTERCAPTCWSCGYKMLKKHEQQANQQRSQESFMARTQKFFHQGSLIADDALRQCRLTNYQTTELETRQAKERALAAVSAIVEGKPIHVIFSGKPGVGKSHLAISILVEVLERSAYQKYCLFVSYSELLEKLKMSMNESAKSQAKAQAYITRMKKADVLVLDDLGAELGIKNKVSTDFNNDILNRILEARQNKATIFTTNFSGKQLVEAYGTRIISRLMKHANGYVFQYKDTTDKRMRSVK

SEQ ID NO: 40463 - DNA, 852 bp, Enterococcus faecalis V583
  CDS (1)..(852)
atgcagtcagcatcagatggattttcaaaaatgattaaaacgttgctttatatcacgcctgatccatgtccagagtgcggaggaaatctttatgcttggcgtgcaaaaaacaaagatgggtccgataggtgtccgccaacttgcatggaatgtggctataaagcacgcaaaaaagcagaagaccttgaaacagagaaaatgtttaacgatagtttgaaagccagagcgattaattatctgaaatatagttcgctttacaccgacaaaaatttaattaattgtcgttttaaaacttacaaaacagtagacacagaaactaagcttgcttttgaaattgcaaatcgagccacaactgaaattcttttgaataaaccaattcatatgattctttcaggcaaaagtggtgttggaaaaagtcatttagctatgtcaacggcttgggaagtgttggagaaatcaaactatgataaacgctgcttatttattagctatgcggaactcttagaacaactaaaatttgcgatgaatgatgagcaagccagaaaagagataacaggtagtttgatggcagaaatcaaaagcgcagatttagtagttctggacgatttaggagccgagttgggagttaaacaaattgatgataggaataaaagtactaacttcaataacgacaccttgaatcgcattgtagaagctcggcagaataaagcaactatttttactacgaacttaactggtaaagaaatgagtcaagcttatggggagagaattctttctcgtatcatgagtaattcacaaggttttgtgatgaaaattgaagggacatcagacaaacgagtagcaggcatctaa

SEQ ID NO: 40464 - protein, 283 aa, Enterococcus faecalis V583
MQSASDGFSKMIKTLLYITPDPCPECGGNLYAWRAKNKDGSDRCPPTCMECGYKARKKAEDLETEKMFNDSLKARAINYLKYSSLYTDKNLINCRFKTYKTVDTETKLAFEIANRATTEILLNKPIHMILSGKSGVGKSHLAMSTAWEVLEKSNYDKRCLFISYAELLEQLKFAMNDEQARKEITGSLMAEIKSADLVVLDDLGAELGVKQIDDRNKSTNFNNDTLNRIVEARQNKATIFTTNLTGKEMSQAYGERILSRIMSNSQGFVMKIEGTSDKRVAGI

SEQ ID NO: 40465 - DNA, 885 bp, Lactococcus phage P335
  CDS (1)..(885)
atgcagtcaatggcagatggaatccgagagttccataaaaagagagaagttaaaacaggtctattttgtgaaaaacatcaacaaaccgaacttgttagatataaacatccagtaagtatagattatgatccgttgattcatggcgagttagttgatggtttgcaggtaacctcaatgagttattgtacagaatgtgctaaagagggaatataccaacatcaccaacaatcaagtgctgaaataaaagcaaatgaagatttcttgaataaaagtaagtatggaaaatatagcttgcttaaaacacaaagccttgtaggcaagaaatcgctctggtttgcacgtttcaacacttttaaggcaaatagcttagaagagcaaaacgtgttaaatcaagcccaaagaatagccagagagtacactcaaggtcaaaggtttaacactgtattcgttggtggagctggtagagggaaatctcacttagcaatggctattttgcaagaagtaaatgaaaaccttaaagataataaattctcaacattgtttatcaatattagtgaattaattcgagaaattaaaaatagttggaattactctgataccaaagcagaagaagaacgactgacaacattaatgcgaacagttgatttgcttgttattgacgatttgggaactgaaagcacgttttctaaagataatagctgggtacaaggtgttatttacaatatttacaatgcaagagaaggcaatacgattatcacatcaaatcttactggtaaagaaatgcgttcatcttatgacgataaaatagtttctcgaatcatggaaggctcaaaaaatagtgttgttaaatttgagggaattactgataagaggaaaagtaaatga

SEQ ID NO: 40466 - protein, 294 aa, Lactococcus phage P335
MQSMADGIREFHKKREVKTGLFCEKHQQTELVRYKHPVSIDYDPLIHGELVDGLQVTSMSYCTECAKEGIYQHHQQSSAEIKANEDFLNKSKYGKYSLLKTQSLVGKKSLWFARFNTFKANSLEEQNVLNQAQRIAREYTQGQRFNTVFVGGAGRGKSHLAMAILQEVNENLKDNKFSTLFINISELIREIKNSWNYSDTKAEEERLTTLMRTVDLLVIDDLGTESTFSKDNSWVQGVIYNIYNAREGNTIITSNLTGKEMRSSYDDKIVSRIMEGSKNSVVKFEGITDKRKSK

SEQ ID NO: 40467 - DNA, 804 bp, Bacillus anthracis str. Ames
  CDS (1)..(804)
atgactcggatagtgaatacatcggcttgtagtgaagaaacggaagggtatacatgcgaacactgtaataaatatatcgccgcaatcactgtagaggttccgcagttacgtattaaaaacaaaatacttcctacatgtgagtgtgttgtagaacgtgaagaagcaaaaatacgtgaagctcaaaactttgctaagaagagagaaatagaaaagttgttcagcattagtaacttaggagaaaggttctccaaaagtacatttgaatcgtttctagatagaaatggatcagagacagcttataaagttgcagtgaaatacgtaaagacgtttaaagaatggaacggggaatcgttaatgctttggggagaacctggtaatggtaaaacacacctagcagccgcgattgtaaatgaactttctaaaaaaggatacatcgtagtatttcaaagtgttccagaattattacaacgtattcgaagtacgtttaacagcgaaaacaaagaaaatgaaacacaaattatgagagcacttttagaatgcgacttacttatattagatgatattggagcggaaaaaactacggaatgggtagaagaaaaattgttcaatatcattgatggtcggtatagaaaagaacttcctactctgtatacgagtaatttagaacccaaagaattaaaaaatcaagttggcaaacgttcatatgaccgaatggttgaaacaagtctaactgtaaaaaatgaagcggctagttatagaagagagatagcgaaacaacgtttacaaaggtttattgaagtataa

SEQ ID NO: 40468 - protein, 267 aa, Bacillus anthracis str. Ames
MTRIVNTSACSEETEGYTCEHCNKYIAAITVEVPQLRIKNKILPTCECVVEREEAKIREAQNFAKKREIEKLFSISNLGERFSKSTFESFLDRNGSETAYKVAVKYVKTFKEWNGESLMLWGEPGNGKTHLAAAIVNELSKKGYIVVFQSVPELLQRIRSTFNSENKENETQIMRALLECDLLILDDIGAEKTTEWVEEKLFNIIDGRYRKELPTLYTSNLEPKELKNQVGKRSYDRMVETSLTVKNEAASYRREIAKQRLQRFIEV

SEQ ID NO: 40469 - DNA, 849 bp, Pseudomonas sp. ADP
  CDS (1)..(849)
atgaccatgtccaatgacatcgcagcaagcctcaagggcttgagcctgcacggcatggccagtgcctggccggaactgctgggcatcgcccggctcaaatcgctcgaccacgaagcccttctgcatcagctcatcaaggccgagggcgcgcaccgggaagtgcgctccatggcctaccagatgcgggtggcccgattccctcaccaccgcgatctggctggctttgcctttgatcaggcccaagtggacgaggcgctggtgcgtcagctgcacgagttcaagttcatcgactcagcccacaacgtggtcttcgtgggcggcccaggcacgggcaaaacacaccttgccacaagcctgggcgttcatgccatccgtgcacatggtaagcgggtgcgcttcttctcgaccgtcgagctggtcaatctgctggaggccgagaaagctcaaggtaaggccgggcaactggcacatcggctcatgtacgtggatctcgtcatcctcgacgagatgggctatttgcccttcagtcaagccggtggggccttgctgttccacctgctgtccaagctgtacgagcgcaccagcgtggtcgtcaccaccaacctgtcgttctcggagtgggccagcgtgttcggcgacgccaagatgaccaccgcgctactcgaccgactcacccatcactgccacatcgtcgaaaccggcaaccagagctggcgcttcaggcactcgactgcacaaccgtcttcgatcatcagagccacacgaaccaaaacggccaaaggagcaccccagacagatcacgcagtagacttatccacatccgaacagtccatttcttcgtcaacttag

SEQ ID NO: 40470 - protein, 282 aa, Pseudomonas sp. ADP
MTMSNDIAASLKGLSLHGMASAWPELLGIARLKSLDHEALLHQLIKAEGAHREVRSMAYQMRVARFPHHRDLAGFAFDQAQVDEALVRQLHEFKFIDSAHNVVFVGGPGTGKTHLATSLGVHAIRAHGKRVRFFSTVELVNLLEAEKAQGKAGQLAHRLMYVDLVILDEMGYLPFSQAGGALLFHLLSKLYERTSVVVTTNLSFSEWASVFGDAKMTTALLDRLTHHCHIVETGNQSWRFRHSTAQPSSIIRATRTKTAKGAPQTDHAVDLSTSEQSISSST

SEQ ID NO: 40471 - DNA, 771 bp, Streptococcus mitis phage SM1
  CDS (1)..(771)
atggtaactgatgcactagaggagatggccttatcttaccatagaaatactgaacaacaggctgaaatttgcgaaaagcatgggattcccttgatcaaaatcctccggacaaatgacgtcctttgtcgcttatgtgaatcggaacgaatccacgcagagaaccaattgaaggtggatgagctggccgatgcggagcatgagagagagcggaagttttatcttgagaaattttctctctatgatgatgtcttgaagaatgctactcttgataactttgatacaccgactgaaaaagaagcggaaaagctagcttttgtaaagaggatttgtcgggagtggtccgagggcgccagaaacaatattgtttttcaaggagaagctgggactgggaagagccatcttgctttcgcaatgatgaaatatttatcagagactacaaaggaaattgctatttttatcaatgtcactgacttactgatgaaaatcaaggcagactttagccaggaagagttcctggtcaataaaattgctagtgcaaagtttttggtcttggatgatcttggtatggaaaaggacagtgagtggtccttcagtatcctgtacaacattctcaacaaaagggccaatacggttatcacgaccaatttgactgcacaagaaattcagaaacgctacggccggccgtttatgagtcgattgatgaagggcgtagacaatagtcatctgatggtttttaatgacttgaaaaacaaaaggaaagattacttttag

SEQ ID NO: 40472 - protein, 256 aa, Streptococcus mitis phage SM1
MVTDALEEMALSYHRNTEQQAEICEKHGIPLIKILRTNDVLCRLCESERIHAENQLKVDELADAEHERERKFYLEKFSLYDDVLKNATLDNFDTPTEKEAEKLAFVKRICREWSEGARNNIVFQGEAGTGKSHLAFAMMKYLSETTKEIAIFINVTDLLMKIKADFSQEEFLVNKIASAKFLVLDDLGMEKDSEWSFSILYNILNKRANTVITTNLTAQEIQKRYGRPFMSRLMKGVDNSHLMVFNDLKNKRKDYF

SEQ ID NO: 40473 - DNA, 798 bp, Burkholderia cepacia phage Bcep22
  CDS (1)..(798)
atgcgcgctgctgctgatcttctgggcggggggatcaacccgcagtcctacacgcgcgaatcgatgtgcgagaagcacggcgcttacaccgagcgcggcggctcgctcaccggcgagctgcacaaggcgatgtggttcggctgcccacagtgcagccgcgagaagcgagagcaggaggagctggaggcgcgcgcgcgcgaggagcgcgtgcggcaggagcgcatcgaggcgcggctgaacgcgtcgggcatccccctcgccttccgcgatcgcacgttcgagaacttcgtcgccgagacggacgagcagcgctatgcgctcgacgtggcgcgctcattcgctgagaacttctggacgaagcacctgccggccggcgacttcctcatcttcggcggcaaccccggcaccggcaaaagccatctcgcgctcgcgatccagcagtacgtgatgcggcactcgacggccatgtacctcgacgcgatggcgctgatccgccgcgtgcgcgcgacgtggcgccgcgatgcgccgcagagcgaggaggaagtgctgcacacgctcggcttcacggtcgacctgctggcgatcgacgagatcggcgtgcagcgcggcaccgacgacgagcaggcgatcgtgttcgagatcatcaaccgccgctaccgcgacttgcggccgacgatcctgatgacgaacctgaacggcgcgggcctgaaggacttcctcggcgcgcgcacgatggatagattgtatgaaaggggcaccatgcttccattcatgtggccgagccatcgccgcaaataa

SEQ ID NO: 40474 - protein, 265 aa, Burkholderia cepacia phage Bcep22
MRAAADLLGGGINPQSYTRESMCEKHGAYTERGGSLTGELHKAMWFGCPQCSREKREQEELEARAREERVRQERIEARLNASGIPLAFRDRTFENFVAETDEQRYALDVARSFAENFWTKHLPAGDFLIFGGNPGTGKSHLALAIQQYVMRHSTAMYLDAMALIRRVRATWRRDAPQSEEEVLHTLGFTVDLLAIDEIGVQRGTDDEQAIVFEIINRRYRDLRPTILMTNLNGAGLKDFLGARTMDRLYERGTMLPFMWPSHRRK

SEQ ID NO: 40475 - DNA, 813 bp, Bacteriophage EJ-1
  CDS (1)..(813)
atgcagagattaggatttgaaccgctccattatgtaaatgagaaagagatttgccaaaagcattcctgcttcatgtggacgtttaaagaaccagttcgggctactaatcgaaaagaaccgtatcagcccacgttttgccctgagtgcaagcgtgaagacatggaacgagagcaactgcaaatggtcggaaaggcttatatctcgtctatcttgagtaacacgtttgaagtgttagctagaaacagcttaatgccaagtgatatgaaagacgctagtttcagtacgttcactgtatcgaatgagacagatgaacaggctaagaattttgctctgagagtagtaaggcattacttcaacgatggacgagggaatgcagtgattgttggacaagctggcagaggtaagacacatttagcgattgcgattgctaagaagttgaatatagatttcaaggctaataacaatcccaagagtgtgttattcatgaatgttcctgctatgttccaaaaaatccagagtggatttaataaaaaggacgctcggacaactgacgaatggcttgacctactaaaaaaagtcgactacttgatactagacgactttgggaaaggcgatcagtcacaatggaaacaggactttctctataacttgcttgattcaagggataagacgattgttacaactaatttgattggtaaggacatggttcagatatttgatgcaagtctggttagtcgagtagccaaaggtgcgaaagaaatgactttcaaatatcctgacagtgcagaagataggaggacattaccattttga

SEQ ID NO: 40476 - protein, 270 aa, Bacteriophage EJ-1
MQRLGFEPLHYVNEKEICQKHSCFMWTFKEPVRATNRKEPYQPTFCPECKREDMEREQLQMVGKAYISSILSNTFEVLARNSLMPSDMKDASFSTFTVSNETDEQAKNFALRVVRHYFNDGRGNAVIVGQAGRGKTHLAIAIAKKLNIDFKANNNPKSVLFMNVPAMFQKIQSGFNKKDARTTDEWLDLLKKVDYLILDDFGKGDQSQWKQDFLYNLLDSRDKTIVTTNLIGKDMVQIFDASLVSRVAKGAKEMTFKYPDSAEDRRTLPF

SEQ ID NO: 40477 - DNA, 1524 bp, Onion yellows phytoplasma OY-M
  CDS (1)..(1524)
atgaataattataataaaatttgggaaataattttaaatgaactatcaaaaatttacagtgatgaagtttttaaagaaacattttccaatattaaaaaaataaaccaaattgaagaaaaaattataatttcagtagaaactgaatttattaagaataaaatatataaaatgtattttgaaaaaatcaaaaaaataactaaattaaaatttgaagaaaaaattataattgaatttgtttcagaaaaaaataaaaaaaatagtaattttgatgatgaaaaaaagcattttgaaaatcttaaagaaaaattagaaaatgagaatcaaacttatttttccaaaattgaaaataatgaaaataatgatgaattccaaaataataaatattttgaaacaattgaaaaagaacaaattgaaactaaaactgataatgacaaaaatgttgaaattgaaaatagaaaaataagttttaataaatacaattatggaaataccaatcccaagtatagttttgataattttgttgtgggaaaaagtaataattttgcctttaaaattgccaaaaaaattgctgaagaaaaaaaagtaactaccaatccgctatatatttttggaaaagcaggaatcggaaaaacccatctaattcaggcaatcggaaatcatattttgaaaaaaacacattcatccaaaaaagttctatatgtaaaagctgacggatttattgaagaatttaccaaccaattaagaaaagccaaaatggaggatttcaacgaaaaataccgtgatattgatcttttattagttgatgatatccaaattatggcaggtgctacaagaactcaaatggagttttttaaattatttgattatctttatttaaaccaaaaacaaattgtaattacaagtgataaacaagcctcagaactaaaaaatattatgagtagattaacttcacgttttgaagctggtcttatggttgatattcaaagtcctgattttaatcatcgtctcaatattttgaaaaagaaaatattagaatttgaaccacaaaatcctttgaaaataaaaaaagatgtccttgatttgattgcttcttcttttgttaataatgttcgtgaaatggaaggagctttattaagattgttgaattatgcccaaacttttggctatgatattgatattaatattgccaatgaagctttagaacttttgattaaaagcaaaaaaagtgtttcttatgatgaggatgttttggaaaaaatcaaatcagttgttagcaattttttcaatatttcagttcgtgatttaatgagtaaaaaaagacaacaaaaatacactttaccgcgtcatattgctatgtatttaatcaaagaattaaaagatattccttataatattgttggtagttttttcaaaagaaaccattctgcagtttttaaagcttatcaaaaaattaaaaaaaattctcaaagtgattatgaattaaaaaaatccttagaacttattttgaaaaaaattaattcttaa

SEQ ID NO: 40478 - protein, 507 aa, Onion yellows phytoplasma OY-M
MNNYNKIWEIILNELSKIYSDEVFKETFSNIKKINQIEEKIIISVETEFIKNKIYKMYFEKIKKITKLKFEEKIIIEFVSEKNKKNSNFDDEKKHFENLKEKLENENQTYFSKIENNENNDEFQNNKYFETIEKEQIETKTDNDKNVEIENRKISFNKYNYGNTNPKYSFDNFVVGKSNNFAFKIAKKIAEEKKVTTNPLYIFGKAGIGKTHLIQAIGNHILKKTHSSKKVLYVKADGFIEEFTNQLRKAKMEDFNEKYRDIDLLLVDDIQIMAGATRTQMEFFKLFDYLYLNQKQIVITSDKQASELKNIMSRLTSRFEAGLMVDIQSPDFNHRLNILKKKILEFEPQNPLKIKKDVLDLIASSFVNNVREMEGALLRLLNYAQTFGYDIDINIANEALELLIKSKKSVSYDEDVLEKIKSVVSNFFNISVRDLMSKKRQQKYTLPRHIAMYLIKELKDIPYNIVGSFFKRNHSAVFKAYQKIKKNSQSDYELKKSLELILKKINS

SEQ ID NO: 40479 - DNA, 780 bp, Bacteriophage 77
  CDS (1)..(780)
atgaaaccactattcagcgaaaagataaacgaaagcttgaaaaaatatcaacctactcatgtcgaaaaaggattgaaatgtgagagatgtggaagtgaatacgacttatataagtttgctcctactaaaaaacacccgaatggttacgagtataaagacggttgcaaatgtgaaatctatgaggaatataagcgaaacaagcaacggaagataaacaacatattcaatcaatcaaacgttaatccgtctttaagagatgcaacagtcaaaaactacaagccacaaaatgaaaaacaagtacacgctaaacaaacagcaatagagtacgtacaaggcttctctacaaaagaaccaaaatcattaatattgcaaggttcatacggaactggtaaaagccacctagcatacgctatcgcaaaagcagtcaaagctaaagggcatacggttgcttttatgcacataccaatgttgatggatcgtatcaaagcgacatacaacaaaaatgcagtagagactacagacgagctagtcagattgctaagtgatattgatttacttgtactagatgatatgggtgtagaaaacacagagcacactttaaataaacttttcagcattgttgataacagagtaggtaaaaacaacatctttacaactaactttagtgataaagaactaaatcaaaatatgaactggcaacgtataaattcgagaatgaaaaaaagagcaagaaaagtaagagtaatcggagacgatttcagggagcgagatgcatggtaa

SEQ ID NO: 40480 - protein, 259 aa, Bacteriophage 77
MKPLFSEKINESLKKYQPTHVEKGLKCERCGSEYDLYKFAPTKKHPNGYEYKDGCKCEIYEEYKRNKQRKINNIFNQSNVNPSLRDATVKNYKPQNEKQVHAKQTAIEYVQGFSTKEPKSLILQGSYGTGKSHLAYAIAKAVKAKGHTVAFMHIPMLMDRIKATYNKNAVETTDELVRLLSDIDLLVLDDMGVENTEHTLNKLFSIVDNRVGKNNIFTTNFSDKELNQNMNWQRINSRMKKRARKVRVIGDDFRERDAW

SEQ ID NO: 40481 - DNA, 756 bp, Symbiobacterium thermophilum IAM 14863
  CDS (1)..(756)
atgcccttgcagacgacgattgaaaggcttcgggaaatgcggcttcgcggcatggctgacgccctggtgcgccaacagcagcaacctgaactccagtccctgtcgttcgaggaacgtctggaactcctcgtggatcaggaatggctcgaccggcaaaaccggcgcctggctcggcttctcaaagaggcgaaattccgcgtggccgcatgcatggaggatgttgactaccagcatccgcgcggcctggaccgaaccgtcatgcggagcctcgccgcatgccagtgggtcgagtacggccagcacatcctgattgttggacccaccggtgtggggaaaacgtttatcgcgtgcgccctgggcaacgccgcctgccggcacggctacaccgttcgctactaccgagtgccgcgactccttgccgagctggctaccgctcgggttgatggctcccttcgccgcatcctcaacaccctggcccggaccgatgtactgatcctggacgactggggtctcgctcccatctctgtggcggaatcccgagaccttctcgaagtcatcgatgatcgtacacaggcacggtcgacagtgattgcctcgcagttgccgatcgaaacgtggcacagtgtgatcggcgacgctaccgtagccgatgcgatcttggaccgcctggtacatggtgcgcacaaactgaacctgaagagggaatccatgcggaagatagcgaacctccagacatcccagtcgagcatggcttag

SEQ ID NO: 40482 - protein, 251 aa, Symbiobacterium thermophilum IAM 14863
MPLQTTIERLREMRLRGMADALVRQQQQPELQSLSFEERLELLVDQEWLDRQNRRLARLLKEAKFRVAACMEDVDYQHPRGLDRTVMRSLAACQWVEYGQHILIVGPTGVGKTFIACALGNAACRHGYTVRYYRVPRLLAELATARVDGSLRRILNTLARTDVLILDDWGLAPISVAESRDLLEVIDDRTQARSTVIASQLPIETWHSVIGDATVADAILDRLVHGAHKLNLKRESMRKIANLQTSQSSMA

SEQ ID NO: 40483 - DNA, 774 bp, Symbiobacterium thermophilum IAM 14863
  CDS (1)..(774)
ttgagccaggaactcctgctggactactacctgaagcgcctaaagctacccacagtccggcgcctgtacaaggatctggcgcgggatgcggctgaacacaacaagacctttgaggagtacctacaagccctcatggagcaggaggtgatccaccgggaagacaaccagcttcagcgccgtctcaaggccgccggcttccctgttcccaagacactggagtctttcgacttcacggttattccgtccgtgaacaaggcgaagatcctggcgctgagcaagagcgaatacatccgggatcgggagaacgtcctcttcgttggaaatagcggtacaggcaagactcacctggccacagcgctgggcatcgcggcgtgccggcagggctaccgggttcgcttctggcgcgtcggccagctcgtcgccgaacttcaggaggcgcagaatgagcaccggctaagccgcctcgagaagcagtggctgcgactcgatctggtcgtgctggacgagcttggctatgtgtccctcagccgcacggccagtgaactgctgttccacttcgtcgccgcacgctacgaacggggcagcctgatgattacgacgaacctggaattctcggaatggccgcaggtgtttggggacgagaagatgacagcggcgttggcagaccgtgtaacccacaaggcacacatcatcgagatgaacggggagtcgtaccgattccgtgagaccctccggcggcaggaagccttgaagcagcgcctggagtcaccgtaa

SEQ ID NO: 40484 - protein, 257 aa, Symbiobacterium thermophilum IAM 14863
MSQELLLDYYLKRLKLPTVRRLYKDLARDAAEHNKTFEEYLQALMEQEVIHREDNQLQRRLKAAGFPVPKTLESFDFTVIPSVNKAKILALSKSEYIRDRENVLFVGNSGTGKTHLATALGIAACRQGYRVRFWRVGQLVAELQEAQNEHRLSRLEKQWLRLDLVVLDELGYVSLSRTASELLFHFVAARYERGSLMITTNLEFSEWPQVFGDEKMTAALADRVTHKAHIIEMNGESYRFRETLRRQEALKQRLESP

SEQ ID NO: 40485 - DNA, 783 bp, Symbiobacterium thermophilum IAM 14863
  CDS (1)..(783)
gtgcgccaacagcagcaacctgaactccagtccctgtcgttcgaggaacgtctggaactcctcgtggatcaggaatggctcgaccggcaaaaccggcgcctggctcggcttctcaaagaggcgaaattccgcgtggccgcatgcatggaagatgttgactaccagcatccgcgcggcctggaccgaaccgtcatgcggagcctcgccgcatgccagtgggtcgagtacggccagcacatcctgattgctggacccaccggtgtggggaaaacgtttatcgcgtgcgccctgggcaacgccgcctgccggcacggctacaccgttcgctactaccgagtgccgcgactccttgccgagctggctaccgctcgggttgatggctcccttcgccgcatcctcaacaccctggcccggaccgatgtactgatcctggacgactggggtctcgctcccatctctgtggcggaatcccgagaccttctcgaagtcatcgatgatcgtacacaggcacggtcgacagtgattgcctcgcagttgccgatcgaaacgtggcacagtgtgatcggcgacgctaccgtagccgatgcgatcctggaccgcctggtacatggtgcgcacaaactgaacctgaagggggaatccatgcggaagatagcgaacctccaccatgggctagcgctgcccagccatcgccacttcgctccatcccctcagtgccaccgcgctggccggatgaaatcggaaacggcggtcgacttggatcagaaccggtggtcggcttga

SEQ ID NO: 40486 - protein, 260 aa, Symbiobacterium thermophilum IAM 14863
MRQQQQPELQSLSFEERLELLVDQEWLDRQNRRLARLLKEAKFRVAACMEDVDYQHPRGLDRTVMRSLAACQWVEYGQHILIAGPTGVGKTFIACALGNAACRHGYTVRYYRVPRLLAELATARVDGSLRRILNTLARTDVLILDDWGLAPISVAESRDLLEVIDDRTQARSTVIASQLPIETWHSVIGDATVADAILDRLVHGAHKLNLKGESMRKIANLHHGLALPSHRHFAPSPQCHRAGRMKSETAVDLDQNRWSA

SEQ ID NO: 40487 - DNA, 774 bp, Symbiobacterium thermophilum IAM 14863
  CDS (1)..(774)
ttgagccaggaactcctgctggactactacctgaagcgcctgaaactccccacagtccggcggctgtacaaggagctggcgcgggatgcagcagagcacaacaagacatttgaggagtacctacaagcgctcatggaacaggaggtgatccatcgggaagacaaccaactccagcgccgtctcaaggccgccggcttccctgttcccaaaacactggagtccttcgacttcacggtcatgccgtccgtgaacaaggccaagatcctggcgctgagcaagagtgaatacatccgggatcgggaaaacatcctccttgttggaaacagcgggacaggtaagactcacctagctacagcactcggcatcgcagcgtgccgacagggctaccgcgttcgcttctggcgcgtgggccagttcgttgccgaactgcaggaggcgcagaacgagcaccgcctcagccgcctcgaaaagcagtggctacggttcgacctcgtcgtgctggacgagcttggctatgtgtccctcagccgcccggccagtgaactgctcttccactttgtcgccgcacggtacgagcggggcagcctgatcatcacgacgaacctggaattctcggaatggccgcaggtgttcggggaccagaagatgacagcagcgttggcagaccgtgtgactcacaaggcccacatcatcgagatgaatggggagtcgtaccggttccgtgagacccttcgacggcaggaagctttgaagcaccacccggaaacaccgtaa

SEQ ID NO: 40488 - protein, 257 aa, Symbiobacterium thermophilum IAM 14863
MSQELLLDYYLKRLKLPTVRRLYKELARDAAEHNKTFEEYLQALMEQEVIHREDNQLQRRLKAAGFPVPKTLESFDFTVMPSVNKAKILALSKSEYIRDRENILLVGNSGTGKTHLATALGIAACRQGYRVRFWRVGQFVAELQEAQNEHRLSRLEKQWLRFDLVVLDELGYVSLSRPASELLFHFVAARYERGSLIITTNLEFSEWPQVFGDQKMTAALADRVTHKAHIIEMNGESYRFRETLRRQEALKHHPETP

SEQ ID NO: 40489 - DNA, 831 bp, Bacillus cereus ZK
  CDS (1)..(831)
atggctctagtaaaggtaacagatatagcaaagaccctttcgaagaagatgatcttcctttctgatacatgtgaggtttgtaaaaaagaacgtaaacgtactgttagattcatgaagataaatggtgaagtagtttgcccggtatgtaagttggcagaagacaatcaaaagctagaagcggaaatgaatgtatttcgagatgagaaggaacagagaaaacgtaaaagtatgttttacgataagagcttgattaaagacgaaacaattaaacttgctagattctcaacttttaaatctgactgtgaagaggatgaaaagaattacaccttagcaaaacgagcacttgaagattatttaaatgatgtgaggtttaatttaattctagtgggaaaagtaggtgctggtaaaagtcatcttgcctattcaattgctcatgaaatgaatgagaatagcgcaggaactgttctttatgtttctgtatcagaactatttgactatatacgttctacgttcaatgggcaatctgaggagtctgagcatagcattgttaatttactaattaatgcagatttattagttattgatgacttaggtgcggaactaggtgatatggatgccgctgatccgaaggcaactgcattcgtgaatcgggtactgttcaaagtatttgatggaagacaaggaaagaaaacaatcattacaacaaacctaacaggtgaagctgtgatgaaagcttacgatgagcgcattacatcccgtatgttcaacacatacagacatattgagtttaagtatacaagagataagcgaaaaagaaagttgcctttttaa

SEQ ID NO: 40490 - protein, 276 aa, Bacillus cereus ZK
MALVKVTDIAKTLSKKMIFLSDTCEVCKKERKRTVRFMKINGEVVCPVCKLAEDNQKLEAEMNVFRDEKEQRKRKSMFYDKSLIKDETIKLARFSTFKSDCEEDEKNYTLAKRALEDYLNDVRFNLILVGKVGAGKSHLAYSIAHEMNENSAGTVLYVSVSELFDYIRSTFNGQSEESEHSIVNLLINADLLVIDDLGAELGDMDAADPKATAFVNRVLFKVFDGRQGKKTIITTNLTGEAVMKAYDERITSRMFNTYRHIEFKYTRDKRKRKLPF

SEQ ID NO: 40491 - DNA, 753 bp, Geobacillus kaustophilus HTA426
  CDS (1)..(753)
atgagagcagaggtgaaagagatttgtaaagcgctgcatttggcctatatcgcagatcgattcgaggaggtgagattcgaaacgaaagaacagtttttgcgggatgtattggcgctggaactgtcgtgccgccaagaagcgaaacaggctcggctgatcaagaaagccaagtttcgggagttgaaatggctgaaggattacgaatggtcgggtcatatccattggccagccacgacatcgagggaggaactgtgtgaccttcgctttttggagcgaaagcaaaacgttctgcttttaggttcacctggaacggggaaaacccatctcgccacagcacttggcattcaggcgtgccaacaaggccatgaggttcggtttttccgcgtcgcggatcttgtcgcccagctggaagaggcgttgaaaaacggcacgctcggacggctgaaacgaagcctcgacccatgcgaactgttgattttggatgaactcggctatgtgccgtttcaaaagcaaggatcggaactgttgtttcatattatcgccgactgttacgagcgaaaaagcgtcatggtgacatcgaatctagaatttggacagtggaatcgggtgtttggggacaaccgtttgacggcagcgttggtggatcgcttggttcaccacgcccacatcttggcctttacgggagagagctatcgactgcggaacgctctctccgcgatccagccgtcctctgcctccggtctggaaccttaa

SEQ ID NO: 40492 - protein, 250 aa, Geobacillus kaustophilus HTA426
MRAEVKEICKALHLAYIADRFEEVRFETKEQFLRDVLALELSCRQEAKQARLIKKAKFRELKWLKDYEWSGHIHWPATTSREELCDLRFLERKQNVLLLGSPGTGKTHLATALGIQACQQGHEVRFFRVADLVAQLEEALKNGTLGRLKRSLDPCELLILDELGYVPFQKQGSELLFHIIADCYERKSVMVTSNLEFGQWNRVFGDNRLTAALVDRLVHHAHILAFTGESYRLRNALSAIQPSSASGLEP

SEQ ID NO: 40493 - DNA, 798 bp, Azoarcus sp. EbN1
  CDS (1)..(798)
atgagcgcgctcgaggccgccacgctgccgatgatgctcaccgaactgcgcttgcccaccatcaagcgtctgtggccggccctggccgagcagtccaaccgcgagggttggcctgccgagcggtttctggcggcactgtgcgagcacgaaatgaatgagcgcgagcggcgccgtatcgatcgccatcgggccgagtcggccttgccgcccgacaagcggctgtcggcgttcgacttcgctgccgtgccgacggtctccaaggctcacgtcactgcgctcgccgagggcgacagctggctcgagcaaggcgccaacatcctgctgttcggtccgccaggtgtcggcaagacacacttgatcgccggcctgggccacgcgctcgtcgaacgcggataccgcgtgctcttcacccgcacgagcgatctggtgcagcggttgcaggcggctcggcgcgatctgcggctgccggccgaactggccaggctcgaccgcttcgatctgctgatctgtgacgacttcagctatgtccgccgcgaccagggcgagacctcggtgctgttcgaactcatcgccgaacgctacgagcgaaagagtttggccatcacggccaaccagccattctccggctgggaccacgtctttgccgaaccggccatgacgctggccgcagtcgatcgtcttgtacatcacgccacgatcttcgagatgaacgtcgagagcttccgccgccgcgttgctcagaaggggctcgccccttctgagcaacgcaaacccacaacctcgaaaccgaaaggctga

SEQ ID NO: 40494 - protein, 265 aa, Azoarcus sp. EbN1
MSALEAATLPMMLTELRLPTIKRLWPALAEQSNREGWPAERFLAALCEHEMNERERRRIDRHRAESALPPDKRLSAFDFAAVPTVSKAHVTALAEGDSWLEQGANILLFGPPGVGKTHLIAGLGHALVERGYRVLFTRTSDLVQRLQAARRDLRLPAELARLDRFDLLICDDFSYVRRDQGETSVLFELIAERYERKSLAITANQPFSGWDHVFAEPAMTLAAVDRLVHHATIFEMNVESFRRRVAQKGLAPSEQRKPTTSKPKG

SEQ ID NO: 40495 - DNA, 780 bp, Azoarcus sp. EbN1
  CDS (1)..(780)
atgaacctgcaatacgaacggatccaggcgctgtgccagacgctgagcctgccgctcaccgcccaaggctatgccgcagcggcccagcaggcggccaccgatcaactggcctacagcgacttcctcgaacagttgctgcgggccgaggcggccggtcgtcagagccgcaagcaaagcatgctcacgcgcctggcgggcttccccgcgatcaagacgctggaggatttcgactatggctttgccagcgggctcaagcgcagccagatcgaggagttggccagcctcgccttcgtcgagcgtgccgagaacgttgtgctggtgggccccagcggggtgggcaagacccatctggccatcgcgctgggctaccgcgccacgcaggccggcatcaagacgcgcttcaccaccgccgccgacctgctgctgacgctggtcctggcgcatgagcgcaaccagctcaagaacgtgatgcagcgggcgatcaacgcctaccggctgttgatcgtcgacgagatcggctacctgccgatgacgcgcgagcaggccaacctgttcttccaggtgatcgcggcgcgctacgagcggggcagcctgatcgtgaccagcaatctgtcgttcgggcagtgggacagcaccttcgcccaggatgcgacgctcacggcggcgctactggatcggctgctgcatcacgcgcacatcgtgccgatcagcggcgagagctaccggctgaaacaccagcgcaaggccgggatggtgcaagcgctggcggtcgccggctga

SEQ ID NO: 40496 - protein, 259 aa, Azoarcus sp. EbN1
MNLQYERIQALCQTLSLPLTAQGYAAAAQQAATDQLAYSDFLEQLLRAEAAGRQSRKQSMLTRLAGFPAIKTLEDFDYGFASGLKRSQIEELASLAFVERAENVVLVGPSGVGKTHLAIALGYRATQAGIKTRFTTAADLLLTLVLAHERNQLKNVMQRAINAYRLLIVDEIGYLPMTREQANLFFQVIAARYERGSLIVTSNLSFGQWDSTFAQDATLTAALLDRLLHHAHIVPISGESYRLKHQRKAGMVQALAVAG

SEQ ID NO: 40497 - DNA, 690 bp, Chloroflexus aurantiacus
  CDS (1)..(690)
atgccgtatggggatcccaattttggcgttctgatcacctgtcgttgcaaacaggccgagaaagaacgccgacgctacgaagaactggagcgactctcaaacctggcaccgctgcgtgataagacgtttgccacctttgaccgtactgtacccggcgtacagcgggcatttgcccgtgcttatgagtatgcgcaaaacccccagggctggctggttttgtttggtgggtatgggtgcggtaaaacccatctggccgccgccattgcaaacgaagctcttgaccgtcatacgccggtgctttttaccgttgtgcccgatctgctcgaccaccttcgctcaaccttcggccctaattctgagacggcctacgatgaacggtttgaactggtgcgcgatgtaccattgctgatccttgacgacctgggcaccgaaaatacgaccccctgggcacgagaaaaactttaccagatcatgaaccatcggtataattatgctctaccgacggtgatcaccagtaatcgtgacccgaaggatatcgatccgcgcattctttcccggatgtacgataccgctatctgtcgggaacggattatcatcgaagcaggagattatcgccgtctgagtcttgaacagcggtatcattcacgccgacgccggggcgacagctctcgcgccaggactcaggaatga

SEQ ID NO: 40498 - protein, 229 aa, Chloroflexus aurantiacus
MPYGDPNFGVLITCRCKQAEKERRRYEELERLSNLAPLRDKTFATFDRTVPGVQRAFARAYEYAQNPQGWLVLFGGYGCGKTHLAAAIANEALDRHTPVLFTVVPDLLDHLRSTFGPNSETAYDERFELVRDVPLLILDDLGTENTTPWAREKLYQIMNHRYNYALPTVITSNRDPKDIDPRILSRMYDTAICRERIIIEAGDYRRLSLEQRYHSRRRRGDSSRARTQE

SEQ ID NO: 40499 - DNA, 780 bp, Azotobacter vinelandii
  CDS (1)..(780)
atgaacctgcaacacgcgcgcatcgccgaactgtgccaggcgctcaagctcgagcgcatcgttgatcactacccactgttggcccagcaggcggtcaaggacgacctgagcttcggcgacttcctggagcaactgctgcggcacgagcacggctttcgccagcagcgcagccgcgagttgctgacgcggatggcctgcttcccggcgatcaagacgcttgaggagtacgacttcagcttcagccccggtgtgcccaaggccctgctgcatgagctggcgggcttggccttcgtcgagcgcaccgaaaacatcgtgctgatcggcccctcgggcgtcggcaagacgcacctggccatcgccctcggctaccgggcagcacagagcggcctcaagacccgcttcatcacggcggccgacctgatgctgcaactgggcgcggcccagcggcagggccggctgaagacctacctcaaccgcgccatcctggccccccgactgctagtgatcgatgagatcggctacctgccgttcggtcgcgaggaggccaacctgttcttccaggtcgtcgccaaacgctacgagaagggttcgatgatcctgacctcgaacctgccgttcagccagtgggccgaggccttcagcggcgacgccacgctgacggcggccatgctggatcggctgctgcaccatgcccatatcctcaccctgaccggagaaagctaccgactcaaggacaaacgcaaggcgggcgtcatccgccagaaccgtaaccccgagtga

SEQ ID NO: 40500 - protein, 259 aa, Azotobacter vinelandii
MNLQHARIAELCQALKLERIVDHYPLLAQQAVKDDLSFGDFLEQLLRHEHGFRQQRSRELLTRMACFPAIKTLEEYDFSFSPGVPKALLHELAGLAFVERTENIVLIGPSGVGKTHLAIALGYRAAQSGLKTRFITAADLMLQLGAAQRQGRLKTYLNRAILAPRLLVIDEIGYLPFGREEANLFFQVVAKRYEKGSMILTSNLPFSQWAEAFSGDATLTAAMLDRLLHHAHILTLTGESYRLKDKRKAGVIRQNRNPE

SEQ ID NO: 40501 - DNA, 654 bp, Desulfitobacterium hafniense DCB-2
  CDS (1)..(654)
atgcggcaaaaacggatggagaacctgttccgccacgcgcgcatggcccgtggcttgcttaattgccgttttgaggccttcagacaggagtattatctgagccaagccaatccccaggaccggagttatctggagggagccttaacggccttgcatgcttcaaaggagtttgtggcccgttgcctcgacgattatcatggcttaggtttgatcctgatcgggccggtgggggccgggaaaacctttctggcggcagccattgccaatgccttaatggaacaggagcatcaagtccttttcctggttgttccggaccttttggaccaattgcgcgccacctataaaaccgatgagaatgaattggatcttttggatacggcccgggaaattcctattctcattttggatgatctgggggcccataattacaccgactggactcgcaatcgtctttattctattattaattatcgtttgaaccagcagctgccgacggtgatcacttccaatttgtctttagaggagatggaagagcatttgggggcgcgaaccacttcgcggctcattcaatcctgccggatcttcagaatgcatgttgaacaggatattcggctgcgccaatatcaggatagagaaaaagaacgaaaaaaataa

SEQ ID NO: 40502 - protein, 217 aa, Desulfitobacterium hafniense DCB-2
MRQKRMENLFRHARMARGLLNCRFEAFRQEYYLSQANPQDRSYLEGALTALHASKEFVARCLDDYHGLGLILIGPVGAGKTFLAAAIANALMEQEHQVLFLVVPDLLDQLRATYKTDENELDLLDTAREIPILILDDLGAHNYTDWTRNRLYSIINYRLNQQLPTVITSNLSLEEMEEHLGARTTSRLIQSCRIFRMHVEQDIRLRQYQDREKERKK

SEQ ID NO: 40503 - DNA, 600 bp, Bifidobacterium longum DJO10A
  CDS (1)..(600)
atggactcgcgcgagcgatccaaacgcctgcgcctgctcaaacaggccggcttccccgccgacaagaccctcgacggctatgactggaccaacctgaagatgcccgccgactgggggcgcgcgcagctcgagaacctcgacttcgtcgccggatgcgaggacctcgtgctctacgggcccgtcggcaccggcaagagccacctggccatcgcgatcggacggctcgcctgcgagcggggcgtcccggtgcgcttcttcaccgcgaccggactgctcatgcgtctgcgccgcgcccagcaggagaaccggctcgaccgggaactcgcgagcatcggcaaggcccgacttctcatcatcgacgagttcggctacctacccatagacgaggagggcagcaggctcctcttccagatcatttccgattcctacgagacaaggagcatcatctacaccaccaacatcgaattcagcggatggggacgcgtgctcggcgacaagaacatggccgccgccctcatcgaccgcaccgtccaccacggacggctcatcagattcgagggccgctcctaccgaagcgaacacgccctcatgaccaaatag

SEQ ID NO: 40504 - protein, 199 aa, Bifidobacterium longum DJO10A
MDSRERSKRLRLLKQAGFPADKTLDGYDWTNLKMPADWGRAQLENLDFVAGCEDLVLYGPVGTGKSHLAIAIGRLACERGVPVRFFTATGLLMRLRRAQQENRLDRELASIGKARLLIIDEFGYLPIDEEGSRLLFQIISDSYETRSIIYTTNIEFSGWGRVLGDKNMAAALIDRTVHHGRLIRFEGRSYRSEHALMTK

SEQ ID NO: 40505 - DNA, 774 bp, Desulfovibrio desulfuricans G20
  CDS (1)..(774)
atggatagcctccagcacgaacgaatggtttcggtctgtgaaaagctcaagctatgcgctgtgccgaactgctatgaccagcttgcggaagcggccgtcaggcaggagaagagttacatacagtttctcgaagaggtcttgcgggcggaagaggccttccgcaaagagcggagccgtgaagtaatgacgcgtatggcgaaattcccggcaccaaagaccattgagggatatgacttttcctttgccgcaggggctccgaagagactgatccaggagcttgccggactcaccttcctgaagcgcagggaaaacgttctgctgcttggccccagcggggtcggcaaaacgcatctggcaattgctcttggcctgcgtgcggctgaggccggtctcaaggtccgcttcacgacggcggcagacctcattctccagttggagaccgcgatccggcaaggccgctacgcacagaccatgaaacgctccgtcagcgggccgagcctgctcattgtggatgaggtcggctatctcccgatgacaggcgaccaggcaaacctcttctttcaggtggtggccaagcggtacgagtcaggttcaatcatactgacttccaacttaagcttcggcgaatgggagaccgtcttttccggaaatacggccctgacctcagccatgctcgaccggctgctgcaccactcccatgtcatccagatcaagggagacagctaccggctgaaagacaaaatcaaatccggcgtgttcggaaaaaacaactga

SEQ ID NO: 40506 - protein, 257 aa, Desulfovibrio desulfuricans G20
MDSLQHERMVSVCEKLKLCAVPNCYDQLAEAAVRQEKSYIQFLEEVLRAEEAFRKERSREVMTRMAKFPAPKTIEGYDFSFAAGAPKRLIQELAGLTFLKRRENVLLLGPSGVGKTHLAIALGLRAAEAGLKVRFTTAADLILQLETAIRQGRYAQTMKRSVSGPSLLIVDEVGYLPMTGDQANLFFQVVAKRYESGSIILTSNLSFGEWETVFSGNTALTSAMLDRLLHHSHVIQIKGDSYRLKDKIKSGVFGKNN

SEQ ID NO: 40507 - DNA, 675 bp, Burkholderia cepacia R1808
  CDS (1)..(675)
atgacgctcacggcaagcaccagcctgtcattcgaggaacgcgtgggcatgctcgtagatcgcgagctggcctggcgtgatacgcgacgactcgaacgtttgctgcgcgccgcgaagctcaagaacccacaggcctgcgtcgaagacattgaataccggcaaacccgtgggctggaccagcgcatcgtcgccacgctcgccggctgcgactgggtgcgcaatgctcagaacctgatcctgaccggccccaccggcgcgggcaagacgtggctcgcttgcgcgttcggccagcaggcgtgccggcagggcttctccgtgttctatgtgcgcgtcgcgcggctgttcgaagagctgaaaatcgcgcacggcgacggcagcttcacacgtcggcttgcgcaactcgcgaagattgatgtgctgatcctcgacgattggggcttgcaggatctcgaccaggcggcgcgcaatgatctgcttgaggtacttgatgatcgtgtcggtacgcgctcgactgtgatcaccagccagttgccgctcgaacactggcacgcgtggctgcaggaccccacgctcgccgatgcgattctcgatcggctcgtgcatcaggcccacaagcttccggtcaagggcgattcgatgagaaagaaaacgaaatccgagtccgctgacgcctga

SEQ ID NO: 40508 - protein, 224 aa, Burkholderia cepacia R1808
MTLTASTSLSFEERVGMLVDRELAWRDTRRLERLLRAAKLKNPQACVEDIEYRQTRGLDQRIVATLAGCDWVRNAQNLILTGPTGAGKTWLACAFGQQACRQGFSVFYVRVARLFEELKIAHGDGSFTRRLAQLAKIDVLILDDWGLQDLDQAARNDLLEVLDDRVGTRSTVITSQLPLEHWHAWLQDPTLADAILDRLVHQAHKLPVKGDSMRKKTKSESADA

SEQ ID NO: 40509 - DNA, 699 bp, Burkholderia cepacia R1808
  CDS (1)..(699)
atggctcgcgcgttcgaggagcagtcaacgctcacggcaagcaccagcctgtcattcgaggaacgcgtgggcatgctcgtagatcgcgagctggcctggcgtgatacgcgacgactcgaacgtttgctgcgcgccgcgaagctcaagaacccacaggcctgcgtcgaagacattgaataccggcaaacccgtgggctggaccagcgcatcgtcgccacgctcgccggctgcgactgggtgcgcaatgctcagaacctgatcctgaccggccccaccggcgcgggcaagacgtggctcgcttgcgcgttcggccagcaggcgtgccggcagggcttctccgtgttctatgtgcgcgtcgcgcggctgttcgaagagctgaaaatcgcgcacggcgacggcagcttcacacgtcggcttgcgcaactcgcgaagattgatgtgctgatcctcgacgattggggcttgcaggatctcgaccaggcggcgcgcaatgatctgcttgaggtacttgatgatcgtgtcggtacgcgctcgactgtgatcaccagccagttgccgctcgaacactggcacgcgtggctgcaggaccccacgctcgccgatgcgattctcgatcggctcgtgcatcaggcccacaagcttccggtcaagggcgattcgatgagaaagaaaacgaaatccgagtccgctgacgcctga

SEQ ID NO: 40510 - protein, 232 aa, Burkholderia cepacia R1808
MARAFEEQSTLTASTSLSFEERVGMLVDRELAWRDTRRLERLLRAAKLKNPQACVEDIEYRQTRGLDQRIVATLAGCDWVRNAQNLILTGPTGAGKTWLACAFGQQACRQGFSVFYVRVARLFEELKIAHGDGSFTRRLAQLAKIDVLILDDWGLQDLDQAARNDLLEVLDDRVGTRSTVITSQLPLEHWHAWLQDPTLADAILDRLVHQAHKLPVKGDSMRKKTKSESADA

SEQ ID NO: 40511 - DNA, 750 bp, Burkholderia cepacia R1808
  CDS (1)..(750)
atggcgagcacctggccagagctgctggcgcagtcgcgtcacacggagttcgacccggagcgcttcatgaagcagctgctgatggctgagacggcggagcgacaggtgcgctcgatcgcctatcagatgaccgccgctcgcttcccggctcaccgcgacctgaagggcttcgacttcgcgcaggcgcacgtcgacgaagcgctggttcgagaactcagtgacctgtcgttcctcgcaagcgcacacaacgtcgtgttcatcggtggccccggcaccggcaaaacgcacctcgcctcagcgatcggaattgaggccgtgcagcgccacggcaagcgcgtgcgctacttctcgaccgtcgagctgaccaacgcactggagcaggagaagtccatcggcaaacaaggccagatcgcccataagctaatgtacgtcgacctggtaatcctcgacgaactgggctacctgccgttcagccagaccggtggcgcattgctgttccacttgctctcgaagctgtatgaacacacgagtgtcgtgatcaccaccaacctcagcttcggcgagtgggcgaccgtgttcggggacgcaaagatgacgacggcgctgctggaccgcgtcacccatcactgccacatcgtcgaaacgggcaatgaatcctggcgcttcaagtccagttctgccaaggcgaaggcaaccagaaagagagcagcaaaagccgcaggcagtgaggagttatccacaccggaatag

SEQ ID NO: 40512 - protein, 249 aa, Burkholderia cepacia R1808
MASTWPELLAQSRHTEFDPERFMKQLLMAETAERQVRSIAYQMTAARFPAHRDLKGFDFAQAHVDEALVRELSDLSFLASAHNVVFIGGPGTGKTHLASAIGIEAVQRHGKRVRYFSTVELTNALEQEKSIGKQGQIAHKLMYVDLVILDELGYLPFSQTGGALLFHLLSKLYEHTSVVITTNLSFGEWATVFGDAKMTTALLDRVTHHCHIVETGNESWRFKSSSAKAKATRKRAAKAAGSEELSTPE

SEQ ID NO: 40513 - DNA, 810 bp, Bacillus cereus G9241
  CDS (1)..(810)
atgcagagagcggcggcagcaataccaacagatatagccaaaaaggtgaatatgactatggattttgatgtgtgcgatacacatggaatgaataagatgaagttcggtggacaagttgtttgccctcgatgcttccttgaaaacgaaagtaataagcttcagcaacaagagcaagcgaaatacgatgcagataaagcgaatgagaagaagttcatgttccatcaacaaagcatgattgccgatagcaacattaagaaagctaatttcgataactacaaacctactagcgaagaaggagcgaagaacctagaactcgcaaaggtcatcgctacggattatctcgatgagaaggtgtttaacacgattatggccgggaattgcggagcagggaaaacacaccttgcttatgctatcgcagatcagcttgcaggagcagggaagtcagttgtcttcgttacagtcggcgaattgctacggaagataaaaagtacattcagtaaagattctacattaaccgaagatgcaattataagaagtttagtaagagcagaagtattaatagttgatgatttaggcgcggagttaggtgcattagatgccaatacaaaagcgacaaacttcattaatagggtgctattcgatgttttcgatggcaggcaaggtaaatctactatcttcacaacaaacctcacaggaaagcgtttagacgacgcatacgatgagcggattgtatcacgtattctcaataactttagaacgattactttcaaagatacaaaggattacagaagaaaggcattgccattttaa

SEQ ID NO: 40514 - protein, 269 aa, Bacillus cereus G9241
MQRAAAAIPTDIAKKVNMTMDFDVCDTHGMNKMKFGGQVVCPRCFLENESNKLQQQEQAKYDADKANEKKFMFHQQSMIADSNIKKANFDNYKPTSEEGAKNLELAKVIATDYLDEKVFNTIMAGNCGAGKTHLAYAIADQLAGAGKSVVFVTVGELLRKIKSTFSKDSTLTEDAIIRSLVRAEVLIVDDLGAELGALDANTKATNFINRVLFDVFDGRQGKSTIFTTNLTGKRLDDAYDERIVSRILNNFRTITFKDTKDYRRKALPF

SEQ ID NO: 40515 - DNA, 834 bp, Rubrivivax gelatinosus PM1
  CDS (1)..(834)
atgagcgccgagatcgtcacgcgcctgaaggcgctcaagctacacggcatggcggcgaactggccggagctggtggcgcgctgccggcatgcggcgctggagcccgagcagttcgtcgagcagttgctcgatgccgagggcgccgagcgcaacgtgcgctcgatcgcgtaccagatgacggcggcccggttcccggcgcaccgggacctggcgggcttcgacttcgccagcagtgcggtcgatgaagcgctggtgcgcaagctgcacacgacggcgttcactgaggccgcccacaacgtggtgttcatcggcgggccgggcacgggcaagacgcacctggccaccgcgctcggcatcgaggcggtccagcggcacggcaagcgggtgcgcttccactcgacggtggaactggtcaacgcgctggaggcggagaaggccgcaggccgggccgggcagatcgcgcaccggctgacctacgtggacctgctcatcctggacgagctgggctacctgccgttcagccaggccggcggcgccttgctgttccacctgctgagcaagctctacgagcacaccagcgtggtgatcacgaccaacctgagcttcggcgagtgggccagcgtcttcggcgacgcgaagatgaccactgcgctgctggaccggctcacgcaccactgccacatcgtcgagagcggcaacgactcctggcgcttcaggcacagcagcacgaccaccgctgcggcacgaacccgatcaacgacgcaacgcaggaaaggaccgacccaagaccccagaaccgcagagatatccacagaccaaggcaccctcgggtag

SEQ ID NO: 40516 - protein, 277 aa, Rubrivivax gelatinosus PM1
MSAEIVTRLKALKLHGMAANWPELVARCRHAALEPEQFVEQLLDAEGAERNVRSIAYQMTAARFPAHRDLAGFDFASSAVDEALVRKLHTTAFTEAAHNVVFIGGPGTGKTHLATALGIEAVQRHGKRVRFHSTVELVNALEAEKAAGRAGQIAHRLTYVDLLILDELGYLPFSQAGGALLFHLLSKLYEHTSVVITTNLSFGEWASVFGDAKMTTALLDRLTHHCHIVESGNDSWRFRHSSTTTAAARTRSTTQRRKGPTQDPRTAEISTDQGTLG

SEQ ID NO: 40517 - DNA, 819 bp, Burkholderia fungorum LB400
  CDS (1)..(819)
atgaacgctcccgcccatgacaacggccgtctggccctgatgctcaacgagctgcgtttgccgaccatcggcaggttgtggcccgagttcgcggaacgatctgacaaggaaggctggccggccacccggctactcggcgcattgctcgagcacgaactggctgaacgagctaaacgacgtatcgagcgccaccgaaccgagtcacatctggacccgacaaagacacttgcgaccttcgacttcggcatggtgcccatggtctcgaaggcgcatgtcactgcgttggcaaccggagaatcctggctggagaaaggcgccacgattctcctgttcgggccgcctggcgccggcaagagtcatctgggatcagccatcggacacgcgttgatcgacgctggctaccgggtgctgttcacgcgcaccagtgaactcgtccagaagctgcaggctgcacgccagagcctgcaattgccatccgcgcttgcgaagctcgatcgcttcgatctcatcattctggatgacctgtcgtacgcgcgcaaggaccaggccgaaaccagtgtgctgttcgaactgattgccgagaggtatgagcgcaaaagtcttttaataacggccaatcagccgttctctggctggaatgatgtgttccccgaccccggtatgacggtcgcagccatcgaccggctcgtccatcactcgacgatcttcgagctgaacgtcgaaagctatcgccgtcgtaaggccagcgacaaacagagcgctcgccggcgacaattacccgacgacaattacgagggaggcgcgacaattatgaattag

SEQ ID NO: 40518 - protein, 272 aa, Burkholderia fungorum LB400
MNAPAHDNGRLALMLNELRLPTIGRLWPEFAERSDKEGWPATRLLGALLEHELAERAKRRIERHRTESHLDPTKTLATFDFGMVPMVSKAHVTALATGESWLEKGATILLFGPPGAGKSHLGSAIGHALIDAGYRVLFTRTSELVQKLQAARQSLQLPSALAKLDRFDLIILDDLSYARKDQAETSVLFELIAERYERKSLLITANQPFSGWNDVFPDPGMTVAAIDRLVHHSTIFELNVESYRRRKASDKQSARRRQLPDDNYEGGATIMN

SEQ ID NO: 40519 - DNA, 744 bp, Enterococcus faecium
  CDS (1)..(744)
atggatcaagcaaaaagtttagaaactgcctgtaagttgctgagactttcccatgttcttcccactttggttcgcaaagacttagattacagctttgaaaccaaagaagattggttgatgtatcttctggaaaaggagttggcttgccgtgaagaattgaaaactgcccgactcctaaaacaagcaaagttcccaaataaacgtaccttagaggattacgaatggcatgatcatatatgtttgccaaatgcgacgactaaagatgaattattgagtctatcgtttattcatcagaaagaaaatgctgtatttgtgggtacacccggtaccggtaaaacacatctagcttgtggattgggtcagctggcagccaaatcaggtatcgatacacgcttttggcgggtatcagatttagtcaacgaattggaacaccattggaaaaacaataccttagaggtcttcaagcatcgcttcgataaagtaaaattaatcattcttgatgagatgggttatgtgcctttcactaaagaaggcgcggaactgcttttccaattgatcagcgattggtatgaaacaaaaagcgttatagtgactagtaatttagagtttagcaaatggaataaagtcttcgttgatgcacggttaactgccgcgttggtggatcgcttgattcatcatgcgcatattctcagcttcacgggtgagagctttcgattgaaaaatgctttatcaaaatcaaattag

SEQ ID NO: 40520 - protein, 247 aa, Enterococcus faecium
MDQAKSLETACKLLRLSHVLPTLVRKDLDYSFETKEDWLMYLLEKELACREELKTARLLKQAKFPNKRTLEDYEWHDHICLPNATTKDELLSLSFIHQKENAVFVGTPGTGKTHLACGLGQLAAKSGIDTRFWRVSDLVNELEHHWKNNTLEVFKHRFDKVKLIILDEMGYVPFTKEGAELLFQLISDWYETKSVIVTSNLEFSKWNKVFVDARLTAALVDRLIHHAHILSFTGESFRLKNALSKSN

SEQ ID NO: 40521 - DNA, 720 bp, Magnetococcus sp. MC-1
  CDS (1)..(720)
atgcgacgtcatgaactgatcgatggtctcaagaggctgaagttgcacggtatggtggcagcctttgatgaagcggtggtggtggatgaacggcgaaacagaacgattcatgaaattctgggcgcattgattgaggctgagcaggtagaacgaaaggtccgatctatccacgatcagatgtcagtcgctaaattcccttcgcagaaaaatctggatagctttgattttacggcctcatcagctaatgaagggcgaatccgcacgctctatgatggggaattccttgatggtgcaggcaatatcattttagtcggcgggacaggaaccggaaagactcacttggcgattgccgttgccgccaactgcattcgtctgggcaagcgttgtcgttacttcagcgtggtcgatctggtcaacaaactggaacgtgagcaagctgatggtttagctggacgacttgctgaaaagctattacgcacccatctgttggtactggatgaactgggctatcgacctttttctaaaactggaggcgcgttgctgttccatctgatcagcaaactttatgagcagacctccttgatcgtcaccaccaatctgaccttcggtgaatggcccaaggtattcggggatgccaaaatgaccacggcactgctggatcgtctcacccatcattgcgacattatcaagaccggaaatgagagctaccgaatgaaataa

SEQ ID NO: 40522 - protein, 239 aa, Magnetococcus sp. MC-1
MRRHELIDGLKRLKLHGMVAAFDEAVVVDERRNRTIHEILGALIEAEQVERKVRSIHDQMSVAKFPSQKNLDSFDFTASSANEGRIRTLYDGEFLDGAGNIILVGGTGTGKTHLAIAVAANCIRLGKRCRYFSVVDLVNKLEREQADGLAGRLAEKLLRTHLLVLDELGYRPFSKTGGALLFHLISKLYEQTSLIVTTNLTFGEWPKVFGDAKMTTALLDRLTHHCDIIKTGNESYRMK

SEQ ID NO: 40523 - DNA, 795 bp, Geobacter metallireducens GS-15
  CDS (1)..(795)
atgagcgacatccagcaccagcgtatggtcaccctctgcgacgacttgaagtttctggcggtgaccgatgtgtacgccgaccttgccgatgctgcggcaaagcaggagtcgtcatacatcgactatctcgagcaggtactcaaggccgagaacgacgtccggcaggggcgctcgcgccacaccatggcaaagctcgcgggctttcccgcgatcaagacccttgaggattatgacttcgattttgccaccggcgccccgaagcagcgaatcctggacctatcggcaatggcgtttctggagcgtcgggagaatgtaatcctgctcggtcccagcggtaccggcaagactcacctcgccattgccctcggctaccgggcaacccagtgcggcgtgaaggtgcgcttcatttccgctgcggacctgatgctgcaactcgaaagcgcccagcgccaggggcggtacaaggaagtaatgcggcgcagtgtcctggggccgagactactcatcatcgacgagattggataccttccgttcagcgaaacacaggcaaacctgttctttcaggtgatcgccaaaaggtacgaaacaggttccgtcatcctcacctcgaacctgagctttggggaatgggaacaggctttcggcggcaacacggcactcacatcagcaatgctcgaccggttgctgcaccacgcccatgtcattcagatcaggggtgacagctaccgattgaaagagaagcgccgagctggcattctcgggcagcaactgccgacaccccagatggatgattaa

SEQ ID NO: 40524 - protein, 264 aa, Geobacter metallireducens GS-15
MSDIQHQRMVTLCDDLKFLAVTDVYADLADAAAKQESSYIDYLEQVLKAENDVRQGRSRHTMAKLAGFPAIKTLEDYDFDFATGAPKQRILDLSAMAFLERRENVILLGPSGTGKTHLAIALGYRATQCGVKVRFISAADLMLQLESAQRQGRYKEVMRRSVLGPRLLIIDEIGYLPFSETQANLFFQVIAKRYETGSVILTSNLSFGEWEQAFGGNTALTSAMLDRLLHHAHVIQIRGDSYRLKEKRRAGILGQQLPTPQMDD

SEQ ID NO: 40525 - DNA, 759 bp, Clostridium thermocellum ATCC 27405
  CDS (1)..(759)
atgccggtcaataaaatgcttatcgaaacttacatgaagaagctaaagatgccacaggtggcaaaaacctatgaatccctggcaagagaagccgcagacaataatctggattatgaagaatacctgctgtgtgtgctggaacaggaagtacatcagcgggagaataaccggatccagagagggatccggcaagcaggctttcctgttatcaaaacgattgaaagctttgacttccttgccataccttctttgaacaaaccgcgggtattgaaactcatgcagggagaatatatccgaagaagagaaaatgtcattttgataggcaactccggagtagggaaaacccatattgcaactgcgctcggttacgaggcttgtcggcagggtatgaaggtcaaattctatacggcagctggtttgataaatgaattgcttgcagcacagcaggaatatcgtcttaataagcttgaaaagcaatggctggcgccgcatttagtgatccttgatgaattaggctatgtgcctttcagtaaaatcggagcagaattgttgttccagttctgctcttcccgatatgagaggggcagcctgatcataactacaaacttagaatttccaagatggacggaggtgttaggcgatgagcaaatgacagccgccctgcttgaccgcttgacccataatgcgcacattctgaacatcaatggtgaaagctacaggtttaagcaggctctttccaagcaggcaaataatgactga

SEQ ID NO: 40526 - protein, 252 aa, Clostridium thermocellum ATCC 27405
MPVNKMLIETYMKKLKMPQVAKTYESLAREAADNNLDYEEYLLCVLEQEVHQRENNRIQRGIRQAGFPVIKTIESFDFLAIPSLNKPRVLKLMQGEYIRRRENVILIGNSGVGKTHIATALGYEACRQGMKVKFYTAAGLINELLAAQQEYRLNKLEKQWLAPHLVILDELGYVPFSKIGAELLFQFCSSRYERGSLIITTNLEFPRWTEVLGDEQMTAALLDRLTHNAHILNINGESYRFKQALSKQANND

SEQ ID NO: 40527 - DNA, 837 bp, Clostridium thermocellum ATCC 27405
  CDS (1)..(837)
atgaactttgacggtattatcgaagatctggcgaagaagtgtgaaccgagcgaagaacactttgattattacaaagacggcctgcttatttgtggcaaatgcaatactcccaaagagtgcgtggttgaagtattggggacactcagaaaatttggatgcatgtgtaaatgccagagtgaagagtaccgtgccatgcaggagcagatcaggcaaagggaagagtttgagcggatcggtcgcctccggacgcagggcatccaggaccgatgctattgtaactggacttttgaaaatgacgatggacggaaccctcagcaaatggacaaggctatgcggtactgcctgagatgggaggaaatgtaccgtgacaatattggactcctcctttggggcgatgtcggaaccggcaagacgttttttgcggcctgcatagcaaattacctaatagaccggggcgtgccggtgcttatgactaactttattagattgtcgaatgcactaatggcccttgacgaggacagaaacgagtacattaaatccttagacagctacaagctgctcataatcgatgatctgggcgccgaacggcagagtgactatatgcttgagcaggtctataacatcatagatagccgttataagaacggccaacctcttattgtcacaactaacctgccgttgtcggaaatcaagaatccttctgatatcaagtacagcaggatttatagcagaatcattgaaatgtgcgtgcccatcaagtttgagggaccagacaggaggaaagaaatatttaacttaaagttggaaaaagcaaaaaaattgttcgagggtgattaa

SEQ ID NO: 40528 - protein, 278 aa, Clostridium thermocellum ATCC 27405
MNFDGIIEDLAKKCEPSEEHFDYYKDGLLICGKCNTPKECVVEVLGTLRKFGCMCKCQSEEYRAMQEQIRQREEFERIGRLRTQGIQDRCYCNWTFENDDGRNPQQMDKAMRYCLRWEEMYRDNIGLLLWGDVGTGKTFFAACIANYLIDRGVPVLMTNFIRLSNALMALDEDRNEYIKSLDSYKLLIIDDLGAERQSDYMLEQVYNIIDSRYKNGQPLIVTTNLPLSEIKNPSDIKYSRIYSRIIEMCVPIKFEGPDRRKEIFNLKLEKAKKLFEGD

SEQ ID NO: 40529 - DNA, 819 bp, Pediococcus pentosaceus ATCC 25745
  CDS (1)..(819)
atggaggacttgagttttaatcttttaaatcaagctaatttaactgatgaatattgtaaaatccaccctgatcagaaactagtaagagtaggtaatgaacacaattccttttgtacattatgtgttaaagaacaacgggaaaagcatttaaacgacttagtactcaagggggtacttagcaactaccatcggggatttagggacgttttgagaaaagattcaatcatagacgatgaagacctatgggaagcaagttttggtaactacgaggtcaatagcggtacagaagcagaaactaatctaaaaaaagcacgacagattgcaggcaaataccttaaccgtgattatcaagctaataccattattactggtaaccctggagttggtaagtcgcacttagcaatttcgatgttaaaaggcgttaatgaaaatattaaacctaacgcttcatgcttgtttatttcagtcaatgaactgttgcgattgattaaagattcatttaatcatcctgatagctattacactgaatcccggatggtggacttattaggtaaggttagcttgcttgtgttggacgatttgggcagtgaggcctcgtttaagcgtgataacagagaagcaagtgaatatgtacagcaagtattgtttggcgtcttaaacaaacgcaatcggacgattattactactaatctcaatagtgacgaattatctaagatatataatccaaaattgttaagcagaatgtataagggcgttatgaaaaacgatggaattattaaatttaaagaaactcaagataaaaggatggcgatattttaa

SEQ ID NO: 40530 - protein, 272 aa, Pediococcus pentosaceus ATCC 25745
MEDLSFNLLNQANLTDEYCKIHPDQKLVRVGNEHNSFCTLCVKEQREKHLNDLVLKGVLSNYHRGFRDVLRKDSIIDDEDLWEASFGNYEVNSGTEAETNLKKARQIAGKYLNRDYQANTIITGNPGVGKSHLAISMLKGVNENIKPNASCLFISVNELLRLIKDSFNHPDSYYTESRMVDLLGKVSLLVLDDLGSEASFKRDNREASEYVQQVLFGVLNKRNRTIITTNLNSDELSKIYNPKLLSRMYKGVMKNDGIIKFKETQDKRMAIF

SEQ ID NO: 40531 - DNA, 813 bp, Moorella thermoacetica ATCC 39073
  CDS (1)..(813)
atggaacggatccgtatcccccccaaccttgtgaccaaaaaccagccacccaacataccggcgcccagcccccattaccagtgccccctgtgccgcgaccgggggttgatcattcgggacggccgtgcttaccgctgtcgttgcatgcaacaaaaggcctggcaaaaccgcctgcgggcagccaacctggcaccccagctcagccggtataccttccagaacttcgatctcaagtattactcccgcaccctgaaggatgagctgacgggaactacatattatgatagtgcccgccattgcctggaggcagcccgtcgctttgtcaacacctaccgccaggaggatcacggccgcggcctttttattttcggcccggtaggaagtggtaaaacctttctggcagcagccattgccaacgccctgactgccgccgggagggaggttctattcgccgtcgtccccgatcttctcgatgcccttcgcgccacctatgaccgccgttccctggacaatagccatacagaactcgaactcattgatgcggcccggggggtggctatccttatccttgacgatctgggcgcccataactacactgagtggacttgtaacaaaatctattccctgatcaactaccgcctaatcaatgagttgccgacggtgataaccagtaatctggatctgaaggccctggaagaatacctgggggagcggacgacctcccggataatccagctctgtcaatccttccacctgccagtggccgaagatattcgttatatcataagccgggaaggcatcaccaaaaagtga

SEQ ID NO: 40532 - protein, 270 aa, Moorella thermoacetica ATCC 39073
MERIRIPPNLVTKNQPPNIPAPSPHYQCPLCRDRGLIIRDGRAYRCRCMQQKAWQNRLRAANLAPQLSRYTFQNFDLKYYSRTLKDELTGTTYYDSARHCLEAARRFVNTYRQEDHGRGLFIFGPVGSGKTFLAAAIANALTAAGREVLFAVVPDLLDALRATYDRRSLDNSHTELELIDAARGVAILILDDLGAHNYTEWTCNKIYSLINYRLINELPTVITSNLDLKALEEYLGERTTSRIIQLCQSFHLPVAEDIRYIISREGITKK

SEQ ID NO: 40533 - DNA, 759 bp, Moorella thermoacetica ATCC 39073
  CDS (1)..(759)
atgagcaacaaattaaccgcttacctggaaagccagatgcaggccttaaaactaaaggggatgcttgcccattaccaggagataacagaaaaagcctcgcaaaacaacctttcttataccgaatacctctcccttctcttcgaagaggagttaaaaaggaaaaacgaaggcacggtcaagacgaaaatcaataaagcgcgtttcccctttatcaaaaccctggaggaatttgactttagctttcaaccctcaatccgggaaaaagaaattatctctttaagctccctggatttcgtggagaaaaaggagaatatcatcttcctggggccgcccggggtcggcaagacccatctatcagtagccttaggtatcaaggcctgcatggccaaataccgggtagtgtttattacggctcagaaactactggaagaactacttttgagcgccaaagacggcagtctccttgacaagctattgggttactcccggctaaaccttctaatcatcgacgaactcggctacatgcctgtaactaaagaacaggccaatcttctcttccgcttggtctccatgcgttacgagaaggggagtattatcctgaccagcaactacaacttcaacgaatggggggagatattttccgaccaggtggtagccgcggccataattgaccggcttgtgcatcatgcccgcattttctatattaacggcactagctaccggctcaagggtaaactgaaagcagccaacgaccgttaa

SEQ ID NO: 40534 - protein, 252 aa, Moorella thermoacetica ATCC 39073
MSNKLTAYLESQMQALKLKGMLAHYQEITEKASQNNLSYTEYLSLLFEEELKRKNEGTVKTKINKARFPFIKTLEEFDFSFQPSIREKEIISLSSLDFVEKKENIIFLGPPGVGKTHLSVALGIKACMAKYRVVFITAQKLLEELLLSAKDGSLLDKLLGYSRLNLLIIDELGYMPVTKEQANLLFRLVSMRYEKGSIILTSNYNFNEWGEIFSDQVVAAAIIDRLVHHARIFYINGTSYRLKGKLKAANDR

SEQ ID NO: 40535 - DNA, 726 bp, Rubrobacter xylanophilus DSM 9941
  CDS (1)..(726)
atggagttcccgcccgccctgcagcggaagttcggccgccccggggagtggtactaccacccctgcaccccggagtgcgagcggaagaacgagcgcagggagtgggagctcatgcgccgcgacgcgcgggtagccgcgctgcgcgagcgcagcgggctctcgcggcgcatgaagggctacaccctgagcgggttcaacccctacgtcagcccggcggcggccaaggcgctggagaaggtggaggcctacctgaagggctgggaggagaaccgggagcagggcaggggcctgtacttctgcggcggggtgggcaccggcaagacgcacctggcggtggcggtgatgaacgagctcatccagcggaggcgggtgccctccctcttcgtcacggtccccgagctgctggacaacctgcgcggggcgtacaacgacccgggccgcgacctcgacgagtggatggacgcggtcaagaacgccgagctgctgctgctggacgacctgggggccgagaaggcgaacgagtgggtccgggagcggctcttcgtgatcatcaaccaccgctaccgggaggcgctgccgaccatcttcacctccaacatcgggcccgaggagctgccgcggcagctcggggagcggacggccagcaggatcatcgccatgtgcgagggcgtggagctggagggcccggactaccgggagaagctgcgcaacgagcggggcgcatga

SEQ ID NO: 40536 - protein, 241 aa, Rubrobacter xylanophilus DSM 9941
MEFPPALQRKFGRPGEWYYHPCTPECERKNERREWELMRRDARVAALRERSGLSRRMKGYTLSGFNPYVSPAAAKALEKVEAYLKGWEENREQGRGLYFCGGVGTGKTHLAVAVMNELIQRRRVPSLFVTVPELLDNLRGAYNDPGRDLDEWMDAVKNAELLLLDDLGAEKANEWVRERLFVIINHRYREALPTIFTSNIGPEELPRQLGERTASRIIAMCEGVELEGPDYREKLRNERGA

SEQ ID NO: 40537 - DNA, 828 bp, Polaromonas sp. JS666
  CDS (1)..(828)
atgcgtgatatcaccactgaactcaaagagctgcgcctgcacggcatggccggagcctgggccgacttgacgacccaagagggagagccaaccgatgtgggcgtacaaacctcccgttggttgatcgagcatttactgcaagccgagcacacccagcgcgccatggcctcggtgcgtcaccagatgaaggcggccaaattcccactgcatcgtgacctggcgggctttgactttgaggcggccaaggtggatcaaaagctggtgaagcaactctccacactggacttcaccgacacggcacaaaacgcggttctcattggtgggccaggcaccggcaagacgcacttggccacggccattggggtgtctggcattgcagcaaagggcaagcgcgtgcgcttttattccacggtggatctggtcaatgaattggagaaagaaaagcgcgagggcaaagccggacgcatcgcattggcactgatgcgcctggacttggtcatccttgatgagctggggtatttgcccttcagccagaccggaggtgccttgctgtttcacctgctctccaagctgtacgagcacaccagtgtggtgatcaccaccaacctgagcttctcggaatggtcggccgtgtttggcgatgccaagatgaccacggcgctgctggaccggctcacccaccactgccacatcgtggagacgggcaacgagtcctatcggttcaggcacagcaccatggccgccaagacgcgcatcaaggccagggaaagcgcccgcaaaggcagcttggcagcacccgccaccgaggagttggacgcgccgttctga

SEQ ID NO: 40538 - protein, 275 aa, Polaromonas sp. JS666
MRDITTELKELRLHGMAGAWADLTTQEGEPTDVGVQTSRWLIEHLLQAEHTQRAMASVRHQMKAAKFPLHRDLAGFDFEAAKVDQKLVKQLSTLDFTDTAQNAVLIGGPGTGKTHLATAIGVSGIAAKGKRVRFYSTVDLVNELEKEKREGKAGRIALALMRLDLVILDELGYLPFSQTGGALLFHLLSKLYEHTSVVITTNLSFSEWSAVFGDAKMTTALLDRLTHHCHIVETGNESYRFRHSTMAAKTRIKARESARKGSLAAPATEELDAPF

SEQ ID NO: 40539 - DNA, 951 bp, Pseudomonas alcaligenes
  CDS (1)..(951)
atggcaatgcacggctggaagccgctgccgagcgggccgtccagctgcgcgccttcaccgggcgcagcgtgcgcagcctgctccagcaaggcctggatcagcagccgctgcccaagcgcgcggctgaaacggccttgcccgagcaccacgaaaacgtccgtggcgccgactactaccaacccccgcaacaggagctgttcgatgatgccgcaacacaccctgaatcaactgcaccagctacgcctggacggcatggcccgcgccctggaggagcaatggacgctgccggccagccacagcctgagcttcgatgaacgcctcggcttactgctcgaccgcgaactggcctggcgtgacaaccagcgcctggtacggctgcgcaagaaggccaagctcaagtacgccaacgcctgcctggaagatttcgaccgccgctccggacgcgccctggacgagcgtctgatcgccaccctggccagtggcgactggatccgccagcagcacaacctgctgctgaccggcccgaccggtgccggcaaaacctggctggcctgcgccctgggcaaccaggcctgccgccagggctatagcaccctgtacctgcgcaccccgcgcctgctggaacaactgcgcatcgctcatggcgacggcagcttcggccgcaccctgcaacagctggcaaaggtcgacgtcctggtgctggacgactgggcgctagccccgctggaggaaggagcccggcatgacctgctggaggtgatcgacgaccgcgctggcagccgctccaccatcctgacgagccaactgcccatcgagcactggcacggctggatcaacgacccgaccctggccgatgccatcctcgaccgcctggtgcacaacgcctaccggctgacgatgaaaggcgagtcgctgcgccgaaaaaaagccgaggaacaagccgcatcgtga

SEQ ID NO: 40540 - protein, 316 aa, Pseudomonas alcaligenes
MAMHGWKPLPSGPSSCAPSPGAACAACSSKAWISSRCPSARLKRPCPSTTKTSVAPTTTNPRNRSCSMMPQHTLNQLHQLRLDGMARALEEQWTLPASHSLSFDERLGLLLDRELAWRDNQRLVRLRKKAKLKYANACLEDFDRRSGRALDERLIATLASGDWIRQQHNLLLTGPTGAGKTWLACALGNQACRQGYSTLYLRTPRLLEQLRIAHGDGSFGRTLQQLAKVDVLVLDDWALAPLEEGARHDLLEVIDDRAGSRSTILTSQLPIEHWHGWINDPTLADAILDRLVHNAYRLTMKGESLRRKKAEEQAAS

SEQ ID NO: 40541 - DNA, 660 bp, Pseudomonas alcaligenes
  CDS (1)..(660)
atgcgctcggtgagccaccagatgaacatggccaagctgccgatgcaccgcgatctggccggcttcgacttcagcgcctccagcgccgacgctcgcttgatcagcgagctggccaatctgagctttaccgacaccgcgcagaacgtggtgctgatcggtgggccaggcaccggtaaaacccacctagccaccgcgctggccgtgtccggcatcacccggcacggtaagcgcgtgcgcttctactccacggtcgatctggtcaatttgctggagcgcgaaaaacacgacggcaaagccgggcggatcgcccaggcactgctgcgcatggatctggtcatcctcgacgaactgggttatctgccgttcagccaggctggcggtgcgttgctgtttcacctgctgtccaagctgtacgaacacaccagcgtggtgatcaccaccaacctgagcttcgccgaatggtcgagcgtgttcggcgacgccaagatgaccaccgccctgctggatcggctgacccaccactgccaacattcgtcgaaaccggtaacggagtcctattcgcctgcaaacacagtagcttggcggcccaggccaagatcaaatcacggggagcgaaagcgtaagggcggccaggaaccggaggacgatgagccgttctga

SEQ ID NO: 40542 - protein, 219 aa, Pseudomonas alcaligenes
MRSVSHQMNMAKLPMHRDLAGFDFSASSADARLISELANLSFTDTAQNVVLIGGPGTGKTHLATALAVSGITRHGKRVRFYSTVDLVNLLEREKHDGKAGRIAQALLRMDLVILDELGYLPFSQAGGALLFHLLSKLYEHTSVVITTNLSFAEWSSVFGDAKMTTALLDRLTHHCQHSSKPVTESYSPANTVAWRPRPRSNHGERKRKGGQEPEDDEPF

SEQ ID NO: 40543 - DNA, 780 bp, Azoarcus sp
  CDS (1)..(780)
atgaacctgcaatacgaacggatccaggcgctgtgccagacgctgagcctgccgctgaccgcccaaggctacgccgcagcggcccagcaggcggccaccgaccaactggcctacagcgacttcctcgagcagttgctgcgggccgaggcggccggtcgtcagagccgcaagcaaagcatgctcacgcgcctggcgggcttcccggcgatcaagacgctcgaggacttcgactatggctttgccagcgggctcaagcgcagccagctcgaggagttggccagcctcgccttcgtcgagcgtgccgagaacgttgtgctggtgggccccagcggggtgggcaagacccatctggccatcgcgctgggctaccgcgccacgcaggccggcatcaagacgcgcttcaccaccgccgccgacctgctgctgacgctggtcctggcgcatgagcgcaaccagctcaagaacgtgatgcagcgggcgatcaacgcctaccggctgttgatcgtcgacgagatcggctacctgccgatgacgcgcgagcaggccaacctgttcttccaggtgatcgcggcgcgctacgagcggggcagcctgatcgtgaccagcaatctgtcgttcgggcagtgggacagcaccttcgcccaggacgcgacgctcacggcggccctgctggatcggttgctgcatcacgcgcacatcgtgccgatcagcggcgagagctaccggctgaaacaccagcgcaaggccgggatggtgcaagcgctggcgatcgccggctga

SEQ ID NO: 40544 - protein, 259 aa, Azoarcus sp
MNLQYERIQALCQTLSLPLTAQGYAAAAQQAATDQLAYSDFLEQLLRAEAAGRQSRKQSMLTRLAGFPAIKTLEDFDYGFASGLKRSQLEELASLAFVERAENVVLVGPSGVGKTHLAIALGYRATQAGIKTRFTTAADLLLTLVLAHERNQLKNVMQRAINAYRLLIVDEIGYLPMTREQANLFFQVIAARYERGSLIVTSNLSFGQWDSTFAQDATLTAALLDRLLHHAHIVPISGESYRLKHQRKAGMVQALAIAG

SEQ ID NO: 40545 - DNA, 768 bp, Azoarcus sp
  CDS (1)..(768)
atgatgctcaccgaactgcgcttgcccaccatcaagcgtctgtggccggccctggccgagcagtccaaccgcgagggctggcctgccgagcggtttctggcggcactgtgcgagcacgaaatgaatgagcgcgagcggcgccgtatcgatcgccatcgggccgagtcgggcctgccgccggacaagcggctgtcagcgttcgacttcgccgccgtgcccacggtctccaaagcccacgtcactgcgcttgccgagggcgacagctggctcgagcaaggtgccaacatcctgctgttcggcccgccaggcgtgggcaagacgcatctgattgccagcctgggccacgcgctcgtcgaacgcggataccgcgtgctcttcacccgcacgagcgatctggtgcagcggctgcaagccgcccggcgggatttgcggctaccggccgaactggccaagctcgatcgtttcgatctgctgatctgcgacgacttcagctatgtccgccgcgatcagggcgagacttcggtgctgttcgaactcatcgccgaacgctacgagcgcaagagcctggccatcacggccaaccagccgttctccggctgggatcacgtctttgccgaaccggccatgacgctggccgccgtcgatcgcctggtgcatcacgccacgatcttcgagatgaacgtggagagtttccgtcgccgcgttgctcagaaggggctcgccccttctgagcaacgcaaaccccaaacctcaaacccgaaaggctga

SEQ ID NO: 40546 - protein, 255 aa, Azoarcus sp
MMLTELRLPTIKRLWPALAEQSNREGWPAERFLAALCEHEMNERERRRIDRHRAESGLPPDKRLSAFDFAAVPTVSKAHVTALAEGDSWLEQGANILLFGPPGVGKTHLIASLGHALVERGYRVLFTRTSDLVQRLQAARRDLRLPAELAKLDRFDLLICDDFSYVRRDQGETSVLFELIAERYERKSLAITANQPFSGWDHVFAEPAMTLAAVDRLVHHATIFEMNVESFRRRVAQKGLAPSEQRKPQTSNPKG

SEQ ID NO: 40547 - DNA, 750 bp, Burkholderia multivorans
  CDS (1)..(750)
atgttgatgcagcacacccttacccagctaaaggcgctcaaactggacggcatggctcgcgcgttcgaggagcagtcaacgctcacggcaagcaccagcctgtcattcgaggaacgcgtgggcatgctcgtagatcgcgagctggcctggcgtgatacgcgacgactcgaacgtttgctgcgcgccgcgaagctcaagaacccacaggcctgcgtcgaagacattgaataccggcaaacccgtgggctggaccagcgcatcgtcgccacgctcgccggctgcgactgggtgcgcaatgctcagaacctgatcctgaccggccccaccggcgcgggcaagacgtggctcgcttgcgcgttcggccagcaggcgtgccggcagggcttctccgtgttctatgtgcgcgtcgcgcggctgttcgaagagctgaaaatcgcgcacggcgacggcagcttcacacgtcggcttgcgcaactcgcgaagattgatgtgctgatcctcgacgattggggcttgcaggatctcgaccaggcggcgcgcaatgatctgcttgaggtacttgatgatcgtgtcggtacgcgctcgactgtgatcaccagccagttgccgctcgaacactggcacgcgtggctgcaggaccccacgctcgccgatgcgattctcgatcggctcgtgcatcaggcccacaagcttccggtcaagggcgattcgatgagaaagaaaacgaaatccgagtccgctgacgcctga

SEQ ID NO: 40548 - protein, 249 aa, Burkholderia multivorans
MLMQHTLTQLKALKLDGMARAFEEQSTLTASTSLSFEERVGMLVDRELAWRDTRRLERLLRAAKLKNPQACVEDIEYRQTRGLDQRIVATLAGCDWVRNAQNLILTGPTGAGKTWLACAFGQQACRQGFSVFYVRVARLFEELKIAHGDGSFTRRLAQLAKIDVLILDDWGLQDLDQAARNDLLEVLDDRVGTRSTVITSQLPLEHWHAWLQDPTLADAILDRLVHQAHKLPVKGDSMRKKTKSESADA

SEQ ID NO: 40549 - DNA, 702 bp, Rhizobium sp
  CDS (1)..(702)
atgggcctggccggcatggcaaaggccttcagtgaactcgttggcaacggcgaagccgaacatctctcgcacgccgaatggctcggattactgctcgaacgggaatggagctcccgttacgatcgcaagcttgcggcacgcctccggtttgccaagcttcgccaccaggctaccccggaagatgtcgattatcgcgccgaacgcggccttgaccgcgccctcttcatgaaactgctcgctggcgactggatcaacgcgcatgacaatctggccatctgcggaccctcaggtgtcggaaagagttggttggcttgcgctcttggccacaaggcttgccgcgacgatcgctcagtgctctatcagcgtgtcccgaggctgtttgctcagcttgcgctcgctcgtggtgacggcaggtatgcccggctgcaacggaccttgggccatgttcagctcctgatcctcgatgattggggactcgagccgctcaacgaacaggcccgtcacgatctgctcgaaatcctcgaagatcgctacggccgtcgatcgacgatcattaccagccaacttcccgtatccgcatggcacggcgtcatcggcgacccaacctatgccgatgccatactcgacaggttggtccacaatgctcaccgcattgaactgagcggcgaaagcctacgccgaaatctgccgcgcaaagcttga

SEQ ID NO: 40550 - protein, 233 aa, Rhizobium sp
MGLAGMAKAFSELVGNGEAEHLSHAEWLGLLLEREWSSRYDRKLAARLRFAKLRHQATPEDVDYRAERGLDRALFMKLLAGDWINAHDNLAICGPSGVGKSWLACALGHKACRDDRSVLYQRVPRLFAQLALARGDGRYARLQRTLGHVQLLILDDWGLEPLNEQARHDLLEILEDRYGRRSTIITSQLPVSAWHGVIGDPTYADAILDRLVHNAHRIELSGESLRRNLPRKA

SEQ ID NO: 40551 - DNA, 741 bp, Enterococcus faecium
  CDS (1)..(741)
atgaagaatagccattatcaagaactgatgaccaacctagaaacgctcggtttaaatcacatgcgggagtatgttcccaattatatcgaggttgccaatcgagaggagctttccttgacggaagctcttctggaattaacgcgaaaggaagtcaatcatcaacataaccagaaaatgaatcgcgtgatagagcgagcgcgctttcctaaacggaccagtctagaggaatttgattttaccttccagccaagtattaataaacgtgaactgctggatttaaagcacatgggtttcgtagaaaagcatgagaacctggtctttattgggagcccaggagttgggaaaacgcatctaacgattgccttaggaattgaagcctgccatcaagggtaccggactttattcatcccttgtcatgagcttcttttacgcttacgagctgcctatgagaaaggcacgcttgagcgagtactaaaccgatatgcacgatatgatgtgttgattattgatgagattggctatctaccgatacaaaaacaagaagccgatttgttcttccagcttctggccatgcgttatgaacaccgctctacgattattacgacaaatatcgtcttatctcgatggggtgaattgtttcaaagcccagaaatcgcggcagcgatccttgaccgactggttcatcatgtcaaagtgttcaagattaccggcaagtcttatcgtatgagaaataaaatctaa

SEQ ID NO: 40552 - protein, 246 aa, Enterococcus faecium
MKNSHYQELMTNLETLGLNHMREYVPNYIEVANREELSLTEALLELTRKEVNHQHNQKMNRVIERARFPKRTSLEEFDFTFQPSINKRELLDLKHMGFVEKHENLVFIGSPGVGKTHLTIALGIEACHQGYRTLFIPCHELLLRLRAAYEKGTLERVLNRYARYDVLIIDEIGYLPIQKQEADLFFQLLAMRYEHRSTIITTNIVLSRWGELFQSPEIAAAILDRLVHHVKVFKITGKSYRMRNKI

SEQ ID NO: 40553 - DNA, 660 bp, Aeromonas hydrophila
  CDS (1)..(660)
atgagcgctctccaacatcaacggatcgcagaactctgcgaacagtttcggcttgatcgtatcgcatctgaatggccggctctcgcgcagcaagcgatagataacgcctcttcactaggtgattttcttgagcaacttctgaagctggagtctgacagtcgtgatgagcgtcgacgccagacgctgttacgcctttcaggtttaccagtagtcaagacgctggagcagttcgacttcaagttcgccagtggcgcacctcgggcacagatacaggaactggcgagcctggcgttcatcgaacggaaggagaatgtcgtgttcttgggaccatctggcgtagggaaaagtcaccttgctggcgcattggcatacaggtgtgccatggctgggctgagtacccggtttatcaccgcagcagacatgatgttgcaattggtcgccgcacatcgtcagggggagcttaaaggctatctgaatcgcatcatccacaagccaagattactggttattgacgagatcggttatctgccttttggcaaagaggaggctaacttattcttccaggttgtcgccaggcgttacgagtcaggcagtctgatattgactagcaatctgccatttacacagtggtcgagcacatttgggatgatgaaacactga

SEQ ID NO: 40554 - protein, 219 aa, Aeromonas hydrophila
MSALQHQRIAELCEQFRLDRIASEWPALAQQAIDNASSLGDFLEQLLKLESDSRDERRRQTLLRLSGLPVVKTLEQFDFKFASGAPRAQIQELASLAFIERKENVVFLGPSGVGKSHLAGALAYRCAMAGLSTRFITAADMMLQLVAAHRQGELKGYLNRIIHKPRLLVIDEIGYLPFGKEEANLFFQVVARRYESGSLILTSNLPFTQWSSTFGMMKH

SEQ ID NO: 40555 - DNA, 792 bp, Pseudomonas stutzeri
  CDS (1)..(792)
atggcggaactcaaggagctgcgcctgcacggcatggccacggcctgggcggagttaactgcacagggtgagtcgaacacagcctcgtccaagtggctgctcgaacacctgctggaacaagagcacacagatcgcgccatgcgctcggtgagccaccagatgaacatggccaagctgccgatgcaccgcgatctggccagcttcgatttcaacgcctctagcgccgacgcacgcctgatcagcgagctggccagcctggcctttaccgacaccgcgcagaacgtggtgctgatcggtgggccaggcaccggtaaaacccacctagccaccgcgctggccgtgtccggcatcacccggcacggtaagcgcgtgcgcttctactccacggtcgatctggtcaatctgctggagcgcgaaaaacacgacggcaaagccgggcggatcgcccaggcactgctgcgcatggatctggtcatcctcgacgaactgggttatctgccgttcagccaggctggcggtgcgttgctgtttcacctgctgtccaagctgtacgaacacaccagcgtggtgatcaccaccaacctgagcttcgccgaatggtcgagcgtgttcggcgacgccaagatgaccaccgccctgctggatcggctgacccaccactgccacatcgtcgaaaccggtaacgagtcctatcgcctgcaacacagtagcttggcggcccaggccaagatcaaatcacgggagcgaaagcgtaagggcggccaggaaccggaggacgatgagccgttctga

SEQ ID NO: 40556 - protein, 263 aa, Pseudomonas stutzeri
MAELKELRLHGMATAWAELTAQGESNTASSKWLLEHLLEQEHTDRAMRSVSHQMNMAKLPMHRDLASFDFNASSADARLISELASLAFTDTAQNVVLIGGPGTGKTHLATALAVSGITRHGKRVRFYSTVDLVNLLEREKHDGKAGRIAQALLRMDLVILDELGYLPFSQAGGALLFHLLSKLYEHTSVVITTNLSFAEWSSVFGDAKMTTALLDRLTHHCHIVETGNESYRLQHSSLAAQAKIKSRERKRKGGQEPEDDEPF

SEQ ID NO: 40557 - DNA, 744 bp, Pseudomonas aeruginosa
  CDS (1)..(744)
atgcctactgatcgtatttctgaactcaaaaacctgcacctgcatggtatggcgagtgctttacaagagctgcttgctgaagcctcacgtcggcctgcgcggccagagctttggctcgatcgattgatcgaagccgaacaggcggaccgccaagtgcgccgtttgagctatcagctcaaagcggctcgcttcccaatccaccgtgacctgggcggcttcgactggcaagaaacaccattgatccgtgaatccatcgagcaactggccgagggaacgttcatggacggtgcgcacaacctgattttggtgggaggcaccggcactggcaaaacccacctggccaccgccttgggagttggggccatccatcaaggcaagcgggtgcgcttttacaacgctgtagacctagtcaatcacctggagcgggaaaagcaacaaggcaaggccggcaaccttgccaaacaactgcagcatatcgacgccgtgatcctggatgagctgggctatctgccgttccctgactcgggtggggcgctgttgtttcacttgatcagccagctctacgagaagacttcgttgatcgtgacgaccaatttgtccttcggagagtgggtcagtgtgtttggtgacgccaagatgacaacggcgctattggaccgtctgactcaccactgcgaaatccttgagacgggtaatgactctttccgcttcaaacaacggaaaaaggccgtgaaaaaagcttga

SEQ ID NO: 40558 - protein, 247 aa, Pseudomonas aeruginosa
MPTDRISELKNLHLHGMASALQELLAEASRRPARPELWLDRLIEAEQADRQVRRLSYQLKAARFPIHRDLGGFDWQETPLIRESIEQLAEGTFMDGAHNLILVGGTGTGKTHLATALGVGAIHQGKRVRFYNAVDLVNHLEREKQQGKAGNLAKQLQHIDAVILDELGYLPFPDSGGALLFHLISQLYEKTSLIVTTNLSFGEWVSVFGDAKMTTALLDRLTHHCEILETGNDSFRFKQRKKAVKKA

SEQ ID NO: 40559 - DNA, 780 bp, Rhizobium sp
  CDS (1)..(780)
atgcgtcatgatccggccagcgccgctgtggttgtcatgctacgtggcctcaaaatgtatggcatggcgcaagccgctggtgatctgatcgagcagggcgcgccagcctttgatgctgccgttccgatcctctcacagcttctcaaggcggagatgtccgagcgggaggtcaggtccattgcttaccagatcaaggcagcccggttcccggcctacaaggatctggcaggcttcgactttgccgtcagtgaggtcaacgaggcgctcgtgcgtcaacttcaccgtggtgactttatggatagcgccgacaacgtcgtactgatcggcggaccaggcaccggcaaaagccacatcgcgacggctttgggcgtccaggcggttgagcatcaccgcaaaaagatccgcttcttctccaccgtcgatctggtcaatgcgttggagcaggaaaaggccgcaaacagagcgggccagttggccgagcgtctgttgcgcctcgacctcgtcatccttgatgagctgggatatctacccttcagcccttcaggcggggccatgctgttccatctgctcagcaaactctatgagcggaccagcgttgttatcaccaccaacctgagcttcagcgagtggtccagtatctttggcgatgccaaaatgaccaccgccctgctggatcgcctcacgcatcattgccatatccttgaaaccggcaatgacagcttccgcttcagagccagttccgccgccccaaaatccagaaaggacaaatcacccgcttga

SEQ ID NO: 40560 - protein, 259 aa, Rhizobium sp
MRHDPASAAVVVMLRGLKMYGMAQAAGDLIEQGAPAFDAAVPILSQLLKAEMSEREVRSIAYQIKAARFPAYKDLAGFDFAVSEVNEALVRQLHRGDFMDSADNVVLIGGPGTGKSHIATALGVQAVEHHRKKIRFFSTVDLVNALEQEKAANRAGQLAERLLRLDLVILDELGYLPFSPSGGAMLFHLLSKLYERTSVVITTNLSFSEWSSIFGDAKMTTALLDRLTHHCHILETGNDSFRFRASSAAPKSRKDKSPA

SEQ ID NO: 40561 - DNA, 780 bp, Salmonella enterica subsp
  CDS (1)..(780)
atgaacctccagcatgagcggatcgacgccctgtgccagcaactcaaactcgaacgggtggcaacgcattaccccgtcctggcgcagcaggcggtgcgcgaggacttcagcttcaccgacttcctggaacacctgttgcggcatgaagcggggtgtcgccagcagcgcagccgcgaactgctgacgcggatggcttgcttcccgggcatcaagaccctggaggactatgacttcagcttcaaccccggcgtgcccaaggcactggtgcaggagctgggcagtctggcgtttgtcgaacgggccgagaacgtggtgctgatcggaccctctggcatcggcaagacccacctcgccatcgccttgggttacaaggccgcgcaagccggggtcaagacacgcttcatcacggcagccgacctgatgctgcaactgagcacggcgcagcgacaagggcggctgaaggaatacttcaaccgcgccatcctcggtccacggctgctggtgatcgatgagatcggctacctgcctttcggacgcgaggaagcgaacctgttctttcaggtggtggcgaagcgctatgagaaaggggcgatgatcctgacctcgaacctgccgttcagccagtgggccgacgcgtttgccggcgataccaccctgacagccgcgatgctggatcggctgctgcaccatgcccatatcctgaccctgagcggcgaaagctaccgcttgaaggacaagaggaaggcgggagtggtcaggaaaaattccaaacccgaatga

SEQ ID NO: 40562 - protein, 259 aa, Salmonella enterica subsp
MNLQHERIDALCQQLKLERVATHYPVLAQQAVREDFSFTDFLEHLLRHEAGCRQQRSRELLTRMACFPGIKTLEDYDFSFNPGVPKALVQELGSLAFVERAENVVLIGPSGIGKTHLAIALGYKAAQAGVKTRFITAADLMLQLSTAQRQGRLKEYFNRAILGPRLLVIDEIGYLPFGREEANLFFQVVAKRYEKGAMILTSNLPFSQWADAFAGDTTLTAAMLDRLLHHAHILTLSGESYRLKDKRKAGVVRKNSKPE

SEQ ID NO: 40563 - DNA, 804 bp, Lactococcus delbrueckii bacteriophage LL
  CDS (1)..(804)
atgggaatcgcgatggcggcacttgccagtgccatgagcgccaaagaaacgggggacacgtgctccaagcaccactgcccgctcctgtcatccaagaccgtgagagacggggcgttccgcacctactgtccgcagtgcgacttggaaaaactcaagtcactccagctggactttgaccgcaaggcccaggcggaaatcgaggccaggaagtttcgggaaaactcgctggtcagtcccaagatgtgggactgcaccttcgacagcttcgttgccgaagaagggagcagggaagcagtgatgaagaagcgggtaggcaaggctgctgaagcttttgccgccaagaaggtcgctcaccatgctgtcctctacggccagccgggagcaggtaagagccatttggctatggccctcatgcaggaagtccaccggacgagcgggcagaccatggcctttataaacattagccggcttttctccagactcaagaactcgtttgacgatccctcagagtactggactaaggaaaaggcgctccagatcatgaccagcgttgacttgctgtgcatcgacgacctgggcacggagtcgagcatgggccgatctggtcaggaagccacaaagtgggcccaggacatcatctacgatgttttggagaatcaagaccggatcgtcatcacgactaatctgtcggaacaagaaatgaaacgggtttatgatgccaagatcttcagccggatcttttctaacagcaaaaacacgcgatttgacttcactggcatttcagacaagaggatagaaggatga

SEQ ID NO: 40564 - protein, 267 aa, Lactococcus delbrueckii bacteriophage LL
MGIAMAALASAMSAKETGDTCSKHHCPLLSSKTVRDGAFRTYCPQCDLEKLKSLQLDFDRKAQAEIEARKFRENSLVSPKMWDCTFDSFVAEEGSREAVMKKRVGKAAEAFAAKKVAHHAVLYGQPGAGKSHLAMALMQEVHRTSGQTMAFINISRLFSRLKNSFDDPSEYWTKEKALQIMTSVDLLCIDDLGTESSMGRSGQEATKWAQDIIYDVLENQDRIVITTNLSEQEMKRVYDAKIFSRIFSNSKNTRFDFTGISDKRIEG

SEQ ID NO: 40565 - DNA, 876 bp, Lactococcus lactis
  CDS (1)..(876)
atggcagatggaatccgagagttccataaaaagagagaagttaaaacaggtctattttgtgaaaaacatcaacaaaccgaacttgttagatataaacatccagtaagtatagattatgatccgttgattcatggcgagttagttgatggtttgcaggtaacctcaatgagttattgtacagaatgtgctaaagagggaatataccaacatcaccaacaatcaagtgctgaaataaaagcaaatgaagatttcttgaataaaagtaagtatggaaaatatagcttgcttaaaacacaaagccttgtgggcaaaaaatcgctctggtttgcacgtttcaatacttttaaggtaaatggcttagaagagcaaaacgtgttgaatcaggcccaaagaatagccagagagtacactcaaggtcagaggtttaacactgtgtttgttggcggagctggtagagggaaatctcacttagcaatggccattttgcaagaagttaacgagaatctcaaagatgataaattctcaacactatttatcaatattagtgaattgattcgagagataaaaaatagttggaattactctgataccaaggcggaagaagagcgactgacaacattaatgcgaacagttgatttgcttgttattgatgatttaggaactgaaagcacgttttctaaagataatagctgggtacaaggtgttatttacaatatttacaatgcaagagaaggcaatacgattatcacgtcaaaccttactggtaaagaaatgcgttcatcttatgacgataaaatagtttctcgaatcatggaaggctcaaaaaatagtgttgttaaatttgagggaattactgacaagaggaaaagtaaatga

SEQ ID NO: 40566 - protein, 291 aa, Lactococcus lactis
MADGIREFHKKREVKTGLFCEKHQQTELVRYKHPVSIDYDPLIHGELVDGLQVTSMSYCTECAKEGIYQHHQQSSAEIKANEDFLNKSKYGKYSLLKTQSLVGKKSLWFARFNTFKVNGLEEQNVLNQAQRIAREYTQGQRFNTVFVGGAGRGKSHLAMAILQEVNENLKDDKFSTLFINISELIREIKNSWNYSDTKAEEERLTTLMRTVDLLVIDDLGTESTFSKDNSWVQGVIYNIYNAREGNTIITSNLTGKEMRSSYDDKIVSRIMEGSKNSVVKFEGITDKRKSK

SEQ ID NO: 40567 - DNA, 843 bp, Pseudomonas sp
  CDS (1)..(843)
atgttgcccaacccgacactcgacaagctacaaaccctgcgcctgcatggcatgatcaaggcgcttggcgaacaacacgcaacgcctgacatcaacgatctcagcttcgacgaacgcctcggcctgatggtcgaccgcgagctgaccgagcgcgaagacgcccgcctgacgactcgcctcaaagccgcacgactgcgccataacgcctgcctggaagacatcgattaccgcagccctcgtggcctggacaaggcgctgatcctgcaactgggtagcggcccagtgctgcgcgatggcctgaacctgatcatcggcgggccgacgggcgtaggcaaaacctggctcgcctgcgcgctggctcataaagcttgccgcgacggttacagcgtgcgctatctgcgcctgccgcgcttgatggaagaactgggcctggcacacggcgacggccgcttcgccaagctaatggccggctacgccaagaccgacctgctgatcctggatgactggggactggcaccgtttaccgctgtgcaacgccgcgacatgctcgaactactggacgaccgctacggcaaccgctcgacgctggtgaccagccagatgccggtggacatggcatgcactgatcggcgatccgaccttgggcgacggatcctagaccggctggtgcacaacgcatataggatcgaactgaagggcgaatctatgcgcaggcgcgcaacgaaattgacggccggcagggacttcagactaacaatgcaaacctgcgtcgctgcgctccgactgcctgccaagtggacgggatcaggtgtcacaagtgcggtggaacgagtgtccaaatga

SEQ ID NO: 40568 - protein, 280 aa, Pseudomonas sp
MLPNPTLDKLQTLRLHGMIKALGEQHATPDINDLSFDERLGLMVDRELTEREDARLTTRLKAARLRHNACLEDIDYRSPRGLDKALILQLGSGPVLRDGLNLIIGGPTGVGKTWLACALAHKACRDGYSVRYLRLPRLMEELGLAHGDGRFAKLMAGYAKTDLLILDDWGLAPFTAVQRRDMLELLDDRYGNRSTLVTSQMPVDMACTDRRSDLGRRILDRLVHNAYRIELKGESMRRRATKLTAGRDFRLTMQTCVAALRLPAKWTGSGVTSAVERVSK

SEQ ID NO: 40569 - DNA, 1368 bp, Lactococcus lactis
  CDS (1)..(1368)
atggcatcccttaatgaaaatcaaaaattttgggcccgtgtaaccgaactagctcagcagagtatcggtaaacaagcttatgatttttttattgagcctgctcaattaatgtctgtcgagcaagatactgccaatatcttgcttgatagtggaatgaaaaaagattattggaaaaaacagtccgatttgatcacaacggcgggatttgaggtctttggtcggatgattgattatgaactctatgcaaatgatgagttaactgaactggaacttcatcgtttaaataatcaatcttctattgaagagcagccgcgttctactgctaaacccgcttctcctttggttagtggtctcaacgagaaatataattttgaaaattttgtgcaaggtcctggtaaccgttggactttggctgcggcaattgctgttgctgataaacctggtgatacctataatccactatttatttatggtggagctggtctaggtaagacgcatttaatgcatgcaattggaaatcagattttgactgacaatccgactgctcgaattaaatatgtttcttcggagaatttcgttaacgactatgttaatgcaacgcgaaaaaaccaaatggagaattttgaaaatacttatcgtaatttagatttacttctattggacgatgtgcaatttttcagtgataaagaggggacgaaaaatgaatttttcaataccttcaacgcactctatgataaaggttcccaaattgttttaacttctgatcgtattccgcaagaattaaataatttggaagatcgcttggtttcacgcttctcttggggtttgactactgatattacggctcctgactatgaaactcggatggctattcttttgattaaatctgaatcaagtcgtttagaatttccgagtgaaactctatcttatattgctggtcagattgattcaaacgttcgagaactcgagggcgctctaaatcgagtcgaatttgtggctcgagcaaatggcattgcggtggtcgatattgagacagcaagtcaggctttgcgttctttaaaaaatgcaactcagcaatctttatcaaatcttactattaaaaaaattcaagatgaagttgctaattattatcatatttcattttcagatcttgttggtcctaagcgccctaaggaaattgcctttccaagacagattgcgatgtatcttgtcagagaacttttaggtacaagtcttccggcaattggaactgcttttggtggccgtgaccacacaacggtaatgtatgcttataaacaaatttcggataagatgaaaaatgatatggatgttcaaaaagacatcgacagcattaaacgtaaattttaa

SEQ ID NO: 40570 - protein, 455 aa, Lactococcus lactis
MASLNENQKFWARVTELAQQSIGKQAYDFFIEPAQLMSVEQDTANILLDSGMKKDYWKKQSDLITTAGFEVFGRMIDYELYANDELTELELHRLNNQSSIEEQPRSTAKPASPLVSGLNEKYNFENFVQGPGNRWTLAAAIAVADKPGDTYNPLFIYGGAGLGKTHLMHAIGNQILTDNPTARIKYVSSENFVNDYVNATRKNQMENFENTYRNLDLLLLDDVQFFSDKEGTKNEFFNTFNALYDKGSQIVLTSDRIPQELNNLEDRLVSRFSWGLTTDITAPDYETRMAILLIKSESSRLEFPSETLSYIAGQIDSNVRELEGALNRVEFVARANGIAVVDIETASQALRSLKNATQQSLSNLTIKKIQDEVANYYHISFSDLVGPKRPKEIAFPRQIAMYLVRELLGTSLPAIGTAFGGRDHTTVMYAYKQISDKMKNDMDVQKDIDSIKRKF

SEQ ID NO: 40571 - DNA, 1545 bp, Pseudomonas aeruginosa
  CDS (1)..(1545)
gtgtccgtggaactttggcagcagtgcgtggatcttctccgcgatgagctgccgtcccaacaattcaacacctggatccgtcccttgcaggtcgaagccgaaggcgacgaattgcgtgtgtatgcacccaaccgtttcgtcctcgattgggtgaacgagaaatacctcggtcggcttctggaactgctcggtgaacgcggcgagggtcagttgcccgcgctttccttattaataggcagcaagcgtagccgtacgccgcgcgccgccatcgtcccatcgcagacccacgtggctcccccgcctccggttgctccgccgccggcgccagtgcagccggtatcggccgcgcccgtggtagtgccacgtgaagagctgccgccagtgacgacggctcccagcgtgtcgagcgatccctacgagccggaagaacccagcatcgatccgctggccgccgccatgccggctggagcagcgcctgcggtgcgcaccgagcgcaacgtccaggtcgaaggtgcgctgaagcacaccagctatctcaaccgtaccttcaccttcgagaacttcgtcgagggcaagtccaaccagttggcccgcgccgccgcctggcaggtggcggacaacctcaagcacggctacaacccgctgttcctctacggtggcgtcggtctgggcaagacccacctgatgcatgcggtgggcaaccacctgctgaagaagaacccgaacgccaaggtggtctacctgcattcggaacgtttcgtcgcggacatggtgaaggccttgcagctcaacgccatcaacgaattcaagcgcttctaccgctcggtggacgcactgttgatcgacgacatccagttcttcgcccgtaaggagcgctcccaggaggagttcttccacaccttcaatgcccttctcgaaggcggccagcaggtgatcctcaccagcgaccgctatccgaaggaaatcgaaggcctggaagagcggctgaaatcccgcttcggctggggcctgacggtggccgtcgagccgccggaactggaaacccgggtggcgatcctgatgaagaaggccgagcaggcgaagatcgagctgccgcacgatgcggccttcttcatcgcccagcgcatccgttccaacgtgcgtgaactggaaggtgcgctgaagcgggtgatcgcccactcgcacttcatgggccggccgatcaccatcgagctgattcgcgagtcgctgaaggacctgttggcccttcaggacaagctggtcagcatcgacaacatccagcgcaccgtcgccgagtactacaagatcaagatatccgatctgttgtccaagcggcgttcgcgctcggtggcgcgcccgcgccaggtggccatggcgctctccaaggagctgaccaaccacagcctgccggagatcggcgtggccttcggcggtcgggatcacaccacggtgttgcacgcctgtcgtaagatcgctcaacttagggaatccgacgcggatatccgcgaggactacaagaacctgctgcgtaccctgacaacctga

SEQ ID NO: 40572 - protein, 514 aa, Pseudomonas aeruginosa
MSVELWQQCVDLLRDELPSQQFNTWIRPLQVEAEGDELRVYAPNRFVLDWVNEKYLGRLLELLGERGEGQLPALSLLIGSKRSRTPRAAIVPSQTHVAPPPPVAPPPAPVQPVSAAPVVVPREELPPVTTAPSVSSDPYEPEEPSIDPLAAAMPAGAAPAVRTERNVQVEGALKHTSYLNRTFTFENFVEGKSNQLARAAAWQVADNLKHGYNPLFLYGGVGLGKTHLMHAVGNHLLKKNPNAKVVYLHSERFVADMVKALQLNAINEFKRFYRSVDALLIDDIQFFARKERSQEEFFHTFNALLEGGQQVILTSDRYPKEIEGLEERLKSRFGWGLTVAVEPPELETRVAILMKKAEQAKIELPHDAAFFIAQRIRSNVRELEGALKRVIAHSHFMGRPITIELIRESLKDLLALQDKLVSIDNIQRTVAEYYKIKISDLLSKRRSRSVARPRQVAMALSKELTNHSLPEIGVAFGGRDHTTVLHACRKIAQLRESDADIREDYKNLLRTLTT

SEQ ID NO: 40573 - DNA, 741 bp, Buchnera aphidicola
  CDS (1)..(741)
atgacattttataatgaattttttaaacgccttcaacgtcttatgcctagtaatgtaaaaccaaaatttgaaagtgatcaagatttattagcttggaatcaagaacaaggtaggctatcttcagaatctatattacgtgaaaacaaagctatgaaaatgcaacgcgttttaggaagatcaggaatacgtgaattatatatgaattgttcttttgaaaactataaaattgaacatgatggacaaagaaaggtactgaaagcagcaaaacgttatgctgaagaatttaatgaaaacattgcaagttttattttttcaggaagaccaggaactggaaaaaatcatttagcatcagctataggtaattatttaattttacatggaaaaagtattttaattgtaacagtagcagatttaatgtctaatatgaaaggtacatttagtggtactagtaatatcactgaagaaaatttattacataatcttagtagtgttgatttgttaatgattgatgaaattggtatgcaaactgaatcacgttatgagaaggtaattatcaatcaaatagttgataggagatcatcttctaagcgttctactgggatgttatctaatttagatcacagaggtatgaaaaatttattaggagaaagagtaattgatagaatgcgtttaggtaatagtctatggttaacttttgaatgggatagctatagacaatacgtaaggggggatgaatattaa

SEQ ID NO: 40574 - protein, 246 aa, Buchnera aphidicola
MTFYNEFFKRLQRLMPSNVKPKFESDQDLLAWNQEQGRLSSESILRENKAMKMQRVLGRSGIRELYMNCSFENYKIEHDGQRKVLKAAKRYAEEFNENIASFIFSGRPGTGKNHLASAIGNYLILHGKSILIVTVADLMSNMKGTFSGTSNITEENLLHNLSSVDLLMIDEIGMQTESRYEKVIINQIVDRRSSSKRSTGMLSNLDHRGMKNLLGERVIDRMRLGNSLWLTFEWDSYRQYVRGDEY

SEQ ID NO: 40575 - DNA, 741 bp, Escherichia coli
  CDS (1)..(738)
atgaaaaacgttggcgacctgatgcaacgcctgcaaaaaatgatgcctgcccatatcaaacccgcattcaaaacgggtgaagaactactggcctggcaaaaagaacaaggagcgatccgctccgccgctctcgaacgtgaaaatcgggcgatgaaaatgcagcgcacctttaaccgctccggtattcgtccactgcatcagaactgttcctttgagaactatcgcgttgagtgtgaagggcagatgaatgcgttaagcaaagcgcgccagtatgtcgaagagtttgacggcaacatcgccagcttcatcttttctggtaagccaggaaccggcaaaaaccatctggcggcggcaatctgcaacgagctgctgctacgcggtaaatccgtattgatcatcaccgtggccgatattatgtcggcgatgaaagataccttcaggaatagcggtaccagcgaagaacaactgcttaacgatctgagcaacgttgatctgctggtgatcgatgagatcggcgtgcagaccgaatcgaaatacgaaaaagtgatcatcaaccagatcgtcgatcgccgctcttcttccaaacgcccaaccgggatgctgaccaacagtaatatggaagagatgaccaagttgctgggcgaacgcgtgatggaccgtatgcgcctgggtaacagtttgtgggtgatcttcaactgggatagctaccgtagccgggtaacaggtaaagagtattaatcc

SEQ ID NO: 40576 - protein, 245 aa, Escherichia coli
MKNVGDLMQRLQKMMPAHIKPAFKTGEELLAWQKEQGAIRSAALERENRAMKMQRTFNRSGIRPLHQNCSFENYRVECEGQMNALSKARQYVEEFDGNIASFIFSGKPGTGKNHLAAAICNELLLRGKSVLIITVADIMSAMKDTFRNSGTSEEQLLNDLSNVDLLVIDEIGVQTESKYEKVIINQIVDRRSSSKRPTGMLTNSNMEEMTKLLGERVMDRMRLGNSLWVIFNWDSYRSRVTGKEY

SEQ ID NO: 40577 - DNA, 22 bp, Primer
atgaaaaatattgcgacaggcg

SEQ ID NO: 40578 - DNA, 23 bp, Primer
ttacttcgcaattcctggctgga

SEQ ID NO: 40579 - protein, 156 aa, consensus
  MISC_FEATURE (1)..(156): consensus for the disclosure of xaa see table XV
GXXGXGKXXLAXXXXXXXXXXXXXXXXXXXXXXXXXXXXXXXXXXXXXXLXXXXXXXXXXXXXXXXXXXXXXXXXXXXXXXLXXDXXGXXXXXXXXXXXXXXXXXXXXXXXXXXXXXXXXXXXXXXTXNXXXXXXXXXXXXXXXXXXXXXXXXXXR

SEQ ID NO: 40580 - protein, 14 aa, consensus
  MISC_FEATURE (1)..(14): consensus for the disclosure of xaa see table XV
GXXGXGKXXXXXXX

SEQ ID NO: 40581 - protein, 73 aa, consensus
  MISC_FEATURE (1)..(73): consensus for the disclosure of xaa see table XV
XXXXDXXXXXXXXXXXXXXXXXXXXXXXXXXXXXXXXXXXXXXXXXXXXXXXXXXXXXXXXXXXXXXXXXXXX

SEQ ID NO: 40582 - DNA, 321 bp, Escherichia coli
  CDS (1)..(321)
atggaaaagaaacacatttatctgttttgttctgcgggcatgtctacctctttactggtatcaaaaatgcgcgcacaggcagaaaaatatgaagttccggtcattattgaagcatttccggaaacactggctggtgaaaaaggtcagaatgccgatgtcgtgttattagggccgcagattgcttatatgttgcccgaaatccagcgtttgttacccaacaaaccggttgaagtaattgactcgctgctttatggcaaagtcgatggtttaggcgtgcttaaggctgcggttgcagcgattaaaaaagccgcagcaaattaa

SEQ ID NO: 40583 - protein, 106 aa, Escherichia coli
MEKKHIYLFCSAGMSTSLLVSKMRAQAEKYEVPVIIEAFPETLAGEKGQNADVVLLGPQIAYMLPEIQRLLPNKPVEVIDSLLYGKVDGLGVLKAAVAAIKKAAAN

SEQ ID NO: 40584 - DNA, 336 bp, Lactobacillus acidophilus NCFM
  CDS (1)..(336)
atggctgaacaaactattatgttaaattgtagtgctggtatgagtacttcacttttagtaactaagatgcaagctgctgctcaagaagaaggtattgacgctgaaatttttgcttgtcctgcttcagaagctgatgacaaaatggcacaaaaacaaattgactgtgttcttcttggacctcaagtaagttacatgagaggtgaatttgaaaataaggttaagggcaagggcaaagacggcaaggatattccattagatgtcattaacatgcaagactacggcatgatgaatggaaagaatgttttggctcaagctgaaaagttaattaagggctaa

SEQ ID NO: 40585 - protein, 111 aa, Lactobacillus acidophilus NCFM
MAEQTIMLNCSAGMSTSLLVTKMQAAAQEEGIDAEIFACPASEADDKMAQKQIDCVLLGPQVSYMRGEFENKVKGKGKDGKDIPLDVINMQDYGMMNGKNVLAQAEKLIKG

SEQ ID NO: 40586 - DNA, 318 bp, Borrelia burgdorferi B31
  CDS (1)..(318)
atgaacatactacttgtatgtggagctgggatgtccacaagtatgctggtacaaagaattgaaaaatatgccaaatcaaaaaatataaatgcaacaattgaagctattgctgagacacgccttagcgaagttgttgaccgatttgacgttgttttacttgcaccacagtcaagatttaataaaaaaagacttgaagaaatcacaaaacccaaaggaattccaatcgaaataattaacacaatcgattatggaacaatgaatggcgaaaaagtattacaacttgcaatcaatgcatttaacaataaaagttcagtttaa

SEQ ID NO: 40587 - protein, 105 aa, Borrelia burgdorferi B31
MNILLVCGAGMSTSMLVQRIEKYAKSKNINATIEAIAETRLSEVVDRFDVVLLAPQSRFNKKRLEEITKPKGIPIEIINTIDYGTMNGEKVLQLAINAFNNKSSV

SEQ ID NO: 40588 - DNA, 306 bp, Vibrio cholerae O1 biovar eltor str. N16961
  CDS (1)..(306)
atgaaaaagatcctactctgctgtagtgctggtatgtctaccagtatgttagtgaagaaaatgcagcaagctgctgaaagtaaaggcattgaatgcaagattgatgcgttatcagtgaatgcatttgaagaggccatccaagaatatgatgtttgcttattagggcctcaagtccgttttcagttggaagagctacgcaaaacggccgatgaatatggcaaaaacattgcagctatctctcctcaagcttacggcatgatgaaaggtgacgaggttcttcagcaagctttagatttaattaactaa

SEQ ID NO: 40589 - protein, 101 aa, Vibrio cholerae O1 biovar eltor str. N16961
MKKILLCCSAGMSTSMLVKKMQQAAESKGIECKIDALSVNAFEEAIQEYDVCLLGPQVRFQLEELRKTADEYGKNIAAISPQAYGMMKGDEVLQQALDLIN

SEQ ID NO: 40590 - DNA, 312 bp, Bacillus halodurans C-125
  CDS (1)..(312)
atgaaaaagattttattggcttgcagttcgggaatgtcaacaagtcttttagtgacaaaaatggaagagtacgcagcatccatcggagatgaggttaagatttgggcagttggacaggatcaggcgaagcgggaaatggcgaacgccgatgtagtactgatcgggccacaaatgagctttttaaaaggggaatttcaaaaagaagcggagcaatatggcattcaagtggatgtcattgacatgatggcatacgggatggcagatggcaaaaaagcatatgagcaagccttgtccctcataggaggacgttaa

SEQ ID NO: 40591 - protein, 103 aa, Bacillus halodurans C-125
MKKILLACSSGMSTSLLVTKMEEYAASIGDEVKIWAVGQDQAKREMANADVVLIGPQMSFLKGEFQKEAEQYGIQVDVIDMMAYGMADGKKAYEQALSLIGGR

SEQ ID NO: 40592 - DNA, 327 bp, Lactococcus lactis subsp. lactis Il1403
  CDS (1)..(327)
atggcagataaagttattgcacttgcatgtgcagccggtatgtcaacatcacttttggtatcaaaaatgcaaaaagcagcagcagataacgggaaagattacgaaattttcgcaaaatcaacagcggatattgataacatgcttgccggaacaggctcaccaaaacctgacgttcttcttttaggcccacaagttgccttcatgaaaggtgaagttgctaaaaaagctgaaatcgctggtgtgccaatggacgttatcaaaatgcaagattatggaatgatgcgcggagataaagttcttgcagcagctgaaaacttgatgaattaa

SEQ ID NO: 40593 - protein, 108 aa, Lactococcus lactis subsp. lactis Il1403
MADKVIALACAAGMSTSLLVSKMQKAAADNGKDYEIFAKSTADIDNMLAGTGSPKPDVLLLGPQVAFMKGEVAKKAEIAGVPMDVIKMQDYGMMRGDKVLAAAENLMN

SEQ ID NO: 40594 - DNA, 309 bp, Streptococcus pneumoniae TIGR4
  CDS (1)..(309)
atggtgaagattggtttgttttgtgcagcaggtttttctactggtatgcttgtaaataatatgaaaattgcagcgcaatctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaa

SEQ ID NO: 40595 - protein, 102 aa, Streptococcus pneumoniae TIGR4
MVKIGLFCAAGFSTGMLVNNMKIAAQSSGVEAEIEAFSQSKLADYAPNIDVALLGPQVAYTLDKSKEICDKCDVPIAVIPMMDYGMLDGKKVLDLALSLISG

SEQ ID NO: 40596 - DNA, 309 bp, Clostridium acetobutylicum ATCC 824
  CDS (1)..(309)
atggttagaattttattattttgtagtgcaggaatgtcaactagtatgttagtttcaaaaatgaaaaaggcagctgaagcaaaaaatatagaagcatttatagaggcttatcctcaagcacagatggctgattatgccgacaaggctgatatagcattacttgggcctcaaattaaatttcttttaccaaaagcaaaaggagtatttgatccaaagggagtaccagtagaagtaataaattcagctgattatggaatgctcaatggtgaaaaggttttagatcatgcattaaaggttttaggaaaataa

SEQ ID NO: 40597 - protein, 102 aa, Clostridium acetobutylicum ATCC 824
MVRILLFCSAGMSTSMLVSKMKKAAEAKNIEAFIEAYPQAQMADYADKADIALLGPQIKFLLPKAKGVFDPKGVPVEVINSADYGMLNGEKVLDHALKVLGK

SEQ ID NO: 40598 - DNA, 309 bp, Streptococcus pneumoniae R6
  CDS (1)..(309)
atggtgaagattggtttgttttgtgcagcaggtttttctactggtatgcttgtaaataatatgaaaattgcagcgcaagctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaa

SEQ ID NO: 40599 - protein, 102 aa, Streptococcus pneumoniae R6
MVKIGLFCAAGFSTGMLVNNMKIAAQASGVEAEIEAFSQSKLADYAPNIDVALLGPQVAYTLDKSKEICDKCDVPIAVIPMMDYGMLDGKKVLDLALSLISG

SEQ ID NO: 40600 - DNA, 309 bp, Streptococcus pneumoniae R6
  CDS (1)..(309)
atgaaacaaattttattagtatgtaatgcgggaatgtcgacaagtatgcttgttaaaaaaatgcaacaaagtgcgactgaacgtgggattgaaatttctatccaagcaaaatcaatgacagaagctaaaaagaatatccatgaagcagatgtcattctaattgggccacaaattcgttatgagttacttgctgtgaaagaaattgcaggaaatacccctgtagataccattgatatgcgggattacggaatgatgaatggagcaaaagttctggaacaagcacttgcatggataggagaaataagatga

SEQ ID NO: 40601 - protein, 102 aa, Streptococcus pneumoniae R6
MKQILLVCNAGMSTSMLVKKMQQSATERGIEISIQAKSMTEAKKNIHEADVILIGPQIRYELLAVKEIAGNTPVDTIDMRDYGMMNGAKVLEQALAWIGEIR

SEQ ID NO: 40602 - DNA, 312 bp, Bacillus subtilis subsp. subtilis str. 168
  CDS (1)..(312)
ttgaaaaaaatattactcgcgtgcagttcaggaatgtctaccagtttattggtgacaaaaatgaaggaatacgcacagtctatcggtgaggaagcggagatttgggctgttggccaggataaagcaaaagaagacatgagaaaagcggatgccgttttgatcggtccgcaaatgagctttctgaaaagcgagctccaaaaagaagcagatcaatacaacattcaagttgaagtcattgacatgatggcctacggaatggcagatgggaaaaaagcgtatgagcaggcattgtccttaatggtgaatcaataa

SEQ ID NO: 40603 - protein, 103 aa, Bacillus subtilis subsp. subtilis str. 168
MKKILLACSSGMSTSLLVTKMKEYAQSIGEEAEIWAVGQDKAKEDMRKADAVLIGPQMSFLKSELQKEADQYNIQVEVIDMMAYGMADGKKAYEQALSLMVNQ

SEQ ID NO: 40604 - DNA, 321 bp, Salmonella typhimurium LT2
  CDS (1)..(321)
atggaaaagaaacacatttatctgttttgttctgcgggcatgtcaacatcgttactggtatcaaaaatgcgcgctcaggctgaaaaatatgaagtgccggtgattattgaagcattccctgaaaccctggccggtgaaaaaggcccggcagcggacgtcgtgttattaggcccgcaaattgcttatatgctccccgaaattcagcgtttattacctggtaaaccggtagaagtcattgattcaatgttgtacggcaaggtagatggcttaggcgtgcttaaagctgcggtagcggcaattaaaaaagccgccgcgaattaa

SEQ ID NO: 40605 - protein, 106 aa, Salmonella typhimurium LT2
MEKKHIYLFCSAGMSTSLLVSKMRAQAEKYEVPVIIEAFPETLAGEKGPAADVVLLGPQIAYMLPEIQRLLPGKPVEVIDSMLYGKVDGLGVLKAAVAAIKKAAAN

SEQ ID NO: 40606 - DNA, 336 bp, Listeria innocua Clip11262
  CDS (1)..(336)
atggaaataaatcaattacatgtacttctagtgtgtaatctaggtgcatcaaccggagtaatggtaacaaaaatgaaagaaattgctcaaaatagcgaaaaactaaagaatacagacgtgaaaatcgaggcacatcctgctggagaattacgtgagcatattgaagacttcgatgttattttagtcgggccacaaattaaacaccaactaaaacatttaagtgaaatcgcagctgaatataataaaccaatccaagtcatcgatacgaaagattacggcacagttaacggagcaaacattttaaaagacgcgattatccttaaaatgaacaaataa

SEQ ID NO: 40607 - protein, 111 aa, Listeria innocua Clip11262
MEINQLHVLLVCNLGASTGVMVTKMKEIAQNSEKLKNTDVKIEAHPAGELREHIEDFDVILVGPQIKHQLKHLSEIAAEYNKPIQVIDTKDYGTVNGANILKDAIILKMNK

SEQ ID NO: 40608 - DNA, 306 bp, Listeria innocua Clip11262
  CDS (1)..(306)
atgaaaaacattttactcatttgtgggtcaggagcttcaagtggatttatggcagcagcaattagaaaagccgcaaaaaaacgcggagaaaaagtaaccgtgaaagcagctagtgagtctcaaattgatgaaagaataaacgaaatcgactatttactcatcggaccacatttagcttatatgttagacgatttaaagcaaaaagtagctgataaagatgttttagtatcagtcattccacaagcaacatacggcacacttaatggcgaaaaagcacttgatctcattttaaatatggagggataa

SEQ ID NO: 40609 - protein, 101 aa, Listeria innocua Clip11262
MKNILLICGSGASSGFMAAAIRKAAKKRGEKVTVKAASESQIDERINEIDYLLIGPHLAYMLDDLKQKVADKDVLVSVIPQATYGTLNGEKALDLILNMEG

SEQ ID NO: 40610 - DNA, 357 bp, Listeria innocua Clip11262
  CDS (1)..(357)
atgaaaattatgttagtatgttttggcggattatccacctccattttagtgaaaaagatggaagaggctattgcggcatcagaaaagtttaagaataaaggaattacaattgaagcttgggggaaagatgaatattctgaccacctagataacgtgtctattgttttactcggaccgcaattatcaatggcatatgaacaagtaatagaagctacaacagaacgcgggttaaaagttcctgtagaagtaattgataaagaagattatggcaatatgaatgcagtaccaattcttattgctgcatttaaaaaaattaaagaagctggaacgaatacatttacgacggagggaaactaa

SEQ ID NO: 40611 - protein, 118 aa, Listeria innocua Clip11262
MKIMLVCFGGLSTSILVKKMEEAIAASEKFKNKGITIEAWGKDEYSDHLDNVSIVLLGPQLSMAYEQVIEATTERGLKVPVEVIDKEDYGNMNAVPILIAAFKKIKEAGTNTFTTEGN

SEQ ID NO: 40612 - DNA, 330 bp, Clostridium perfringens str. 13
  CDS (1)..(330)
atgaaaaaagtagtattattatgtacactaggaatgtctacatctttattagtttctaaaatgagaaaagctgcaaatgaattagggattgattgttctatagttgcaataggagaatatgagcttaaaaaatatgaaaaagaggcagatataataatgttaggacctcaagtaaggtatttatttaatagtttaagaaaaaaagtagatagtaatataccaataactcttataaatagtgcagattatggaacgatgaatggtaataagattttaaatcaagccttagcactaatggataataaggaattatccacaaataatttgtaa

SEQ ID NO: 40613 - protein, 109 aa, Clostridium perfringens str. 13
MKKVVLLCTLGMSTSLLVSKMRKAANELGIDCSIVAIGEYELKKYEKEADIIMLGPQVRYLFNSLRKKVDSNIPITLINSADYGTMNGNKILNQALALMDNKELSTNNL

SEQ ID NO: 40614 - DNA, 312 bp, Thermoanaerobacter tengcongensis MB4
  CDS (1)..(312)
atgagaattttgttaatttgtggcgcaggaatgtcaacaagtttgttagtagaaaagatgaaaaaagaaggggaaaaaagaggaataaaggatttgtacattaatgcagaagcagcagataatttagaaaaagttattgatgactacgatgtagttcttttgggaccccagataagatataaagagaaatacgttgcagagcttacaaaagaaaaaaataaggtttacagagtaattccgcctcatatatatggaatggtggatggagctaaaacattagatttagcaatagaggcactaaagaataaataa

SEQ ID NO: 40615 - protein, 103 aa, Thermoanaerobacter tengcongensis MB4
MRILLICGAGMSTSLLVEKMKKEGEKRGIKDLYINAEAADNLEKVIDDYDVVLLGPQIRYKEKYVAELTKEKNKVYRVIPPHIYGMVDGAKTLDLAIEALKNK

SEQ ID NO: 40616 - DNA, 327 bp, Thermoanaerobacter tengcongensis MB4
  CDS (1)..(327)
atggcaataaagggagttatactctgcagctggggtgctacctcaagtgctcttgctaagaaggtgacagaagaagcaaaaaggcaagggttagatgtggttgtagatgcaggtggtacaggagagtttaagaaaaaagcggaggaatacgatgtggctttactggagccccaggtaaggcatcttaaaaaggaaattgagtcaattgcatccaaatataatattcctgttgatgtagtggacatgcaggcttttgccatgatggatggcaaaaaaatattaaatcaaataatcgaacttgccaaaaaagcaggaaaagaagtataa

SEQ ID NO: 40617 - protein, 108 aa, Thermoanaerobacter tengcongensis MB4
MAIKGVILCSWGATSSALAKKVTEEAKRQGLDVVVDAGGTGEFKKKAEEYDVALLEPQVRHLKKEIESIASKYNIPVDVVDMQAFAMMDGKKILNQIIELAKKAGKEV

SEQ ID NO: 40618 - DNA, 321 bp, Streptococcus agalactiae 2603V/R
  CDS (1)..(321)
atgataaaaattggtttattctgtgcagcaggtttttcaacaggtatgttagtaaacaatatgaaaatcgcagcggataaagaagggatagaggcacatattgaagcttattcacaaggaaaaattgcagattatgctaaagatttagatgttgcattacttggtccacaagttagctatactctagataaatcaaaatcaatctgtgatgaatacggtgtaccgatagcagttattccaatggcagattatggtatgttggatggtgtaaaagttttgaaacttgctttgagtttattggaaacaagaaaagaggcttga

SEQ ID NO: 40619 - protein, 106 aa, Streptococcus agalactiae 2603V/R
MIKIGLFCAAGFSTGMLVNNMKIAADKEGIEAHIEAYSQGKIADYAKDLDVALLGPQVSYTLDKSKSICDEYGVPIAVIPMADYGMLDGVKVLKLALSLLETRKEA

SEQ ID NO: 40620 - DNA, 306 bp, Oceanobacillus iheyensis HTE831
  CDS (1)..(306)
atgaaaattcgtctcgtatgctctgccggaatgtctacgtccatgcttgtgaaaaaaatggaaattgcagcaacagagaaagaaatagaagcagaaattgatgctattcctgaatcacaattaaaaaatcatttaacagatctagatgttgtattaataggccctcaagttcgttatttagagaataaaatccgtgaatttgttgaaccaaaagggattaaagtagccgtcattgaccagatggcttacggcttggttcaaggagataaagtattagaacaagcgataaaattaaaacattcttaa

SEQ ID NO: 40621 - protein, 101 aa, Oceanobacillus iheyensis HTE831
MKIRLVCSAGMSTSMLVKKMEIAATEKEIEAEIDAIPESQLKNHLTDLDVVLIGPQVRYLENKIREFVEPKGIKVAVIDQMAYGLVQGDKVLEQAIKLKHS

SEQ ID NO: 40622 - DNA, 306 bp, Oceanobacillus iheyensis HTE831
  CDS (1)..(306)
atgaaacatattctattagcctgctcttcaggcatgtcgactagtttactagtatcaaaaatggaggaggcagcatccaaacaaggtctggaagtaaaaatttgggcagttgctcaagacaaagctttttctgaattagaaaacgcagatgttcttttaattggtccacaaatgcgttttcttaaaaagaaattcgaaaaagctggcgcagaggcaaatgtccccatcgatgttattgatccagtagcttatggccgtgtagatggagaagctgttttaaacaaagcattgtcattaatgccttaa

SEQ ID NO: 40623 - protein, 101 aa, Oceanobacillus iheyensis HTE831
MKHILLACSSGMSTSLLVSKMEEAASKQGLEVKIWAVAQDKAFSELENADVLLIGPQMRFLKKKFEKAGAEANVPIDVIDPVAYGRVDGEAVLNKALSLMP

SEQ ID NO: 40624 - DNA, 300 bp, Lactobacillus plantarum WCFS1
  CDS (1)..(300)
atgaaggcaatcaacgtgttattagtttgtgcgggcggtatgtcaaccagcattttaatgaaaaagttacagcagtatcgtgacgaacaaggtgttgcagggcaaatccaggcagtaggcttgtccgcgtatgaagatgtctatcaggactatgacgttattttaatggggccgcaagtggcttatcggcagggtgaagttgaggcggcaactgggttgcccgtcgctgctattccaccattggactatgcggtgggtgacagtgcccatattttcaaactggccgagaacttggtgtga

SEQ ID NO: 40625 - protein, 99 aa, Lactobacillus plantarum WCFS1
MKAINVLLVCAGGMSTSILMKKLQQYRDEQGVAGQIQAVGLSAYEDVYQDYDVILMGPQVAYRQGEVEAATGLPVAAIPPLDYAVGDSAHIFKLAENLV

SEQ ID NO: 40626 - DNA, 318 bp, Lactobacillus plantarum WCFS1
  CDS (1)..(318)
atggctgaaagaacaattatgttggtatgtgccgctgggatgtcaacgtcattattagtttcaaagatgcaaaaggctgcggaagcagaaggcattgatgcagatatttttgcaaccgctgccagtgacgctgatgcgaagttagctgaaaagaatcctgacattttaatgcttggaccacaagttcgttatatgttaagtgatttccaaaagcgcgttgatattccagttgaagttatcaacatgcaagactacggcatgatgaacggcgaaaaagttttaaaggaagccgaagcatcaattgcaaaagcaaactaa

SEQ ID NO: 40627 - protein, 105 aa, Lactobacillus plantarum WCFS1
MAERTIMLVCAAGMSTSLLVSKMQKAAEAEGIDADIFATAASDADAKLAEKNPDILMLGPQVRYMLSDFQKRVDIPVEVINMQDYGMMNGEKVLKEAEASIAKAN

SEQ ID NO: 40628 - DNA, 327 bp, Lactobacillus plantarum WCFS1
  CDS (1)..(327)
atggctgaaaaaattattatgttggcatgttctgcgggaatgtcaacctcactattagtgtctaagatggaagctgcggcaaagcaagatggtgttgattacaagatctttgccacctcagcggctgatattgaccatcaactgagtcaagatccgcatcccgatgtcttgttattaggaccacaagttcgctacatggcgaatgacgtgaagaagaagactgataaggctgggattccaatggatatcatcaatatgtccgactatggcatgatgaatggtgaaaatgtcttacaagcagctgaaaagttactcggcgacagataa

SEQ ID NO: 40629 - protein, 108 aa, Lactobacillus plantarum WCFS1
MAEKIIMLACSAGMSTSLLVSKMEAAAKQDGVDYKIFATSAADIDHQLSQDPHPDVLLLGPQVRYMANDVKKKTDKAGIPMDIINMSDYGMMNGENVLQAAEKLLGDR

SEQ ID NO: 40630 - DNA, 306 bp, Vibrio parahaemolyticus RIMD 2210633
  CDS (1)..(306)
atgaaaaagatccttttatgctgtagcgcagggatgtcgaccagtatgcttgttaaaaaaatggagcaagctgctgaaattaaaggaattgaatgcaaaattgatgcgatgtcagtgaatgcatttgaagaggcgattaaagagtatgacgtttgtttactaggtcctcaggtacgttttcaactggaagagttaagaaaaacagcgcaagagtacggaaaaaatatcgatgcgatatctccccaagcatatggaatgatgaaaggggacgaagttctagaacaagcattagaattaattaactaa

SEQ ID NO: 40631 - protein, 101 aa, Vibrio parahaemolyticus RIMD 2210633
MKKILLCCSAGMSTSMLVKKMEQAAEIKGIECKIDAMSVNAFEEAIKEYDVCLLGPQVRFQLEELRKTAQEYGKNIDAISPQAYGMMKGDEVLEQALELIN

SEQ ID NO: 40632 - DNA, 330 bp, Enterococcus faecalis V583
  CDS (1)..(330)
atgagtaaaaaacaaatttatcttttttgtgatgcagggatgtctacaagtattatggtgaataaaatgatggaagtggtggaaaaacatcaaatgcctttaatgattactgcttttcctattgcaagagcacaagaagtggttgaagcagagaagcctgttgctattttattaggaccacaagtccgttttttattagaaaaaacaaaagaacaatttgctcctcaagggattcctgtcgctgcaattgcgccagaaatttatggcatgatggatggcgaaaaagcattgaaagaagcgctgcggttaattaagcaaaataaaaaataa

SEQ ID NO: 40633 - protein, 109 aa, Enterococcus faecalis V583
MSKKQIYLFCDAGMSTSIMVNKMMEVVEKHQMPLMITAFPIARAQEVVEAEKPVAILLGPQVRFLLEKTKEQFAPQGIPVAAIAPEIYGMMDGEKALKEALRLIKQNKK

SEQ ID NO: 40634 - DNA, 336 bp, Enterococcus faecalis V583
  CDS (1)..(336)
atgtcaaaaaaaacaattatgttagtttgctccgcaggaatgagtactagtttacttgttacaaaaatgcaaaaagcagcatttaatcaaggcttagatgcccatatatttgcggcttctgcatcggaagcagaaacaaatttagaaaataatccagtcgatgtgttattgttaggtccacaagttcgttatatgaagagtgattttgaaaagcgtctatcaccaaaaggtatcccaacagatgtcattagcatgtctgattacggcttaatgaacggggaaaaagtgctggaacaagccttgggtttgttagcacaagcagataaaaaagagtaa

SEQ ID NO: 40635 - protein, 111 aa, Enterococcus faecalis V583
MSKKTIMLVCSAGMSTSLLVTKMQKAAFNQGLDAHIFAASASEAETNLENNPVDVLLLGPQVRYMKSDFEKRLSPKGIPTDVISMSDYGLMNGEKVLEQALGLLAQADKKE

SEQ ID NO: 40636 - DNA, 303 bp, Bacillus cereus ATCC 14579
  CDS (1)..(303)
atgaatattttactttgctgtgcagcgggaatgtcttccagtttgattgttacaaagatggagaaagcagcagaggcaagagggatagaagtgaaaatctgggcagtatcaggttctgaagtgaatagtcatattgataaagctgatgtccttttacttggaccgcaagtacgttatttattaccgaaaatgaaagaattatgtaaggataaagggatacctgttgatgtcattcaatccgttcattacggactttgtaatggagaagctatcttgcaagcagctttgtcaatgaaaccatga

SEQ ID NO: 40637 - protein, 100 aa, Bacillus cereus ATCC 14579
MNILLCCAAGMSSSLIVTKMEKAAEARGIEVKIWAVSGSEVNSHIDKADVLLLGPQVRYLLPKMKELCKDKGIPVDVIQSVHYGLCNGEAILQAALSMKP

SEQ ID NO: 40638 - DNA, 306 bp, Photorhabdus luminescens subsp. laumondii TTO1
  CDS (1)..(306)
atgaaaaaaatcctattgtgttgtgcggccggtatgtccaccagcatgctagtacaacgcatgcaggcagaagtgataaaacgggcattggacattgagatcaaggctgttcccacggttgaattagaacacctgatagccgacgctgacgttattttactcggcccacaggtgagatatcaattggcccatttttccgctattgccaaaccactcggtaaaccaatagacgttattgacatgatggattatggcactcttcgtggtgataaggttctcgataaggcattgagcctgttggaataa

SEQ ID NO: 40639 - protein, 101 aa, Photorhabdus luminescens subsp. laumondii TTO1
MKKILLCCAAGMSTSMLVQRMQAEVIKRALDIEIKAVPTVELEHLIADADVILLGPQVRYQLAHFSAIAKPLGKPIDVIDMMDYGTLRGDKVLDKALSLLE

SEQ ID NO: 40640 - DNA, 324 bp, Lactobacillus johnsonii NCC 533
  CDS (1)..(324)
atggcagataaaactattatgttagcttgttcagcaggtatgtcaacttcacttttagtatcaaagatgcaaaacgcagctaaagaaaaaggtaaggactacaagatctttgctactgcagcatcaggtattcaagatgaaattgataaggaacacccagatgtattaatgcttggacctcaagttcaatacatggaagacagtgttaaaaagattactgatgaagcaggcatcccattagcagttattaacatgcaagactacggtatgatgaatggtgagcatgttcttgaaactgctcaagaattaatgggcgataaatag

SEQ ID NO: 40641 - protein, 107 aa, Lactobacillus johnsonii NCC 533
MADKTIMLACSAGMSTSLLVSKMQNAAKEKGKDYKIFATAASGIQDEIDKEHPDVLMLGPQVQYMEDSVKKITDEAGIPLAVINMQDYGMMNGEHVLETAQELMGDK

SEQ ID NO: 40642 - DNA, 306 bp, Bacillus cereus ATCC 10987
  CDS (1)..(306)
atgtacattttattatgttgtgcagcaggcatgtcaacgagtatggttgtaagaaaaatgcaagaagaggcaatgaaacaagggaaggattataaaattaaagcagttgattcagaacttgtgaaactggaaataaaaaatgctgatgttgttttaattggtccgcaagtgaaatatttatttccagccgtagagtttcttgcaaattcatacaatataccagttgcgattatagaccaacgagattatggcatgtgtgatggtttgaaagtactgaaacaagcagaacaattagttttagcataa

SEQ ID NO: 40643 - protein, 101 aa, Bacillus cereus ATCC 10987
MYILLCCAAGMSTSMVVRKMQEEAMKQGKDYKIKAVDSELVKLEIKNADVVLIGPQVKYLFPAVEFLANSYNIPVAIIDQRDYGMCDGLKVLKQAEQLVLA

SEQ ID NO: 40644 - DNA, 306 bp, Listeria monocytogenes str. 4b F2365
  CDS (1)..(306)
atgaaaacaatcatgttagtatgttcagcaggtatgtctaccagcttactagttacaaaaatggaaaaagcagctgcagaaaaaggccttgaagcaaaaatcttcgccgttgcagaagcagaagcagctaaccatttagacgaaatcgatgttttattacttggaccacaagtacgtttcttagaaggaaacatgaagaaaaaattagagccaaaaggtattccattagctgttattaacagtgttgattacggaatgatgaaaggcgacaaagttttagaacaagcattagagttaatgaagtaa

SEQ ID NO: 40645 - protein, 101 aa, Listeria monocytogenes str. 4b F2365
MKTIMLVCSAGMSTSLLVTKMEKAAAEKGLEAKIFAVAEAEAANHLDEIDVLLLGPQVRFLEGNMKKKLEPKGIPLAVINSVDYGMMKGDKVLEQALELMK

SEQ ID NO: 40646 - DNA, 303 bp, Bacillus thuringiensis serovar konkukian str. 97-27
  CDS (1)..(303)
atgaatattttattatgttgctcagcagggatgtctacaagtttactagttacaaaaatggaggcggctgcaaaagctcgcggtttagaaggaaagatttgggctgtatctggggatgcagtaaaaacaaatatcgatcaagcagacgtactattattaggaccacaagttcgttacatgctttcttcaatgaaaacgcttgctgatgagaagaacgttggaatcgacgttatcaatccaatgcactacggcatgatgaatggagaagcagttttagatcacgcgttaacacttaaaaaataa

SEQ ID NO: 40647 - protein, 100 aa, Bacillus thuringiensis serovar konkukian str. 97-27
MNILLCCSAGMSTSLLVTKMEAAAKARGLEGKIWAVSGDAVKTNIDQADVLLLGPQVRYMLSSMKTLADEKNVGIDVINPMHYGMMNGEAVLDHALTLKK

SEQ ID NO: 40648 - DNA, 318 bp, Erwinia carotovora subsp. atroseptica SCRI1043
  CDS (1)..(318)
atgaaaagaatcgtactggcttgctcggcaggcatgtcgacctcactggtggtcaccaaaatggagaaggaagcagaagcgcggggaatggtgtttaagatctacgcgatcccggaacaaaatctgcgggatgaattgcaggagttcggcagcgatattattgcggttctgttggggccgcaggtgcgcttcaaacttaacgaaaataaaaagctaacggacagctatcagattcctatcgcggtgatcgactctgtcgcctatggcacattaaatggcgcaaaagtactggatcaggcgctgagtttggtagactaa

SEQ ID NO: 40649 - protein, 105 aa, Erwinia carotovora subsp. atroseptica SCRI1043
MKRIVLACSAGMSTSLVVTKMEKEAEARGMVFKIYAIPEQNLRDELQEFGSDIIAVLLGPQVRFKLNENKKLTDSYQIPIAVIDSVAYGTLNGAKVLDQALSLVD

SEQ ID NO: 40650 - DNA, 312 bp, Erwinia carotovora subsp. atroseptica SCRI1043
  CDS (1)..(312)
atgctttgttgttccgctgggatgtctaccagccttttagtgagaaagatgaaggaagtggccagcgcacgtggtctggacgttgagattgccgcctatgctgcccatgaatttgacgaacaagtcgggaagtatgacgttgtgctgctggggccgcaggtgaaatatatgctggcatcattcaaggaaaaagctgagggaaaaggcgtacccgtggcagcgatagacatgatggattacggtatgcagcgcggtgacaacgtgctggattttgcattttcactgatcgaaaaatcaggacaaccgctatga

SEQ ID NO: 40651 - protein, 103 aa, Erwinia carotovora subsp. atroseptica SCRI1043
MLCCSAGMSTSLLVRKMKEVASARGLDVEIAAYAAHEFDEQVGKYDVVLLGPQVKYMLASFKEKAEGKGVPVAAIDMMDYGMQRGDNVLDFAFSLIEKSGQPL

SEQ ID NO: 40652 - DNA, 306 bp, Erwinia carotovora subsp. atroseptica SCRI1043
  CDS (1)..(306)
atgaataaaattttactctgttgcgcagcaggaatgtctaccagcatgctggtacagcgaatggaaaaggtcgccgagaaaaatgcgatcgctgttgagataaaagccgtgggttttgaagaatttaatgaactaattgatgagtatgattgctgccttttggggccgcaaatcaaatataaactgcctgaattcaaagtgatagccgacgaaaaaaagaagccgattgcagtcattaatatggttgattacggcatgatgaatggggaaaaagtcctcaatgatgccttggcgatgatcaattag

SEQ ID NO: 40653 - protein, 101 aa, Erwinia carotovora subsp. atroseptica SCRI1043
MNKILLCCAAGMSTSMLVQRMEKVAEKNAIAVEIKAVGFEEFNELIDEYDCCLLGPQIKYKLPEFKVIADEKKKPIAVINMVDYGMMNGEKVLNDALAMIN

SEQ ID NO: 40654 - DNA, 318 bp, Borrelia garinii PBi
  CDS (1)..(318)
atgaatatattacttgtatgtggagctggaatgtccacaagcatgctggtacaaagaattgaaaaatatgccaaagcaaacaatataaatgcaaaaattgaagctattgctgagacacgacttggcgaagttgttgaccgctttgatgttgttttacttgcaccacagtcaagattcaataaaaacagacttgaagaaataacaaagcccaaaggaattccaatcgaaataattaacacaatcgattatggaacaatgaatggagaaaaagtattacaacttgcaattaatgcactcaagaataaaagttctttttaa

SEQ ID NO: 40655 - protein, 105 aa, Borrelia garinii PBi
MNILLVCGAGMSTSMLVQRIEKYAKANNINAKIEAIAETRLGEVVDRFDVVLLAPQSRFNKNRLEEITKPKGIPIEIINTIDYGTMNGEKVLQLAINALKNKSSF

SEQ ID NO: 40656 - DNA, 318 bp, Yersinia pseudotuberculosis IP 32953
  CDS (1)..(318)
atggaaaagaaaaaaatttatctgttttgctctgctgggatgtctacctcgctattagtttccaaaatgaaagtgcaagcagaaaagtatgaagtgccggttattatcaatgcttacccagaagcgctggcatcggcgcagggtgctcatgctgatgtgatcctactggggccgcagatcgcctatatgttgcctgaaatagccaaaatgttcccgaataaacccgtcgaagtgattgatacgcttctttacggcaaagtcgatgggttaggggtattaaaagctgcggtggccgcaataaaaaaagcaaaacaataa

SEQ ID NO: 40657 - protein, 105 aa, Yersinia pseudotuberculosis IP 32953
MEKKKIYLFCSAGMSTSLLVSKMKVQAEKYEVPVIINAYPEALASAQGAHADVILLGPQIAYMLPEIAKMFPNKPVEVIDTLLYGKVDGLGVLKAAVAAIKKAKQ

SEQ ID NO: 40658 - DNA, 303 bp, Bacillus cereus ZK
  CDS (1)..(303)
atgaatattttgctttgctgtgcagcgggaatgtcttccagcttgattgttacaaaaatggagaaagcagcagaggcaagaggaatagaggtaaagatttgggctgtatcaggttctgaagtaaatagccatattgataaagccgatgtacttttacttgggccacaagtacgttatttattaccgaaaatgaaggaattatgtaaggagaaaggagtacctgttgatgtcattcaatccgttcattacggactttgtaatggggaagctatcttgcaagtagctttgtcaatgaaaccatga

SEQ ID NO: 40659 - protein, 100 aa, Bacillus cereus ZK
MNILLCCAAGMSSSLIVTKMEKAAEARGIEVKIWAVSGSEVNSHIDKADVLLLGPQVRYLLPKMKELCKEKGVPVDVIQSVHYGLCNGEAILQVALSMKP

SEQ ID NO: 40660 - DNA, 300 bp, Bacillus licheniformis ATCC 14580
  CDS (1)..(300)
atgaagaaaattttattggtttgtgcggccggcatgtcaacgagcctgcttgtcagcagaatgaaaaagcatgcagaggcgctgaacgaagaggtcgacatcattgctctgcctgtatccgaagcggggactgccgcgtcaagcgcggacgtcgtattgttggggccgcaagtcaggtaccaaaagtcacaggttgaggcgagcgcaggagacacgccggtccaggtgatcgacatgcgagactacggcaccatgaacggcgaagctgtgctgcaaaaagcgctgcagctgatgaaataa

SEQ ID NO: 40661 - protein, 99 aa, Bacillus licheniformis ATCC 14580
MKKILLVCAAGMSTSLLVSRMKKHAEALNEEVDIIALPVSEAGTAASSADVVLLGPQVRYQKSQVEASAGDTPVQVIDMRDYGTMNGEAVLQKALQLMK

SEQ ID NO: 40662 - DNA, 309 bp, Bacillus licheniformis ATCC 14580
  CDS (1)..(309)
atgaagaaaattttactcgcatgcagctctggaatgtcgacaagtctcctggttaccaagatgcaggaatacgcgcattcaatcggtgacgaggcaaaaatttgggcggtcggacaggaccaggcgaaaaaagagatggcagaggcgaacgtcgttctcatcggcccgcaaatgagctttttaaaaggcgagctgcagaaggaagctgaacagtacggtattaaggttgatgtgattgatatgctggcttacggaatggctgatggaaagaaagcttatgaacaggcgctaagcctgatcggggattga

SEQ ID NO: 40663 - protein, 102 aa, Bacillus licheniformis ATCC 14580
MKKILLACSSGMSTSLLVTKMQEYAHSIGDEAKIWAVGQDQAKKEMAEANVVLIGPQMSFLKGELQKEAEQYGIKVDVIDMLAYGMADGKKAYEQALSLIGD

SEQ ID NO: 40664 - DNA, 336 bp, Photobacterium profundum SS9
  CDS (1)..(336)
atggtggaaagtgatatgaggattatattgtgctgcggtggtggattctcaaccagtatactggcaaagagaatgagggcggaggctgaaactagagggatagattgcacggttgaagcgtttgccgagattgaaatgaaagataaaatgcaagattgtgatgtttgtttaatcggccctcagattagcttctataaagataatttacagaaacttgccagtaagtatggtacgcgagtcgcggttatccctaatatggtatacggtatgatgaaaggagatgaagcattagatcaagctctgtctcttatttcaaacgaagttaacagtaattag

SEQ ID NO: 40665 - protein, 111 aa, Photobacterium profundum SS9
MVESDMRIILCCGGGFSTSILAKRMRAEAETRGIDCTVEAFAEIEMKDKMQDCDVCLIGPQISFYKDNLQKLASKYGTRVAVIPNMVYGMMKGDEALDQALSLISNEVNSN

SEQ ID NO: 40666 - DNA, 318 bp, Photobacterium profundum SS9
  CDS (1)..(318)
atgaagatttttctatgctgtgcagctgggatgtcaaccagcatgcttgtaaaaaaaatgcgtgaagctgctgataagcaaaatattgattgctcaattaatgcttattcagtttctgaatttgaaacatcacttgctgataatgatgtttgtctggtagcaccgcaagttaagttccaatttgaagatttcaagaaacgtgctgaagatagcggtaaagcttgtggccttatcgacatgatgacctacggcatgatgaaaggtgacgtcgttcttgatcaagcaattaatctttatcaatcgataaataacaagtaa

SEQ ID NO: 40667 - protein, 105 aa, Photobacterium profundum SS9
MKIFLCCAAGMSTSMLVKKMREAADKQNIDCSINAYSVSEFETSLADNDVCLVAPQVKFQFEDFKKRAEDSGKACGLIDMMTYGMMKGDVVLDQAINLYQSINNK

SEQ ID NO: 40668 - DNA, 312 bp, Geobacillus kaustophilus HTA426
  CDS (1)..(312)
atgaaacggattttattggcgtgcagttctggcatgtcgacaagcttgctagtgacgaaaatgcaggagtatgcaaaatccgtcggtgaggaggcagagatttgggcggtcggccaagatcaggcgaaaaaagagatggcccaagccgatgtcattcttattggcccacaaatgagctttttgaaagaggaattgcaaaaagaagcgcaaaaatacggcattccagtcgatgtcattgacatggtggcttatgggatggcggatggcaaaaaagtgtatgagcaggcattgaaattgatgggggacaagtaa

SEQ ID NO: 40669 - protein, 103 aa, Geobacillus kaustophilus HTA426
MKRILLACSSGMSTSLLVTKMQEYAKSVGEEAEIWAVGQDQAKKEMAQADVILIGPQMSFLKEELQKEAQKYGIPVDVIDMVAYGMADGKKVYEQALKLMGDK

SEQ ID NO: 40670 - DNA, 297 bp, Bacillus clausii KSM-K16
  CDS (1)..(297)
atgaatattttactcgtttgctctgctggaatgtcaacaagcatgcttgttgatagaatgaaaaaagcagctgaagaattagaagtacacgccacaattacggcaacggctgaagcagggttggctaatgagctagacacgacaaacgtcattttaattggaccgcaagtacgctatttggaaaacaaaattaccaaaaaggcagaaccccatggcattaaagtcgctgttatcgattcaattgcttatgggacgatggatggaaaaaaagtgctgcaacaagcattggctttatga

SEQ ID NO: 40671 - protein, 98 aa, Bacillus clausii KSM-K16
MNILLVCSAGMSTSMLVDRMKKAAEELEVHATITATAEAGLANELDTTNVILIGPQVRYLENKITKKAEPHGIKVAVIDSIAYGTMDGKKVLQQALAL

SEQ ID NO: 40672 - DNA, 324 bp, Lactobacillus gasseri
  CDS (1)..(324)
atggcagataaaactattatgcttgcttgttcagcaggaatgtcaacttcattattagtatccaagatgcaaaacgcagctaaagaaaaaggcaaggactacaagatctttgctactgcagcatcaggtattcaagacgaaattgacaaggaacacccagatatattgatgcttgggcctcaagttcaatacatggaagacagtgttaagaagattactgatgcagcaggcatcccattaacagttattaacatgcaagactacggcatgatgaatggcgaacacgttcttgaaactgctcaagaattaatgggcgacaaatag

SEQ ID NO: 40673 - protein, 107 aa, Lactobacillus gasseri
MADKTIMLACSAGMSTSLLVSKMQNAAKEKGKDYKIFATAASGIQDEIDKEHPDILMLGPQVQYMEDSVKKITDAAGIPLTVINMQDYGMMNGEHVLETAQELMGDK

SEQ ID NO: 40674 - DNA, 312 bp, Haemophilus somnus 2336
  CDS (1)..(312)
atgaaaagaattttacttatttgtgatttaggcatgtccaccagcttagtagttaaacgtatgaaacaagcagctgaagcacagggtttacccgttgaaattgaagctaagggtatgcaaagctttcgttcattaatacaagattttgactgtgtcctattaggtcctcaaatttcctataagctgcaagaatgccaaactattggtgcagaattcggcaaacctgtcgcttgtattgatatgatgagttatggcatgaccgatggagaaaaaattttagcacaagcactatctttattggaggaaaaatga

SEQ ID NO: 40675 - protein, 103 aa, Haemophilus somnus 2336
MKRILLICDLGMSTSLVVKRMKQAAEAQGLPVEIEAKGMQSFRSLIQDFDCVLLGPQISYKLQECQTIGAEFGKPVACIDMMSYGMTDGEKILAQALSLLEEK

SEQ ID NO: 40676 - DNA, 303 bp, Listeria monocytogenes str. 1/2a F6854
  CDS (1)..(303)
atgaaaaaaatattacttgtatgtgcggccggaatgtcgacaagcttactagttactaaaatgaaagcgcacgcaacctctatcggggaagaaattgaaattgaagcattgccagtatctgaagctagtaacgtagtagataaaatggatatcgttatgcttggacctcaagtccgttaccaaaaaccgcaagtggatgaacttgtacaaggtcgcatccctgttgttgtaattgatatgaaagattatggtatgttaaacgggaaagccgttcttgaaaaagctttcgcggaaattggttaa

SEQ ID NO: 40677 - protein, 100 aa, Listeria monocytogenes str. 1/2a F6854
MKKILLVCAAGMSTSLLVTKMKAHATSIGEEIEIEALPVSEASNVVDKMDIVMLGPQVRYQKPQVDELVQGRIPVVVIDMKDYGMLNGKAVLEKAFAEIG

SEQ ID NO: 40678 - DNA, 324 bp, Listeria monocytogenes str. 1/2a F6854
  CDS (1)..(324)
atgtctaaaaaaaccattatgcttatttgttcagcaggaatgagtacgagcttattagtcactaaaatgcaaaaggcggcagcggaaaaaagtttagaattagatatttttgctgtggcagcttcagatgcagataatcaacttgccagtaaaacgattgatgtcgttttattaggcccacaagtgcggtttatggaaaagcaaatggaagaaaaacttgcgccaaaaaatatcccgtcagcagttattaacatgactgattacggaactatgaatggtcaaaatgtattaaatcttgctcttaatcttatcaaaggagcgtga

SEQ ID NO: 40679 - protein, 107 aa, Listeria monocytogenes str. 1/2a F6854
MSKKTIMLICSAGMSTSLLVTKMQKAAAEKSLELDIFAVAASDADNQLASKTIDVVLLGPQVRFMEKQMEEKLAPKNIPSAVINMTDYGTMNGQNVLNLALNLIKGA

SEQ ID NO: 40680 - DNA, 321 bp, Enterococcus faecium
  CDS (1)..(321)
atggaaaagaaaacaatcatgcttgtatgttcagctggaatgagtacaagtctcctagtcacaaaaatgcaaaaggcagcagaagcaaaaggaatggaagcagacatctttgctgtatctgcttcagatgcggataatcaactagaatctaaaaatgtagacgttttacttttaggaccgcaagtacgctttatgcaaaatcaatttgctgaaaagctagcacctaaaggcattcctttagatgtaatcaatatggctgactatggcatgatgaatggtgaaaaagtactcgaccaagcagaaaaactaataaacaaataa

SEQ ID NO: 40681 - protein, 106 aa, Enterococcus faecium
MEKKTIMLVCSAGMSTSLLVTKMQKAAEAKGMEADIFAVSASDADNQLESKNVDVLLLGPQVRFMQNQFAEKLAPKGIPLDVINMADYGMMNGEKVLDQAEKLINK

SEQ ID NO: 40682 - DNA, 318 bp, Enterococcus faecium
  CDS (1)..(318)
atggcaaaaaaaacaatcatgttagtttgttcagcagggatgagtacgagtttattggtcacaaaaatgcaaaaagcagcagaagaaaaagggatggaagccgatatttttgcggtctctgcctcagatgcagataataatttagaatctaagaatgtcgatgtattattattaggtcctcaagtacgtttcatgaaagctcaatttgaacaaaaacttgcgcctaaaggtattccattagatgtcatcaatatgcaagactatggcatgatgaacggagaaaaagttcttgcacaagcagaaaatctaatgaaataa

SEQ ID NO: 40683 - protein, 105 aa, Enterococcus faecium
MAKKTIMLVCSAGMSTSLLVTKMQKAAEEKGMEADIFAVSASDADNNLESKNVDVLLLGPQVRFMKAQFEQKLAPKGIPLDVINMQDYGMMNGEKVLAQAENLMK

SEQ ID NO: 40684 - DNA, 309 bp, Oenococcus oeni PSU-1
  CDS (1)..(309)
atggctgaaaaaacaattatgctttgctgtgctgcaggtatgtcaacaagtttactagtatcaaagatgcaaaaagctgctgaaagtgacggtgttgatgctgaaatcttcgctactgccgctgctgatgctgatgcaaaactagaagaaaaacatcctgatgttttaatgcttggacctcaagttagatatctagaaggtcaattcaaagagaagttgacaattcctgttgaagttatcaacatgcaagattacggaatggtgaacggtgaaaaggttctaagagaagctttaagcttaatcaaataa

SEQ ID NO: 40685 - protein, 102 aa, Oenococcus oeni PSU-1
MAEKTIMLCCAAGMSTSLLVSKMQKAAESDGVDAEIFATAAADADAKLEEKHPDVLMLGPQVRYLEGQFKEKLTIPVEVINMQDYGMVNGEKVLREALSLIK

SEQ ID NO: 40686 - DNA, 324 bp, Oenococcus oeni PSU-1
  CDS (1)..(324)
atgaaaggaacaataatggcagagaaaaaagtaatgttggtttgtgcggccgggatgtcgaccagcctactggtaagcaagatgcaaaaggcggctaaagagcagggagaagatgttgatatctttgccacggctgcttccgatgccgataacaaactagaaagcgaacagccggatattttaatgctcggaccccaggtcagctatatgctctcccagtttaaagaaaaggtcaaaatcccagttgaagtaattaacatgcaggactatgggctgatgaacggagaaaaagttttaaaccaggctttaaaagagatcggctaa

SEQ ID NO: 40687 - protein, 107 aa, Oenococcus oeni PSU-1
MKGTIMAEKKVMLVCAAGMSTSLLVSKMQKAAKEQGEDVDIFATAASDADNKLESEQPDILMLGPQVSYMLSQFKEKVKIPVEVINMQDYGLMNGEKVLNQALKEIG

SEQ ID NO: 40688 - DNA, 312 bp, Pediococcus pentosaceus ATCC 25745
  CDS (1)..(312)
atggctgaaaaaacaattatgttagtatgtgctgcaggtatgtcaacaagtttattagtttcgaaaatgcaaaaagccgctgaagctgaaggtgtagatgcagaaatcttcgcaacagctgcatcagatgcagataataaattggcagaaaagaatcctgatattttaatgcttggacctcaagttcgttaccttgaaggtaatttcaaagaaaaattggatattccggtagaagtaattaacatgcaagattacggcatgatgaatggtgaaaaggtattgaaggaagctctaacatcaatgggtgtttag

SEQ ID NO: 40689 - protein, 103 aa, Pediococcus pentosaceus ATCC 25745
MAEKTIMLVCAAGMSTSLLVSKMQKAAEAEGVDAEIFATAASDADNKLAEKNPDILMLGPQVRYLEGNFKEKLDIPVEVINMQDYGMMNGEKVLKEALTSMGV

SEQ ID NO: 40690 - DNA, 312 bp, Streptococcus suis 89/1591
  CDS (1)..(312)
atgaaacacattatgttagtttgtaacgcaggcatgtctacaagtatgcttgtaactaagatgcaaaaagcatcagaagaaacaggggttgaagcaactatttgggctgttccagtatctgaagccgataatgaagttgctcaaaaagagattgatgtattactcttaggtccacaagtaaaattcctattgaacgactataaggcaaaatttgagccaactattaaggtagatgctatcaatatgatggattacggagtgatgaacggagctaaggtgctagaggctgccctaaaaatgatggaggggtag

SEQ ID NO: 40691 - protein, 103 aa, Streptococcus suis 89/1591
MKHIMLVCNAGMSTSMLVTKMQKASEETGVEATIWAVPVSEADNEVAQKEIDVLLLGPQVKFLLNDYKAKFEPTIKVDAINMMDYGVMNGAKVLEAALKMMEG

SEQ ID NO: 40692 - DNA, 306 bp, Streptococcus suis 89/1591
  CDS (1)..(306)
atggttaaaatcgctctattttgtgccgctggtttttctacaggcatgttggtaaacaacatgaagatcgcagcagcagacgcaggtgtcgaagtagaaatcgacgcgcattcccaagggaaaattgcagattaccttgacgaaatcgatgtagctttactgggaccacaagtagcatatacgcttgataagtcaaaagcgctctgtgatgaaaagcaagtccctattgccgtgattccaatggcagactacgggatgttggacgggaaaaaagttcttcaattggcactcagcatggtttcataa

SEQ ID NO: 40693 - protein, 101 aa, Streptococcus suis 89/1591
MVKIALFCAAGFSTGMLVNNMKIAAADAGVEVEIDAHSQGKIADYLDEIDVALLGPQVAYTLDKSKALCDEKQVPIAVIPMADYGMLDGKKVLQLALSMVS

SEQ ID NO: 40694 - DNA, 306 bp, Pectobacterium carotovorum
  CDS (1)..(306)
atgaataagattttactctgttgcgcagcaggaatgtctaccagcatgctggtacagcggatggaaaaggtcgccgagcaaaaggcgatcgctgttgagataaaagccgtaggttttgaagagtttagtgaactgattgatgaatatgactgttgtcttttggggccgcagattaagtataaactgcctgaattcaaagtgatagctgacgagaaagagaagccgattgcggttattaatatggttgattacggcatgatgaatggggagaaagtccttaacgatgccctggcgatgatcgcgtaa

SEQ ID NO: 40695 - protein, 101 aa, Pectobacterium carotovorum
MNKILLCCAAGMSTSMLVQRMEKVAEQKAIAVEIKAVGFEEFSELIDEYDCCLLGPQIKYKLPEFKVIADEKEKPIAVINMVDYGMMNGEKVLNDALAMIA

SEQ ID NO: 40696 - DNA, 312 bp, Bacillus pumilus
  CDS (1)..(312)
ttgaaacgtattttattagcatgcagttcgggaatgtctacgagtttactagtgacaaagatgaaagcacatgccgattcaatcggggacgaagcagaaatttgggcagttggtcaagatcaagcaaaaaaagaaatggcgaatgcagatgttgtgttaatcggcccgcaaatgagctttttaaaaggagaccttcaaaaagaagcaacaaaatacgggattgaggtagaggtcattgatatgcaggcatacgggcttgccgatggacaaaaagcgtatgaacaggcacttacattgatgggagaatcttaa

SEQ ID NO: 40697 - protein, 103 aa, Bacillus pumilus
MKRILLACSSGMSTSLLVTKMKAHADSIGDEAEIWAVGQDQAKKEMANADVVLIGPQMSFLKGDLQKEATKYGIEVEVIDMQAYGLADGQKAYEQALTLMGES

SEQ ID NO: 40698 - DNA, 318 bp, Serratia marcescens
  CDS (1)..(318)
atggaaaagaaaaaaatctatctgttttgttctgccggtatgtccacttccctgttggtatcaaaaatgaaggcgcaggccgagaaatatgaagtgccggtgatcatcgccgcctatccggaagcgctggctgcggagaaaggcgttgaggcggatctgatcctgctggggccgcagatcgcctacaccttgccggaagtgcaaaaacagctgcccaataaacccgttgaggtcatcgatccgctgctgtacggcaaggtcgatgggctgggcgtgctgaaggccgcggtggccgccatcaagaaagccaatcaataa

SEQ ID NO: 40699 - protein, 105 aa, Serratia marcescens
MEKKKIYLFCSAGMSTSLLVSKMKAQAEKYEVPVIIAAYPEALAAEKGVEADLILLGPQIAYTLPEVQKQLPNKPVEVIDPLLYGKVDGLGVLKAAVAAIKKANQ

SEQ ID NO: 40700 - DNA, 309 bp, Bacillus subtilis
  CDS (1)..(309)
atgaatatattactcgtttgtgcagcaggcatgtctactagcttactggtgagcaagatggaaaaaagtgcgcaggaacagggaaaagactataccatttgggcagtttcaggcgattctgtacaaaatcatatcgataaagcggatgtattgcttctcggtccgcaagtccgttacatgcttccgcagctcaaaaaattaggagagtcaaagggggttccggtagacgtcattaataccgtccattatggaacgtgcaatggggcggaagtgctgaaatcagctgaacagcttggacatgtgtcatag

SEQ ID NO: 40701 - protein, 102 aa, Bacillus subtilis
MNILLVCAAGMSTSLLVSKMEKSAQEQGKDYTIWAVSGDSVQNHIDKADVLLLGPQVRYMLPQLKKLGESKGVPVDVINTVHYGTCNGAEVLKSAEQLGHVS

SEQ ID NO: 40702 - DNA, 27 bp, Primer
atggaaaagaaacacatttatctgttt

SEQ ID NO: 40703 - DNA, 26 bp, Primer
ttaatttgctgcggcttttttaatcg

SEQ ID NO: 40704 - protein, 107 aa, consensus
  MISC_FEATURE (1)..(107): consensus for the disclosure of xaa see table XV
IXLXCXXGMSTSXLVXXMXXXAXXXXXXXXXXXXIXAXXXXXXXXXXXXXXXXXXDXXLXGPQXXXXXXXXXXXXXXXXXXXXXXXXXXIXXXXYGXXXGXXXLXXA

SEQ ID NO: 40705 - protein, 18 aa, consensus
  MISC_FEATURE (1)..(18): consensus for the disclosure of xaa see table XV
XXXXCXXGXXXXXXXXXX

SEQ ID NO: 40706 - protein, 11 aa, consensus
  MISC_FEATURE (1)..(11): consensus for the disclosure of xaa see table XV
DXXXXXPXXXX

SEQ ID NO: 40707 - protein, 21 aa, consensus
  MISC_FEATURE (1)..(21): consensus for the disclosure of xaa see table XV
XXXIXXXXYXXXXGXXXXXXX

SEQ ID NO: 40708 - DNA, 2049 bp, Escherichia coli
  CDS (1)..(2049)
atgaacatgttttttaggcttaccgcgttagctggcctgcttgcaatagcaggccagaccttcgctgtagaagatatcacgcgtgctgatcaaattccggtattaaaggaagagacgcagcatgcgacggtaagtgagcgcgtaacgtcgcgcttcacccgttctcattatcgccagttcgacctcgatcaggcattttcggccaaaatctttgaccgctacctgaatctgctcgattacagccacaacgtgctgctggcaagcgatgttgaacagttcgcgaaaaagaaaaccgagttaggcgatgaactgcgttcaggcaaactcgacgttttctacgatctctacaatctggcgcaaaagcgccgttttgagcgttaccagtacgctttgtcggtactggaaaagccgatggatttcaccggcaacgacacttataaccttgaccgcagcaaagcgccctggccgaaaaacgaggctgagttgaacgcgctgtgggacagtaaagtcaaattcgacgagttaagcctgaagctgacaggaaaaacggataaagaaattcgtgaaaccctgactcgccgctacaaatttgccattcgtcgtctggcgcaaaccaacagcgaagatgttttctcgctggcaatgacggcgtttgcgcgtgaaatcgacccgcataccaactatctttccccgcgtaataccgaacagttcaacactgaaatgagtttgtcgctggaaggtattggcgcagtgctgcaaatggatgatgactacaccgttatcaattcgatggtggcaggtggtccggcagcgaagagtaaagctatcagcgttggtgacaaaattgtcggtgttggtcaaacaggcaagccgatggttgacgtgattggctggcgtcttgatgatgtggttgccttaattaaagggccgaagggcagtaaagttcgtctggaaattttacctgctggtaaagggaccaagacccgtactgtaacgttgacccgtgaacgtattcgtctcgaagaccgcgcggttaaaatgtcggtgaagaccgtcggtaaagagaaagtcggcgtgctggatattccgggcttctatgtgggtttgacagacgatgtcaaagtgcaactgcagaaactggaaaaacagaatgtcagcagcgtcatcatcgacctgcgtagcaatggcggtggggcgttaactgaagccgtatcgctctccggtctgtttattcctgcgggtcccattgttcaggtccgcgataacaacggcaaggttcgtgaagatagcgataccgacggacaggttttctataaaggcccgctggtggtgctggttgaccgcttcagtgcttcggcttcagaaatctttgccgcggcaatgcaggattacggtcgtgcgctggttgtgggtgaaccgacgtttggtaaaggcaccgttcagcaataccgttcattgaaccgtatttacgatcagatgttacgtcctgaatggccagcgctgggttctgtgcagtacacgatccagaaattctatcgcgttaacggcggcagtacgcaacgtaaaggcgtaacgccagacatcatcatgccgacgggtaatgaagaaacggaaacgggtgagaaattcgaagataacgcgctgccgtgggatagcattgatgccgcgacttatgtgaaatcaggagatttaacggcctttgaaccggagctgctgaaggaacataatgcgcgtatcgcgaaagatcctgagttccagaacatcatgaaggatatcgcgcgcttcaacgctatgaaggacaagcgcaatatcgtttctctgaattacgctgtgcgtgagaaagagaataatgaagatgatgcgacgcgtctggcgcgtttgaacgaacgctttaaacgcgaaggtaaaccggagttgaagaaactggatgatctaccgaaagattaccaggagccggatccttatctggatgagacggtgaatatcgcactcgatctggcgaagcttgaaaaagccagacccgcggaacaacccgctcccgtcaagtaa

SEQ ID NO: 40709 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 40710 - DNA, 1491 bp, Staphylococcus aureus subsp. aureus COL
  CDS (1)..(1491)
atggatgataagcaacacacatcttcatccgatgatgaacgcgctgaaattgcaacaagcaatcaagaccaagaaactaattcatcgaaacgcgttcacttaaaacgttggcaattcatatcaatattaattggtacaatcctaataacagctgtcatcacagttgttgcatatatttttataaatcaaaaaataagtggtttaaacaaaactgatcaatcaaacttaaataaaattgaaaatgtgtataaaatcttaaatagtgattattacaaaaaacaggactctgacaagttaagtaaagctgcaattgatggcatggtcaaagaattaaaagatccttattctgaatatttaacaaaagaacaaacgaaatcctttaatgaaggtgtttcaggtgattttgtaggtattggtgcagaaatgcaaaagaaaaatgatcaaattatggttactagtcctatgaagggatctccagcagaacgtgctggcattcgtcctaaagatgtcattactaaagtaaatggaaaatcaattaaaggtaaagcattagatgaagttgtcaaagatgttcgtggtaaagaaaacactgaagtcactttaactgttcaacgaggtagtgaagaaaaagacgttaagattaaacgtgaaaaaattcatgttaaaagtgttgagtataagaaaaaaggtaaagttggagttattactattaataaattccagaatgatacatcaggtgaattgaaagatgcagttctaaaagctcacaaagatggtttgaaaaagattgttttagatttaagaaataatccaggtggactactagatgaagctgttaaaatggcaaatatttttatcgataaaggaaaaactgttgttaaactagaaaaaggtaaagatactgaagcaattcaaacttctaatgatgcgttaaaagaagcgaaagacatggatatatccatcttagtgaatgaaggttcagctagcgcttctgaagtgtttactggtgcgctaaaagactataataaagctaaagtttatgggtcaaaaacattcggcaaaggtgtcgtacaaactacaagagagtttaaggatggttcattgttaaaatatactgaaatgaaatggttaacgccagatggtcattatattcacggtaaaggcattaaaccagacgttactattgacacacctaaatatcaatctttaaatgtcattcctaatacgaaaacatttaaagttggagacgatgataaaaatattaaaactattaaaattggtttatcagctttaggttataaagttgataatgaatcaacgcaatttgataaagctttagaaaatcaagttaaagctttccaacaagcgaataaacttgaggtaactggtgaatttaataaagaaacgaataataaatttactgagttattagttgaaaaagctaataaacatgatgatgttctcgataagttgattaatattttaaaataa

SEQ ID NO: 40711 - protein, 496 aa, Staphylococcus aureus subsp. aureus COL
MDDKQHTSSSDDERAEIATSNQDQETNSSKRVHLKRWQFISILIGTILITAVITVVAYIFINQKISGLNKTDQSNLNKIENVYKILNSDYYKKQDSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVEYKKKGKVGVITINKFQNDTSGELKDAVLKAHKDGLKKIVLDLRNNPGGLLDEAVKMANIFIDKGKTVVKLEKGKDTEAIQTSNDALKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNESTQFDKALENQVKAFQQANKLEVTGEFNKETNNKFTELLVEKANKHDDVLDKLINILK

SEQ ID NO: 40712 - DNA, 1476 bp, Staphylococcus epidermidis RP62A
  CDS (1)..(1476)
atgaatgatcatcaaaaaaatcatgcaacatctcaagatgataacacaaagtcaacaccatctaagaatagcaagcatataaaaattaaattatggcatttcatactcgttattttgggtattattcttttaacatccatcattactgtagtatcaacaattttaattagccatcaaaaaagtggtttaaataaagaacaacgtgcaaatttaaaaaaaattgaatatgtctatcaaacacttaataaagattattacaaaaagcaaagttctgataaattaactcaatctgccatagatggtatggttaaagaacttaaagatccatattcagaatatatgactgctgaagaaacaaaacaatttaatgaaggtgtatcaggtgatttcgttggcataggtgctgaaatgcaaaagaaaaatgaacagataagtgttactagtccaatgaaggattcaccagcagaaaaagctggtattcaacctaaagatatcgtcacacaagtgaatcatcattcggtagtcggtaaaccacttgatcaagttgttaaaatggtccgcggtaaaaaaggaacatatgttactttaactataaaacgtggttcgcaagaaaaggatattaagattaaacgcgataccattcacgttaagagtgtagagtatgagaagaaaggcaatgtaggcgtactaacaatcaataaattccaaagcaatacttctggtgaactcaaatctgcaatcatcaaagcgcataagcaaggcatccgtcatatcattttagatttgagaaataatccgggggggttattagatgaggcagtcaagatggctaacatctttattgataagggaaatactgtcgttcaattagaaaaaggtaaggataaggaagaattaaaaacttctaatcaagcactaaaacaagcaaaagatatgaaagtatccatcttagttaatgagggatcagctagtgcttcagaagtgtttacaggtgctatgaaagactatcataaagctaaagtttacggttctaaaacatttggtaaaggtatcgttcagaccattcgtgaatttagtgatggttcattaattaaatatacagagatgaaatggctaacgcctgatggccattatattcatggtaaaggaattagaccagatgttagtatctcaacaccaaaataccaatcactcaatgtcattccagataacaaaacttatcatcaaggtgaaaaagataaaaatgttaaaacgatgaaaataggtctaaaagctttaggttatccaattgataacgaaacaaacatatttgacgaacaattagaatctgctattaaaacatttcaacaagacaataatttaaaagttaatggcaattttgataaaaaaacaaatgataaatttactgaaaaactagttgaaaaagcgaataaaaaagatactgttttaaacgatttactaaacaaactaaaataa

SEQ ID NO: 40713 - protein, 491 aa, Staphylococcus epidermidis RP62A
MNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTIREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 40714 - DNA, 1458 bp, Gluconobacter oxydans 621H
  CDS (1)..(1458)
atgaagtttcgcagtggcctgttgctgggcaccgcctttctggccggactggccgtcggaccgggagccctgcgtcttgctggctccggcgactttccgggtgcagccctcgcccgtgaaatctcccatgacaacagcgcggaaaccgtccgtctgctgacgctgctgggaacggtcatggacgtggtgaaggcggaatatgtccaccccgtctccgacaaggacctgatcaataacgcgcttgacgggatggtgggcaatctcgatccccattcgtcctacatgacggcggcccagttccacgacatgcagaccgagatctcgggcaagttcggcggtctgggccttcaggttcagggtgaatccggacatgtccgcgtggtctccccgatcgacggaaccccggccgcacgcgctggcatccagcccggcgactttatcacgatggtggaccacaagagcattgatgacctgacgcttgatcaggccgtccgcaagatgcgtggtgatccgggcacgaaaatcagcctgacgatcgtgcgccccaagacgggtaagacgctcactttcgacatgacgcgtgagatcgtgcacgtccagatcgtgaagtccgcgctgtatggcagcacgggttatatccgcctgaccgagttcgatgatgatctcgaaagcgccatgcatgccgcgttcgacaagctcaaggcacaggctaccaaggcgtcgggcggcaagctgaccggtatcatccttgacctgcgctccaatccggggggcaagctcgatcaggccattgccgtttcggacgacttcatcaaggacggtgaaatcgtctcgatccgtggccgtcatgccgagaataaccagcgctgggatgccaagggcacggacatcaccaatggcctgccgatcgtcgtcctgacgaatggcggttcggcctcggccagtgaaatcgtggccggcgctttgaaggatcatcaccgtgccatcattcttggcgaaaagaccttcggcaaaggttcggtccagaccctcattcccattggcgaccagggtgccgtacgtctgacgacagcgcgttattacacgccgtccggccgctccattcagggacttggcatcacgcccgatatccctgtggccgagaccaaggatgatgatgcgtatggttatcgtgaggccgatctgtcccatatcctgacgaatatcggcggcaaccggacgaacgaaacgccgcgcaccgatattccgccgatcgcaaaatccattccgaagatgccggatgccagctggcccgcgttcgatgccacgaagcctgcaaccgatttccagcttcagcaggcgatcaaggtgatcaacgccatggcgggcctctcaaaccctgcgccggccaccgcgccggcaacagaggtcaaggctgccgcgccgaccgcccccaaaccgcctgaagcccaccactga

SEQ ID NO: 40715 - protein, 485 aa, Gluconobacter oxydans 621H
MKFRSGLLLGTAFLAGLAVGPGALRLAGSGDFPGAALAREISHDNSAETVRLLTLLGTVMDVVKAEYVHPVSDKDLINNALDGMVGNLDPHSSYMTAAQFHDMQTEISGKFGGLGLQVQGESGHVRVVSPIDGTPAARAGIQPGDFITMVDHKSIDDLTLDQAVRKMRGDPGTKISLTIVRPKTGKTLTFDMTREIVHVQIVKSALYGSTGYIRLTEFDDDLESAMHAAFDKLKAQATKASGGKLTGIILDLRSNPGGKLDQAIAVSDDFIKDGEIVSIRGRHAENNQRWDAKGTDITNGLPIVVLTNGGSASASEIVAGALKDHHRAIILGEKTFGKGSVQTLIPIGDQGAVRLTTARYYTPSGRSIQGLGITPDIPVAETKDDDAYGYREADLSHILTNIGGNRTNETPRTDIPPIAKSIPKMPDASWPAFDATKPATDFQLQQAIKVINAMAGLSNPAPATAPATEVKAAAPTAPKPPEAHH

SEQ ID NO: 40716 - DNA, 2184 bp, Xanthomonas oryzae pv. oryzae KACC10331
  CDS (1)..(2184)
atgacctacaacgttcctgtgtccatgaaggccggcctgctggcgctggtgttgaccactccgatggccttgctcgcgcgcgccgataccgcgttgcctgccgccgccacgcccgaccaggcgacggccaccaaactcgtctacggcctgctctccgacagccgctatgcctatcggccgcgcgtgctggatgaggcgatgtccaaggacgtgttcaagcgctatctggaaacgctggacggcggcaagcagttctttactcaggccgatatcgacagctttgctccgctgcaggccggcgttggcgatgcactgcgcggtggcaatctggagccggccttccaggtgttctcgctctacaagaagcgtgtcgatcaacgcgtcaaatacgcgctcgatttgctcaagcaggacttcgatttcagcggcaacgacaagttcgagtacgaccgtaaggacgtgccatgggctgcagacgacaagcagctggatgtgctgtggcgccagtcggtcatgaacgactggttgcgcctgaagctggccggcaagaagcccgacgacatccgcaagacgctggataagcgctacgtggcgctggccgattcggtcaagcagctcaagggcgaagacgtgttccagttcttcgtcaacgcttacaccaatgccgtcgacccgcacaccgattacttcacgccgcgtactgccgagacgttcaatcagcagatgtcgctgtcgctggaaggcatcggtgcgcagctgcagaagcaggacgacatggtggtgatccgcgaggtgatcccgggcggtccggcggcggtggatggcacgctcaagccgggcgatcgcatcgtcggcgtgggccagaccaagactggcgcgatcgaagatgtgatcggctggcgcatcgacgacgtggtggccaagatccgcggcagcaaggacacccaggtgcgcctggaatacattccggctgaatcgggcatcgatggcaagcaccgcaccgtaaccctgacccgccagaaggtacgtctggccgaacaggccgcaaagggcgaaaccatcaccttgccggccacgggcaccgagccgcagcgtcgcatcggcatcatcaagctgccgggcttctaccaggatttcgaaggccgtcgtcgcaatgcgaccgactacgcctcggcgacccgcgatgtcgccaagctgctggccggtttcaagaccgacaaggtcgacggcgtggtgctggacttgcgcaacaacggcggcggctcgctggatgaggcaatcgaactcaccggcctgttcatcgagcagggtccggtggtgcaggtgcgtgaatccggcgggcgcgtcaccgtcaatggcgacagcgaccccaaggtcgcctgggacgggccgttgggggtgttgatcaaccgcggctcggcatcggcatcggaaatctttgccggtgcgatccaggattacggtcgtggtctggtgatcggcgaaaccagcttcggtaagggcaccgtgcagaacatcgtcgacctggatcgctggccggctgccgaggggcagcgctacgggcaggttaagctgaccatcgcgcagttcttccgcgtcagcggttccagcacccagcacaagggtgtcgtgccggatatcgtcttcccggccagcgtagatgccaccgaattcggcgagagcacctacgacaacgcgctgccatggacgcgcatcgctgccgcgccgcacacccagtacggcaactttgcgccgctgctgcccaagctgcaggccctgcacaccgcacgcatcgccaccgacaaggaattccagtggtgggaagaagacgtcaagcagtttcgcgatgaaaaagccaagaagtacatttcgttgaatgaagccgagcgcgtcgccgaacgtcagaagcaggatcagcagcgcaaggatcgccagcagatccgtaagcaactcgggttgccgttggacccgcttgccgaagacagcgacgacggcttgaccggtaacgagcgcgacatcgtcaaggacaccgcacgcgagaaggctgccgaaaagcgtccggatccattgctgcatgaatcggctgcgatcctggccgacgcgctgggcttgctgtcgcaggacaagccgttgtcggcccaggtgctgccgaagtcgaccgcgccggggcgttgggcggattga

SEQ ID NO: 40717 - protein, 727 aa, Xanthomonas oryzae pv. oryzae KACC10331
MTYNVPVSMKAGLLALVLTTPMALLARADTALPAAATPDQATATKLVYGLLSDSRYAYRPRVLDEAMSKDVFKRYLETLDGGKQFFTQADIDSFAPLQAGVGDALRGGNLEPAFQVFSLYKKRVDQRVKYALDLLKQDFDFSGNDKFEYDRKDVPWAADDKQLDVLWRQSVMNDWLRLKLAGKKPDDIRKTLDKRYVALADSVKQLKGEDVFQFFVNAYTNAVDPHTDYFTPRTAETFNQQMSLSLEGIGAQLQKQDDMVVIREVIPGGPAAVDGTLKPGDRIVGVGQTKTGAIEDVIGWRIDDVVAKIRGSKDTQVRLEYIPAESGIDGKHRTVTLTRQKVRLAEQAAKGETITLPATGTEPQRRIGIIKLPGFYQDFEGRRRNATDYASATRDVAKLLAGFKTDKVDGVVLDLRNNGGGSLDEAIELTGLFIEQGPVVQVRESGGRVTVNGDSDPKVAWDGPLGVLINRGSASASEIFAGAIQDYGRGLVIGETSFGKGTVQNIVDLDRWPAAEGQRYGQVKLTIAQFFRVSGSSTQHKGVVPDIVFPASVDATEFGESTYDNALPWTRIAAAPHTQYGNFAPLLPKLQALHTARIATDKEFQWWEEDVKQFRDEKAKKYISLNEAERVAERQKQDQQRKDRQQIRKQLGLPLDPLAEDSDDGLTGNERDIVKDTAREKAAEKRPDPLLHESAAILADALGLLSQDKPLSAQVLPKSTAPGRWAD

SEQ ID NO: 40718 - DNA, 1539 bp, Xanthomonas oryzae pv. oryzae KACC10331
  CDS (1)..(1539)
atgtcggagtgcttcatgcgcgtagccgtcctgtccgttgccctgtcgctggccctgttcgcgtcgcccggttgggcgcagaaggccggccccgccgccgcccaggccactgcggacgatccagaagccaatgaagctgctgtttccaaggtgccgctggacgaaattcgtcgcttcgtggcggtgtacaacgcggtcaagcaggcctacgtcgacccggtcgaagacaagaagctgatgcacgccgccgtgcgtggcctgctctcggacctggacccgcacagcacctatttcgacaaggaagacgccgaagccttcgacgaacaggccactggcgcctacgacgggatcggcgtggaattgctgcagcagcaggacaacacgctgaaggtgatcgcgccgatcgacgacaccccggccgcgcgcgccggcatccgcgccggcgatgtgatcgtggccatcgacggcaagccgatcgatgccagcaaggcgatggagccgctgcgcggcgcatccggcagcaaggtggttctgaccatcgtgcgcgacaagacgcccaagccgttcgatgtgaccctgcagcgcgaaaccatccgcgtggccagcgtgcgcagcaagatgctggagccgggctacggctacatccgcatcagcaccttccaggccgacaccggtgccgatttccagaagaacctcaagcagctgcaggctggcggcaagttgcgcggccttgtgctggatctgcgcagcaaccccggcggtctgctgacctcggcggtgcaggtggccgacgatctgctcgacaagggcaatatcgtcagcacgcgcggacgcatctccatcagcgatgccaagttcgacgccaccccgggcgatctggtcaacggcgcgccggtcgtggtgctggtggacgccggctcggccagtgcctcggaagtgctggccggggcgctgcgcgacaacaagcgtgcacgcatcatcggcagccgcaccttcggtaagggttcggtgcagaccgtgctgccgctggacaacggcgactcggtcaagctcaccaccgcgcgttattacacgccgagtggcaagtcgatccaggccagcggcatcgtgccggacgtgatgctcacccccgaaccgcagccaggcgatgccgacgtgccggccagcctgaccgactacaacgaagccaccttgccgggccacctgcgtggcgacgacgaaggcgaagaaggctacagcgccggcgacgtgttgccgggcgatggcccgatcagcgaagccctggccgaactcaagcaacccggctccgccgccaaagcgcaagccgcacgcaaggccaaggcgcaggccgcgcagaaggcgaaagcggccaagaccggtgccgagcccaagcccgccgcagcgcgcccggcaaccacggacaagcccaaatcggccgaaccggcgggcaaagccaagccggctaccgcacccactgcgccaaccgagccagcacagccgacaccgccagcggacaagcctgccgagccggtcaactaa

SEQ ID NO: 40719 - protein, 512 aa, Xanthomonas oryzae pv. oryzae KACC10331
MSECFMRVAVLSVALSLALFASPGWAQKAGPAAAQATADDPEANEAAVSKVPLDEIRRFVAVYNAVKQAYVDPVEDKKLMHAAVRGLLSDLDPHSTYFDKEDAEAFDEQATGAYDGIGVELLQQQDNTLKVIAPIDDTPAARAGIRAGDVIVAIDGKPIDASKAMEPLRGASGSKVVLTIVRDKTPKPFDVTLQRETIRVASVRSKMLEPGYGYIRISTFQADTGADFQKNLKQLQAGGKLRGLVLDLRSNPGGLLTSAVQVADDLLDKGNIVSTRGRISISDAKFDATPGDLVNGAPVVVLVDAGSASASEVLAGALRDNKRARIIGSRTFGKGSVQTVLPLDNGDSVKLTTARYYTPSGKSIQASGIVPDVMLTPEPQPGDADVPASLTDYNEATLPGHLRGDDEGEEGYSAGDVLPGDGPISEALAELKQPGSAAKAQAARKAKAQAAQKAKAAKTGAEPKPAAARPATTDKPKSAEPAGKAKPATAPTAPTEPAQPTPPADKPAEPVN

SEQ ID NO: 40720 - DNA, 1332 bp, Mesorhizobium loti MAFF303099
  CDS (1)..(1332)
atgatgcggaaactgtcgcttctgtttgccggtgcgctgatgggcgcatccgccatgagccttgtctatggtgctcctggctcgtcggcgaacgctgcgggctcggagacctacaagcagctggcgatcttcggcgacatcttcgagcgggtgcgggcacaatatgtcacgccgcctgacgacaagtcgctggtcgagaacgccatcaacggcatgctttcctctctcgacccgcactcctcctacatgaatgccgaacaggcgcaggacatgcgcgttcagaccaagggcgagttcggcggcctcggcatcgaggtcaccatggagaacgacctggttaaggtgatcacgccgatcgacgatacgcccgccgccaaggctggcgtgctggccggcgactacatcgccaagatcgacggcgaagaggttcgcggcctgacgctcaacgacgcggtcgacaagatgcgtggcctggtcaacacgccgatcaagctcaccatcctgcgccagggtgccgacaagccgatcgagctgacggtggtgcgcgacatcatcaaggtcaaggcggtcaagttccgggtcgagaacgacatcggctacatgaagatcacctccttcaccgaaaagacctatgacgacctcgagaacgccatcgacaccatcaagaagcaggtgccggacgacaagctcaagggctatgtgctcgacctgcgcctcaatccgggtggtctgctcgaccaggcggtgagcgtgtccgacgccttcctgaagcgtggcgagatcgtctcgacgcgtggacgcgatccgaaggacgtcacccgtttcgatgccaagccgaagcagaccgacgacatcaacggcaagccgatgatcgtgctcgtcaatggcggctcggccagcgcgtccgaaatcgtcgccggcgcgctgcaggatctgcgtcgcgtcacggtggtgggcacgcagtccttcggcaagggttcggtgcagaccatcattccgctcggcgagaatggcgcgctgcggttgacgacggcgctctattacacgccgtcgggtaagtcgatccagggcaagggcatcacgcccgacatcaaggtcgaccagccgctgccgccggaactgcagggcagggacctgacgcgcggtgaatccgatctcaagggccacatcaagggcgccgacgagagcaagaccggctcgggctcggcagcctatgtgccgccggatccgaaggacgatctgcagctcatctttgctgagcaactgctgcgtggacagaagaccgatcccgctttcccgcccaatccggaaaaggccgtgctcaaccagtaa

SEQ ID NO: 40721 - protein, 443 aa, Mesorhizobium loti MAFF303099
MMRKLSLLFAGALMGASAMSLVYGAPGSSANAAGSETYKQLAIFGDIFERVRAQYVTPPDDKSLVENAINGMLSSLDPHSSYMNAEQAQDMRVQTKGEFGGLGIEVTMENDLVKVITPIDDTPAAKAGVLAGDYIAKIDGEEVRGLTLNDAVDKMRGLVNTPIKLTILRQGADKPIELTVVRDIIKVKAVKFRVENDIGYMKITSFTEKTYDDLENAIDTIKKQVPDDKLKGYVLDLRLNPGGLLDQAVSVSDAFLKRGEIVSTRGRDPKDVTRFDAKPKQTDDINGKPMIVLVNGGSASASEIVAGALQDLRRVTVVGTQSFGKGSVQTIIPLGENGALRLTTALYYTPSGKSIQGKGITPDIKVDQPLPPELQGRDLTRGESDLKGHIKGADESKTGSGSAAYVPPDPKDDLQLIFAEQLLRGQKTDPAFPPNPEKAVLNQ

SEQ ID NO: 40722 - DNA, 1551 bp, Arabidopsis thaliana
  CDS (1)..(1551)
atggaaaaagttgtaaccctaaatcatgatctacctctgttacacttcccgaattctcggaaacccttttcgattccatctccgattcttcggatttcgagcttcaagcgtcataagaaacgttcttgtcttgcatcgtcttcgcgtctagggttctatacagagaccaagaccgtttcagagagccatggtgtgatagttgacaacagtaccatcggaagaagattgcttggtttagccgcagccgtttcagtagcggtttctttgtcgatcttttgtgattccccggcactagctgagtctctaacgatcgctttccctgtttcacgtgctcgtgaggttactacagtacagagaactcttgtggaagcttggggtttgattagagaaacatttgttgatccaacttttaatcatcaaggcaatttgcaacagacgatggtggaaatgtttcctctaagatcagcagatgctgcttatggaaagctcaaagctatgctctctacgcttggtgatccctttactcgactcattaccccaaaggagtaccaaagtttcagaattggcagcgatggaaatctccaaggtgttggccttttcataaactcagaaccaagaacaggtcacctggttgttatgtcttgcgtagaaggtagcccggcagatcgtgctggtatacatgaaggcgaggagttagtcgagataaatggtgagaaattagatgatgttgatagtgaagcagcagcacagaagctgagaggccgagttggaacatttgttaccataaaacttaaaaatgtgaatggatcagggacagattctggtattagagaggtcaagttacctcgagattacattaagctatctccaatatccagtgctataatcccacatacaacacctgatggacgtttagcgaagacaggttatgtcaaactcacagcgttttcacagactgcagcgtccgatatggaaaatgcggtgcacgagatggagaatcaggatgttcagtcatacattctagacctaaggaacaatccgggaggtctggttagagctggtcttgatgttgcacaattatggcttgacggagatgagactcttgtgtatacaatcgatcgagaaggggttacatcaccgatcaacatgatcaatggacacgctgtgacacatgatccacttgttgtgcttgtgaatgaaggaagtgctagtgcaagtgaaattttggcaggtgctttacacgataatggtcgagctatacttgtcggtaaccggacatttgggaaagggaaaattcaaagcataacagagctaaacgatgggtcggctttgtttgtgacggtggctaagtatttgtctccgtctttacacgaaattgatcaagtagggattgcacctgatgtacagtgtaccacaggtatgatcgattctttgaccgctgagatagttgagaagatgaacagttcggttccattgcttgaagcagactcatgtgttatggtcgctgagcacgaacttgaggctcgacgatctaatggaacagcttcttga

SEQ ID NO: 40723 - protein, 516 aa, Arabidopsis thaliana
MEKVVTLNHDLPLLHFPNSRKPFSIPSPILRISSFKRHKKRSCLASSSRLGFYTETKTVSESHGVIVDNSTIGRRLLGLAAAVSVAVSLSIFCDSPALAESLTIAFPVSRAREVTTVQRTLVEAWGLIRETFVDPTFNHQGNLQQTMVEMFPLRSADAAYGKLKAMLSTLGDPFTRLITPKEYQSFRIGSDGNLQGVGLFINSEPRTGHLVVMSCVEGSPADRAGIHEGEELVEINGEKLDDVDSEAAAQKLRGRVGTFVTIKLKNVNGSGTDSGIREVKLPRDYIKLSPISSAIIPHTTPDGRLAKTGYVKLTAFSQTAASDMENAVHEMENQDVQSYILDLRNNPGGLVRAGLDVAQLWLDGDETLVYTIDREGVTSPINMINGHAVTHDPLVVLVNEGSASASEILAGALHDNGRAILVGNRTFGKGKIQSITELNDGSALFVTVAKYLSPSLHEIDQVGIAPDVQCTTGMIDSLTAEIVEKMNSSVPLLEADSCVMVAEHELEARRSNGTAS

SEQ ID NO: 40724 - DNA, 1380 bp, Helicobacter pylori 26695
  CDS (1)..(1380)
gtggtgttattaacaatgacaaaacgactttttaaagggttgttagcggtttctcttgctgtgagtttgcatggtggtgaagttaaggaaaaaaagccggttaagccggttaaagaagatccgcaagaattagcggctaaaagggtggaagcgttcagtcgtttctctaatgtggtttcagaaattgaaaaaaaatatgtggataaaatcagcatttctgagatcatgactaaagcgattgaaggcttgctctctaatttggacgcgcattcagcgtatttgaatgaaaagaagtttaaggaatttcaagcccaaaccgagggcgaatttggggggcttgggatcacggtgggcatgcgcgatggcgttttaaccgttattgcccctttagaaggcactccagcttacaaggctggggttaagtcaggcgataacattttaaaaatcaataacgaaagcacgctgagcatgagcattgatgatgcgatcaacctcatgcgcggcaagccaaaaacccctattcagatcaccgttgtaagaaaaaacgagccaaaacctttagtgtttaacatcattagagacatcattaaactcccctctgtctatgtgaaaaagattaaagaaaccccttatctgtatgtgagagtgagtggttttgacaagaatgttaccaaatcggttttagaaggcttaaaagctaaccctaaggctaaggggatcgtgttggatttaaggggcaatcctggagggctattaaaccaagcggtgggcttgtctaacctcttcattaaagagggggttttagtctctcaaaaaggcaaaaataaagaagaaaatttagaatacaaggctaacggcagagccccttataccaatttgcctattgcggtgttagtcaatggcggttcagcgagcgcgagcgagatcgtcgcaggggcactgcaagatcacaaacgggccgtgattatcggtgaaaaaacctttggtaagggaagcgtgcagatgctgctccctgtcaataaagacgaagccattaaaatcacaaccgcacgctactatttgccgagcgggcgtaccattcaagctaaggggatcacgcctgatattgtgatttatccgggtaaagtgccagaaaatgaaaacaaattcagcttgaaagaagcggatctaaaacaccatttagagcaagagcttaaaaagattgatgataaaacccccaattccaaagaggcggataaagacaagaaaaacgaagaggaaaaagagattactcctaaaatgatcaacgatgatattcagctaaaaaccgctattgacagcttgaaaacctggtctatcgttgatgagaaaatggatgaaaaagcgcctaagaagaaataa

SEQ ID NO: 40725 - protein, 459 aa, Helicobacter pylori 26695
MVLLTMTKRLFKGLLAVSLAVSLHGGEVKEKKPVKPVKEDPQELAAKRVEAFSRFSNVVSEIEKKYVDKISISEIMTKAIEGLLSNLDAHSAYLNEKKFKEFQAQTEGEFGGLGITVGMRDGVLTVIAPLEGTPAYKAGVKSGDNILKINNESTLSMSIDDAINLMRGKPKTPIQITVVRKNEPKPLVFNIIRDIIKLPSVYVKKIKETPYLYVRVSGFDKNVTKSVLEGLKANPKAKGIVLDLRGNPGGLLNQAVGLSNLFIKEGVLVSQKGKNKEENLEYKANGRAPYTNLPIAVLVNGGSASASEIVAGALQDHKRAVIIGEKTFGKGSVQMLLPVNKDEAIKITTARYYLPSGRTIQAKGITPDIVIYPGKVPENENKFSLKEADLKHHLEQELKKIDDKTPNSKEADKDKKNEEEKEITPKMINDDIQLKTAIDSLKTWSIVDEKMDEKAPKKK

SEQ ID NO: 40726 - DNA, 1428 bp, Borrelia burgdorferi B31
  CDS (1)..(1428)
atgaaaaataaatttttaatatgtgtatattttttattgactctgggtataagctctttagtaattgttgaatctatttttgcttttgatgaatctaataataagttatcaagatcaaattatgagcagatgatgattcaagcttttgaatttgtaaaagaaaattatgttgatcctgtaagtgatgaagtaatttttgaaggtgctttaaaaggaatatttcaatccctaggcgatccttattctcaatatttgacaaaaaaagatttagaagaaatttcaaaaacaacagtaggagattatgttggcattggaatttctataataaaaaaaatgcattcccaagataagcaagacaaggcaaaagattttgatcctaatagtgcttgtgtttctattgttacgccttttgaaggaggtccggcttataaggctggaattaaatctggagattgtattaccgctgttgatggcaagagtgtttattctatggaagtagatcaagttgttgatcttttaaaaggtaaagaaggcacaaaagttaaagtatctattcttaggggaaaaaatttaacattggattttgaacttacaagagagaagatagaaatacaaacratcaagtatgacgttattaattcagatattggctatataagaatagtaagctttaatccacacacctctgtagattttagaaaagctttagataatcttaagaataaaaatattaaatctttaattttagatttaaggcttaataccggaggatattttcaggcagctataaaaatggcggatgatattttatctaaaggaattattgtttccacaaaatcaagaaattctagcaagcctattgattataaggcaagctcaaaacaagttttgccttcaaatataaaaattgttgctttaatagacagatcatcagcctcagcatcagaggtttttgtaggagccttaaaagacaataagagagcatacattataggggaaaagtcttatggcaaggggcttattcagcatgtagttcctttttatactggtggatttaaaattacaagctcaaagtattatactccatctggaaagagtattcataaggttggaattgagcctgatttggaaataaaatctccagatttttctgaggaggaggcattaatatataaagaaatttttgataaaaagctgatagaaggttttttgaagggtaaaaaattcattaccgaacaagagattgatttttttgttgagaatcttgtaaaagaaaatccaaaatataaaattgataaagaatttttaggcaagtatgtgttttttaattactatcaggacaataataaagaattgccaatttataatctacattatgacaaagttttaaaaacagcttgtgagtatttgtctaaattaggtaattaa

SEQ ID NO: 40727 - protein, 475 aa, Borrelia burgdorferi B31
MKNKFLICVYFLLTLGISSLVIVESIFAFDESNNKLSRSNYEQMMIQAFEFVKENYVDPVSDEVIFEGALKGIFQSLGDPYSQYLTKKDLEEISKTTVGDYVGIGISIIKKMHSQDKQDKAKDFDPNSACVSIVTPFEGGPAYKAGIKSGDCITAVDGKSVYSMEVDQVVDLLKGKEGTKVKVSILRGKNLTLDFELTREKIEIQTIKYDVINSDIGYIRIVSFNPHTSVDFRKALDNLKNKNIKSLILDLRLNTGGYFQAAIKMADDILSKGIIVSTKSRNSSKPIDYKASSKQVLPSNIKIVALIDRSSASASEVFVGALKDNKRAYIIGEKSYGKGLIQHVVPFYTGGFKITSSKYYTPSGKSIHKVGIEPDLEIKSPDFSEEEALIYKEIFDKKLIEGFLKGKKFITEQEIDFFVENLVKENPKYKIDKEFLGKYVFFNYYQDNNKELPIYNLHYDKVLKTACEYLSKLGN

SEQ ID NO: 40728 - DNA, 1227 bp, Aquifex aeolicus VF5
  CDS (1)..(1227)
atgaaaaggataagcttcattcctttgttaatcctcgtgttctttgcaggttttatcctgggccagagttcggagaataagaaggaagaggacaagtacttttaccttaaactctttacggaagcccttaagatagtagagagagaatacgtagaacccgtgccgataaagaagctcatatacggggcgatagacggtatggtttcctccttagacccattttccgacttcttcacccccgaggagtacaaggaatttctctcggaaactgagggagagttcggtggcgtgggtatagaaatcaccatggaaaacggaagacctgtggtggtatcgcccatagagggaacgcctgcctggaaagccggaataagaccgggtgacataataatagcggtagacggcgaggataccttcaacatgtccttgatggaagtagtcaaaaagataagaggaaaacctggaacaaaggtaaagctcacgatactgagaaagggtgaagggaaacctatagaggtaacactggtaagggcgaggataaaggttcccagcgttaagtacaccaattacaaaggaataggatacataaaaatttctcaatttacttcgggaacctctaagagtttggagaaagccatactggaacttgagaaccagaacgtgaaaggcttcataatagacctcaggaataaccccggaggacttctgtcggaagctgtggatgtaggagatctctttatccccaaaggaaagttgatagtttacacgaaaggaagaaagggagagctccacaggtactttgccgagagggaacccataacacaggggcttcccgtagtgctcctcgttaacaaagggtcggcaagtgcgtcagagatagtggcgggagcccttcaggattaccacatagctacactagtgggagaaaagaccttcggtaaggcctccgttcaaaacctgatacccctctccgacggctctgctatgaaattgaccatagcctactactacacgcctaagggaaggctcatacacaagaagggtataaaacccgacgtagaggttaaaatggacgaagaaacttggaaaaagctctttgaaactataaggaaaatgcgctttgaaggacacatggaaaaagtgatactccttcccgacatagacgttcagctgagaaaggctattgaaatactggagaaaaaggctaaactcaaaaaggcagcatga

SEQ ID NO: 40729 - protein, 408 aa, Aquifex aeolicus VF5
MKRISFIPLLILVFFAGFILGQSSENKKEEDKYFYLKLFTEALKIVEREYVEPVPIKKLIYGAIDGMVSSLDPFSDFFTPEEYKEFLSETEGEFGGVGIEITMENGRPVVVSPIEGTPAWKAGIRPGDIIIAVDGEDTFNMSLMEVVKKIRGKPGTKVKLTILRKGEGKPIEVTLVRARIKVPSVKYTNYKGIGYIKISQFTSGTSKSLEKAILELENQNVKGFIIDLRNNPGGLLSEAVDVGDLFIPKGKLIVYTKGRKGELHRYFAEREPITQGLPVVLLVNKGSASASEIVAGALQDYHIATLVGEKTFGKASVQNLIPLSDGSAMKLTIAYYYTPKGRLIHKKGIKPDVEVKMDEETWKKLFETIRKMRFEGHMEKVILLPDIDVQLRKAIEILEKKAKLKKAA

SEQ ID NO: 40730 - DNA, 1326 bp, Rickettsia prowazekii str. Madrid E
  CDS (1)..(1326)
atgttattacgttttattatagcactatttttaagtataaattgtgcaatagaaggaaaagaaactgaaaataaaatatcaaatcaagaggcttataagcaatttcaagatgtatttgaacgtattgaaaaggattacgtacaggtacctgataggcaaaaaatgatagatgaagcaattaacggtatgttaaactcccttgatcctcattcaaactattacaccgatgaagatttagaagatatttttacttttacaaaaggtgaatttggcgggatcggtgttgaaataatgtatgatagtggtgcaattaagataatatcgtctattgacgatttgccagcttttaaagcagggcttaaaggtggtgattatatagtaggagtcaatgacgaattagtctctacgcttggtcctaataaagctataaaagaaatgcgtggtacacctggtactaaggttagattgctaataatcaaggaagaagaggcaaaaccacaagagctggaactgactcgtgaaatagtaaaaatcaaaccaataaaagcacatctagaaaaaaataatatcgcctatatacgtatcactacttttaatgagtcaacaatttctgaattgaaggcagcagtaaagaagttaaaaactgaaagtaaagataatcttaaaggtataattctcgatttacgtaataatgctggtggtatacttgatcaagctattgctgttagtgattattttattgattctggtgtcattgttacaacaaaaggtagaactacatcaagtaatagcgaaactaaagcgaatgagttttcgttaaaagccccaaaagtacctatgattgttttaataaacggtaattctgcatctgcttcagaaatagttgctggagctttgcaagatcataaaagagcaataatacttggtactaaatcttttggtaaaggatcagttcaggctttaacacaaattaattctagggctgctgtaaaactaactatatctaaatattataccccaagtggtcgttctattcaagcagaagggatagagcctgatattttaattgagcctgcaaaagttgagtatccagaagtaaaaaaaatagataagcgtttttcagaaagttctttaaaaaattacttaaagaatgataatgcaaaaaataaagatagtaacaaagaaacaaaaaccaagaataataagcaagaagagagtgaattatcggaattatataagaaagattatcaatttgctcgtgcttatgatgtaattacagggttgattattaatacgaatcttgagacccaagggaaagctaaataa

SEQ ID NO: 40731 - protein, 441 aa, Rickettsia prowazekii str. Madrid E
MLLRFIIALFLSINCAIEGKETENKISNQEAYKQFQDVFERIEKDYVQVPDRQKMIDEAINGMLNSLDPHSNYYTDEDLEDIFTFTKGEFGGIGVEIMYDSGAIKIISSIDDLPAFKAGLKGGDYIVGVNDELVSTLGPNKAIKEMRGTPGTKVRLLIIKEEEAKPQELELTREIVKIKPIKAHLEKNNIAYIRITTFNESTISELKAAVKKLKTESKDNLKGIILDLRNNAGGILDQAIAVSDYFIDSGVIVTTKGRTTSSNSETKANEFSLKAPKVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNAKNKDSNKETKTKNNKQEESELSELYKKDYQFARAYDVITGLIINTNLETQGKAK

SEQ ID NO: 40732 - DNA, 1380 bp, Helicobacter pylori J99
  CDS (1)..(1380)
gtggtgttattaacaatgacaaaacgactttttaaagggttgttagcgatttctcttgcggtgagtttgcatggtggtgaagttaaggaaaaaaagccggtcaagccggtcaaagaagatccgcaagaattagcggctaaaagggtggaagcgttcagtcgtttctctaatgtggttacagaaattgaaaaaaagtatgtggataagatcagtatttctgagatcatgactaaagcgattgaaggcttactctctaatttggacgcgcattcagcgtatttgaatgaaaagaagtttaaggaatttcaggcccaaaccgagggcgaatttggggggcttgggatcacggtgggcatgcgcgatggcgttttgaccgttattgcacctttagagggcactccagcttacaaggctggggttaaatcaggcgatagcattttaaaaatcaataacgaaagcacgctgagcatgagcattgatgatgcggttaatctcatgcgcggcaagccaaaaacctctattcagatcactgttgttaggaaaaatgagccaaaacccttggtatttaatatcgttagggatattatcaagatcccctctgtctatgtgaaaaagattaaagacacaccttatttgtacgtgagagtcaattcttttgataaaaatgttaccaaatcggttttagacggcttgaaggctaaccctaacattaagggcgttgtgttggatttgagggggaatcctggagggctattaaaccaggcggtaggcttgtctaaccttttcattaaagagggggttttagtctctcaaagaggcaaaaataaggaggaaaacttagaatacaaggctaatggcagagccccttataccaatttacctgttgtggtgttagtcaatggcggttcagcgagcgcgagcgagatcgtcgcaggggcactgcaagatcacaagcgagccatcattatcggtgaaaaaacctttggtaagggaagcgtgcaagtgttgctccctgtcaataaagacgaagccattaaaatcacgaccgcgcgctattatttgccgagcgggcgcaccattcaagctaaggggatcacgcctgatattgtgatttatccgggtaaagtgccagaaaatgaaaataaattcagtttgaaagaagcggatttaaaacaccatttagagcaagagcttaaaaaacttgatgataaaacccctatttccaaagaggcggataaagacaagaaaagcgaagaggaaaaagaggttactcctaaaatgatcaatgatgatattcagctaaaaaccgctattgacagcttgaaaacctggtctatcgtagatgagaaaatggatgaaaaagtgcctaagaagaaataa

SEQ ID NO: 40733 - protein, 459 aa, Helicobacter pylori J99
MVLLTMTKRLFKGLLAISLAVSLHGGEVKEKKPVKPVKEDPQELAAKRVEAFSRFSNVVTEIEKKYVDKISISEIMTKAIEGLLSNLDAHSAYLNEKKFKEFQAQTEGEFGGLGITVGMRDGVLTVIAPLEGTPAYKAGVKSGDSILKINNESTLSMSIDDAVNLMRGKPKTSIQITVVRKNEPKPLVFNIVRDIIKIPSVYVKKIKDTPYLYVRVNSFDKNVTKSVLDGLKANPNIKGVVLDLRGNPGGLLNQAVGLSNLFIKEGVLVSQRGKNKEENLEYKANGRAPYTNLPVVVLVNGGSASASEIVAGALQDHKRAIIIGEKTFGKGSVQVLLPVNKDEAIKITTARYYLPSGRTIQAKGITPDIVIYPGKVPENENKFSLKEADLKHHLEQELKKLDDKTPISKEADKDKKSEEEKEVTPKMINDDIQLKTAIDSLKTWSIVDEKMDEKVPKKK

SEQ ID NO: 40734 - DNA, 1209 bp, Thermotoga maritima MSB8
  CDS (1)..(1209)
atgagactgaaccagatttcaaagtttgctatcgtcagtgtagtagtactcgttcttgcgcttcttctcgggggttctgctaaaacgaatctcaccgtagaagaagtgaacaaggcattggagccgttctttgattcgctttcttacatcctgaactattactacgaagcggacaagcttgacatcaacaagctcatagaccacgcgatagacggccttgtgaagggaacgggagacgatttttcctactaccaggacccagaaacctaccgtgaaaaccagatagaaatgaagggagagtacggtgggcttggaatagaagtgacctacgatgcggaacatggcgctataaaggtagtggctcctatgtatggcactcccgcctggagggctggactcaaagcgggtgatctcatcataaccatagacggcacacccgtgtccaagatgacctacatggaagccgtgaacaacctgagaggagaacccggaacctctgtcacgatcgaggttctcagagacggtgaaaaactcaccttcaccatcgtgagggagaagatcgagataaagatggtgctttactccttcatagaaacggaaaaaggaagtatcgggtacgtcaggatcacacgcttcggagaaaaagcagattccgacatgaaaaacgctctggacaagatcttcgaaaagggtgtgaagggattgataatcgatgtgagggacaaccccggtggatacctcgatgtcgctctcaagatcgtcagcatgttcgtcgacaaaggtgtgattctgaaggtcagaaacggattcggagaagaagacgtctacgaatcctatggaaacagctatccgaacgtaccgatagtacttctggtgaacgaaggatcggcctcggcatccgagatactgacgggagcgctcaaagacctcggcattgcaaccgttgttgggagaaaaaccttcggtaaaggttcagtccagacaggtttcccactgagcaacggtggtgttctctttctcacaacggctcactacctgacaccatctggaaaggacattcacaagatcggaatagagcccgatgtcctggtagaagaaagcgttgaggaggaactccatgcagaaaccagagaacagatagaagtagatccagaaaaggatccattcgtgaaaaagggcctcgaggtgttactcgagaaaataaaatga

SEQ ID NO: 40735 - protein, 402 aa, Thermotoga maritima MSB8
MRLNQISKFAIVSVVVLVLALLLGGSAKTNLTVEEVNKALEPFFDSLSYILNYYYEADKLDINKLIDHAIDGLVKGTGDDFSYYQDPETYRENQIEMKGEYGGLGIEVTYDAEHGAIKVVAPMYGTPAWRAGLKAGDLIITIDGTPVSKMTYMEAVNNLRGEPGTSVTIEVLRDGEKLTFTIVREKIEIKMVLYSFIETEKGSIGYVRITRFGEKADSDMKNALDKIFEKGVKGLIIDVRDNPGGYLDVALKIVSMFVDKGVILKVRNGFGEEDVYESYGNSYPNVPIVLLVNEGSASASEILTGALKDLGIATVVGRKTFGKGSVQTGFPLSNGGVLFLTTAHYLTPSGKDIHKIGIEPDVLVEESVEEELHAETREQIEVDPEKDPFVKKGLEVLLEKIK

SEQ ID NO: 40736 - DNA, 1998 bp, Vibrio cholerae O1 biovar eltor str. N16961
  CDS (1)..(1998)
atgaaatgccgttcaaaaatatctctgattgctgctagcctatggctggcagccttttcagctcaggctctagaagccaaactcaaaccagaagatctccctcttcttgttcctgaagctcaacacgcaacggcagcgaaacgtgttacctcacgttttacccgttctcattacaaacaattcaatttagacgaccagttttctcaagccatgtttgaacgctaccttgagatgctggattacagtcgaaatatctttactcaagcggacatagacagcttcaaagcttggtctttgcaattggatgaccaattaaaagcaggtgacaatcaaatcgcttacgatctgtataacctgtcaatggaaaaacgttttgagcgctttcaatacgcactttctctgcttgatcaagagatgacgtttgatgctgatgagtctattgagcttgatcgtacgaaatcgccttggccaaaagatcttaaagagattaacgagctgtggagacaacgagttaaatacgatgcgttaagcttgaaactggcaggtaaagagtggccagaaatcaaagaaacgctcgataaacggtacaacaatgccatcaagcgcctcacacagacaaaaagtgaagacgtatttcaaacttatatgaatgcgtttgcgcgtgaagttgatccgcacaccagctatttgtcaccgcgtaacgcagaacaattccaatctgaaatgaatctctcgttggaagggattggtgccgtgttacaaatgaccgacgattacaccatcatccgctcattggttgcaggtggtcctgcagcattgagcaaacaattgggtgagggtgaccgcattatcggcgtcggtcaagaaggcgaagatgtggtagatgtagtcggttggcgcttagacgatgtcgttcaactgattaaaggacctaaaggtagcaaggtgaaactgctcgtgttacctgaaggcaaagacgcaaaaagtcacgttgtcactattgtgcgagataaaattcgcttagaagatcgcgccgtaaaatctgaagtgattgaaaaagcagggaagaaaattggtgtactagaagtaccgagtttctacgttggcttagctcaagacacggaaaaactactggcggagctaaaagcgaaaaaagtcgacggcatcattgttgatttacgcaataacggtggtggtgcattaaccgaagctaccgcgctttctggtttgttcattaccagtggccctgtagttcaggtgcgtgatagctatggtcgagtcaacgttaactcggataccgatggtagcattagctatagcggaccaatgaccgtgctgattaaccgctacagtgcatcggcttcagaaatctttgctgccgcaatgcaagactatggccgcgcgatcattctcggtgagaactcatttggtaaaggtaccgtacagcagcatcgctctctcaatcatatctatgatttgtttgataaagagcttggctacgtacaatacacgattcaaaaattttaccgtattgatggtggtagtacccaaaacaaaggtgtcgtccctgatatcgcgtatccaaccgcgattgccccttccgaaacaggggaaagtgttgaagataacgcactaccgtgggacagcattgataaagcaaaatatgagcgtttgaataacttcaacaccatcattgctagcttggaagctaaacaccaacaacgtgtcgcgaatgatttagaatttggttttatcgagcaagatattgcgaaataccgtgcagagaaagatgacaacctactttcgctgaatgaaaaagtacgcaaagaagagagtgctaaggctgatgaagagcgcttagctcgcatcaatcaacgccaaaaagcgttaggtaaatcgacctatgcgagcttgcaagatataccgaaagattatgaagcaccggatgcttatctcgatgaatcggttaacattatgcttgacatgatatcgcgataa

SEQ ID NO: 40737 - protein, 665 aa, Vibrio cholerae O1 biovar eltor str. N16961
MKCRSKISLIAASLWLAAFSAQALEAKLKPEDLPLLVPEAQHATAAKRVTSRFTRSHYKQFNLDDQFSQAMFERYLEMLDYSRNIFTQADIDSFKAWSLQLDDQLKAGDNQIAYDLYNLSMEKRFERFQYALSLLDQEMTFDADESIELDRTKSPWPKDLKEINELWRQRVKYDALSLKLAGKEWPEIKETLDKRYNNAIKRLTQTKSEDVFQTYMNAFAREVDPHTSYLSPRNAEQFQSEMNLSLEGIGAVLQMTDDYTIIRSLVAGGPAALSKQLGEGDRIIGVGQEGEDVVDVVGWRLDDVVQLIKGPKGSKVKLLVLPEGKDAKSHVVTIVRDKIRLEDRAVKSEVIEKAGKKIGVLEVPSFYVGLAQDTEKLLAELKAKKVDGIIVDLRNNGGGALTEATALSGLFITSGPVVQVRDSYGRVNVNSDTDGSISYSGPMTVLINRYSASASEIFAAAMQDYGRAIILGENSFGKGTVQQHRSLNHIYDLFDKELGYVQYTIQKFYRIDGGSTQNKGVVPDIAYPTAIAPSETGESVEDNALPWDSIDKAKYERLNNFNTIIASLEAKHQQRVANDLEFGFIEQDIAKYRAEKDDNLLSLNEKVRKEESAKADEERLARINQRQKALGKSTYASLQDIPKDYEAPDAYLDESVNIMLDMISR

SEQ ID NO: 40738 - DNA, 2052 bp, Pasteurella multocida subsp. multocida str. Pm70
  CDS (1)..(2052)
atgaaattgagtaaaacaaaaagttatttagcaacgtttttgttaagtactttcttaatgagctttaatcttgtcgaggcagtacagccaaaaatcaaattaagcgatattgttacgccacaacctacggaagaaaatcaattagcgacaaaacgggcgacaactcgtttaacgcaaagtcattatcgtaagttccagttaaatgacgcgttttctgagaaaatttttgagcgttatcttaagtcattagattttagccgaaatacttttctacaatctgatattgatgaaatgcgcgcaaaatatgccgataagtttgatgatgcattaaatgaaggggatttaagtattgcctttgcaatgtacgatttaatgatgaaaagacgctatgatcgttataaatacgcgctttctttattagataaagagcctgatttatcgggtcaggatcaaattgaaatcgatcgtgagaaatccccgtggccaaaagacaacgcagaattagataagttgtgggaacaacgagttaaaaacgacattatcaatcagaaattaaaagataaaaaatggtctgatattaagaaacgtttaattaaacgttatgatttggcgattcgtcgtttaacccagactaaagcagatgacattcttcaggtgtatttaaatgcctttgcacgagaagtggatccgcacacaagctatttggcaccgagaacagcgaaaagttttaacgaaagtatgaacctgtcgttagaagggattggcgcgacattacaacaaacggaagatgatgggacaacgattaaatcattagtgccaggggcacctgcagaacggagcaaaaaattgaaagcaggtgaccgcattattggtgtagggcaagccagcggtgaaatcgaagatgttgtaggttggcgtttagaagatattgttgacaaaattaaaggtaagaaaggcacaaaagtgcgtttagaaattgagcctgcgaaagggggcaaatctaagattattaccttagtgcgcgataaagttcgtattgaagatcaagccgcaaaactcacaatcagcaaagtagaggggcaaattgtcgcctcaattaagattccaagtttttacattggattgacacaagatgtgagaaaattattggctgaaatgaaaacgaaaaaagcaaaagccttaattattgacttacgcgataatggcggtggcgcattaaccgaagcggttgggttaagcggtttatttattagcgatggaccgattgttcaagtgcgcgatgcttttcaacgtattcgcgttcatgaagatccagacagtgaacaagtttattctggacctttattagtgatgattaaccgttttagtgcttcagcttcagagatttttgctgccgcaatgcaggattataatcgtggaattattattgggcagaatacttttggtaagggaacagtacagcaaagtcgttcgttaaactttgcgttcgatgccaatcaagaacctttaggtctgattcaatatactattcagaagttttatcgtattgatggtggaagtactcaattaaaaggcgtggcaactgacattgatttccccgctgcgattgatgcgaaagaatatggtgaggaaagagaagataatgcgttgccttgggataaaattcctgccgcaaattactttgaagtcgcacaagcgcgtgatgcagtagcgttcttaacaccaaagcatattgaacgcatagctaaagatcccgaatttgtcgcattaaatgaagagcttaaaattcgtgatgaaagaaacgcattaaaatatttgtcgttgaattatcaaaagcgcaaaattgaaaatgataaagatgatgcaagacgtttaaaagacttaaatgcacgctttaaacgtgagggtaaaaaaccattaaaagatctggatgatttagcaaaagattatgaggcgccagatttttatttaaaagaagcagagagaatggcagctgatcttgttcagtttgaaaccgaaaaaatgggtatgaatcagaaaagcacaaactag

SEQ ID NO: 40739 - protein, 683 aa, Pasteurella multocida subsp. multocida str. Pm70
MKLSKTKSYLATFLLSTFLMSFNLVEAVQPKIKLSDIVTPQPTEENQLATKRATTRLTQSHYRKFQLNDAFSEKIFERYLKSLDFSRNTFLQSDIDEMRAKYADKFDDALNEGDLSIAFAMYDLMMKRRYDRYKYALSLLDKEPDLSGQDQIEIDREKSPWPKDNAELDKLWEQRVKNDIINQKLKDKKWSDIKKRLIKRYDLAIRRLTQTKADDILQVYLNAFAREVDPHTSYLAPRTAKSFNESMNLSLEGIGATLQQTEDDGTTIKSLVPGAPAERSKKLKAGDRIIGVGQASGEIEDVVGWRLEDIVDKIKGKKGTKVRLEIEPAKGGKSKIITLVRDKVRIEDQAAKLTISKVEGQIVASIKIPSFYIGLTQDVRKLLAEMKTKKAKALIIDLRDNGGGALTEAVGLSGLFISDGPIVQVRDAFQRIRVHEDPDSEQVYSGPLLVMINRFSASASEIFAAAMQDYNRGIIIGQNTFGKGTVQQSRSLNFAFDANQEPLGLIQYTIQKFYRIDGGSTQLKGVATDIDFPAAIDAKEYGEEREDNALPWDKIPAANYFEVAQARDAVAFLTPKHIERIAKDPEFVALNEELKIRDERNALKYLSLNYQKRKIENDKDDARRLKDLNARFKREGKKPLKDLDDLAKDYEAPDFYLKEAERMAADLVQFETEKMGMNQKSTN

SEQ ID NO: 40740 - DNA, 2097 bp, Pseudomonas aeruginosa PAO1
  CDS (1)..(2097)
atgaagcgttttctgccccgtaccgccctgttgctcctcctcggcgccagttcgctgccgctgttcgcctcgaccgccgtctccgtcggcagcgcccagaattcctgggacagcctgcagccggaccgcgagcaggtcatcgccagcctcaacgtcgtggaactgctcaagcggcaccactacaacaagccgccgctgaacgatgaacgctcggccaagatctacgacagctacctgaagatgctcgatccggcgcggatgtacttcaccgccggcgacatcgccgagttcgatcgctggcgcaacaggttcgacgacttcctcaagagcggcgacctcgatcccggcttcgtcatctacaagcgccacctcgaccgcctgaaaggtcggctcgactacgccctggcgatgctcgacaagggcgtcgacaagatcgacttcagcgtcgacgagagcctgctgatcgaccgcgaaaaggccccctgggcgaaggacaccgcagagctcgacgacctctggcgcaagaaggtgaaggacgaggtcctgcgcctgaagatcaccggcaaggacgacaaggcgatccaggaacagctcaccaagcgctacaagaaccagctgtcgcgcctgaagcagacccgcagcgaagacatcttccaggcctacatcaacgccttcgcccagtcctacgatccgcacacccagtacctgtcgccggacaacgcggaaaacttcgacatcaacatgagcctctcgctggaaggcatcggcgcggtgctgcagagcgacaacgactacgtcaaggtcgtacgcctggtgccggccggcccggcggcgaagagcaagcagatcgccacctccgacaagatcatcggcgtcgcccagggcaagggcgaaatggtcgacgtagtcggctggcgcctggatgaagtggtcaagctgatccgtgggccgaaaggttcccaggtacgcctggaagtgattccggcgagcaacgcgccgaacgaccagaccagcaagatcgtcgccatcacccgcgaggcggtgaagctggaggaccaggcggcgaagaaatccatcatcaaggtcgaccacgaaggccgcagctacaagctcggcgtgatcgacctgcccgccttctacctggacttcaaggcctaccgcgccggcgacccgaactacaagagcaccacccgcgacgtgaagaagctggtcgccgaattgcagaaggacaaggtcgacggcatcgtcctcgacctgcgcaacaacggcggcggctccctgcaggaggccaccgagctgaccggcctgttcatcgaccagggcccgaccgtactggtgcgcaacagcgacggccgcgtcgacgtgctcaacgacgacgaaggcaaggccttctataccggcccgctggcggtactggtcaaccgtctctcggcctccgcctcggagatcttcgccggcgccatgcaggactaccaccgcgcgctgatcctcggtggacagaccttcggcaagggcaccgtgcagaccatccagccgctcaaccacggcgaactgaagctgaccctggcgaagttctaccgtgtctccgggcagagcacccagcaccagggcgtgatcccggacatcagctacccgtccatcgtcgacgacaaggaaatcggcgaaagcgccctgcccgactcgatgccctgggacaccatccgcccggtggtgaaggacgaggccaacccgttcaagccgttcctcgcgcaactcaaggcccagcacgacgcgcgcaccgagaacaacgccgacttcgtctacgcccgcgagcgcctggcgctggcccaggagctgatgaaggagaagaccgtcagcctgaacgaggccaagcgccgcgcccagcagaccagcatcgagaaccgccagttggccatggagaacgccctgcgcaagtccaagggccaggagccgctgaaggaactcaagcgcgaggacgagaacgccctgccggaagaggacgacaagaccaagccgcaggacgacgcctacctcaccgagtccgggcacatcctgctggactacctgaacctcaactcggcggtggccaagcactga

SEQ ID NO: 40741 - protein, 698 aa, Pseudomonas aeruginosa PAO1
MKRFLPRTALLLLLGASSLPLFASTAVSVGSAQNSWDSLQPDREQVIASLNVVELLKRHHYNKPPLNDERSAKIYDSYLKMLDPARMYFTAGDIAEFDRWRNRFDDFLKSGDLDPGFVIYKRHLDRLKGRLDYALAMLDKGVDKIDFSVDESLLIDREKAPWAKDTAELDDLWRKKVKDEVLRLKITGKDDKAIQEQLTKRYKNQLSRLKQTRSEDIFQAYINAFAQSYDPHTQYLSPDNAENFDINMSLSLEGIGAVLQSDNDYVKVVRLVPAGPAAKSKQIATSDKIIGVAQGKGEMVDVVGWRLDEVVKLIRGPKGSQVRLEVIPASNAPNDQTSKIVAITREAVKLEDQAAKKSIIKVDHEGRSYKLGVIDLPAFYLDFKAYRAGDPNYKSTTRDVKKLVAELQKDKVDGIVLDLRNNGGGSLQEATELTGLFIDQGPTVLVRNSDGRVDVLNDDEGKAFYTGPLAVLVNRLSASASEIFAGAMQDYHRALILGGQTFGKGTVQTIQPLNHGELKLTLAKFYRVSGQSTQHQGVIPDISYPSIVDDKEIGESALPDSMPWDTIRPVVKDEANPFKPFLAQLKAQHDARTENNADFVYARERLALAQELMKEKTVSLNEAKRRAQQTSIENRQLAMENALRKSKGQEPLKELKREDENALPEEDDKTKPQDDAYLTESGHILLDYLNLNSAVAKH

SEQ ID NO: 40742 - DNA, 1311 bp, Pseudomonas aeruginosa PAO1
  CDS (1)..(1311)
atgctgcattgcttccgtcccaccaccctggcgctggccctgctgctcggcgcgggcgcggcccaggctgccgacgccccggccgacgccgcgccactggccaacggtagcagtgccccgctgcccctcgacgagctgcgtaccttcgccgaggttctcgaccgggtgaaggccgcctatgtcgagccagtggacgacaagaccctgctggaaaacgccatcaagggcatgctcagcaacctcgacccgcactccgcctacctcggcccggaggacttcgccgagctgcaggaaagcaccagcggcgagttcggcggtctgggcatcgaggtcggcagcgaagacggcttcatcaaggtggtctcgccgatcgacgacacccccgcggcccgcgccggcatccagcccggcgacctgatcgtgcagatcgacggcaagccgaccaagggccagtcgatgaccgaagcggtcgacagcatgcgcggcaaggccggctccccgatcaccctgaccatcgtccgcgatggcggcagaccgttcgacgtcgaactcaagcgcgccatcatcaaggtcaagagcgtcaagagccaggtcctcgaacccggctacgcctacctgcgcatcacccagttccaggtcaacaccggcgaggaagtggtcaaggcgctgaaccagctgcgcaaggacaacaagggccgtctcaagggcctggtcctggacctgcgcaacaaccccggcggcgtgctgcagtccgccgtcgaggtagccgacgccttcctcaccaagggcctgatcgtctacaccaagggccgcatcgccaactccgagctgcgcttcagcgccgacccggccgatcccagcgacaaggttccgctggtggtactgatcaacggtggcagcgcctcggcggcggaaatcgtcgccggtgccctgcaggaccagaagcgcgcgatcctgatgggcaccgacagcttcggcaagggctcggtgcagaccgtgctgccgctgaacaacgaccgcgccctgaagctcaccaccgcgctctactacacccccaacgggcgctccatccaggcccagggcatcgttccggacatcgaggtcggacgcgccaaggtgacccaggagcggagcagcttcgagggcttcaaggaagccgacctgcagggccacctggccaacggcaacggcggcgccgaccgccccaccggcaagcgtgccgcgccgagcgagcgcccgcaggattccgactaccagctcagccaggcccttagcctgctgaaaggcctgagcgtcacccgcggcaactga

SEQ ID NO: 40743 - protein, 436 aa, Pseudomonas aeruginosa PAO1
MLHCFRPTTLALALLLGAGAAQAADAPADAAPLANGSSAPLPLDELRTFAEVLDRVKAAYVEPVDDKTLLENAIKGMLSNLDPHSAYLGPEDFAELQESTSGEFGGLGIEVGSEDGFIKVVSPIDDTPAARAGIQPGDLIVQIDGKPTKGQSMTEAVDSMRGKAGSPITLTIVRDGGRPFDVELKRAIIKVKSVKSQVLEPGYAYLRITQFQVNTGEEVVKALNQLRKDNKGRLKGLVLDLRNNPGGVLQSAVEVADAFLTKGLIVYTKGRIANSELRFSADPADPSDKVPLVVLINGGSASAAEIVAGALQDQKRAILMGTDSFGKGSVQTVLPLNNDRALKLTTALYYTPNGRSIQAQGIVPDIEVGRAKVTQERSSFEGFKEADLQGHLANGNGGADRPTGKRAAPSERPQDSDYQLSQALSLLKGLSVTRGN

SEQ ID NO: 40744 - DNA, 1485 bp, Neisseria meningitidis Z2491
  CDS (1)..(1485)
atgtcgaaacctgtttttaagaaaatcgcactttatactttgggtgcaatcagcggcgtggccgtcagtctggcggtgcagggttttgccgccgagaaggacaggcgggataacgaagtcctgccggtgcaatccatccgcacaatggcggaggtttacggtcaaatcaaggcaaactactatcaggacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggatttgtcaaagtggtttcgccgattgaggacacgcctgcggaacgggcgggggtgaaaagcggcgatttcattgtgaaaatcgataatgtttcgacacgcggcatgacggtcagcgaagcggtgaagaaaatgcggggcaagccgggtacgaagattactttgacgctgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgactggcgcggtcggcgtgtcggcggcatttctgccgtctgaagcagtcgtcgtcagcaccaagggacgcgacggcaaagaccgcatggtactgaaagccgttcctgaagattatgtgtacgggatgggcggcgattcgttggcgggcattcctgccgagttgaaaaccataccgatgacggtattggtcaattccggttcggcttccgcgtcggagattgtcgcaggtgcattgcaggatcataaacgcgcggtcatcgtcggtacgcagagcttcggcaaaggttcggttcagactttgattcctttgtccaacggcagcgcggtcaagctgacaacggcactgtattatacgccgaacgaccgttctattcaggcgcaggggattgttcccgatgtcgaagtaaaagataaggaacgcatttttgaaagccgcgaggcggatttggtcggacacatcggcaatcctttgggcggcgaggatgtgaacagtgaaacccttgccgtgccgcttgaaaaagatgcggataagcccgctgtaaaagaaaaaggtaaaaagaaaaaggacgaggatttgtcttcaaggcggattcccaaccctgccaaagacgaccagttgcggaaagctttggatttagtcaagtcgcccgagcagtggcagaagtctttggggctggcggcgaaaaagccggtttcaaataaagataagaaagataaaaaagataagaagtag

SEQ ID NO: 40745 - protein, 494 aa, Neisseria meningitidis Z2491
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAVPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNSETLAVPLEKDADKPAVKEKGKKKKDEDLSSRRIPNPAKDDQLRKALDLVKSPEQWQKSLGLAAKKPVSNKDKKDKKDKK

SEQ ID NO: 40746 - DNA, 1344 bp, Deinococcus radiodurans R1
  CDS (1)..(1344)
gtgacccccgccgcctattgtgggtcaatgaatcgcaaccgcattgctctggtggcgggcaccctcgccctcaccgccgccgtggccgccgcgcagatgggcggctacacttctcagacgctcgccaatacgcccgaaggcaaaagcctggtccaagtgctcaacgacctcaaccgctattacctctacccggtcaaccaggacaaggtgctgcgcggcgcgatcacgggggcgctcgccagcctcgacgacgaattcacctactacaccgaacccgaagacaacgcggtggccgagcaggacctctcgggatcgttcggcggcatcggggtgacgctggtggccgccaacagtgacggctccggcggcaaggtggacaacgtcttcaaggacaaccccgccttcaagggcggcgtgcacatcggcgacgtgtttctcaagatcggcgacaaggacgtgacgggcgccaagctcaacgacatcgtcaagctggtgcgcggtcctatcggctcggaggtggacgtgaccttcgggcgcaacggcaagccctacaccgtcaagctcaagcgcgacaaggtcaacgtcatcagcgtcgaaaagaccatcttgcccggcaacatcggctacgtggcgctcaacaccttctacaacgagcaggcgagcgcgcagttccgcgccgcgattgccgacatgaaaaaggccaatgtgcagaagctgattctcgacctgcgtgacaacggcggcggcctgctgagcgccggggtggacgtggccgaccagttcctgcaaagcggccccatcgtcagcctacgcgagcgcggcggtcagcccgaggtgtacggcagcgcccgcaagcaggcgaccgactacaccggcaaactggtgctgctcgtcaacaagaacagcgccagcgccagcgaagtggtcggcggcgcccttcaggacaacaagcgcgccaccatcatcggcgagcagaccttcggcaagggcgtggcgcaggtgccgatcaccctgcccgacggcggcaaggtcgccatcgtcaacagcgcctggattacccccaaggggcgcgagattcacaagaagggcattacgccggacatcgtggtcaaggacacccgcttcccggtgccgctcaacttcagcggcagtggcgtggcgcccggcaccaccctgaccctcaccgtcggcgaccagccggtcaaggtcaccgccgacaaggacggcaagttcacctacgtgggcgaaatcaagcgccgtgaccgcagcgacgtgcagggccaggccgtggtggacgtggaacacgacgccatcctgaaaaaggcgctggaaacgctgaagtaa

SEQ ID NO: 40747 - protein, 447 aa, Deinococcus radiodurans R1
MTPAAYCGSMNRNRIALVAGTLALTAAVAAAQMGGYTSQTLANTPEGKSLVQVLNDLNRYYLYPVNQDKVLRGAITGALASLDDEFTYYTEPEDNAVAEQDLSGSFGGIGVTLVAANSDGSGGKVDNVFKDNPAFKGGVHIGDVFLKIGDKDVTGAKLNDIVKLVRGPIGSEVDVTFGRNGKPYTVKLKRDKVNVISVEKTILPGNIGYVALNTFYNEQASAQFRAAIADMKKANVQKLILDLRDNGGGLLSAGVDVADQFLQSGPIVSLRERGGQPEVYGSARKQATDYTGKLVLLVNKNSASASEVVGGALQDNKRATIIGEQTFGKGVAQVPITLPDGGKVAIVNSAWITPKGREIHKKGITPDIVVKDTRFPVPLNFSGSGVAPGTTLTLTVGDQPVKVTADKDGKFTYVGEIKRRDRSDVQGQAVVDVEHDAILKKALETLK

SEQ ID NO: 40748 - DNA, 1950 bp, Chlamydia muridarum
  CDS (1)..(1950)
atgaagagactcgctcgtttttgtcttctagccttaactttattcccacaacttgcgttttcctcagcccccctccgacaacaagatgtccgcaaaaccgtagaaaaattagtcgagcaccatattgatacaaaacatatttctccccacattttatcgagatctttggaagactatgctcgatcattcgattctcataaagcatacttaacccaagatgaggtcctaacatacgtcttttcagaaaaagcgacccattccttatttaaacaataccaagaagataatttcgcttcttttagagagttacatacttgtattcaacagagcatttcccgggtaagagagtggcgtactgtgtggttatcagatgctgttcgcgtcattcaagatgcttcctcacatactatcccaaaaaaaccaactacctggggatcttctattgaagaggtaaagcaaagacaatatgagcttcttctttcctatgcatctatctacctagaagatgctacaaaaaatcgctatcaggggaaagaacatgcactagtgagattatgtattcgccagattgaaaatcacgaaaatccttatataggaatcaatgaccatggactcaaaatgtctcttgaagaagaggccaatagcttccatattcgcatcattaaatccattgctcatagtttagatgctcatacagcctacttcagcaaagaagaagccctttctatgcgagctcagctggagaaaggtatgtgtggaataggggtagttctgaaagaagacattgatggtgtagttgttaaagaagttcttcctggagggcctgctgataaaacaggaagtcttcgtgtgggcgatattatttaccgcgttaatgggaaaaatattgaaaacaccccttttcctggagttttagattccctaagaggattaccaggatcttccgtcactttagatattcacagacaaaacaacgaccatgtcgttcaactacgccgagaaaaaattctcttagatagccgccgtgttgatgtatcctatgaaccttacggtgacggcattatcgggaaaatcaccctacactccttttatgaaggagaaaatcagatatctagtgaacaggatttacgacgagctattcgagaactgcaagaaaaaaaccttcttgggttagttcttgatattcgagaaaacaccggaggatttttatctcaagccatcaaagtttctggtttgttcctaaccaatggagttgttgttgtctctcgatatgcggatggatctgtaaaacgctatcgcacgatttctcctcaaaaattttatgatgggccattagctgttttggtttctaaaagctctgcttccgcagcagaaattgttgcacaaacacttcaagactatggtgtagcccttattgtcggagataaacaaacctatgggaaaggaaccatacaacaccaaacgattacagggaacaactctcaagaagatttctttaaagtaactgtagggagatactattctccttcagggaaatccacacaactggaaggtgttaaatcagatattgttatcccctcccgatatgcggaagacaatctaggtgaacgttttttagaatatgctctcccagccgatcaatatgagaatgttttgaacgacaatttaggagatctcgatatccatattcgtccctggttccaaaaatactattctccacatttacaaaaaaccgagcttacgtggagagaaatgcttccccaactcgtcgagaacagtcagcagcgtcttgaaaaaaacaaaaattttgaaatttttgttcaacatttgaaaaaaacagataaacaagaacaatcatttggaagcaatgacctgcaaatggaagagactgtcaatattgttaaagacatgattcttttgcaaacttcattaagatctcccgcacaataa

SEQ ID NO: 40749 - protein, 649 aa, Chlamydia muridarum
MKRLARFCLLALTLFPQLAFSSAPLRQQDVRKTVEKLVEHHIDTKHISPHILSRSLEDYARSFDSHKAYLTQDEVLTYVFSEKATHSLFKQYQEDNFASFRELHTCIQQSISRVREWRTVWLSDAVRVIQDASSHTIPKKPTTWGSSIEEVKQRQYELLLSYASIYLEDATKNRYQGKEHALVRLCIRQIENHENPYIGINDHGLKMSLEEEANSFHIRIIKSIAHSLDAHTAYFSKEEALSMRAQLEKGMCGIGVVLKEDIDGVVVKEVLPGGPADKTGSLRVGDIIYRVNGKNIENTPFPGVLDSLRGLPGSSVTLDIHRQNNDHVVQLRREKILLDSRRVDVSYEPYGDGIIGKITLHSFYEGENQISSEQDLRRAIRELQEKNLLGLVLDIRENTGGFLSQAIKVSGLFLTNGVVVVSRYADGSVKRYRTISPQKFYDGPLAVLVSKSSASAAEIVAQTLQDYGVALIVGDKQTYGKGTIQHQTITGNNSQEDFFKVTVGRYYSPSGKSTQLEGVKSDIVIPSRYAEDNLGERFLEYALPADQYENVLNDNLGDLDIHIRPWFQKYYSPHLQKTELTWREMLPQLVENSQQRLEKNKNFEIFVQHLKKTDKQEQSFGSNDLQMEETVNIVKDMILLQTSLRSPAQ

SEQ ID NO: 40750 - DNA, 1527 bp, Xylella fastidiosa 9a5c
  CDS (1)..(1527)
ttgtctgttgcttcccgcataattcgtcattgctcggtagtaccgggtgccgttttctttccggagtgctgcatgcgtgtcgttgggttgtcattggccataagtgtggtcttgttgtctttctcgttgtcggcgaagaatcccagcggtgttgttatgtctcctccggttgaagagatggaaatgccggagagcaacgatgctaacgtgccgttagatgaaatccgccgttttgtttctgtgtataacgccatcaagcaagcctatgttgatccggtcaatgacaggaagctgatgcattcggcggtgcgaggtctgctttcggatttggatccgcatagtacctattttgataaggaggatgccgatgccttcgacgagcaaaccaacggtgtttacgatgggatcggtgtggagctgcaagagcagtcggacaacacgttgaaggtgatcgcgccgattgatgatacgccagcagcgcgtgctggtttgcgtccaggtgatctgatcgtggcgatcaacggcaagccgcttgccaatgtcgatgcgatgaagccgctgcgcggtgcgccagggagtcaagtcactttgacgattgtgcgcgataagaatggcaagccattcgatatgacaatcaagcgtgagacgatacacatcgctagtgtgcgtagccgtatgcttgagcctggttatggctatatccgtattagtgttttccaggccgatacgggtaacgatttccataagcatttggggcagcttaagcagcaggcgggtggtaagttgcgtggtctgttattggacttgcgtagtaatcctggtggattgctgacggcagcggtgcaggttgctgatgctttgttggataagggaaacattgtcagtacgcgtggccgtatttcggcgagtgatacgcgctttgatgcaacgccgggggatttactggatggtctcccgttggtggtattggtcgatgctggttcggccagcgcttcggaggtgttggtgggtgcgctgagtgacaatcatcgtgcgcgggtcattggcagctgtaccttcggtaagggatcggtgcagacgttgttgccgcttgataatggcgattcggtcaaattgacgacggcgcgttattacactccgagtggtcgttcgatccaagcgagggggattgttcctgatctgctgctcaagccagatggtgttggagcggctgatctttcaggcagcgggattgatcgcagtgaggcagggcttccaggccatttgcgtggtactgatgaaggggtgccaggttgtacttccagtgatccgttgccgggcgatacgccgatcatgacagcgttgttggagctaaagcaaccgggttcagcggtgcaggctaaaaaagcgatccctgtaaaagtggtcagcgatgttaagtcggcaacaaagagtccgttgtcagtgtttggtaagggtagggctgtcaagcgagtgccggtggtgtctcctacaagtgagcaagttgatggtcagccaagcaaatag

SEQ ID NO: 40751 - protein, 508 aa, Xylella fastidiosa 9a5c
MSVASRIIRHCSVVPGAVFFPECCMRVVGLSLAISVVLLSFSLSAKNPSGVVMSPPVEEMEMPESNDANVPLDEIRRFVSVYNAIKQAYVDPVNDRKLMHSAVRGLLSDLDPHSTYFDKEDADAFDEQTNGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGKLRGLLLDLRSNPGGLLTAAVQVADALLDKGNIVSTRGRISASDTRFDATPGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGVPGCTSSDPLPGDTPIMTALLELKQPGSAVQAKKAIPVKVVSDVKSATKSPLSVFGKGRAVKRVPVVSPTSEQVDGQPSK

SEQ ID NO: 40752 - DNA, 1212 bp, Clostridium acetobutylicum ATCC 824
  CDS (1)..(1212)
ttggataataagaagaaaaagtggattgtcattacggtggctattgttgttgttactaatatagcttcattatttttgggcggaagatttttagtatttgcgggaaatagtagagttgcagtagataaggatacatatgacactgttcaaaaattctctaaattgttttctgtaagggatcaactttataaatactacgatggtaaaatcagtgatagtgtgcttttggatggagctttgaaaggaatgacttcatctttaaaagacccatatacagtatatatggataaaagtgaaacaaaatctttcaattctgaaattcaaggacaacaatatgtaggacttggaatggaggttcaagcgaaagacaataaagtaatagtatctactgtatttgataattctccagcggaaaaggcagggatgaaatctggagatgttattgtaaaagtaaatggaacggatgcagtaagcactgatcttgagaaaacagtttcgatgataaagggaaaagaaggaacaagtgttacacttacattatacagatccaccaagggaaactttgatatcacagcaaaaagacaaaaagttgctattgatactgtaagtggagaaatgttaagtaacgaaataggatatatgcaagttagtatgttcgatgaaaatactgggaataactttaataagaaaattgatgaattaaagcaacagggaatgaagggacttattctcgatttaaggtcaaatccaggaggacttctcagtgcatgtatacaagtgacttcaaactttgttacaaaagataaagttatagtttcaacaattgacaaatataattctaaggaagaatataaatcaaagggtggaaattatataggtcttcctcttgtagttttagtagatggaaatacagcaagtgcttcagaaattttttcaggtgctataagagattataaattgggcaccctaattggtgaaaagacatttggtaagggtgttgttcaggctccatttgatttaaatgatggtacacaacttaagataactatatctaagtactacacaccaaatggtgaaaatatacaccacaaaggtataaaacctgatatagaagttaagtatcctgatacacttaaagataaaccttatgatagaaattcggacccacaatttcagaaagctttggaacaaataaaatctaaaatgaaatag

SEQ ID NO: 40753 - protein, 403 aa, Clostridium acetobutylicum ATCC 824
MDNKKKKWIVITVAIVVVTNIASLFLGGRFLVFAGNSRVAVDKDTYDTVQKFSKLFSVRDQLYKYYDGKISDSVLLDGALKGMTSSLKDPYTVYMDKSETKSFNSEIQGQQYVGLGMEVQAKDNKVIVSTVFDNSPAEKAGMKSGDVIVKVNGTDAVSTDLEKTVSMIKGKEGTSVTLTLYRSTKGNFDITAKRQKVAIDTVSGEMLSNEIGYMQVSMFDENTGNNFNKKIDELKQQGMKGLILDLRSNPGGLLSACIQVTSNFVTKDKVIVSTIDKYNSKEEYKSKGGNYIGLPLVVLVDGNTASASEIFSGAIRDYKLGTLIGEKTFGKGVVQAPFDLNDGTQLKITISKYYTPNGENIHHKGIKPDIEVKYPDTLKDKPYDRNSDPQFQKALEQIKSKMK

SEQ ID NO: 40754 - DNA, 1389 bp, Agrobacterium tumefaciens str. C58
  CDS (1)..(1389)
atggtgtgccggttgattcccaaccatggtggaccgcaaaaaataccggaagggcgcacaatgattcgtaaggtttcgcttctccttatcggtgggcttatgggcgccacggcgatgagcgtgatttattcggcgagcatgccggcacaggcggccgggccttcgacctataaggaactgtcgatttttggcgacgtgttcgaacgcgtgcgcgcacaatatgtgacgccgcccgatgacgagaagctggttgaaaatgccattaacggcatgctcagctcgctcgatccgcattcgagcttcatgaatgccaaggatgccaacgacatgcgcacccagaccaagggtgagttcggcggtcttggcatcgaagtgaccatggagaacgagctggtcaaggtcatctcgccgatggacgacacaccggcttcgcgtgcaggcattctcgccggtgactatatttcggaaatcgacggtacgccggttcgcggcctgaagctggaacaggccgtcgaaaagatgcgcggtgccgtcaagacgccgatcaagctgacggtgatccgcaagggtgccgacaagccgctcgaattcaccgtcgtgcgtgacgtgattgccgtgcgggccgtcaagtctcgcgtcgagggggacaatgtcggttatctgcgcgtcatctcctttaccgagaagacctatgacgatctcgaaaaggcgatcaagaagatcaaggcggatgtgccggccgacaagctgaagggctatgtcctcgacctgcgcctcaaccccggtggtctgctcgatcaggcgatcaatgtctccgacgctttcctcgagcgcggtgaggttgtttcgacccgtggccgcaatcccgatgagactcgccgcttcaatgcgacggccggcgatctgaccgatggcaaaccggtgatcgtgctcgtcaacggcggttcggcttcggcttcggaaatcgtcgcgggtgcgttgcaggatctgcgtcgtgcgaccgtggtcggcacgcgctccttcggtaagggttcggtgcagacgatcattccgctcggtgaagcgggcgcgttgcgcctgaccacggcgctttattacacgccgtcgggcaagtcgatccagggtacgggcatcgagcccgatatcaaggtggagcagccgttgccggcggaattgcagggccgtgtgacggctgaaggggaatcaagcctttccggtcacatcaaaggccagagcgagaccgacgagggttctggttcttccgcctacgtcccgccggaagcaaaggacgacatccagctcaactatgcgctggacctgttgcgcggtgccaagacggatccgtctttcccgccgaacccggacaaggctgtggtcaacaagcagtaa

SEQ ID NO: 40755 - protein, 462 aa, Agrobacterium tumefaciens str. C58
MVCRLIPNHGGPQKIPEGRTMIRKVSLLLIGGLMGATAMSVIYSASMPAQAAGPSTYKELSIFGDVFERVRAQYVTPPDDEKLVENAINGMLSSLDPHSSFMNAKDANDMRTQTKGEFGGLGIEVTMENELVKVISPMDDTPASRAGILAGDYISEIDGTPVRGLKLEQAVEKMRGAVKTPIKLTVIRKGADKPLEFTVVRDVIAVRAVKSRVEGDNVGYLRVISFTEKTYDDLEKAIKKIKADVPADKLKGYVLDLRLNPGGLLDQAINVSDAFLERGEVVSTRGRNPDETRRFNATAGDLTDGKPVIVLVNGGSASASEIVAGALQDLRRATVVGTRSFGKGSVQTIIPLGEAGALRLTTALYYTPSGKSIQGTGIEPDIKVEQPLPAELQGRVTAEGESSLSGHIKGQSETDEGSGSSAYVPPEAKDDIQLNYALDLLRGAKTDPSFPPNPDKAVVNKQ

SEQ ID NO: 40756 - DNA, 1323 bp, Sinorhizobium meliloti 1021
  CDS (1)..(1323)
atgatacgtagagcttcacttgtcctggtcggggcgctgatgggcgcgacggcgatgggcgtcgtctactcggcaaccatgccggccgtggcagcaaattcgtcgacataccgcgaactggcgatcttcggcgacgtcttcgagcgcgtgcgcgcgcaatacgtgacgccgccgcaggacgacaagctgatcgagaacgcgatcaacggcatgctcacgtctctcgacccgcattcgagctacatgaattcgaccgacgccgaagatatgcgcacccagacgcgcggcgagttcggcggcctcggcatcgaggtcaccatggaggaagatctcgtcaaggtgaccagtccgatcgacgacacgcccgccgcgcgcgccggtgtgctcgcaggcgatttcatctcgaagatcgacggtcaggacgtccgcggcctcaagctcgaggaagcggtcgacaagatgcgcggtgccgtcggcacgccgatcaagctgacgatcctgcgcaagggagccgaaaagccgatcgagctgacgatcgtacgcgacgtgatcgcagtacgcgcggtgaaggtccgtgtcgaaggagatgtcggctatctcagggtcatctcgtttacggagaagaccttcgaagacctgaagaagggcatcgagaagatccaggcggaagttcccgcggacaagctcaagggctatgttctcgacctgcgcctcaatccgggcggcctgctcgaccaggcgatcaatgtctcggacgcattcctggagcgtggcgaggtcgtttcgacccgcggccgcaatccggatgaaacccgccgcttcaatgcgaccccgggcgatctggccggcggcaagcccgtcgtcgtgctcgtcaacggcggttcggcatccgcgtcggaaatcgtggccggcgctctccaggacctgaagcgcgccaccgttctcggcacgcgctccttcggcaagggttcggtgcagacgatcatcccgcttggcgacgccggcgcgctgcgtctgacgacggcgctctattacacgccgtccggcaagtcgatccagggcaccggcatcacgcctgacatcaaggtggagcagccgctgccgcccgagcttctgggcaaggtggaagcgcagggcgaatccgatctgcgcggccacattccgggccaggaagagaccgaagagggctccggctcggtagcttacgtgccgccggaaaccaaggacgacattcagctgaactatgcgttcgacctgttgcgcggcaagaagacggatccgtccttcccggccaatccggaacaggcgcagctgaaggaatag

SEQ ID NO: 40757 - protein, 440 aa, Sinorhizobium meliloti 1021
MIRRASLVLVGALMGATAMGVVYSATMPAVAANSSTYRELAIFGDVFERVRAQYVTPPQDDKLIENAINGMLTSLDPHSSYMNSTDAEDMRTQTRGEFGGLGIEVTMEEDLVKVTSPIDDTPAARAGVLAGDFISKIDGQDVRGLKLEEAVDKMRGAVGTPIKLTILRKGAEKPIELTIVRDVIAVRAVKVRVEGDVGYLRVISFTEKTFEDLKKGIEKIQAEVPADKLKGYVLDLRLNPGGLLDQAINVSDAFLERGEVVSTRGRNPDETRRFNATPGDLAGGKPVVVLVNGGSASASEIVAGALQDLKRATVLGTRSFGKGSVQTIIPLGDAGALRLTTALYYTPSGKSIQGTGITPDIKVEQPLPPELLGKVEAQGESDLRGHIPGQEETEEGSGSVAYVPPETKDDIQLNYAFDLLRGKKTDPSFPANPEQAQLKE

SEQ ID NO: 40758 - DNA, 1401 bp, Bacillus subtilis subsp. subtilis str. 168
  CDS (1)..(1401)
ttgaaacggcaattaaaactgttttttattgtgctgatcactgcagttgtcgcttcggcgcttactttatttattacgggcaattccagtatcctgggccaaaaatcagcaagcacaggagacagcaagttcgacaaattaaataaagcgtatgagcaaatcaaaagtgattattaccaaaaaacagatgatgacaaattagtagacggagcaattaaaggaatgattcaatcactggatgatccgtattctacatatatggatcaagagcaagcgaaatcattcgacgagacgatttcagcatcttttgaaggaatcggagcccaagtagaggagaaagacggagaaatccttattgtatccccaattaaaggttcacctgctgaaaaagccggtatcaaaccgagggaccaaatcattaaggtaaatggaaaaagcgtaaaaggcatgaatgtaaatgaagccgtcgctttaatccgaggcaaaaagggcacaaaggtgaagcttgaactgaacagagcgggagtggggaatatcgatctttccattaagcgcgataccattcctgtagagactgtctattcagagatgaaagacaacaacatcggagaaattcaaatcacttctttctctgaaacaacagctaaagagctgacagatgcgattgacagtttagagaaaaaaggcgccaaaggctatattttagacttgagaggcaacccgggcggcttaatggaacaggcgattacgatgagcaacctgttcattgataaagggaaaaacatcatgcaggttgaatacaaaaacggttcaaaagaagtcatgaaggccgaaaaagaacggaaagtgaccaagccgaccgtcgttttagtaaatgacggtacagcaagcgcagccgaaattatggccgctgcccttcatgaatcgtcaaacgtaccgttaatcggcgagacgacattcggcaaaggtacagtacaaacggcaaaagaatatgatgatggctctaccgtcaaactgacagttgccaaatggctgactgctgatggcgaatggattcacaaaaaaggcatcaagcctcaagtgaaagcagagctgcctgattacgcgaagctgccgtatttggacgcagataaaacgtacaaatcaggtgatacaggcacaaacgtcaaagtggctcagaaaatgctcaaagcacttggttacaaggtaaaggttaacagtatgtatgaccaggattttgtatctgtcgtcaaacagttccagaaaaaagagaagctgaatgaaacaggcatactgactggcgatacaacaacgaaattaatgatagaacttcaaaagaagctgtctgataatgatacgcaaatggaaaaggcaattgaaacactgaaaaaagaaatgtaa

SEQ ID NO: 40759 - protein, 466 aa, Bacillus subtilis subsp. subtilis str. 168
MKRQLKLFFIVLITAVVASALTLFITGNSSILGQKSASTGDSKFDKLNKAYEQIKSDYYQKTDDDKLVDGAIKGMIQSLDDPYSTYMDQEQAKSFDETISASFEGIGAQVEEKDGEILIVSPIKGSPAEKAGIKPRDQIIKVNGKSVKGMNVNEAVALIRGKKGTKVKLELNRAGVGNIDLSIKRDTIPVETVYSEMKDNNIGEIQITSFSETTAKELTDAIDSLEKKGAKGYILDLRGNPGGLMEQAITMSNLFIDKGKNIMQVEYKNGSKEVMKAEKERKVTKPTVVLVNDGTASAAEIMAAALHESSNVPLIGETTFGKGTVQTAKEYDDGSTVKLTVAKWLTADGEWIHKKGIKPQVKAELPDYAKLPYLDADKTYKSGDTGTNVKVAQKMLKALGYKVKVNSMYDQDFVSVVKQFQKKEKLNETGILTGDTTTKLMIELQKKLSDNDTQMEKAIETLKKEM

SEQ ID NO: 40760 - DNA, 1395 bp, Caulobacter crescentus CB15
  CDS (1)..(1395)
atgcgcaagtacctgctcattggcgtttcggccttcgtcctcggcgcggggacgatggcctatatcagtcccatcgcccaggcgaacaacgcccccaaggcccagacctacaagcttttggaactgttcggcgacgtgctgggcacagtcgaggaccagtacgtcaccgaggtcgacgacaagaagctgatcgaggcggcgctggacggcatgctgaccagcctggacccgcactcgggctacctggcgcccgacgcctttgaagacatgcaggacaccacgcgcggcgagtacggcgggcttggcttggaagtgaccagcgaagagggcgtggtcaaggtgatctcgccgatggacggcacccccgcctcgcgcgccggcatccaggccggtgactacatcaccgccgtcaacggccagagcgtgctgggcctgaccgtcaacgaagccgtcaagcagatgcgcggcacggccggcgaggccgtcaccctgacgatcgcccgcgaaaagaccgacccgttcgacgtcaagctcgtgcgcgaggtgatcaagcccaaggccgccatcgcccgcatggaaggcgactatggctatgtccgcctgccgggcttcaacgagaaggccaccgacgccctggccagctcggtcagcgagctgaaatccaagaacccgaagatgaagggcctgatcctggatctgcggaacaatccgggcggcctgttggaccaggcggtcggcgtcgccgacgtgttcctggacggcggtgaggtggtcagccagcgcggtcgcgacccgcgcaacatccagcgctacaacgcccggggcggcgacatgctgaacggcctgccgatggtggtgctgatcaaccagggctcggcctcggcggccgaaatcgtggccggcgcgctgcaggaccgcaagcgcgccgaagtcgtgggcctgaccagcttcggcaagggctcggtccagacggtcatcccgctccgcggcggcgccgacggcgcgctgaagctgaccacggcgcgctacttcacgccttcgggccgctcgatccagaagacgggcatcgcccccgacctcgaggtcgcccagacccgcgaccaggcgcaagacatcgccaaccgcgtatggttcagcgaggccagcttcaagaacgccctgaacgccgacgaaggcaagtcgcgcgtcggcgcccacacgccggccgaggccccgcccacaggcttcgacgacaagaagggtgatttccagctgcagcgcgcgatcgcggtgctgcaggcgggcggcgtcgccaagacgcccaagcttcccaagccggccgccaaggtcgccgaggtcaccgccaaggccgccgcagcggcgggcggcaagacgccggtcaccgaggtcaagtag

SEQ ID NO: 40761 - protein, 464 aa, Caulobacter crescentus CB15
MRKYLLIGVSAFVLGAGTMAYISPIAQANNAPKAQTYKLLELFGDVLGTVEDQYVTEVDDKKLIEAALDGMLTSLDPHSGYLAPDAFEDMQDTTRGEYGGLGLEVTSEEGVVKVISPMDGTPASRAGIQAGDYITAVNGQSVLGLTVNEAVKQMRGTAGEAVTLTIAREKTDPFDVKLVREVIKPKAAIARMEGDYGYVRLPGFNEKATDALASSVSELKSKNPKMKGLILDLRNNPGGLLDQAVGVADVFLDGGEVVSQRGRDPRNIQRYNARGGDMLNGLPMVVLINQGSASAAEIVAGALQDRKRAEVVGLTSFGKGSVQTVIPLRGGADGALKLTTARYFTPSGRSIQKTGIAPDLEVAQTRDQAQDIANRVWFSEASFKNALNADEGKSRVGAHTPAEAPPTGFDDKKGDFQLQRAIAVLQAGGVAKTPKLPKPAAKVAEVTAKAAAAAGGKTPVTEVK

SEQ ID NO: 40762 - DNA, 1389 bp, Synechocystis sp. PCC 6803
  CDS (1)..(1389)
atgagtccccatttgctttgtcttcgtcctttggttgccgctttagtcttcggtttgggtttgggcactgccctcaggcccgccctcagcgctcccaacgtgatcaaccccgatagtcctacgttggcgactcccaaggacaaagatagtggtgtatccgataacgttaccctcctggaaaatagtcccaaggcagtggtggatgaggtatggcagttagtcaatcagcaatttgttgataaggactttaaccattccaactggttgtccaaacgccaggaattattagggcgcaattaccaggataatgctgaggcttaccgacaaattgggcgcatattgaaggatttgaatgacccctatacccgttttctgtctccggaggaatttgccatcctcagcagtcaaacatcaggggaagcttccggggtaggaatccgggtgttgatggataaacgtagtagtgatttggtggtggtggatgtgatgcggggcaccccggctttgaaagcaggcattcgccctggcgatcgcattgtgcgcatcaatggccaaccggcggctttgatgtccttggagcaagccacagaggcaattcaaggggagattggcaccgaattgagcctgcaactttcccgccccaaaagcggtgttttcagtgtcaccctcaaacgagaaaatatcgaaattgattctgtgacctataacgtcaaggaagaaggggaattacgggtgggctacatccgcctggatgaatttagctcccattccgctgagcagatggaaaaggccattacggaactcaataaaagtcgcattagcggctatgtgctagacctacggggtaacccagggggcttgttactttccagcattgacattgcccgtctgtggctcaaccggggggaaatcgtcagtactattgaccggcggggaggcgatcgccatttttcagccaacggcagaagtctcacggatttacccttagtggtgttggttaatgagcggtccgccagtgccagtgaaattttggccggggcattgaaagaacagggaagggccacggtggtgggtactgctacctatgggaaaggtacggtgcaatcggttaacactttgtccgacggctccggtttggcggttaccattgctcgttactatccccccagtggcaccgacattaatcgaaaaggcatcagtcccgacattcatttggatatttccaacgataccaagctacagtttcgtaacgacccagaattaatggccacggagattgatccgcagtatcagcgggctattagtgtgttgcgccaacatcgccatagcctggggctgccgccggccaaagacctgggcatagggttattggagcccagtcaactttaa

SEQ ID NO: 40763 - protein, 462 aa, Synechocystis sp. PCC 6803
MSPHLLCLRPLVAALVFGLGLGTALRPALSAPNVINPDSPTLATPKDKDSGVSDNVTLLENSPKAVVDEVWQLVNQQFVDKDFNHSNWLSKRQELLGRNYQDNAEAYRQIGRILKDLNDPYTRFLSPEEFAILSSQTSGEASGVGIRVLMDKRSSDLVVVDVMRGTPALKAGIRPGDRIVRINGQPAALMSLEQATEAIQGEIGTELSLQLSRPKSGVFSVTLKRENIEIDSVTYNVKEEGELRVGYIRLDEFSSHSAEQMEKAITELNKSRISGYVLDLRGNPGGLLLSSIDIARLWLNRGEIVSTIDRRGGDRHFSANGRSLTDLPLVVLVNERSASASEILAGALKEQGRATVVGTATYGKGTVQSVNTLSDGSGLAVTIARYYPPSGTDINRKGISPDIHLDISNDTKLQFRNDPELMATEIDPQYQRAISVLRQHRHSLGLPPAKDLGIGLLEPSQL

SEQ ID NO: 40764 - DNA, 1272 bp, Synechocystis sp. PCC 6803
  CDS (1)..(1272)
atgttgaaacaaaaacgcagtctgattttgggaactacagctctgttattgacaacagtggcggtgacgggggttgggttgcgattggcccgctcccagggctacctacaggataatcccaaggagctggttgacgaagtttggcagattgtcaaccgcacctatgtagatggtactttcaacggtgaggattgggtagcggttcgccaggattatctaacacgggactacaaaaaccaggaagaagcctacaccgccattcgggaaatgctggagaagctaaatgacccctacactcgcttcatgtcccccgatgagtttcaatcaatgcgtatcgacacttccggtgaattgaccggggtgggtattcaaatcacccaggaccaggatacgaagaaaattgtggtggtggctcccatcgaagatacccccgcctacaacgctggcattctttctaaggacgtaattaccaagattgacggtaagtccaccgatggcatggaagtagatgacgcagtgaagttaattcggggtaagcccggcaccagtgtggtgctcactattgagcgggaagggcaggcgatcgaatatcctttgacccggactttaattgaaattcatccagtgcgggcccaagtggaagatattaatggtgccagggttggttatatccgtttaaatcaattcagtgcccaggcttcggaggaaatgcgccaagcagtgcagaaattggaaaaagagaatgtggtgggctacattttcgacctgcgttccaatcccggtggtttgctttattccagtgtggatattgctcgcatttggttggatgaagggggcattgtgtccaccgtcgatcgccgaggggaagtggaacaacaaagtgctaacaagcggcagttgagtaaccgtcccctagtggtgttggtggatggtggttccgccagtgccagtgaaatcgtctccggggccttacaggataatcaacgggccgtcattgtgggcaccaaaacctttggtaagggattagtacaatcggtgcgggaattgggggatggttccggtatggcagtgacgatcgccaaatatttaacccccaacggtcgggacatcaataaacatggcatcgaccccgatgtggaagtagaactcaccgacgcccagcggaaggaattgcaacaaaatcgggaaaaagtaggcaccctggaagacccccaatttgccagggcctatgaagtgctaatgcaacaggtgaacaaaaccgcttctaagtag

SEQ ID NO: 40765 - protein, 423 aa, Synechocystis sp. PCC 6803
MLKQKRSLILGTTALLLTTVAVTGVGLRLARSQGYLQDNPKELVDEVWQIVNRTYVDGTFNGEDWVAVRQDYLTRDYKNQEEAYTAIREMLEKLNDPYTRFMSPDEFQSMRIDTSGELTGVGIQITQDQDTKKIVVVAPIEDTPAYNAGILSKDVITKIDGKSTDGMEVDDAVKLIRGKPGTSVVLTIEREGQAIEYPLTRTLIEIHPVRAQVEDINGARVGYIRLNQFSAQASEEMRQAVQKLEKENVVGYIFDLRSNPGGLLYSSVDIARIWLDEGGIVSTVDRRGEVEQQSANKRQLSNRPLVVLVDGGSASASEIVSGALQDNQRAVIVGTKTFGKGLVQSVRELGDGSGMAVTIAKYLTPNGRDINKHGIDPDVEVELTDAQRKELQQNREKVGTLEDPQFARAYEVLMQQVNKTASK

SEQ ID NO: 40766 - DNA, 1491 bp, Listeria monocytogenes EGD-e
  CDS (1)..(1491)
atggaagaatccccacaaaacgaaccaaataaagtggagaaagacgaagaacaaaaatcaaaacccggcaatggttatataaaaatgaagttattcccatttataatgctattattcgcttttgtatttgtgacggcattagtgactacaatcgtaatgtctttaggggatgacaagcaagtaaaagtgagcattccagaacgaaaagaatttacaaagctctacgatgtatacgacgaaattacaagtaaatattataaagacacaaattctactacgatgatagatggggcaataagtggtatggtgaattcattagatgatccttattccacatttatgtcgaaaaaagaatcttcagagtttaacgatactatttctgctagttttgaaggtattggcgctgagattcaagaaaaagatggggctatcgtaattgtttcgccaatcaaaaactctccggccgaaaaagctggtttgcggccacaagatattattacgcaagtagatgggaagtctgttaagggcgacacagcaacagaagcaacacaaaaaatccgtggtgaaaaaggcaccaaagtaactctgacaattcaacgttccaacgaagataaaccatttgatgtcacgattactcgtgatgaaattccaatcgaaacggtgtacaaagaaatgggcagtgacaaaattgcgcacgtaaccattagtacattttcagaaacaacctatgatgagcttgaaaaggcattgaaatcccttgaaaaagatggcatgaagggccttgttcttgacttgcgaggaaatcctggtgggttacttgatcaagcagtttctatttctagcctctttgttcccgatggcaaaattgttgtacaagagcaggacaaagatggtgataaatcggccattaaagctgatagtagctcacatggtgattataaagtaaaagtaccaactactatgttaattgatggtgggagtgcgagtgcttcagaaattcttgctgctgctgcaaaagaatctggtggcattaaacttgtcggtacgaaatcatttggtaaaggtacggtccaaacggcaacaactttatctgatgactctactcttaaattaactgtcgcaaaatggttaacacctaatagcgaatggattcatgaaaaaggtattacgccagatgtggttgtgaacatgccagattatgcaactatgactatcccttcctccaccaaagtctacaaaaatggcgatttcggtgatgatgttaaaaccattgaaactttgctaaaagcactagattacaatgttggaaaagtagatggcttatacgatacagacacagaatacgctgttcaaagattccaaacagcaaacaaattagatgtgacaggaatcatgacaggtgtaacaactgataaattagtcgaattaacacaaaaacatctaaaagaaacagatccacaactacaaaaagcaaaagccttggtgaagtaa

SEQ ID NO: 40767 - protein, 496 aa, Listeria monocytogenes EGD-e
MEESPQNEPNKVEKDEEQKSKPGNGYIKMKLFPFIMLLFAFVFVTALVTTIVMSLGDDKQVKVSIPERKEFTKLYDVYDEITSKYYKDTNSTTMIDGAISGMVNSLDDPYSTFMSKKESSEFNDTISASFEGIGAEIQEKDGAIVIVSPIKNSPAEKAGLRPQDIITQVDGKSVKGDTATEATQKIRGEKGTKVTLTIQRSNEDKPFDVTITRDEIPIETVYKEMGSDKIAHVTISTFSETTYDELEKALKSLEKDGMKGLVLDLRGNPGGLLDQAVSISSLFVPDGKIVVQEQDKDGDKSAIKADSSSHGDYKVKVPTTMLIDGGSASASEILAAAAKESGGIKLVGTKSFGKGTVQTATTLSDDSTLKLTVAKWLTPNSEWIHEKGITPDVVVNMPDYATMTIPSSTKVYKNGDFGDDVKTIETLLKALDYNVGKVDGLYDTDTEYAVQRFQTANKLDVTGIMTGVTTDKLVELTQKHLKETDPQLQKAKALVK

SEQ ID NO: 40768 - DNA, 1338 bp, Nostoc sp. PCC 7120
  CDS (1)..(1338)
atgaactcatctgcgaaacatcactcgctgctccaggttgctatgattggaggagcgatcgctacaacagcaactgtatctgtatttggcccggcttggactcgtagcgttcgtgccgctttacaagacagccccaaagcggtagtagaccaagtatggcaattagtaaataacgaatatgttgacggcaagtttaatcaacaagattggctggcagttagaaaaagtttattaagcaaagattattcatctaaagaagaagcttacgtggcgattcgggaagccctgcaaaggctcaacgatccatatacaaggtttatggaccccaagcagtttgaagtccttaccagtcaaacatctggggaagtatctggtataggtatccgcatggagttgaacgaaacaaccaagcggctgactgttttagaagccatagaaaactctccagccttgaaagctgggattaaagcaggtgatgaaatcctagcaattgacggcaaacccactcagcaaatgaaagtggatgatgcctctaaattaattcgcggtaaagaaggtacagccattactttacgtctaggacgtactggccgcaacacttttgatttgaagctcacaagggccaaaatagaagtaccaaccgttgtgtacaacctcaagcaagaaggtagcagacgggttggttacatccgcttacgggagtttagcgcccatgccgccgagcaaatggcacgagctatccgcaatttgaacggtcaaaaagtagattcttatgtattagatttacggggaaaccctggtggtttattacaagccagtattgaaattgctcggatgtggttagatgatggtggcattgtccgcaccgttaaccgtcagggatttaacgaagatacaaaagctaaccggactgccttaacaaaactccccttggcagtattggtagatggtaactcagctagcgccagtgagattctgactggtgcgctcaaggataataaacgagctgtagtaattggtggtcaaaccttcggcaaagctttagtccagtcagttcatgaactacctgatggttcaggtttggcagtgacgatcgctcactactatacccccaacggcacagacatcaaccataaaggtattacaccagacatcaaactagagttaaccgacgcacaggaacgccaattagccaccaaccccaaactaattggaactcaaaacgatccgcaatatgcccgtgcgatcgctgtattatctagcaatacctttgctcgtcctcccctcaatcaaaacaatcaaccaatgagtctaggtgccaatgagttgaagttttaa

SEQ ID NO: 40769 - protein, 445 aa, Nostoc sp. PCC 7120
MNSSAKHHSLLQVAMIGGAIATTATVSVFGPAWTRSVRAALQDSPKAVVDQVWQLVNNEYVDGKFNQQDWLAVRKSLLSKDYSSKEEAYVAIREALQRLNDPYTRFMDPKQFEVLTSQTSGEVSGIGIRMELNETTKRLTVLEAIENSPALKAGIKAGDEILAIDGKPTQQMKVDDASKLIRGKEGTAITLRLGRTGRNTFDLKLTRAKIEVPTVVYNLKQEGSRRVGYIRLREFSAHAAEQMARAIRNLNGQKVDSYVLDLRGNPGGLLQASIEIARMWLDDGGIVRTVNRQGFNEDTKANRTALTKLPLAVLVDGNSASASEILTGALKDNKRAVVIGGQTFGKALVQSVHELPDGSGLAVTIAHYYTPNGTDINHKGITPDIKLELTDAQERQLATNPKLIGTQNDPQYARAIAVLSSNTFARPPLNQNNQPMSLGANELKF

SEQ ID NO: 40770 - DNA, 1650 bp, Ralstonia solanacearum GMI1000
  CDS (1)..(1650)
atgtttatccatttctacgttcccaacgtccgccctcgactcatgcgaacttcgctcaagaacatcagcctgatcgccatcggcctcgtgaccggcgtgctggcgacgctccagctttccgccaccgcgcagaacgcgacggtcgggccgctgccgctggaaaagctccggctgatggccgacatcttcgggcagatcaagcgcgaatacgtcgaaccggtggacgacgacaaactgctgaccgaagccatcaagggcatggtcgccagcctcgatccgcattcggcctacctcgacaagaaagacttccaggaactgcaggaaggcacccagggccgcttcgccggactgggcatcgaaatctcgcaggaagaaggcctggtcaaggtcatcaacccgattgaagacacgcccgccttccgcgccggcgtccagccgggcgacctgatcacccgcatcgacgacaagcccgtgcgcggcatgccgctggaacaggcggtcaagcgcatgcgcggcgccccgggcaccaaggtcacgctgaccatctaccgcaagaaggaagagcgcaccttcccgctcaccatcacgcgcgccgaaatccaggtgcaatcggtcaaggccaagctgctgggcgacggcatcgcctgggtgcgcatcaccagcttccaggaacgcacggtaccggacctggccaagaagctgaatgacctggcacaccaagatgcgcgcctcaagggcgtgatcctcgatctgcgcaacaacggtggcggcgtgttgcaggcggccgtgggcgtatcggcggcgttcctgcccccggacgtgacggtggtctcgaccaacggccaggtgccggacgccaagcgcgtgtacaagacgagcttcgcgaactaccgcctgagcaatttcgacaccgatccgctggtgagcctggaccccgagttcaagaccgtgccgatcgtggtgctgaccaacgcctacaccgcctcggcctccgagatcgtggccggcgcgctgcaggatcaccatcgcgccaaggtgatgggcaagaccacctttggcaagggttcggtgcagacggtgcgcccgctgtcgaacgacaccggcatcaagctgaccatcgcgtactactacacgccgtcgggcaaatcgatccaggccaagggcatccgccccgacgtgccggtcgaccagagccccgaaggcgatccggacgacgcgctgatcacccgcgagatcgacaccgagcgccacctgcacaacaagcaggagtcggaagaacccgagatgaccgatcgcgagaagcgccgcgtcgaagagctgcgccgcctggaagaagaaaccgccaagaagacgcccgagcagcgcgagaaggaacgcaacaagaagccgatcgagttcggctcgaccgacgacttcatgttgcagcaggccgtcgccgagctgaagggccagccggtcaagcgctccaagtcggtgctggaggccgctgcggccgtcccggacaaggcgacgaaatcgccggccgcgaaggagtcgagcgcaccggccaagctgcccaagggcaaggccgctccggcatccgaaccggccgcgccctcgggtccggccagcggtgtgattccggcaccggaacccaccggcgcacgataa

SEQ ID NO: 40771 - protein, 549 aa, Ralstonia solanacearum GMI1000
MFIHFYVPNVRPRLMRTSLKNISLIAIGLVTGVLATLQLSATAQNATVGPLPLEKLRLMADIFGQIKREYVEPVDDDKLLTEAIKGMVASLDPHSAYLDKKDFQELQEGTQGRFAGLGIEISQEEGLVKVINPIEDTPAFRAGVQPGDLITRIDDKPVRGMPLEQAVKRMRGAPGTKVTLTIYRKKEERTFPLTITRAEIQVQSVKAKLLGDGIAWVRITSFQERTVPDLAKKLNDLAHQDARLKGVILDLRNNGGGVLQAAVGVSAAFLPPDVTVVSTNGQVPDAKRVYKTSFANYRLSNFDTDPLVSLDPEFKTVPIVVLTNAYTASASEIVAGALQDHHRAKVMGKTTFGKGSVQTVRPLSNDTGIKLTIAYYYTPSGKSIQAKGIRPDVPVDQSPEGDPDDALITREIDTERHLHNKQESEEPEMTDREKRRVEELRRLEEETAKKTPEQREKERNKKPIEFGSTDDFMLQQAVAELKGQPVKRSKSVLEAAAAVPDKATKSPAAKESSAPAKLPKGKAAPASEPAAPSGPASGVIPAPEPTGAR

SEQ ID NO: 40772 - DNA, 1287 bp, Clostridium perfringens str. 13
  CDS (1)..(1287)
atgagtcgcaataaggatgaaaaaaataaatataataatattattaaaaatcttaagaagaaaaaaggattcagagctttagccatgggtgttgccttaactttaataattggtgtttctgtatatgcagggaatagattaactgcctttggtattttacctataactagtgtaagtgcagttcaatcttcattagagaaggtaaatgatacagaaaattttaaaaaggtattagaagtaagggaaatgctttatagatggtatgatggagaaattgatgatagtaaattagctgaaggtgctataaagggtatggtttcatctttaggtgatcaatacacatattatatgaatgaaaaagaattttcagattttaaagaaaaaagtcaaggaaactacatgggaattgggattcaagtagctgttaaggatggtaagatagtagtaatttctcctattcaaggagggccagctgaaaaagcaggaataaaaactggagatattatcttaaaagtaaatggagaaccagtttcaggaaatgaattggataaagccgtttcaatgatgaagggtactacaaaagaaaatataaaattaacattatatagagaaggtaaaggcgaatttgacgttgatgttatgagagatgtaattaaaacatttaacgttaaaagtgaaatgattgatggagatattggatatatagaagttttagcttttgatgagggaacagctaaagactttgaaactcaattaaaagctttagaagagaaaggtatgaaggggttaatccttgatttaagaggaaatccaggaggattcatgaaggaatgtgtagacctagtatcaaactttgttccaaaggataaggttatagtgtctacaatagataagtatggtaataaagaggaaagtgtatctaaaggcggaattgcacagggaatgcctttagtagttttaattgatggaggtactgcttctgcctcagaaatagttgcgggagctattagagattatgatttaggaactctagttggaacaacatcctttggtaaaggaatagttcaagttgttttagataagataggtcaagaaaaagatggtacagctttaaaagtaactatttcaaaatactatactccaaatggagaaaatattcacaaaaagggtataggaccagatgttacaattgaatatccaaaagagcttaaagaaaagacatattcaagaagtactgatcctcaatttgaaaaagccttagaaatcatacaagaaaagataaaataa

SEQ ID NO: 40773 - protein, 428 aa, Clostridium perfringens str. 13
MSRNKDEKNKYNNIIKNLKKKKGFRALAMGVALTLIIGVSVYAGNRLTAFGILPITSVSAVQSSLEKVNDTENFKKVLEVREMLYRWYDGEIDDSKLAEGAIKGMVSSLGDQYTYYMNEKEFSDFKEKSQGNYMGIGIQVAVKDGKIVVISPIQGGPAEKAGIKTGDIILKVNGEPVSGNELDKAVSMMKGTTKENIKLTLYREGKGEFDVDVMRDVIKTFNVKSEMIDGDIGYIEVLAFDEGTAKDFETQLKALEEKGMKGLILDLRGNPGGFMKECVDLVSNFVPKDKVIVSTIDKYGNKEESVSKGGIAQGMPLVVLIDGGTASASEIVAGAIRDYDLGTLVGTTSFGKGIVQVVLDKIGQEKDGTALKVTISKYYTPNGENIHKKGIGPDVTIEYPKELKEKTYSRSTDPQFEKALEIIQEKIK

SEQ ID NO: 40774 - DNA, 1284 bp, Fusobacterium nucleatum subsp. nucleatum ATCC 25586
  CDS (1)..(1284)
atgattgcaatttcaagtctatcttttacagaagatgatagaacaggttttttatctaatatgagggaattaaaagaaatatctgatattatggatgttatccaagatagttatgttgaaaatgctaatgcacaaaaatataaagaagagaaaaataaaaattctgcacgaaaaaatacgggagttacaaaaaagtcactaatgcaaggagcattaagaggaatgatggaatcattagatgacccacattctgtatattttacaaaagaggaaatgagaagtttccaagaagatataaaaggtaaatatgttggagttggaatggttatccaaaagaaagtaggagaaccattgacagtagtttctccaatagaagatggacctgcatataaggttggaataaaacccaaagataaagttatagaaatagatggagagtcaacatataatttaacaagtgaagaagcttcaaaaaggttaaaggggaaagcaaatacaattgttaaggttaaagtttttagagaagttaacaagatgactaaagtctttgaattaaaaagagaaacaatagaattaaagtatgtaaaaagtaaaatgcttgatgatggaattggatatttaagacttactcaatttggagataatgtctacccagatatgaaaaaagccttagaagatttacaagctaaaggaatgaaggggttaatttttgatttaagaagtaatcctggtggagagttaggacaatcaataaaaattgcttcaatgtttattgaaaaaggtaaaattgttagtacaagacaaaaaaaaggtgaagaaagtgtgtacacaagagaaggtaaatactttggaaatttccctatggtagttttaataaatggtggtagtgcttcagcttcagaaatagtttcaggagcattgaaagatcataagagagctacacttattggagaaaaaacttttggaaaaggaagtgtacaaactttattacctctacctgatggagatggaataaaaatcaccattgcaaaatattatactccaaatggaatttctattgatggaacaggaattgagccagatactaaaatagaagataaagattactatttaatttcagatggagctataacaaatatagatgaaaaccaacaaaaagaaaataagaaagaaataatcaaagaagtcaaaggtgaaaaagttgctaaagaagttgatactcataaagatattcaacttgaagcagcaataaaggcaataaaaggaatgacaaataaaaaatag

SEQ ID NO: 40775 - protein, 427 aa, Fusobacterium nucleatum subsp. nucleatum ATCC 25586
MIAISSLSFTEDDRTGFLSNMRELKEISDIMDVIQDSYVENANAQKYKEEKNKNSARKNTGVTKKSLMQGALRGMMESLDDPHSVYFTKEEMRSFQEDIKGKYVGVGMVIQKKVGEPLTVVSPIEDGPAYKVGIKPKDKVIEIDGESTYNLTSEEASKRLKGKANTIVKVKVFREVNKMTKVFELKRETIELKYVKSKMLDDGIGYLRLTQFGDNVYPDMKKALEDLQAKGMKGLIFDLRSNPGGELGQSIKIASMFIEKGKIVSTRQKKGEESVYTREGKYFGNFPMVVLINGGSASASEIVSGALKDHKRATLIGEKTFGKGSVQTLLPLPDGDGIKITIAKYYTPNGISIDGTGIEPDTKIEDKDYYLISDGAITNIDENQQKENKKEIIKEVKGEKVAKEVDTHKDIQLEAAIKAIKGMTNKK

SEQ ID NO: 40776 - DNA, 1197 bp, Thermoanaerobacter tengcongensis MB4
  CDS (1)..(1197)
atgtcaaagaaaagattttatgtcttgctggcagttttattgatagtaacgaacgtttttacttttttcatagctaatacggtgtcagtggctctgccaggaggaaaggttatcgtttcaagggaagattaccggcttttgaaccagtataaaaagctctttgaagtaggtaaaatactggagagcaggtatgtggataaagtaaatccgtcgacgctcttagaaggagccttaaaaggcatggctggttctctgcaggacccatatacagtgtacatgaataaaaaagagtttgcggagtttatgacgcagaccacaggaacttatggtggcataggcataatagtggctgtagaccaggaagaccacatcgtagtagtttctccaataaagaatacccctggggaaagggcaggaattaaatctggagacataatattagaggtgaacggcaaaaaagtgagtggtaagaatctggatgaagcagtgtctatgatgagagggcctaaggggacgcaggttactctaactataatgagggatggaaagacttttacaaagaccataactagggaaataataaaactggaaacagtttttgactacatgttgcctgacaagattggatacattaagataaccctttttgaccagagcacttcttctgatttcaaaaaggctctggagcggcttaaaaaagatggaatgaaaggactcataattgatttaagggataatcctggcgggcttttagaagagtgcgtaaatatagctgatatgcttttgccgaaaggagtaatagtcactacaaaaggtagggcagaaagtcaggaattttattcaaaaggtacggggcttggcatgcctttagtcgtccttgtaaacaagggaagtgctagtgcttccgagattctggcaggcgccattaaggatagaaaagcaggagtgttagtagggacaactacttttggaaaaggccttgtgcagactgttgtcaactttggagatggaacagggcttaaatacactatagcaaggtactacactccaaatgggacagatatacaaggaaaaggcattgagccaaactatgtggtagaactgcctaaagactacactttaaaggacactcctgacctaaaaggagatactcagcttataaaagcttatgagataataaagtctgagataaagtag

SEQ ID NO: 40777 - protein, 398 aa, Thermoanaerobacter tengcongensis MB4
MSKKRFYVLLAVLLIVTNVFTFFIANTVSVALPGGKVIVSREDYRLLNQYKKLFEVGKILESRYVDKVNPSTLLEGALKGMAGSLQDPYTVYMNKKEFAEFMTQTTGTYGGIGIIVAVDQEDHIVVVSPIKNTPGERAGIKSGDIILEVNGKKVSGKNLDEAVSMMRGPKGTQVTLTIMRDGKTFTKTITREIIKLETVFDYMLPDKIGYIKITLFDQSTSSDFKKALERLKKDGMKGLIIDLRDNPGGLLEECVNIADMLLPKGVIVTTKGRAESQEFYSKGTGLGMPLVVLVNKGSASASEILAGAIKDRKAGVLVGTTTFGKGLVQTVVNFGDGTGLKYTIARYYTPNGTDIQGKGIEPNYVVELPKDYTLKDTPDLKGDTQLIKAYEIIKSEIK

SEQ ID NO: 40778 - DNA, 1362 bp, Thermoanaerobacter tengcongensis MB4
  CDS (1)..(1362)
atgagaaaattttctattagaatttttacacttctgctggtattcttcttggcatttacatcctacacttatgccgaagtatctacgcaagaccaggacttgtacaacgaattagcagatattggagctataatgaaatacatcactgataactacattgacaatgtcacatatgagcaactaaaagaggccgccttaaaggggatttttagtagccttgacgaatacagtacatactttacaaaagaagaattttctcaatttgaaaggggcacttctggaacttttagcggcacagggatggtgcttattgaaaaagatgggaaaattgttgtagattcagtgattgaagattctcctgctgcaaaggctggtgtgaagagcggttacatcataaaaacagttgacggcaaaagcgtggaaggcatgaaattgacagatgtagtaaacatgatactgggagaccccggcacaaaggtgaaaatcacttttgacgtaggaggtactcttaaagaaatcgaacttgtaagacaggtcattcacataaaccctgtctcttacaaactccttgaagagggaatcgggtacataaaaataacagaatttaatgaaaatactacagccaatttgacaaaagccttactttttatggataaaaacaacgttaaaaagcttattctcgatttaagaaacaatcctggagggcttctcactgaagtggtgagtgctgcaaacttttttgtgccacagggcattgttgtcacaatagaaagaagaaatggagaaaaagaggattattactcatacctgactaagcctaaatataaactagctgttcttgtcaataaaggcactgcctctgctgcggaaatactggcgggagcaatacaggacacaaaagtaggatttttggtgggagaaaatacgtacggcaagggaactgttcaatctgtagtgcctttggaggatggaagcggctttaaacttacaattgcccgctacaaacttccatcaggaaggtatattggaaaagaaggtttaactcctgatgtctatgtgaaaaatgtgcagtacactgctgatataaaatttggcggagaattgaagattggatcaaggggaaatgaagttaaaatattgcaaaaatatctcaatttgctcaaatttaatgccggaccggaagatggcatatttggacctaaaacagccaatgctgtaaaagaacttcagaaaaaagcagggctttccccaacaggtgtatttgacaagaacacgtacaatgcccttttaaaaatgatagacagcttaaataacaaagatgctgtccttgaaaaagctttggagcttttgagaaacatgtag

SEQ ID NO: 40779 - protein, 453 aa, Thermoanaerobacter tengcongensis MB4
MRKFSIRIFTLLLVFFLAFTSYTYAEVSTQDQDLYNELADIGAIMKYITDNYIDNVTYEQLKEAALKGIFSSLDEYSTYFTKEEFSQFERGTSGTFSGTGMVLIEKDGKIVVDSVIEDSPAAKAGVKSGYIIKTVDGKSVEGMKLTDVVNMILGDPGTKVKITFDVGGTLKEIELVRQVIHINPVSYKLLEEGIGYIKITEFNENTTANLTKALLFMDKNNVKKLILDLRNNPGGLLTEVVSAANFFVPQGIVVTIERRNGEKEDYYSYLTKPKYKLAVLVNKGTASAAEILAGAIQDTKVGFLVGENTYGKGTVQSVVPLEDGSGFKLTIARYKLPSGRYIGKEGLTPDVYVKNVQYTADIKFGGELKIGSRGNEVKILQKYLNLLKFNAGPEDGIFGPKTANAVKELQKKAGLSPTGVFDKNTYNALLKMIDSLNNKDAVLEKALELLRNM

SEQ ID NO: 40780 - DNA, 1581 bp, Xanthomonas campestris pv. campestris str. ATCC 33913
  CDS (1)..(1581)
ttgacggcgattcaacgcggatttaccgctgcttcgcgcataatccagccagcgccgcgctgtggggcgtcttctctcttttcggagtgcttcatgcgcgtagccgtcctgtccgttgccctgtcgctggccctgttcgcgtcgcccggttgggcacagcaggccagccccgctgccgcaccggccaccgcggacgacccggaagccaacgaagccgccgtctccaaggtgccgctggacgagatccgccgcttcgtggccgtgtacaacgcggtcaagcaggcctacgtggacccggtcgaggacaagaagctgatgcacgcggccgtgcgcggcctgctgtcggacctggatccgcacagcacctacttcgacaaggaagacgccgaggccttcgacgaacaggccaccggcgcctatgacggtatcggcgtggaactgctgcagcagcaggacaacacgctcaaggtgattgcgccgatcgacgacacgccggctgcacgcgccggtgtcaaggcgggcgatgtgatcgtggccatcgacggcaaaccgatcgacgccagcaaggcaatggagccgctgcgcggcgagtccggcagcaaggtcacgctgaccatcgtgcgtgacaaggtcgccaaaccgttcgacatcaccctgcagcgcgaaaccattcgcgtggccagcgtgcgcagcaagctgctcgaacccggctatggctacatccgcatcagcaccttccaggccgacaccggcgccgacttccagaagaacctcaagcaactgcaggccggcggcaagctgcgtggcctggtgctggacctgcgcagcaacccgggcggcctgctgacctcggccgtgcaggttgccgacgatctgctcgacaagggcaacatcgtcagcacgcgcgggcgcatctccatcagcgacgccaagttcgacgcaaccccgggcgatttgctcggcggtgcgccggtggtggtgctggtggacgccggctcggcgagcgcgtcggaagtgttggctggcgcgctgcgcgacaaccagcgcgcgcgcatcatcggcagccgcaccttcggcaagggctcggtgcagaccgtgttgccgctggacaacggcgactcggtcaagctcaccaccgcgcgctattacacgcccagtggcaagtcgatccaggccagcggcatcgtgcccgaagtgatgctcacccccgaaccgcagcccggcgacgccgacgtgccggccagcctcaccgacttcagcgaggcaaccctaccgggccacctgcgcggcgatgcagaaggtgaggagggctacagcgccggcgacgtgctgccgggcgatggcccgatcaacgaggcgctggccgaactcaagcaacctggttctgttgccaaggcccaggccgcgcgcaaggccaaggcgcaagcgcaaaagcccaaggccatcaagccaacgcccgagcccaagcccgccgcaccacgcccgcccgccagcgagcagaccacgccgtccgagccgacggacaaggccaagccggcggcgccagcaccggcagctgtgccggccgaaccggtcaagtaa

SEQ ID NO: 40781 - protein, 526 aa, Xanthomonas campestris pv. campestris str. ATCC 33913
MTAIQRGFTAASRIIQPAPRCGASSLFSECFMRVAVLSVALSLALFASPGWAQQASPAAAPATADDPEANEAAVSKVPLDEIRRFVAVYNAVKQAYVDPVEDKKLMHAAVRGLLSDLDPHSTYFDKEDAEAFDEQATGAYDGIGVELLQQQDNTLKVIAPIDDTPAARAGVKAGDVIVAIDGKPIDASKAMEPLRGESGSKVTLTIVRDKVAKPFDITLQRETIRVASVRSKLLEPGYGYIRISTFQADTGADFQKNLKQLQAGGKLRGLVLDLRSNPGGLLTSAVQVADDLLDKGNIVSTRGRISISDAKFDATPGDLLGGAPVVVLVDAGSASASEVLAGALRDNQRARIIGSRTFGKGSVQTVLPLDNGDSVKLTTARYYTPSGKSIQASGIVPEVMLTPEPQPGDADVPASLTDFSEATLPGHLRGDAEGEEGYSAGDVLPGDGPINEALAELKQPGSVAKAQAARKAKAQAQKPKAIKPTPEPKPAAPRPPASEQTTPSEPTDKAKPAAPAPAAVPAEPVK

SEQ ID NO: 40782 - DNA, 2028 bp, Chlorobium tepidum TLS
  CDS (1)..(2028)
atggctgccgttggtcaagctgctcaaccagccctcctcaaaccaactccgaaccaggaggaggccgcccgttacatcgcccagtacctgcttcagaaccattaccgcaaggtgccggtcaacgactcgctctcccagcagattttcaaacgctacctcgacaatctcgacaacaaccgcagttacttcacagcgcccgaggtcgaaaagctccgccaggagttcggggctcacctcgctgacgatttcgtctccggcaatcccgccgacggtttcgccatctacaaccagttcctgaaacgggccagagagaagatggcgtatatgaaaaacgcgctcgaaaagaccacattcaacttttcctcccccgaaacgctcgaactggaacgaagcaaaaccgctccctggccagccaacgaggctgagcttcacgatctgtggcgcaaggagctgaagtatcagtacctgagcgccaaatattccggcgaaaagggcaaaaacatcaagtctgaagtcatgaagacccttgacaacagactcaaaatcttcaaccagcagaagcccgaagatgctttccaggcttatatgtatgccgtgaccacctcgttcgatccgcataccgactacttctcgccggatgaatacgagaacttccagatcgacatgagccgctcgctcgaaggaatcggcgcgaagttgcagatggagaacgaatacacggtggtgaacgagattattcccggcggcccggccttcaaaagcaaacttctgaagaagggcgacaagattgtcggtgttggacagggcgacaagggagagatcatcgacgtgatcggctggcgcatcaatgacgtggtcaaaaagatcagaggtcccaaaggcaccgttgtcaggctcaaggtgcttccggccagccaggctggcaaggggcctgcaaagattatccggctggtgcgggccaaggttgacttgcaggagcaggccgcgcagaaaaagatcatttatgacaacggtcacaaaattggcgttatcgtgcttccgtcgttctatctcgatttcgaaggcgaacggcagcaaaagcataactacgcgagtactacaaaggatgtggccagaatcatcaacgagctgaagcaggagaatgtggagggaatcatcgttgatctgagggaaaacggtggtggatcgctcgaagaggccgtcaatgtcaccggcctgttcaccggcagggggcctgtcgtgcaggtcagcaacgctctcggcggcaagatggtgctgaatgacgaaaattacccgatgctttaccgggggccgctggtggtgctggtcaaccgctacagcgcgtcggcctcggagattttcgccgcggcgatccaggattacgggcgaggactcatcgttggagacagaaccttcggcaagggtaccgtgcagagcatcgtcaccatccagagaccattcagcatgttcatgaaacaggctgacctcggccagctcaagttgaccatcgccaagttctaccgcatctccggcggtagtacccagcatatcggtgttctgccggatatcgttcttccgtccctgatcgacccggaggtggtgggtgaagatacctacaccagcagtctgccctggacaaccatctcaagggctgcttatacaccattaggattcgtcaccaaagaggatattgttttactgaagaaggagttcgccgaacagtccgccaaagacaagctctaccagtcctatctggccgatttggcaaccctgaaccgtatcaggcagaagaagagcgtgtcactccaggaaaaaggctttcaagtggagaacaagaccctgaaagagatacaggatcgctggggagaccagaatgccgataccgggaaaaagaagaaaacggatttcattctgcaggaggctgccagaattctcgatgatctcgtggcgctcaagtcgcgtccggcagttcccgccgcggctccgttggcaaggcctgccgtcaggcgggcggtgcccgtgaaataa

SEQ ID NO: 40783 - protein, 675 aa, Chlorobium tepidum TLS
MAAVGQAAQPALLKPTPNQEEAARYIAQYLLQNHYRKVPVNDSLSQQIFKRYLDNLDNNRSYFTAPEVEKLRQEFGAHLADDFVSGNPADGFAIYNQFLKRAREKMAYMKNALEKTTFNFSSPETLELERSKTAPWPANEAELHDLWRKELKYQYLSAKYSGEKGKNIKSEVMKTLDNRLKIFNQQKPEDAFQAYMYAVTTSFDPHTDYFSPDEYENFQIDMSRSLEGIGAKLQMENEYTVVNEIIPGGPAFKSKLLKKGDKIVGVGQGDKGEIIDVIGWRINDVVKKIRGPKGTVVRLKVLPASQAGKGPAKIIRLVRAKVDLQEQAAQKKIIYDNGHKIGVIVLPSFYLDFEGERQQKHNYASTTKDVARIINELKQENVEGIIVDLRENGGGSLEEAVNVTGLFTGRGPVVQVSNALGGKMVLNDENYPMLYRGPLVVLVNRYSASASEIFAAAIQDYGRGLIVGDRTFGKGTVQSIVTIQRPFSMFMKQADLGQLKLTIAKFYRISGGSTQHIGVLPDIVLPSLIDPEVVGEDTYTSSLPWTTISRAAYTPLGFVTKEDIVLLKKEFAEQSAKDKLYQSYLADLATLNRIRQKKSVSLQEKGFQVENKTLKEIQDRWGDQNADTGKKKKTDFILQEAARILDDLVALKSRPAVPAAAPLARPAVRRAVPVK

SEQ ID NO: 40784 - DNA, 1617 bp, Chlorobium tepidum TLS
  CDS (1)..(1617)
atgtctcgtattttcactgttattatcatgttgctcatcggaggattcggttattttatcggatggcggatgaacagtgggactgggggaaaaatggtcgatacctacaatttgatcaggtcgtattatgtcgatcctgtcaatgccgacagccttcaaagcgcgggtgttcgcggcatgttgcagtcgctcgatccccactccatctatctcgaacccgaaaaagccgcgatcacccagtccaacttcaatggcaatttcgaggggattggtgtcgagttcgatgtcgtacgcgatacgcttttggtggtgacacccctcgctggggggccaagcgagtctgctggcatcatgcccggagatcggatcattgggatcgactcgaagaatgttatcggcatcaagccttcggctgttcttggcaagctcaggggcgagcggggcacaagagtcaggctgagaatttatcggcccctgacccgccggacgattgattttctggtgacgcgcggaaagatttcgacatcgagcatcgacgcagcttttctcgacgatgcgcgtaccggctacatccgcatcagccagttcgtagagaccacgggaagcgagtttcacaatgccgtgcaaaagctgcgcgacaaggggatgcggaagctcattatcgatgtgcggggcaatcccggcggctacctcgatcaggccgtggctgtggcggatgaactgcttcctgcgggaaagctcattgtttataccaaaagccggcacggtggtgacgatcagatgaagtacttatcgacctccggcgggattttcgagaagggagaagtctgccttctggttgaccgcggtagtgcttcggcggcggaaatccttgccggtgcgcttcaggataaccggcgcgcattgctcatcggtgagctgacattcggcaaggggcttgttcagcgtcagttcaaactgcccgacgattcggttgtcaggcttaccgtttcgagatatttcactccgtcgggccgtcagattcagcgggagtatgatgacggtcttcaggggcgtgagcgctattacaaggagatgtttacccggaatctgccaggtggttttataaaaaagtacggtgacctcatgtaccgggaggggcagaacatttcggtctacagtaccggaagtttgctgaaaaacaccgctgcggacagcctccgtgctgtgcttgccaaggccggtggcatcatgcccgattactgggttttcggcaagccgtactccaatctgtaccaggagctctacgccaagggtgtcattgaggatatcgcgctgaaactgatcgacgatccttccgatcctgtccagaaataccggagttcggcgacttcgtatcttgatggataccatgtaccagtgaacctcgaagcgcttgtcagaaaagagtgcgcggaggcaaaggtgcaattcaaccaagccgagtttgaccgtgaccgggccgatatagctctagcgctcaaggccagggttgccaggcatctgttcggaactgaagaacagatcagggtgttagtcagtgaaggtgatcctgtcatgaaggttgcgcggcatttcatcgaaaagagcgcttcatga

SEQ ID NO: 40785 - protein, 538 aa, Chlorobium tepidum TLS
MSRIFTVIIMLLIGGFGYFIGWRMNSGTGGKMVDTYNLIRSYYVDPVNADSLQSAGVRGMLQSLDPHSIYLEPEKAAITQSNFNGNFEGIGVEFDVVRDTLLVVTPLAGGPSESAGIMPGDRIIGIDSKNVIGIKPSAVLGKLRGERGTRVRLRIYRPLTRRTIDFLVTRGKISTSSIDAAFLDDARTGYIRISQFVETTGSEFHNAVQKLRDKGMRKLIIDVRGNPGGYLDQAVAVADELLPAGKLIVYTKSRHGGDDQMKYLSTSGGIFEKGEVCLLVDRGSASAAEILAGALQDNRRALLIGELTFGKGLVQRQFKLPDDSVVRLTVSRYFTPSGRQIQREYDDGLQGRERYYKEMFTRNLPGGFIKKYGDLMYREGQNISVYSTGSLLKNTAADSLRAVLAKAGGIMPDYWVFGKPYSNLYQELYAKGVIEDIALKLIDDPSDPVQKYRSSATSYLDGYHVPVNLEALVRKECAEAKVQFNQAEFDRDRADIALALKARVARHLFGTEEQIRVLVSEGDPVMKVARHFIEKSAS

SEQ ID NO: 40786 - DNA, 1725 bp, Chlorobium tepidum TLS
  CDS (1)..(1725)
atgagctggttcacaactcagcggcactctggtctttgccgtgattttggccgcaggtggcggcgcgttgcgacgatctcatccgccattgcgctgatctgcgcgcagccactgtttgctgttccggctgccaagccgaacgaagatttcttttccatcgccaaaagcattgagcttctcggggatgtgtacaagaatgtggcgcaaaactatgttgatcccgtcaatgtgagtgagttcatgtattcggggattgacgggatgcttggccagcttgatccgtacacagcatttctcgatgaggagcagtctggcgagctcgacgagatcactagcggccagtatgccggcatcggcgttactcttggtattttttccggcgatctgttcatcatctcggtcatcgacggccagcccgccgcgaaagcggggttaaaggtcggcgaccagatcatcgccatcgatggtgtcaaggtgagcaagaagtctatcgatgaagtccggagcacgattaaaggatctcccggaacgaacatcaggctttcgatcaaaagagacggccaggggccgttgacggtcatttcgctcacgagaggagaggtcaggattagttccgtgccttttttcggcctgttcggttcgtcgggttatgtgcagatgaacagtttcagtgaacattcaagggaagagttgagcgcggcgatccggaagattcggcaagaggccgcgaaaaaccgggtcgtgctgaacggcatcgttctcgatcttcggggcaatccgggcgggttgcttacctcggcggtcgaggtagccggtctttttgtcgaaaaaaacagccggatcgtttccaccagaggtcgggctgccgacagcgagcaggtctatgtcaccaaaaccgagccccaggagccaacgcttcctctggtggtgatgatcgacggcgacagcgcctcggcttcggagatcgtgtcgggagccatacaggagcttgatcgcggtgttattctcggcgaaaactcttttggcaaggggctggtgcagtcgattatcaacctgccttatgaccacattctcaagatgacgacggccaaatattatacgccttcgggccgtctcattcagaagccgattgcccgcgatgagtctcgccgcaaggtggtgctctccaacggcgatgcggactccacgaaggtcttctatacccgcaaccggcgaaaggtttacggtggcggcggcatccgtccggatgttgtggcaaaggccgactccctttccgaataccagcacaagatcgagaactcagggctgctcttcagatacgcctcacgctttcaccggaagcatccggaatttcggttgcagcaactgtcgtcggaaccgctgtacgatgatttcaaccgctttctcgaaaaagagcacttcagcttccggtcgggcgcgcaaaaaacgcttgacagcctgaaaacgcttgttcagaaagaggctggggcggacaaggcgctcgccggtcagcttgacgctctcgacaaggcgctcgcagcatcgacccggcggaatatctcgcgggattcacttcacatcaccgctgccttgcagcgtgaaatcatgcgtcattacgacgagcgggccgccttgaagagagcgatagaggatgaccctgtggcggcgaaagccttcgcgctgctcggcgaccagaagcgctatcggtcgctgctcaagccgtag

SEQ ID NO: 40787 - protein, 574 aa, Chlorobium tepidum TLS
MSWFTTQRHSGLCRDFGRRWRRVATISSAIALICAQPLFAVPAAKPNEDFFSIAKSIELLGDVYKNVAQNYVDPVNVSEFMYSGIDGMLGQLDPYTAFLDEEQSGELDEITSGQYAGIGVTLGIFSGDLFIISVIDGQPAAKAGLKVGDQIIAIDGVKVSKKSIDEVRSTIKGSPGTNIRLSIKRDGQGPLTVISLTRGEVRISSVPFFGLFGSSGYVQMNSFSEHSREELSAAIRKIRQEAAKNRVVLNGIVLDLRGNPGGLLTSAVEVAGLFVEKNSRIVSTRGRAADSEQVYVTKTEPQEPTLPLVVMIDGDSASASEIVSGAIQELDRGVILGENSFGKGLVQSIINLPYDHILKMTTAKYYTPSGRLIQKPIARDESRRKVVLSNGDADSTKVFYTRNRRKVYGGGGIRPDVVAKADSLSEYQHKIENSGLLFRYASRFHRKHPEFRLQQLSSEPLYDDFNRFLEKEHFSFRSGAQKTLDSLKTLVQKEAGADKALAGQLDALDKALAASTRRNISRDSLHITAALQREIMRHYDERAALKRAIEDDPVAAKAFALLGDQKRYRSLLKP

SEQ ID NO: 40788 - DNA, 1302 bp, Thermosynechococcus elongatus BP-1
  CDS (1)..(1302)
atgggaatcacacaccgcacgctcgttgtcagtacaacagtggtcatgacggcattggttgctgtcacgggtgcgggtcttcactggtcccgcagcctagcgggttttcgccaaagtccgaaggaactggtggatgaagtgtggcaggtcattgaccgtgaatacgttgatgccacctttaatggcaatgattggcgtgcggtgcggcgagaatttctctcccgcaactataccaagcccgaagaggcctacaaagcggcgcgggaaatgctagaaaagctcaatgatccctatacccgctttatggatcccgagcaatttcgatccatgcaaattgaaacctctggtgaactcacgggggtaggtatcacgattacacaggacgaaaagacaaaagagatcacggttgtttctcccattgaagggagcccagccgccgagatgggcttaatggctaaggatgtgatcctaaaaattgacggcaaatccaccaagggcatggatctcaaccaagcagtcagcatgatccgtggcccggtgaatacaaaagtgcgcctgacgatccggcggggcaatcaaatcttgaactatgagattactcgtgcccgtattgaaattcatcctgtgcgctacagcctgcgccaaactccccaaggaccggtgggctatattcgccttgtcacttttagctccaatgcagcaggggaaatgcgggcagccattcgtgagttagagaagcaaggggttgaaggctatgttctagatttacgctcgaatccgggtggcctcctctttgccagtgctgaaattgcccgcatgtttctaaagcagggggatattgtctctacggtcaatcgccaaggggaagcagaacggctgcgagcaggtcgcggttttctgaccgataaaccccttgtggtgctgattgatggcggttccgccagtgccagtgagattctagccggtgccttgcaggacaataaccgagcgatcttggtgggtacaaagagctttggcaaaggcttagtccaatccgtacaaccggtgggagagggggcagggattgcggtgacgatcgcaaaatactttacccccagtggtcgcgatattaataagaagggcattgaacccgatgttgaagtcacgctcacggagcagcagcgggagcaactgactcgcgatgacattgctaccgatcgcgatccccaatttatgcgggcgctagcggttctcaatgaacgcatcctagcccagcgacggaatcctcaatccgcgcgaccgacccagggccctaatccctaa

SEQ ID NO: 40789 - protein, 433 aa, Thermosynechococcus elongatus BP-1
MGITHRTLVVSTTVVMTALVAVTGAGLHWSRSLAGFRQSPKELVDEVWQVIDREYVDATFNGNDWRAVRREFLSRNYTKPEEAYKAAREMLEKLNDPYTRFMDPEQFRSMQIETSGELTGVGITITQDEKTKEITVVSPIEGSPAAEMGLMAKDVILKIDGKSTKGMDLNQAVSMIRGPVNTKVRLTIRRGNQILNYEITRARIEIHPVRYSLRQTPQGPVGYIRLVTFSSNAAGEMRAAIRELEKQGVEGYVLDLRSNPGGLLFASAEIARMFLKQGDIVSTVNRQGEAERLRAGRGFLTDKPLVVLIDGGSASASEILAGALQDNNRAILVGTKSFGKGLVQSVQPVGEGAGIAVTIAKYFTPSGRDINKKGIEPDVEVTLTEQQREQLTRDDIATDRDPQFMRALAVLNERILAQRRNPQSARPTQGPNP

SEQ ID NO: 40790 - DNA, 1239 bp, Thermosynechococcus elongatus BP-1
  CDS (1)..(1239)
atggggattcgttggctgcaacgtctcattggttgtttggttgtcctcgtggggatctggggcattttcccccctgactcggcgatcgccctgacggaggaacaaaaactctttaatgaggcatggcgtattgttaaccaagcctatgtcgatcccacctttaatggtcaaaactggtggcgagtgcgcgaaaaagctctaaagcgtcccctgcccgatcgcgaggcaacctatgctgccattgaagcaatgctggccacccttgaggatcccttcacccggttcctgcggcctgagcaatttcgcagcctacaaaccaccactgcgggtgaactcatcggcgttggcttgcaaattagcactgaccctaagaccggtgtccttgaagtgattgctcccattgatggctcccccgctgccgaagccggtattcaaccccgcgatcgcattctcgccattgatggcatctccaccaaccagctcagccttgatgaggccgccgaaagaatgcgggggacagccggttctgcggttcacctattgctgcagcggggcaatgacacccctcaggaattgatcctgcaccggggacacattgagattaatccggtgacggctgaggttcgccaagtgcaggggcacaccgttggctatattcgcctcagtcagtttagtgcgatggcccccacagaaatgcgcaaagctattcaaatcctagagcagcagggggctgaggagtacattcttgatctgcgcaataatccggggggactgttgcaggcgggcgtggaaattgcccaattgtggctggactcgggggcaattgtctataccgtcgatcgccaagggattgttgatagcctcaatgccagtgggggggctctcacccatgatcccctagttgtcctggtcaatggtggcacagccagtgcaagtgaaattttggccggtgccctccaggatcatgggcgcgctcgcttggtgggcgatcgcacctttggcaaaggctcgattcagtccctctttcatctcagtgatggctctggcctagcggtgacgattgcccactacgaaacccccaatcaccacaacatcaacaaagtagggattgagccagatcggcgggtgctcgatgctccagagagtctcatggccatgggtaccgcagcagatccccaatatctggcggctctagagctgctccacagtcccatccaagtggccactagcgcagggtaa

SEQ ID NO: 40791 - protein, 412 aa, Thermosynechococcus elongatus BP-1
MGIRWLQRLIGCLVVLVGIWGIFPPDSAIALTEEQKLFNEAWRIVNQAYVDPTFNGQNWWRVREKALKRPLPDREATYAAIEAMLATLEDPFTRFLRPEQFRSLQTTTAGELIGVGLQISTDPKTGVLEVIAPIDGSPAAEAGIQPRDRILAIDGISTNQLSLDEAAERMRGTAGSAVHLLLQRGNDTPQELILHRGHIEINPVTAEVRQVQGHTVGYIRLSQFSAMAPTEMRKAIQILEQQGAEEYILDLRNNPGGLLQAGVEIAQLWLDSGAIVYTVDRQGIVDSLNASGGALTHDPLVVLVNGGTASASEILAGALQDHGRARLVGDRTFGKGSIQSLFHLSDGSGLAVTIAHYETPNHHNINKVGIEPDRRVLDAPESLMAMGTAADPQYLAALELLHSPIQVATSAG

SEQ ID NO: 40792 - DNA, 1326 bp, Thermosynechococcus elongatus BP-1
  CDS (1)..(1326)
gtgctctcccctttccccctccccgtgagggggatttttttatggggggacgatagaataggggcaaggtgttttgaatggctttgtcgggtgaaacactgggcaattcttggagttggtgttgcgcttttggggatgccgccagcagtggggggcaccagtaccctcaaggatgctcccaaggccctggtggatgaggcctggcaaattatctacaaaagctatttggatcgcagctttaatcgtcttgactggcaggccattcgtcgggagctgctctcccaaccctatcgcgatcgcgaggctgcctatcgggtgattcagcaaacccttgtccgcctcaacgatccctatactcgctttctgccgccccatgagtaccgtcagctactcctgcaaacccaagggcagcaggtggatgtgggtctcactttagtggaggcgggggaactctttcgcattcaggcgatccaacccggctctgtggcggctaaggccgatctgaaagtgggcgatgaaattctggccatcaatggtcgagggagcgatcgcctcaccttggagcgcgccacgttggctctgcgagggccagcggggactaaattgcgcctactggtgcgccgtgagggtaaaccccagccttttagtgtcgaactcacccgtgctggcgagattccccgtacggtgaattttcaaattctcaactctccccgggtgggctacatccgtctcagtggcttcaacagccgctcccaacaacagatgcaggaggcgatcgaaatcctgcaacgggaaaaggtgcaaggctttatcttggatttgcgccacaatccggggggacttctagaagcagggattgaaattagccgccaatggctggattctggggtcatcgtgcgcattcaacaaaaccagcgggaagagacgattcgtgcccgccaaggcgccttgagtcagttgccccttgtggtcttagtgaatcaggcctctgccagtgccagtgaaattttggcggcggctttgcaggatcaggggcgagcgatcgttgtcggcacgccaacgtttggtaaggtgcgcgtccaagcggttcatgaactggcggatggctctgcccttgtggtgacggtggctcgctatttgacgcccaagggtcgcgatattgccgcggggggcattagccccgatgtgctggtgacggtggatgccagtacggatctcgaattgcgcctcaatcctaacttggtggcacgccccaccgatccaatggtggccaaggccttagaattattgagcaccaaaattagtaatgctcgccatgtccagtga

SEQ ID NO: 40793 - protein, 441 aa, Thermosynechococcus elongatus BP-1
MLSPFPLPVRGIFLWGDDRIGARCFEWLCRVKHWAILGVGVALLGMPPAVGGTSTLKDAPKALVDEAWQIIYKSYLDRSFNRLDWQAIRRELLSQPYRDREAAYRVIQQTLVRLNDPYTRFLPPHEYRQLLLQTQGQQVDVGLTLVEAGELFRIQAIQPGSVAAKADLKVGDEILAINGRGSDRLTLERATLALRGPAGTKLRLLVRREGKPQPFSVELTRAGEIPRTVNFQILNSPRVGYIRLSGFNSRSQQQMQEAIEILQREKVQGFILDLRHNPGGLLEAGIEISRQWLDSGVIVRIQQNQREETIRARQGALSQLPLVVLVNQASASASEILAAALQDQGRAIVVGTPTFGKVRVQAVHELADGSALVVTVARYLTPKGRDIAAGGISPDVLVTVDASTDLELRLNPNLVARPTDPMVAKALELLSTKISNARHVQ

SEQ ID NO: 40794 - DNA, 1467 bp, Oceanobacillus iheyensis HTE831
  CDS (1)..(1467)
atgaagcttagtaagaaacaaatagtgcttatacttgtgggcgctttgctattaggttttgcaggtgcatatggaggatttcaactagcacaagataataatcaacaatcatcacaatcttctgttgaaaattcttcgacgaatgaagatgacagtaatggacagtctgagttgaccggagatttaagtaaagtctctcaagcctatgatattattaaagaaaattacttagaagatgtagaagataaacaattagtcgaaggtgcaatcgaaggaatgttggcaactctagaggaccaacatacatcttatttagatgttgagatgatgcaacagtttaatgaacaaatcgaatcctcttttgaaggaattggagcagaagttagtatggtgaatggcaatgtcactattgtttctccaatgaaaggatctccagcagaagaatcgggtttacgaccaaatgaccaagtgttaaaagtagatggagaaagtctagaaggattaaatttaaatgaagctgtagcacaaattagaggtgaaaagggttcagaagttgttctagagatacaaagatcaggtgttactgaaccatttgaagtaacaattgtacgagatacaatacctgtagaaactgtatatagtgaaacaaaagaagtagatggtaaattgacaggaattatcgaaatcactaatttctctgaaaaaaccggagatgaatttgatcaacaattaactgaactagagaatcaaggaatagaaggattagttattgatgtccgtggtaatccaggtgggctgttaaatgtagcagaagatattctaaaacatttagtaccaaaagatcttccaatcctgcaaattgaagatggagagggacaagtagaggaagtatattcagatttagaagagaaaaaagagtaccctattagtgttatgattgacgaaggaagtgcgtcagcttctgagattcttgcagttgctatgaaggatcttgggtatgatatagtcggtgaaactagttacggaaaaggtacagttcaacaagctgttccaatgggggacggaagctctattaagttaaccacattaaaatggctttcccctaaaggtgaatggataaatgaagaaggtgttgagcctactatcgaggagaaacaaccagaatattattattctataccgatccaagtagaagaaccgttctctttagatgagactagtgaggaaattgctaatatgcaagtaatgttaactggattaggctatgatactggccgtacagatggatattttgatgaacagaccgcagaagcagtaaaagattttcaagcagataatgatttagaagctactggggaagtagattcagaaactggtggattaattgaaacacaactcgttgaaaagattagaaacggtgaagatgatcaacaactggatacttcattagaagaattgtatcaataa

SEQ ID NO: 40795 - protein, 488 aa, Oceanobacillus iheyensis HTE831
MKLSKKQIVLILVGALLLGFAGAYGGFQLAQDNNQQSSQSSVENSSTNEDDSNGQSELTGDLSKVSQAYDIIKENYLEDVEDKQLVEGAIEGMLATLEDQHTSYLDVEMMQQFNEQIESSFEGIGAEVSMVNGNVTIVSPMKGSPAEESGLRPNDQVLKVDGESLEGLNLNEAVAQIRGEKGSEVVLEIQRSGVTEPFEVTIVRDTIPVETVYSETKEVDGKLTGIIEITNFSEKTGDEFDQQLTELENQGIEGLVIDVRGNPGGLLNVAEDILKHLVPKDLPILQIEDGEGQVEEVYSDLEEKKEYPISVMIDEGSASASEILAVAMKDLGYDIVGETSYGKGTVQQAVPMGDGSSIKLTTLKWLSPKGEWINEEGVEPTIEEKQPEYYYSIPIQVEEPFSLDETSEEIANMQVMLTGLGYDTGRTDGYFDEQTAEAVKDFQADNDLEATGEVDSETGGLIETQLVEKIRNGEDDQQLDTSLEELYQ

SEQ ID NO: 40796 - DNA, 1275 bp, Brucella suis 1330
  CDS (1)..(1275)
atggtgatggtccagggcgcaccagcttccaccgcttttgcggcaggaaaagacagcgatgtctataaggagctggctcttttcggcgatattttcgagcgtgtacgcgcgcaatatgtgacgccgcccgacgacaagaagctgatcgagagcgccatcaatggcatgctgacttctcttgatccccattcgtcctatctcaacccggaagccgcgcaggacatgcgtgtgcagaccaagggtgagtttggcggccttggcatcgaagtcaccatggacaatgatctcgtgaaggtcatcgcgccgatcgacgatacgcccgcctcgaaggccggtgtgctgtcgggcgacctgatcaccaagatcgacggacaggaagtgcgcggcctttcgctgaccgacgctgtggacaagatgcgcggcgaggttggtgcgccaatcgaactgacgatcctgcgcaagggcgccgacaagccgatcacgctcaagatcaatcgcgccattatcaaggtgaaggcggttcgctcgcgcgttgagaatgatgttggctatctgcgtatcatctcgtttaccgaacagacctctgaagacctcaagaaggcgatcaaggacattcaggaaaaggttcccgctgacaagctcaagggctatgtgctcgaccttcgtctcaatccgggcggccttctggatcaggcggttgccgtttccgatgccttcctcgacaagggcgagatcgtttccacccgtggccgcgatccgcaggatgtgacccgtttcgatgcccgtaagggtgacctgacgaatggcaagccgctgatcgttctgatcaatggcggttcggccagtgcctcggaaatcgttgccggtgcgcttcaggatcatcgccgcgccacggtgctcggtacgcagtccttcggcaagggctctgtgcagacaatcatcccgcttggcgaaaacggttcgctgcgtctgacgacggcgctttattacacgccgtctggcaagtcgatccagggcaagggcattacgccggacatcaaggtggatcagccgctgccgccggaacttaaaggcgaggacgttgttcgcggcgaatccgaactcaagggccatatcaagggcaatgccgaagatgcgagcggctccggttcgtcggcttatgttccgcctgatccgaaggatgatctccagctcaatgaggcactgaagcttctgcggggcgaagtgcccaatgccgctttcccgccggacccgaaaaagggcgtgctgaactga

SEQ ID NO: 40797 - protein, 424 aa, Brucella suis 1330
MVMVQGAPASTAFAAGKDSDVYKELALFGDIFERVRAQYVTPPDDKKLIESAINGMLTSLDPHSSYLNPEAAQDMRVQTKGEFGGLGIEVTMDNDLVKVIAPIDDTPASKAGVLSGDLITKIDGQEVRGLSLTDAVDKMRGEVGAPIELTILRKGADKPITLKINRAIIKVKAVRSRVENDVGYLRIISFTEQTSEDLKKAIKDIQEKVPADKLKGYVLDLRLNPGGLLDQAVAVSDAFLDKGEIVSTRGRDPQDVTRFDARKGDLTNGKPLIVLINGGSASASEIVAGALQDHRRATVLGTQSFGKGSVQTIIPLGENGSLRLTTALYYTPSGKSIQGKGITPDIKVDQPLPPELKGEDVVRGESELKGHIKGNAEDASGSGSSAYVPPDPKDDLQLNEALKLLRGEVPNAAFPPDPKKGVLN

SEQ ID NO: 40798 - DNA, 1389 bp, Leptospira interrogans serovar Lai str. 56601
  CDS (1)..(1389)
atgaaaaataaagaaagaatgatctggattggaattgtttcctttctcagctttgcactgatttttccaatagaaaccgtaaaagggatttctaaaaccggggaatcttatctacaaattttccacgaagtattatctactattcattccgactatgtggaatccgtagacgaggaaaaactctatcaaggagccattcgaggacttatttcttctttgggagatccacattctcgttttatggataaggatgatttttctcagctccaagaggaaaccaggggtagttttggcggattgggaatggaggtttcttttgcggatggtgcgattgtagtcatttctcccattgaagacacacccgcaatgaaggctgggattttacctcaggatagaatcatagaaatcgacgggaaaaacacacatgatctttctctttccgattctatcaaactgatgcgtggtaaggtaggaacctccgtttctatcaaattggaaagaaagaatcaaaaggaacctatggttctcaccttagtcagagagatgatcaaaattcgttatgtaagatcttcttttttggaaaaagaaaaattaggttatatcaaactcaatcagtttatgggaaaggaaaatactctttccgaatttaaaaaggagttaaattccctcaaagaaaagggggccgaagggttgatcttagatttgagaatgaacccgggcggacttttagatcttgcgatagcactttctgatttattcttaaaaccggacttagacattgtgtccgtaagaggaagagggggggaactcgttcgggttttccgttctactgcagcaaatgataagttcatcaatttaccgttagttgtactgatcaacgaaggatctgccagcgcttccgaaatttttgcaggagcgatgcaggatcatggaagaggaaaaattttaggaacggtttcttttggaaaaggttcggttcaaaatatctattcactgtcgcataacactggtattgcgctgacgatacaaaagtattatactccgagtggaaaatcgattcacggaaaaggaattcaaccggatgtaattgtaaagccgattgaacctactgaagacgatcgtttttatatccgtaagatggccgaaaagaaaatgcttgagacattcctcttaaaaaatccaaattattcggaagcgaattttgtccttttggagaaatatctttctgaaaaaggaatcaaactttctgcggatgtagccagatttttatataaaagtaaaactcgtcaagaagggcaaaattcgattttggatttggagctggatccacaacttcgtaaggcgattgaaattctaagtcctaacaaagacggagaaaaaaaatcttaa

SEQ ID NO: 40799 - protein, 462 aa, Leptospira interrogans serovar Lai str. 56601
MKNKERMIWIGIVSFLSFALIFPIETVKGISKTGESYLQIFHEVLSTIHSDYVESVDEEKLYQGAIRGLISSLGDPHSRFMDKDDFSQLQEETRGSFGGLGMEVSFADGAIVVISPIEDTPAMKAGILPQDRIIEIDGKNTHDLSLSDSIKLMRGKVGTSVSIKLERKNQKEPMVLTLVREMIKIRYVRSSFLEKEKLGYIKLNQFMGKENTLSEFKKELNSLKEKGAEGLILDLRMNPGGLLDLAIALSDLFLKPDLDIVSVRGRGGELVRVFRSTAANDKFINLPLVVLINEGSASASEIFAGAMQDHGRGKILGTVSFGKGSVQNIYSLSHNTGIALTIQKYYTPSGKSIHGKGIQPDVIVKPIEPTEDDRFYIRKMAEKKMLETFLLKNPNYSEANFVLLEKYLSEKGIKLSADVARFLYKSKTRQEGQNSILDLELDPQLRKAIEILSPNKDGEKKS

SEQ ID NO: 40800 - DNA, 2049 bp, Shewanella oneidensis MR-1
  CDS (1)..(2049)
ttgatgcgaaaactcattttggctacatccatcgccactgtttttgtcggattctcggcttgggctgtgcctcctacaattcaaatcagcgagttacccactctcaagcaggaagcgcagcataaagtggccagtaagcgagtgacggatttatatactcgttcgcattaccaccgatttgcgctcgatgacgcgttttctgcgcagatatttgaccgctatttacagcaacttgattaccgtcgcaatgtgctgacccaagccgatgtcgacagttttaaaccttatatcaatcagtttgacgacatgcttagttcaggtgaactcgatcctgcatacaaaatgtttgatttggttcaaaaacgtcgctacgaaggctttgtgtacgcgctttctctgctcgataaagaaatggactttaccgcccctggtgatgtctacgattatgatcgggaagatgttgcttggccgaaagatcaagctgaaatcaatgaactttggcgtcagcgagtcaaatatgacgcgttgaatctcaagcttactggcaaaaaatggcttgaaatcgttgatattctgcaaaagcgttataacaacgccatcaaacgtttgactcagaccaatagcgaagatgtgttccaagccgtgatgaacgcgttttcacgcagcatagagccgcacactagctatttatccccccgtaatgccgagcgtttccaaatggaaatgaacttaagccttgagggtattggcgcgcagttacagctcgaagatgattacactgtgattaagagtttgatcgcgggtggtcctgcggctggcagtgagaaactgtcaccagaagataagattgtcggtgtcggccaagaaggcggcgagattgttgatgttatcggctggcgtttagacgatgtggtcgaactcatcaaaggacctaagggcagtaaagtcgttttgcagattttaccgaagaaaggcggctcaaatgctaagccgtttaacgtgaccttagtgcgtgacaaaattcgcttagaagaccgtgcagccacttcaaagatcatcgaacctaaagacggtgtatacgccaatcgtaaagtcggtgtgatccagatccctggattctatatgaatttatcccaggatgttgaaaaggaactacttaagctgaatgaagccaaagtcgaaggtgtggttatcgatttacgtggtaacggcggtggcgcattaactgaagctgtgttactgaccggactctttatcgatatgggaccagtagtacaagtccgtgatgccgatggtcgtgtatccgctcaccgtgataacgatggtaagacgacttacacaggtccgttgaccgtgatggttgaccgttatagtgcatcagcttctgagattttcgcagcagcattacaggactatgaccgtgcactgattgtcggagaatccagtttcggtaagggtacagtacaacagcacaagagcctaggtcgtatctacgatatgtacgagaagccaattggccatgtgcaatacaccattcagaagttttatcggattaacggtggtagtactcaactgaaaggtgtgacaccgaatattgcttatccaagtgcattagagcctggtgaatacggtgaagctgaagagaagaatgctttgccttgggacaaagtcccgatggcgcaatatggcacgctaaacgatatcactcctgaactggtggcgagtttagagaaaaagcaccttgctcgaattcaaaacagtgttgaatttaactatatcaatcaagatattgctgactttaaaaagcatcacaaagagaaaacggtctccttagttgaaagtgagcgtattgcatcacgtgaagctgatgagaagaaagtgctcgatagaaccaatgagcgtcgtgttgccaatggtttagcgcctgttaaatcgatggaagacattaaagacgatgtcgtagcaccagatgcatttttagatgaaacggcgtatatcaccttagatatggtggatgcgaaaaagctagctaacgctggcactaaatag

SEQ ID NO: 40801 - protein, 682 aa, Shewanella oneidensis MR-1
MMRKLILATSIATVFVGFSAWAVPPTIQISELPTLKQEAQHKVASKRVTDLYTRSHYHRFALDDAFSAQIFDRYLQQLDYRRNVLTQADVDSFKPYINQFDDMLSSGELDPAYKMFDLVQKRRYEGFVYALSLLDKEMDFTAPGDVYDYDREDVAWPKDQAEINELWRQRVKYDALNLKLTGKKWLEIVDILQKRYNNAIKRLTQTNSEDVFQAVMNAFSRSIEPHTSYLSPRNAERFQMEMNLSLEGIGAQLQLEDDYTVIKSLIAGGPAAGSEKLSPEDKIVGVGQEGGEIVDVIGWRLDDVVELIKGPKGSKVVLQILPKKGGSNAKPFNVTLVRDKIRLEDRAATSKIIEPKDGVYANRKVGVIQIPGFYMNLSQDVEKELLKLNEAKVEGVVIDLRGNGGGALTEAVLLTGLFIDMGPVVQVRDADGRVSAHRDNDGKTTYTGPLTVMVDRYSASASEIFAAALQDYDRALIVGESSFGKGTVQQHKSLGRIYDMYEKPIGHVQYTIQKFYRINGGSTQLKGVTPNIAYPSALEPGEYGEAEEKNALPWDKVPMAQYGTLNDITPELVASLEKKHLARIQNSVEFNYINQDIADFKKHHKEKTVSLVESERIASREADEKKVLDRTNERRVANGLAPVKSMEDIKDDVVAPDAFLDETAYITLDMVDAKKLANAGTK

SEQ ID NO: 40802 - DNA, 1356 bp, Bradyrhizobium japonicum USDA 110
  CDS (1)..(1356)
atgatgcgcaagacttcagttatcctcctcagcgcggccaccggtgcggcgctgacgctgttcgtgacccagccgcgcgcggtcttcatgggctccagcgcgcgggccgccaccgcagacacctatcgccagctcaatctgttcggcgacgtcttcgagcgcgtgcgctccgactatgtcgagaagcccgacgacaccaagctgatcgaatccgccatcagcggcatgctcaccggcctcgatccgcattcgagctacatggacgccaagagcttccgcgacatgcaggtgcagacccgcggtgagttcggaggcctcggcatcgaggtcacgatggaagacggcctgatcaaggtcgtctcgccgatcgacgacacaccggcgtcgcgcgccggcatcatggccaacgacatcatcaccaatctcgacgacgaagcggtgcagggcctgaccctgaaccaggcggtcgagaagatgcgcggtccggtcaacaccaagatcaagctcaagatcatccgcaagggccaggacaatccgctcgacgtcaccttggtgcgcgacaacatccgcgtccgctcggtgcgcgcccgcatcgaggccgacgacatcgcctatatccgcatcaccaccttcaacgagcagaccaccgaaggcctgaagcgcgaggtcgccaacctctcgaatcagatcggcgacaagctgaagggctacatcatcgacctccgcaacaatccgggcggcctgctcgaggaagcggtcaccgtctccgactcgttcctggagaagggcgagatcgtgtcgacccgcggccgcaatgccgaggagacccagcgccgcaccgcgcatgccggcgacctcaccaagggcaagccggtcatcgttctggtcaatggcggctcggcctcggcgtccgaaatcgtcgccggcgcgctgcaggaccacaagcgcgcgaccatcgtcggcacgcgctcgttcggcaagggctcggtgcagaccatcatcccgctcggctcgggcaacggcgcgctgcgcctgaccacggcgcgctactacacgccgtcgggcaagtcgatccaggccaagggcatcgtgcccgatatcgaagtgctccaggacgtgccggacgagttgaagtcgcgcaccgacaccaagggcgaggcttcgctgcgcggccatctgaagaacgacggcgacgagaagaccggctcgcagtcctacgtcccgccggacgccaaggacgacaaggcgctgaagctcgccgacgacctgctccacggcatcaagaacagcgcctccgcggcgcccacgccgggtaccgacaaggccgcgaccgacaagcccaaagcggcgaactga

SEQ ID NO: 40803 - protein, 451 aa, Bradyrhizobium japonicum USDA 110
MMRKTSVILLSAATGAALTLFVTQPRAVFMGSSARAATADTYRQLNLFGDVFERVRSDYVEKPDDTKLIESAISGMLTGLDPHSSYMDAKSFRDMQVQTRGEFGGLGIEVTMEDGLIKVVSPIDDTPASRAGIMANDIITNLDDEAVQGLTLNQAVEKMRGPVNTKIKLKIIRKGQDNPLDVTLVRDNIRVRSVRARIEADDIAYIRITTFNEQTTEGLKREVANLSNQIGDKLKGYIIDLRNNPGGLLEEAVTVSDSFLEKGEIVSTRGRNAEETQRRTAHAGDLTKGKPVIVLVNGGSASASEIVAGALQDHKRATIVGTRSFGKGSVQTIIPLGSGNGALRLTTARYYTPSGKSIQAKGIVPDIEVLQDVPDELKSRTDTKGEASLRGHLKNDGDEKTGSQSYVPPDAKDDKALKLADDLLHGIKNSASAAPTPGTDKAATDKPKAAN

SEQ ID NO: 40804 - DNA, 1338 bp, Bradyrhizobium japonicum USDA 110
  CDS (1)..(1338)
atgcggaaaaccctgctgttccccctgggcgcgctcaccggagcgtgtttgacccttctggtagccagtccgcacggcggagtatgggcggcacgggcggcagcgggcgcggatgatgcctattcacagctcaacttgttcggcgaagtcttcgagcgcgtgaaggcgagctatgtcgagaagcccgacaacgccaagctgatcgaaggcgcgatcaccggcatggtgacctcgctcgatccgcattcgcgctacatgaacgacaaggcctggaccgagatgcaggagaccacctccggcgagttcggcgggctcggcatcgaggtcacgatggaggagggcctggtcaaggtcgtctcgccgatcgacgacacgccggcgtccaaggccggcatcatgtccggcgatctcatcagcaagatcgatggcgatgccgtgcagggcatgacgctcgagcaggccgtcaacaagatgaagggcccggtcgacaccaagaccaagctcaccatcgtgcgcaagggcgccgacgccccgcttgacatcgcgatcacccgcgagatcatccatgtgcggccggttcgcttccacgtcgagaatggcgacatcggctatatccgcgtcacatcgttcaacgagcagaccaccgacggcctgaagaaggcgatcgcggcgatctccagggagatcccgcaggagaagctcgcgggctatgtgatggacctgcgcaacaatccgggcggcttgctcgaccaggccgtgtcggtgtcgagcgcgttccttcagcgcggcgaggtggtctcgacccgcggccgcaatccggaggaaacccagcgcttcaccgcgcatggtggcgacctcaccaagggcaagccgctggtggttctggtcaatggcggctcggcttcggcctcggagatcgtcgccggcgcgctgcatgaccacaagcgtgccacgatcatcggcacgcgctcgttcggcaagggctcggtgcagaccatcattccgctcggcgccggcaatggcgcgctggcgctgaccacggcgcgctactacacgccgtccggccgctcgatccaggcccagggcattgcgcccgacatcgagatcctccaggacgtgccgcccgagctgaagggccggatggataccatggcggagtcccagatgcgcggccacctgcaggctgccgacggcaccgagcagaccggatcgcagtcctacgtcccgccgaaagaggaggacgacaaggccctgcacgcggcctacgacttcctgcatggcgtcaccgcgaatgcggtcgcggccaagcccgcgccgaaggctgcggtgccgaactaa

SEQ ID NO: 40805 - protein, 445 aa, Bradyrhizobium japonicum USDA 110
MRKTLLFPLGALTGACLTLLVASPHGGVWAARAAAGADDAYSQLNLFGEVFERVKASYVEKPDNAKLIEGAITGMVTSLDPHSRYMNDKAWTEMQETTSGEFGGLGIEVTMEEGLVKVVSPIDDTPASKAGIMSGDLISKIDGDAVQGMTLEQAVNKMKGPVDTKTKLTIVRKGADAPLDIAITREIIHVRPVRFHVENGDIGYIRVTSFNEQTTDGLKKAIAAISREIPQEKLAGYVMDLRNNPGGLLDQAVSVSSAFLQRGEVVSTRGRNPEETQRFTAHGGDLTKGKPLVVLVNGGSASASEIVAGALHDHKRATIIGTRSFGKGSVQTIIPLGAGNGALALTTARYYTPSGRSIQAQGIAPDIEILQDVPPELKGRMDTMAESQMRGHLQAADGTEQTGSQSYVPPKEEDDKALHAAYDFLHGVTANAVAAKPAPKAAVPN

SEQ ID NO: 40806 - DNA, 1692 bp, Clostridium tetani E88
  CDS (1)..(1692)
atgaaaaaattaaataataaaaataatattataaaatttattctctacttactatttattactttaataaattctaataatgtagtttttgctaataataacaacgaacatgataattatcataaactagatcaacaattttcggaattattaaaggacaatacatataaagaatacaatgatggattaatagagcaaataaaatatttaataaataatgtttattattatgatgtaccagaaagtatatctaatgctaaaagtgtagaagaaattatgaaaaatataagagacccttatactcaatactatacaggagaagaatttaaaaaattacaagagggaataaacaatgtattttctggaataggtatatactataaaaaacatgaagatggaattataataacggatatggttccaggatcttcagcagaatatgcaggtttaaaaataggagatattgtaatacaattgaatagagaagaaataaaaggtttaagtgttgaaaaaatagataaatatataaagggagaagaaggaactaaagttatattggatgtaaaaaggggaacacaaattgttacttttattttgcagagaagagctgttgaaataccaacagtagattcgaaaatattggatgaaaatataggatatgtacatataaagtcttttggaaataagacaccagaactttttaagaaaagaattgagaatttattaaatagtaatatagaaaacttagttgtagatctaagaggaaaccttggaggatatacaagctctgcatatgaaatagcaggttactttattggaaataaaacagtgactataatgaaggacaaaaaaggaaatgaaactttatatagaggatcgtctcaagaattattaagagatattcctataatatttataacggataaaaacacagcatcggcatcagaaatattaacatcagcagtaaaagactatgaaagagcttttattatagggaataaaacttatggtaaaggagtacaacagacatcatttatacttacagatgaaagttttttaaagcttacaactcatgaatttttttcgccttttggaagtaaaataaataagataggtgtaaaacccaattttgatacaaaaagtatagactctttaaaagttgcagaactcttattttcaggtggaaagcatagagaatataatagccaattagtaaaattgagtattgataatagggagtttattatagatttaaaaaaaggaaaagatagaaactatagaagtgcttttaaatatattatagaaagttctgatggggagaatatagagattggaaataaagataattgggtaaaatttgataaaaataaaataagcaatgacttttattttgagaacttaaaaactatggatagcttaactaagagtagtaaagatactgaacttattgtaaaatttaataaggatattcgacctagaactgcaaatgaattaaatgtaaaattagtagagggagctttttttcaggaaattcaattagaatatactatagataaaggtaatgagattcatataaaatgcaaggaagatctaagtactgataaagaatattatttattagtagaaggtatagaatctatagatggaatgcctctaaaaaatgggtcaatagctagggtatatgtgtattaa

SEQ ID NO: 40807 - protein, 563 aa, Clostridium tetani E88
MKKLNNKNNIIKFILYLLFITLINSNNVVFANNNNEHDNYHKLDQQFSELLKDNTYKEYNDGLIEQIKYLINNVYYYDVPESISNAKSVEEIMKNIRDPYTQYYTGEEFKKLQEGINNVFSGIGIYYKKHEDGIIITDMVPGSSAEYAGLKIGDIVIQLNREEIKGLSVEKIDKYIKGEEGTKVILDVKRGTQIVTFILQRRAVEIPTVDSKILDENIGYVHIKSFGNKTPELFKKRIENLLNSNIENLVVDLRGNLGGYTSSAYEIAGYFIGNKTVTIMKDKKGNETLYRGSSQELLRDIPIIFITDKNTASASEILTSAVKDYERAFIIGNKTYGKGVQQTSFILTDESFLKLTTHEFFSPFGSKINKIGVKPNFDTKSIDSLKVAELLFSGGKHREYNSQLVKLSIDNREFIIDLKKGKDRNYRSAFKYIIESSDGENIEIGNKDNWVKFDKNKISNDFYFENLKTMDSLTKSSKDTELIVKFNKDIRPRTANELNVKLVEGAFFQEIQLEYTIDKGNEIHIKCKEDLSTDKEYYLLVEGIESIDGMPLKNGSIARVYVY

SEQ ID NO: 40808 - DNA, 1200 bp, Clostridium tetani E88
  CDS (1)..(1200)
gtgaataaaaaaaagtggataggatggactatagcaatagtattgcttactaataccttaacatatataggtagcaatattatacctttagctatgcctaatggtaatgtagtagttaggaaagaggattataataatttagtacagtttaataaactatttcaaattaaagatttaatacatgaacgatatgatggagaaataaatgaaaaagatttagaagaaggtgctataaagggattagctaattcattaaaagatccatataccgtttttatgacaaaaaaagagtatgatgattttaatactcaaacagaaggaaattacagtggagttggaatacaacttcaggcgaaagataataaaatagttatagtggatattttcgaagaatctccagctagaaaagcaggaatacttcctaaagatgaaatagaaaaagtaaatgatatacctgtagatggaagtcaattagaaaaagctgtttctcttatgaagggagttgagggttcagaggtaaaacttacactatttagaaaagacaaagggaattttgatgtaaatctaaaaagatcaaaaataaatttaaaaactgtagcaggacaaatgctagatgaagatgttgcccttgtccaggtaacaatgtttgatgaaaatacagctaaaaattttaaaagtgaattagataaattaaagtctcaaggaatgaagggattggttttagatttaagaggtaatcctggaggagtactagatgaatgtgtggatatggtatctaattttgtacctaagggaaaaactattgtttcaaccatggataagtataaatcagagagaaaatataaatctaaaggtggaaattatgtaggattgcctttagtagttcttaccaatgaaggtagtgctagtgcttctgaaatatttgctggtgcaataagggattataaaataggaactttagttggagaaaagacctttggaaaaggacttgttcagactttatatgaaacaggtgaaggaacagcattgaaaattacaatttcaaaatattacactccaaatggagaaaatataaataaaataggaataaagccagatgtagaagtaaagtatcctgaagagctacttaaaaaaccatacaataggaatgaagatcctcaatttaagaaagccttagaggtggtaaaagaaaagatatag

SEQ ID NO: 40809 - protein, 399 aa, Clostridium tetani E88
MNKKKWIGWTIAIVLLTNTLTYIGSNIIPLAMPNGNVVVRKEDYNNLVQFNKLFQIKDLIHERYDGEINEKDLEEGAIKGLANSLKDPYTVFMTKKEYDDFNTQTEGNYSGVGIQLQAKDNKIVIVDIFEESPARKAGILPKDEIEKVNDIPVDGSQLEKAVSLMKGVEGSEVKLTLFRKDKGNFDVNLKRSKINLKTVAGQMLDEDVALVQVTMFDENTAKNFKSELDKLKSQGMKGLVLDLRGNPGGVLDECVDMVSNFVPKGKTIVSTMDKYKSERKYKSKGGNYVGLPLVVLTNEGSASASEIFAGAIRDYKIGTLVGEKTFGKGLVQTLYETGEGTALKITISKYYTPNGENINKIGIKPDVEVKYPEELLKKPYNRNEDPQFKKALEVVKEKI

SEQ ID NO: 40810 - DNA, 1479 bp, Lactobacillus plantarum WCFS1
  CDS (1)..(1479)
atgccagaggaacccaaacaaactaatccgcacataaaaaaagtgccccggcccaagcgacgcgttggtctatggacctatattatttccattgtcgtcgcattaggcattggggtgggtgggacgtactggctgattggtcggcaagtcaatgcccagctcagcagtatgcagcagactagtaaagcaatgaaaaagatcgaatcagtttatgaaacgatcaatgagaattactacaaaccggtcaatgcgaataagttggccaacggtgccattaacggcatggtcaattcgttaggtgataaattttccgagtacatggacaagagcgagacggaaagcttgaatgacacgatcgacagttcgttttctggaattggtgcccaggttcaaaaatctggcaactatgttcaaattatttcaccaattgctggtacgccagctaagaaagctggtttgaaaccgaaggacattattaaggcggtcaatggcaagtcagtggccggtaagaccttgacacaagccgttagcatgatgcgtggtaagatcggtacgacggtcaaattgacgattgaacgcagtggtcaaacctttaccgtaagtttgaagcgggctaagattccagtgacgaccgttgattataagttagtcggtggcgataagaagatcggttatattacggtatcgaccttctcgacgaatactgctaaggaatttaagacggcgttgaaggcactcgataagaagggggccaagaagttagtcatcgatatgcgtggtaatcctggcgggttgatgacggctgccttgaagatggcctcaatcttcttgaagaatggtaagacgatcatgcaggtccaagcacgcgatggttcgaccgaaaaatacacggcgtccaagaagtatgatggtggctttaaagaaacgaagtcaacgaccgtcttaattgatggtgggagtgcttcggcagctgaaatcttctccgcagccttgcatcaatcggcaggtgttaaactggtcgggtcacagtcatatggtaaggggaccgttcaaacggtgacgacttttaatgataagactgagatgaagatcacggtcgcgaagtggctgacaccaaacggcacttggatcaacaagaagggcttgacacctgatgttaaagctgatgagccgagttatgcaagcttgacggttattagcaaggtcagtgatttacaagctgacaaggtcaatagcaatgtcaagacgttccagaagtacttgcaagccttaggctactttaaaggaaccgttaatggctactttggtgattcaaccaccagtgcggtcaagcagtatcaaaagcatgccaagttaacggtcaatggcaaggtcgataaacagacactgactaagatcgagactgaattagctaataagatcagtgataatgatcgggcttacgatgcagcaatgaaattgattgaaaagacaaattag

SEQ ID NO: 40811 - protein, 492 aa, Lactobacillus plantarum WCFS1
MPEEPKQTNPHIKKVPRPKRRVGLWTYIISIVVALGIGVGGTYWLIGRQVNAQLSSMQQTSKAMKKIESVYETINENYYKPVNANKLANGAINGMVNSLGDKFSEYMDKSETESLNDTIDSSFSGIGAQVQKSGNYVQIISPIAGTPAKKAGLKPKDIIKAVNGKSVAGKTLTQAVSMMRGKIGTTVKLTIERSGQTFTVSLKRAKIPVTTVDYKLVGGDKKIGYITVSTFSTNTAKEFKTALKALDKKGAKKLVIDMRGNPGGLMTAALKMASIFLKNGKTIMQVQARDGSTEKYTASKKYDGGFKETKSTTVLIDGGSASAAEIFSAALHQSAGVKLVGSQSYGKGTVQTVTTFNDKTEMKITVAKWLTPNGTWINKKGLTPDVKADEPSYASLTVISKVSDLQADKVNSNVKTFQKYLQALGYFKGTVNGYFGDSTTSAVKQYQKHAKLTVNGKVDKQTLTKIETELANKISDNDRAYDAAMKLIEKTN

SEQ ID NO: 40812 - DNA, 1338 bp, Pseudomonas syringae pv. tomato str. DC3000
  CDS (1)..(1338)
atgctgcatttgtcccgcctcacctcgctggccctggcaattgccatcgttatcggcgcgcccctggcgcaagctgccgaaaaaaccgcgccagccacgcctgcagcagtcgcacccgccaaacccaatgccaacgccaagccgccgctgccgcttgacgagttgcggacctttgccgaggtcatggatcgggtcaaggctgcctacgtcgagccggtggacgacaaaacgctgctggaaaacgctatcaagggcatgctcagcaaccttgatccgcactcggcctacctcggcccggaagatttccaggagttgcaggaaagcaccagcggcgaattcggtggtctgggcatcgaagtaggcgtcgaagacggcctggtcaaggtggtttcgcccatcgacgatacccccgcctccaaggctggcattgaggcaggcgacctgatcgtgaagatcaatggcacgccgacccagggccagaacatgcaggaagcagtcgacaagatgcgcggcaagatcggcgaaaaaataacgctgacattggtgcgcgatggcggcacgccgtttgacgtaacgctggcgcgggcgaccattcaggtcaagagcgtcaaggcgcagatgctggaaaacggctacggctacatccgcatcacccagttccaggtcaagaccggcgacgaggtcggcaaggcgctggccaagttccgcaaggacaacggcaagaagatgagcggcctgattctcgacctgcgcaacaaccctggcggcgtgctgcaatcggcagtgcaggtggcggaccacttcctcaccaaaggcctgatcgtctacaccaaaggccgcatcgccaattccgaactgcgcttctcggccgacccggcagacgccagcgaaggcgtgccactggtggtgctgatcaacggcggcagcgcctcggcatctgaaattgtcgccggcgccctgcaagaccagaaacgcggcatcctgatgggtaccgataccttcggcaaaggctcggtgcaaaccgttctgccgctgaacaacgatcgcgcactgaagatcactacggcgctgtattacacgccgaacggtcgctctattcaggcgcagggtatcaacccggacatcgtggtacgtcgggccaaggtcaccagcgaagcggacggcgagaactacaaggaagccgacctgatgggtcacctgggcaacggcaatggcggcgccgacaaaccgaccgtcaaaggcagcgcagcggccaaggcgcgtccgcaggatgacgacttccagctcagtcaggcgcttagcctgctgaaggggctgagtatcacccgcggtaactga

SEQ ID NO: 40813 - protein, 445 aa, Pseudomonas syringae pv. tomato str. DC3000
MLHLSRLTSLALAIAIVIGAPLAQAAEKTAPATPAAVAPAKPNANAKPPLPLDELRTFAEVMDRVKAAYVEPVDDKTLLENAIKGMLSNLDPHSAYLGPEDFQELQESTSGEFGGLGIEVGVEDGLVKVVSPIDDTPASKAGIEAGDLIVKINGTPTQGQNMQEAVDKMRGKIGEKITLTLVRDGGTPFDVTLARATIQVKSVKAQMLENGYGYIRITQFQVKTGDEVGKALAKFRKDNGKKMSGLILDLRNNPGGVLQSAVQVADHFLTKGLIVYTKGRIANSELRFSADPADASEGVPLVVLINGGSASASEIVAGALQDQKRGILMGTDTFGKGSVQTVLPLNNDRALKITTALYYTPNGRSIQAQGINPDIVVRRAKVTSEADGENYKEADLMGHLGNGNGGADKPTVKGSAAAKARPQDDDFQLSQALSLLKGLSITRGN

SEQ ID NO: 40814 - DNA, 1698 bp, Bacteroides thetaiotaomicron VPI-5482
  CDS (1)..(1698)
atgaaaaaattgctgaataggcggatagctcttgttttggtggctgtaatagctactgtagctttctttagttttaagagtggagacgaccgcaatttccagattgccaagaatctggatacatttaatgcgattgtgaaagaactggatatgttctacgtggataccattgatccgaacaagaccattcgcgaaggaatcgacaatatgcttttctcgctggatccttatacagaatattacccggaggaagatcaaagcgaactggaacagatggtgaaaggaagctttggaggtatcggttctcttattacctataatacgaagctgaaacgttccatgattgccgaaccgttcgagggaactccggcggccaaagcgggactgaaggcgggagatatcctgatggaaatagacggaaaagatctccttggaaagaataattcggaagtcagccagatgttgcgcggacaggcgggtacgagctttaaactgaaagtggagcgtcctaatgagaaaggcggacaaaccccgatggagtttactatcgtacgtgaatctattcagacccctgccatcccatatgctaccgtgatggataataaagtgggatatatcagcctgagcacattctccggcaacccttccaaggatttcaaaaaagcattgctggatctgaagaaacagggagctacttctctggtcatcgacctccgtaataacggtggcggtctgttggatgaagcagtggaaatagccaattatttcctgccccgtggaaaagtaatcgtaaccaccaagggaaagacgaaacaggcaagcaacacatacaagactttgcgtgaaccgctggatctggatattccgattgccgtattggtaaacagtggtacggcttctgcttcagaaatcctgtcgggctcattgcaagaccttgatcgtgccgttattgttggtaaccgtacatttggaaagggacttgtacaggttccccgttctttaccttatggaggaatgatgaaagtgactacttccaaatattatatcccaagcggacgttgtgtgcaggcgatcgactataagcaccggaacgaagatggaagtgtgggaacgattcccgacagtctgactaacgtattctatactgctgccggacgtgaagtacgtgacggaggtggtgtaatgcctgatattactgtcaagcaggaaaaactcccgaatatcttgttctatctcgtacgtgataatctgatttttgactatgcaactcaatactgcttgaagcatcctactgtagctgctcctgaaaagtttgtagtgacggatgctgattacaatgatttcaaggaactggtgaagaaggccgatttcaaatatgaccagcagagtgagaagattctgaaaacactgaaagaggctgctgaatttgaaggctatatgacagatgctgccgaagagttcaaggcactggaaaagaagttgaatcataatcttgaccgtgacctggattatttctctaaggatatcaagagaatgattgctaatgaaattatcaagcgttattatttccagagaggtggtattatcgagcaactgaaggatgatgatgatttgcaggaagcaataaaggtattgaatgatcctgcgaagtataaggaaatgctgagcgcgccgataacgaaagctgaaaagaagtaa

SEQ ID NO: 40815 - protein, 565 aa, Bacteroides thetaiotaomicron VPI-5482
MKKLLNRRIALVLVAVIATVAFFSFKSGDDRNFQIAKNLDTFNAIVKELDMFYVDTIDPNKTIREGIDNMLFSLDPYTEYYPEEDQSELEQMVKGSFGGIGSLITYNTKLKRSMIAEPFEGTPAAKAGLKAGDILMEIDGKDLLGKNNSEVSQMLRGQAGTSFKLKVERPNEKGGQTPMEFTIVRESIQTPAIPYATVMDNKVGYISLSTFSGNPSKDFKKALLDLKKQGATSLVIDLRNNGGGLLDEAVEIANYFLPRGKVIVTTKGKTKQASNTYKTLREPLDLDIPIAVLVNSGTASASEILSGSLQDLDRAVIVGNRTFGKGLVQVPRSLPYGGMMKVTTSKYYIPSGRCVQAIDYKHRNEDGSVGTIPDSLTNVFYTAAGREVRDGGGVMPDITVKQEKLPNILFYLVRDNLIFDYATQYCLKHPTVAAPEKFVVTDADYNDFKELVKKADFKYDQQSEKILKTLKEAAEFEGYMTDAAEEFKALEKKLNHNLDRDLDYFSKDIKRMIANEIIKRYYFQRGGIIEQLKDDDDLQEAIKVLNDPAKYKEMLSAPITKAEKK

SEQ ID NO: 40816 - DNA, 1590 bp, Bacteroides thetaiotaomicron VPI-5482
  CDS (1)..(1590)
atgatgatgaagaagattaaagtatacgccctcctggtttgtctgttggcaacgtctgctgcacaggcccaaagtttcggctctgccgccatgcgcaaactccaaatggcggaattcgcaatttccaacttctacgtagacaaagtagatgaagacaaactggtagaagaagctatcatcaagatgctggcacagctcgacccgcactccacttactcggatgccgaagaagtgaagaagatgaacgaaccgcttcaaggcaacttcgaaggcatcggcgtacagttccagatgatcgaggacaccctgctcgtcgtacaacccgtcagcaacggcccctccgagaaagtgggcatccttgccggcgaccgcatcattgccgtcaacgactccgccatcgcaggagtaaaaatgagcacggaagatatcatgaagcgcctgcgtggcccgaaaggttcgaaagtcaacctgaccatcgtccgccgtggagtacaagacccgctcgtgttcaccgtgaaaagagataagatacctatcctgagtctcgacgcttcctacatgattcagccaaagatcggatacatccgcatcaaccgctttggcgcaaccaccgccgaagaatttaagaaagcaatgaaagacctgcaaaagcaaggcatgaaagacctcatcctcgacctgcaaggcaacggcggaggatatctgaacgccgccatcgaccttgccaacgaattcctcggacagaaggaactgattgtttacaccgaaggccggaccgcacagcgcagcgagttcttcgccaaaggaaacggagagttccgtgacggccgcctcatcgtactggtagacgaatacaccgcttccgccagcgaaatcgtgagcggcgcagtgcaggattgggacagaggtatcatcgtaggccgacgttctttcggcaaaggactggtgcaacgtcctatcgacctgccggacggctccatgatccgactgaccattgcacggtactacacccctgccggtcgttgcatccaaaagccttatgacagctcgaccgattacaataaagacctgatagaccgcttcaaccacggagaactgatgaatgccgacagcatccacttccccgactcattgaaagtgcagaccaagaaactgaaacgtaccgtctacggcggaggtggcatcatgccggactacttcgttccgattgatacgacactctacacggactatcaccggaaactggtcggcaaaggagtcatcatcaaattcacaatgaaattcatcgaagaccaccgcaaggaactggccgataaatataagaagttcgacagcttcaacgaaaagtttgttattgacgacgatatgctcgccaccctccgcgaaatgggtgagaaagaaggggtgaagtttaacgaagagcagtatcagaaggcacttccgctgatcaagacacagctcaaagcactgatagcccgtgacctctgggatatgaacgaatatttccgcgtcatgaatacaacgaacgaaagcgtgcagaaagcattggaaatcttccgttcgggagagtatcagaagaagttgaaataa

SEQ ID NO: 40817 - protein, 529 aa, Bacteroides thetaiotaomicron VPI-5482
MMMKKIKVYALLVCLLATSAAQAQSFGSAAMRKLQMAEFAISNFYVDKVDEDKLVEEAIIKMLAQLDPHSTYSDAEEVKKMNEPLQGNFEGIGVQFQMIEDTLLVVQPVSNGPSEKVGILAGDRIIAVNDSAIAGVKMSTEDIMKRLRGPKGSKVNLTIVRRGVQDPLVFTVKRDKIPILSLDASYMIQPKIGYIRINRFGATTAEEFKKAMKDLQKQGMKDLILDLQGNGGGYLNAAIDLANEFLGQKELIVYTEGRTAQRSEFFAKGNGEFRDGRLIVLVDEYTASASEIVSGAVQDWDRGIIVGRRSFGKGLVQRPIDLPDGSMIRLTIARYYTPAGRCIQKPYDSSTDYNKDLIDRFNHGELMNADSIHFPDSLKVQTKKLKRTVYGGGGIMPDYFVPIDTTLYTDYHRKLVGKGVIIKFTMKFIEDHRKELADKYKKFDSFNEKFVIDDDMLATLREMGEKEGVKFNEEQYQKALPLIKTQLKALIARDLWDMNEYFRVMNTTNESVQKALEIFRSGEYQKKLK

SEQ ID NO: 40818 - DNA, 1749 bp, Bacteroides thetaiotaomicron VPI-5482
  CDS (1)..(1749)
atgagtacaagaaactcttcacgttttacgcctatcatcatagctatcagcgtggtggccggtattcttatcggtacattttatgccaagcacttcgccggcaaccgtctgggtatcatcaacggttcttccaacaagctgaatgcgctgttgagaatcgtagatgatcaatatgtagacaccgtaaacatgaccgacctcgtggagaaggctatgccacagatcctggcagaactggacccgcactccacttacatccctgcacagaatctcgaagaagtcaattcggaactggaaggcagtttcagcggaatcggtatccagtttacgatacagaatgatacgattcatgtgaatgccgttatccagggaggcccatctgaaaaagtgggactcatggcgggcgaccgcatcgttaatgtagacgacagtttatttgtaggcaaaaagctgaacaacgaactagccatgcgcacactgaaaggtcctaagggatcgcaggtgaaactgggtgtcaaacgcgtaggagaaccgaaattgctggacttcaccatcacccgcggagacattcctcaaaatacagtagacgctgcctatatgctgaacgatgatatcggttatgtaaaagtcagcaaattcggacggacaagccacgtagaattgcttaacgccttggcccagctcaatcataagaaatgtaaaggactgattattgaccttcgcggcaatacaggaggatacatggaagctgccatccgcatggtgaatgaattcctgcccgaaggtaaactgattgtatatacacaaggacgtaaatatccccgtgcggaagaatttgccaacggtacgggcagttgccagaaaatgccactcgttgtattgattgacgagggttctgcttctgccagcgaaatctttaccggagcaattcaggataatgaccgcggtacagtggtaggacgccgttccttcggaaaaggactggtacaacaaccgattgacttcagcgacggctctgctatccgcctgactatcgcccgctattatactccttcagggcgttgcatccaacgtccttacgaaagtggtaaagacaagaattatgaactagacatatacaaccgctacgaacacggtgagttcttctcacgcgacagcatcaagctgaacgaaaacgaacgctatctcaccagcctgggacgcactgtttatggtggtggcggtatcatgccggatgtatttgtaccacaagatactaccggagtcacttcttatctctcatcagtaatcaaccgcggactaactcttcagtttactttccagtacacggacaataatcggaagaagctgagccagtatgaaacggaagaagacctgctgaattatcttcgtcaccaaggtttggtagagcagttcatccgctttgccgactcgaaaggtgtaaagagaaggaatattctgatccagaaatcgtataaacgactggaagcgaatatatacggcaacattatctataatatgctgggactggaagcttatctgaaatacttcaataaatcggatgctacagttcaacaaggtatagaactgctcgaaaaaggagaagctttcccaaaagcacccgccgagacagaagaggaagtgacgaaagacaataaagatggaaagaaaaaaagaactgcgcaagcttatggcatcactgaagatccgacacgcatcttcgactttgcagaagctacaatcagctaa

SEQ ID NO: 40819 - protein, 582 aa, Bacteroides thetaiotaomicron VPI-5482
MSTRNSSRFTPIIIAISVVAGILIGTFYAKHFAGNRLGIINGSSNKLNALLRIVDDQYVDTVNMTDLVEKAMPQILAELDPHSTYIPAQNLEEVNSELEGSFSGIGIQFTIQNDTIHVNAVIQGGPSEKVGLMAGDRIVNVDDSLFVGKKLNNELAMRTLKGPKGSQVKLGVKRVGEPKLLDFTITRGDIPQNTVDAAYMLNDDIGYVKVSKFGRTSHVELLNALAQLNHKKCKGLIIDLRGNTGGYMEAAIRMVNEFLPEGKLIVYTQGRKYPRAEEFANGTGSCQKMPLVVLIDEGSASASEIFTGAIQDNDRGTVVGRRSFGKGLVQQPIDFSDGSAIRLTIARYYTPSGRCIQRPYESGKDKNYELDIYNRYEHGEFFSRDSIKLNENERYLTSLGRTVYGGGGIMPDVFVPQDTTGVTSYLSSVINRGLTLQFTFQYTDNNRKKLSQYETEEDLLNYLRHQGLVEQFIRFADSKGVKRRNILIQKSYKRLEANIYGNIIYNMLGLEAYLKYFNKSDATVQQGIELLEKGEAFPKAPAETEEEVTKDNKDGKKKRTAQAYGITEDPTRIFDFAEATIS

SEQ ID NO: 40820 - DNA, 1434 bp, Enterococcus faecalis V583
  CDS (1)..(1434)
atgaagaacaaacgaactgttcctttttatcaatatattatttcgctcctctgtgtcgcatttttagctggaggaagtagttatatttattttgatcatcgtgttaaaaagatgagtcaagaaggggcaattaccaatgctgatttaagcaaagtgcaggatttatataatgaaattagtaccaattatgtaggtgaagtagataaaaatgaattagttgaaggcgccttaaaaggcatgtctgaagccattggagacccatactcaacttatctaaatgaatctgctgccaatgatttaaacgaaagcttatctggtgattttgaaggaattggtgccactatgacaatgaaagatggcgaaccagttgtagcagaggcccctgtagcagattccccagctgaaaaagcgggaatcaaagaaggcgatattattgaaaaggttgatggtacagctacaaaagggatgaaactagcagaagtcgtctcaaaagtccgaggtaaaaaaggaacttccgttgaattgactatccaaagagagggagaaactaaaaatatctcaatcaaacgtgggaaaattcccgttaaaacagtgactggtgagttagacaaaaatgatgcacaaattggctcgattaaaattacgtcctttggtaaaaaaacatatcaagaattgaaagaaacaatcacgaatttacgtgacaaaggagctaaatcctttgtaattgatgtacgccaaaatcctggtggactgctagatcaagcagagcgaatggccagtatgtttttaaaaaatggcgaaacaattgttcaatttgaagacaaaaaaggacgtacgatgaaagaagttgcttccaaagaattagacggcggctttaaagtaaaagaacctgttgcagttatcattgatggcaatagtgccagtgcatccgaaatttttgctgcagcactgcatgaatctgcgaatgtcccattaattggaacgaaaacatttggcaaaggaacggtccaaacggtgaaagatttaaatgaccaaaccgaaataaaattgactgttttaaaatggttaacaccaaaaggcgaatggatcaacgaaaaaggaattgaaccaaccatcaaagctgattaccccgagtatgcctatttaaaattgattcctcgcgataaaacgctaaaagaaggagatcaatctgaagatattcagaacttaaatgctattttagctgtattagcgtatcctgttgatgaaaacaatgcaaactacaccgcagaaacaaaagcagcggttagcgatcttcaacagaaaaatggcttgcctgtaactggagaaatcgacaatgaaacagccacaaaaattgaagccactttaggtaaattaattcttgaaaatgacgctgcttacgatacagcagtcaaagaaattcaaaaaaactag

SEQ ID NO: 40821 - protein, 477 aa, Enterococcus faecalis V583
MKNKRTVPFYQYIISLLCVAFLAGGSSYIYFDHRVKKMSQEGAITNADLSKVQDLYNEISTNYVGEVDKNELVEGALKGMSEAIGDPYSTYLNESAANDLNESLSGDFEGIGATMTMKDGEPVVAEAPVADSPAEKAGIKEGDIIEKVDGTATKGMKLAEVVSKVRGKKGTSVELTIQREGETKNISIKRGKIPVKTVTGELDKNDAQIGSIKITSFGKKTYQELKETITNLRDKGAKSFVIDVRQNPGGLLDQAERMASMFLKNGETIVQFEDKKGRTMKEVASKELDGGFKVKEPVAVIIDGNSASASEIFAAALHESANVPLIGTKTFGKGTVQTVKDLNDQTEIKLTVLKWLTPKGEWINEKGIEPTIKADYPEYAYLKLIPRDKTLKEGDQSEDIQNLNAILAVLAYPVDENNANYTAETKAAVSDLQQKNGLPVTGEIDNETATKIEATLGKLILENDAAYDTAVKEIQKN

SEQ ID NO: 40822 - DNA, 1371 bp, Coxiella burnetii RSA 493
  CDS (1)..(1371)
atgagcctaaaaagaaagattatagctatcgtagttgctgccttcatcagtccgggacttaccaccgtattcgctttttctcctccttttttaccgaaaacgctgatctccactccagcagaagataaaaacgatgagctctccagaaaagacgtcgaacgtttcgtgacggccattgcattggtccatcagtattacattaaaaatatgagtaataaaaaattactcgacagcgcaattagcggcatgatggccaacctcgacccacattctagttatctcgacaacaacgacttgaaagaattgaaaaccaccgtctctggagagtttgtgggcgttggcatcgagctcacggtctccaaagacggtcttttaaaagtcatcagcccgctggaagattcccccgccgcgcgcgcgggcatccaacccaacgattatattgttaaaattgacgaccaattagtccaaaacatgagtcttccggaagcggtgagccgaattaaaggcaaaaaagagacgaccgtcaagttaacggttttacgcaaaagtgcaaataagcctttaattttttcgattcaacgtgaacccattcatttggttagtgtaaaaagcaaaactttagaacccggttacggttatgtccgaatcactttcttccaagggcccgtggaaaaccagttgcgtgatgcgattgataaattgaaaaaagaatcgcaaggtcctttgaaaggtttagtcctcgatctgcgtaataatcccggcggcctgctcgatgtcagcgcccaagtggcggacagtttccttgatgcgagtaagatgcaccgctataacgacctcatcgtttacacaaaaggacgcgttccgggtgccgatattcaaatcaaagcgacgcctggcgatctcattccccacacaccgatggtcgtactgatcaacggcggatcggcctctgcttcagaaattgtggctggcgctcttcaagattacaaacgcgctattatcatgggaacacccagcttcgggaaagggtcggtccaaaccgttttacccattgggaaagaggacgcgattaaactaacgactgctttgtattacaccccggcaggccgcgaaattcaggccaaaggcattataccgaatgttgcggttccggaattcagtattacgcctcctaaatcacagttatcattggatgaagccgatttccaaaaccatttgcccaatgacggcgcggcttccactaaggcaaatcccacaacggccgaagaagagaaaaatttattacaaatccaactgcaattggcgaaaaccgattatcagctatatcaagctttaatgatgttacaaggtcttcaggtggttaagcattag

SEQ ID NO: 40823 - protein, 456 aa, Coxiella burnetii RSA 493
MSLKRKIIAIVVAAFISPGLTTVFAFSPPFLPKTLISTPAEDKNDELSRKDVERFVTAIALVHQYYIKNMSNKKLLDSAISGMMANLDPHSSYLDNNDLKELKTTVSGEFVGVGIELTVSKDGLLKVISPLEDSPAARAGIQPNDYIVKIDDQLVQNMSLPEAVSRIKGKKETTVKLTVLRKSANKPLIFSIQREPIHLVSVKSKTLEPGYGYVRITFFQGPVENQLRDAIDKLKKESQGPLKGLVLDLRNNPGGLLDVSAQVADSFLDASKMHRYNDLIVYTKGRVPGADIQIKATPGDLIPHTPMVVLINGGSASASEIVAGALQDYKRAIIMGTPSFGKGSVQTVLPIGKEDAIKLTTALYYTPAGREIQAKGIIPNVAVPEFSITPPKSQLSLDEADFQNHLPNDGAASTKANPTTAEEEKNLLQIQLQLAKTDYQLYQALMMLQGLQVVKH

SEQ ID NO: 40824 - DNA, 1170 bp, Streptomyces avermitilis MA-4680
  CDS (1)..(1170)
atgtcaggccccgacccgttctgtgaaccccgccgcttcggccgcggggcggccctgacgttgctcttcgcgagcgtcctcgtggcgggcgccgcgaccggctcgttcgacgaaccggacgactccggccggaaagcctcctccgcccgcccggccccggcgagccaccgcgaggacgtcgccgaggcggccgccgaggccgcggccgacggcaagtcccccgtggaggccgccgagcgcgcggtcagccgcagcggcgaccgctggggcgccgtctactcccagggcgagtacgaggagttcgaggaggccctcgacggccagtacaccggcgtgggcctgtgggcccggcgcgaacgtgacggccgtatcgaggtgagccgggtgcagtccggctcgcccgcggccgccgccgggatccgcgagggtgaccggctgcgcaccgtcgacggcgagaacgtcgcgggcaagcccgtcaccgatgtcgtctccttactgcgcggcgacgccggcgacgcggccgccggcacccgggtccggctcggcctggcgcgcggcacgcacgcgtgggacgagaccgtgcgccgcgcccgcctgtccaccgaccccgtcaccgtgcgcaggctcgccgacgacgtcaccgtgatcaaggtcgccgcgttcaccaagggctccggcgaccgcgtacgggccgccgtggccgacgcgccccacgccgacgggatcgtcctcgacctgcggggcaactccggcggactggtcaccgaggcggtcaccgccgcgtccgccttcctcgacggcggcctggtggcgacgtacgacgtcaacggtgagcagtgcgccctgcacgccgactccggcgccgacaccacgcggcccctggtcgcactggtcgacggcggcacgatgagcgcggccgagctgctcaccggcgctctccaggaccgcgggcgcgcggtcgtcgtgggcaccaggaccttcggcaagggctcggtccagatgccgagccggctgcccggcggctccgtcgccgagctgaccgtggggcactatcgcaccccctccggccacagtgtcgacggccgcggcatcacccccgacctggaggcggacacggaggcgctggagcgggccgggaccgtgctgagcggtctcggagatccttcgtaa

SEQ ID NO: 40825 - protein, 389 aa, Streptomyces avermitilis MA-4680
MSGPDPFCEPRRFGRGAALTLLFASVLVAGAATGSFDEPDDSGRKASSARPAPASHREDVAEAAAEAAADGKSPVEAAERAVSRSGDRWGAVYSQGEYEEFEEALDGQYTGVGLWARRERDGRIEVSRVQSGSPAAAAGIREGDRLRTVDGENVAGKPVTDVVSLLRGDAGDAAAGTRVRLGLARGTHAWDETVRRARLSTDPVTVRRLADDVTVIKVAAFTKGSGDRVRAAVADAPHADGIVLDLRGNSGGLVTEAVTAASAFLDGGLVATYDVNGEQCALHADSGADTTRPLVALVDGGTMSAAELLTGALQDRGRAVVVGTRTFGKGSVQMPSRLPGGSVAELTVGHYRTPSGHSVDGRGITPDLEADTEALERAGTVLSGLGDPS

SEQ ID NO: 40826 - DNA, 1431 bp, Nitrosomonas europaea ATCC 19718
  CDS (1)..(1431)
atgcataattttataaagaaaatcagtttagtttttgccggcgtcattgctggaatcatggtcagcctgaatttctccgccatcgccgacaaagaaatcaaagaggaattgcaaacgctcccgattgaggagctgcgtacattttcccaggttttcggtcgcatcaaaagcgactatgtcgaacctgtagaagataaaaaactgattaccgaagcgatcaacgggatgctggtcgggctggatccgcattcggcttttctggacagtgaggaatacaaagaactgcagatcggtacacagggagagtttggcgggctgggtatacaagtaacaatggaagatggcctggtcaaggttatttctccgatcgaagatacacctgctttccgtgcaggcgtcaaaaccggtgatctgatcataaaaattgatgatacagccgtaaaaggtatgaccctcaacgatgctatcaagcggatgcgaggaaaaccggataccccgattacactgactgtcattcgtgaaggtgaagcagagccccttaccttcacactcgttcgtgccattatcaaaattgacagtgtcaagtccaagcttattgagccgggttatgcctatgtccgcatcacccagttccaggaacgtactggtgagaatcttgcggaagccattaccaagctttacagcggaagcaaagtccctatgaaaggtctgatactggatttacgaaatgacccgggtggattgctgaacagtgctgtcgcagtctcagctgctttcctgccgagcaatgcgctggtggtatacactgaaggacgtacgaacgatgccaagatgcaacttcgcgccaatcctgaatattatcttcgtggatcagggcgtgatttcctggccaatctccctcaaagtatcaaaaccatacccatggtgacactggtcaacggcggttcagcttctgcctcggaaatcgtagcgggtgctctgcaagaccataaacgatctattgtcatgggttcgcaaacctttggcaaaggatcggtacaaactatcctgccgctcagcaataacacagctatcaaactgacgacagcacgttacttcacgcccaatggtcagtcgatacaagcaaaaggcatcactccggatatactagatgaagaaactgacaatgactcacgcctgttgagagaagccgatctcaaccgccatctgagcaatggtcaggaagaaaaaaccgataaggcagcagcatccgacaaaaaaggtgcacaatcttccaaaagatcaaaaaacaaggcagataagaagcagaaaaagcatgaacccatggaattcggatctagtgatgacctgctgctggccaaagcagtcaatcatttgaaatccatggctcagaaatccaagcataaaacagccaaatcaactcaaagctga

SEQ ID NO: 40827 - protein, 476 aa, Nitrosomonas europaea ATCC 19718
MHNFIKKISLVFAGVIAGIMVSLNFSAIADKEIKEELQTLPIEELRTFSQVFGRIKSDYVEPVEDKKLITEAINGMLVGLDPHSAFLDSEEYKELQIGTQGEFGGLGIQVTMEDGLVKVISPIEDTPAFRAGVKTGDLIIKIDDTAVKGMTLNDAIKRMRGKPDTPITLTVIREGEAEPLTFTLVRAIIKIDSVKSKLIEPGYAYVRITQFQERTGENLAEAITKLYSGSKVPMKGLILDLRNDPGGLLNSAVAVSAAFLPSNALVVYTEGRTNDAKMQLRANPEYYLRGSGRDFLANLPQSIKTIPMVTLVNGGSASASEIVAGALQDHKRSIVMGSQTFGKGSVQTILPLSNNTAIKLTTARYFTPNGQSIQAKGITPDILDEETDNDSRLLREADLNRHLSNGQEEKTDKAAASDKKGAQSSKRSKNKADKKQKKHEPMEFGSSDDLLLAKAVNHLKSMAQKSKHKTAKSTQS

SEQ ID NO: 40828 - DNA, 1410 bp, Bacillus anthracis str. Ames
  CDS (1)..(1410)
atggttgttgcatttttaattggtgctggcggaatgtttgcaggtatgtctttatttggggttaatccagcagaagtaacgcaaacaatttcgagtggaaacgctagcactgcgcaagggaatttggcaaaaattaatgaggcgtatgcactaattgattcacgttatgtggaagacgtgaaagatgaaaaattagtcgaaggtgcaatacaaggcatgttgtctacgctgaaggacccttattccacgtatatggataaagaaacggctaaacagtttagtgaatcgcttgatcctgagttagaagggatcggggctgaggtgaacaaaacggacggtaagcttattatcgtatctccaattaaaggctcaccggcagaaaagattggaattaaaccgaatgaccaaattttatctgtagatggaaatagtgtgaaagatttatcacgtgaagaagcagtattaaagattcgtggtaaaaaaggaacgactgttgcgattgaaattaagcgtgcaggagtagctgatccgattgtatttaaaattaagcgtgaaaaaattccaatcttcacagtgtttagctctgtgaaacaagagagtggaaaagatatcggttatatgcaaatcacttcttttgctgaaaatacagcgaaagaatttaaggatcagttaaaagagttagagaagaaaaacataaaagggctagttattgacgtgcgcggtaatcctggtggctacttaaatagtgtagaagagatactaggggaaattatgacggataaaaagccgatgctacaagtagagcaaagaaatggtgagaagaagaaattctctacggaactgaaagagagaaagccatatccaatttcagtattaattgataacggaagtgcttctgcttcagagattttagcgggtgcgctaaaagagggagaaggatacgatttaattggtgaaaaaacgtttggtaaaggtactgttcagcaagctgttccatttaaagatggcagcaatatcaaattaacgatgttcaaatggttaacaccggatggaaactggattcataaaaaaggaatcaagccaactgtagaagtgaaacaaccagattattatcatgcgacaccaattcaaattgaaaagacactttcatacaatgcaaatgatgtacaagtaaaacacgcacaagaaatgcttaagagtttaggatatgtaccaggacgtgaagatggatactttagtaaagagacagaatcagcactgaaagcattccaaaatgcgaataagatggaagcgacagggcagctagataaaaagacagctgaggcgattcaaacgaaaattattgaaaaaatccgttctggagaaaatgatctccaattacagtcagcattaaaattaatggcgaaataa

SEQ ID NO: 40829 - protein, 469 aa, Bacillus anthracis str. Ames
MVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 40830 - DNA, 1518 bp, Arabidopsis thaliana
  CDS (1)..(1518)
atggaggtccttgcgagctcttcattatccccaatttcttttactaagcctaacaaaataaaccctaatttctcaatccagatttcaaaagctagcaaatttagttatgctcgtagtcgtagtaacatttcaaggagcaatgcagcaaacccaggagtcgtgttcgtctgtaatagatttctgtgtgttatcgaaagaaatgatcagaggaaattatctgggaaggttatgatgaaatcttctgttaatttcagacagaatctctctgttgcattagttcggatcgtttctgttctgcttgtctcttccatttctgttgttaccactgattcaccaccatcatggggtcttactgaagagaatcttctcttcctcgaggcttggagaacaattgatcgtgcttatattgataaaacctttaatggacaaagctggtttcgttacagagagactgctttacgaaatgagcctatgaacactcgagaagagacatacatggctatcaagaaaatggtggcaacactagatgatccttttactcgattcttggagcccggaaagttcaagagtttgcggtcggggactcaaggggcggttacgggtgttgggctgtcgataggttaccccactgcatcagatggaccaccagctgggcttgttgttatatcagctgctccaggaggtcctgcaaatagggcggggatattacctggcgatgttattcaaggaattgataatacaaccacagaaactcttaccatatacgatgctgcacagatgttgcagggacctgaaggaagtgcagtggagctagcgattcgcagtggacctgaaacgagactcttaactttgacgcgagagcgggtttctgtgaatccagtgaagtcaagattatgtgaacttcctggttctgggagtaactcccctaagattggctatatcaagctaacaacattcaatcaaaatgcttctagtgcggtaagggaagctattgaaaccttgagaggcaacaatgtaaacgcattcgtcttggaccttcgagacaatagtggaggttctttcccagaaggaattgagattgctaaattttggttagataaaggagtgattgtgtatatttgcgatagtcgaggtgttagagatatatatgatactgatggaagcaatgctatagcaacctctgagcctcttgccgttcttgttaacaaaggcaccgcgagtgccagcgagatattagcaggtgccttgaaagataataaacgtgctctggtttatggagaaccaacttacggaaaaggcaagatacagtcggtttttgagctttctgatggttcgggcttggcagtaacagttgctcgatatgaaacaccagctcacacagatatagacaaagtcggtgtaactcctgatcatccattgccaaagtcgtttccgaaagatgaagaggcgttctgtggatgccttaaggatcctacagctgcttgttatctcaatcaaggcctacttttttctagatga

SEQ ID NO: 40831 - protein, 505 aa, Arabidopsis thaliana
MEVLASSSLSPISFTKPNKINPNFSIQISKASKFSYARSRSNISRSNAANPGVVFVCNRFLCVIERNDQRKLSGKVMMKSSVNFRQNLSVALVRIVSVLLVSSISVVTTDSPPSWGLTEENLLFLEAWRTIDRAYIDKTFNGQSWFRYRETALRNEPMNTREETYMAIKKMVATLDDPFTRFLEPGKFKSLRSGTQGAVTGVGLSIGYPTASDGPPAGLVVISAAPGGPANRAGILPGDVIQGIDNTTTETLTIYDAAQMLQGPEGSAVELAIRSGPETRLLTLTRERVSVNPVKSRLCELPGSGSNSPKIGYIKLTTFNQNASSAVREAIETLRGNNVNAFVLDLRDNSGGSFPEGIEIAKFWLDKGVIVYICDSRGVRDIYDTDGSNAIATSEPLAVLVNKGTASASEILAGALKDNKRALVYGEPTYGKGKIQSVFELSDGSGLAVTVARYETPAHTDIDKVGVTPDHPLPKSFPKDEEAFCGCLKDPTAACYLNQGLLFSR

SEQ ID NO: 40832 - DNA, 1386 bp, Helicobacter hepaticus ATCC 51449
  CDS (1)..(1386)
atgcgacctaaaagaaatatgtctacagaattttatatcacaaaggcagtgtcaatgatgaataaatcgcgcgtggttgtagcaggtattattgtttctttgcttgcgagttcggctttatttgtggggttatcagctgatgaatcccacaaagctaaaccaaaagtgcaggaagtcaataagctagaatctttcaaaaagcttcgtcgcattatggcgatagtagaagagtcttatgttgatgaattaagtcttgatgagattgtcaataaggcaatagatggattattaagcaatcttgatgcgcattcaaattatcttaacaaaaagaaatttgatgatttgcgtgccaatattgatggtgagtttggtggcattggtatcacggtgggcttaaaagatggtgctttgacaattattgcacctgttgatggcacacctggagacaaggcagggttaaaaagtggcgatgttattgtgaaggtaaatgacaaaagcacgattgatatgagtattgatgatgcagtaaatcttatgcgtggcacacctcgcacaaaggtggagcttactattgtgcgtaagggtgaagcaaaacctctaaattttagtattgtaagagatattatcaagatggattttgtaaaggtgcgcaagattcaagatactgattttgcatatgtgcgtgtagcatcgtttgataaaaatgtaacgcggaatgtattaagctcactcaaacaaatgggtaaagtaaaaggtattgtgcttgatttacgcaataatccgggtggagcacttgaccaagcagttgatttgagtagattattcatcaaaaatggtgtgattgttacccaaaaaggacgcaataaaaatgacaacgttgaatatagagcaacaaatgctccttatgcttctgtgcctattgttgtgcttgttaatggtggaagtgcaagtgcaagtgagattgtcgcaggtgcattacaagaccataaacgtgctgttcttattggggaacaaacatttggtaaaggaagtgtgcagacatttatgcaacttgaccaaaatgaaggcttaaaactcactactgctaaatattatttaccaagtggaaggacgattcaagcagtgggtgtaacacctgatattatcgtgtatcccggtgtagcaccagagaatgagaatagttttagcattaaggaatctgatttaaaaagacatcttcaaggcgagcttgagaaggttaatgaacaaaatacaaagacagaaacagcgagtgatgataaaaaaaatattacccaagcaatgatatatcaagatattcaacttaaaagtgctattgatgtgcttaaagcgtggggtgtgattggtgctttaaatccaaacaagtaa

SEQ ID NO: 40833 - protein, 461 aa, Helicobacter hepaticus ATCC 51449
MRPKRNMSTEFYITKAVSMMNKSRVVVAGIIVSLLASSALFVGLSADESHKAKPKVQEVNKLESFKKLRRIMAIVEESYVDELSLDEIVNKAIDGLLSNLDAHSNYLNKKKFDDLRANIDGEFGGIGITVGLKDGALTIIAPVDGTPGDKAGLKSGDVIVKVNDKSTIDMSIDDAVNLMRGTPRTKVELTIVRKGEAKPLNFSIVRDIIKMDFVKVRKIQDTDFAYVRVASFDKNVTRNVLSSLKQMGKVKGIVLDLRNNPGGALDQAVDLSRLFIKNGVIVTQKGRNKNDNVEYRATNAPYASVPIVVLVNGGSASASEIVAGALQDHKRAVLIGEQTFGKGSVQTFMQLDQNEGLKLTTAKYYLPSGRTIQAVGVTPDIIVYPGVAPENENSFSIKESDLKRHLQGELEKVNEQNTKTETASDDKKNITQAMIYQDIQLKSAIDVLKAWGVIGALNPNK

SEQ ID NO: 40834 - DNA, 1830 bp, Rhodopirellula baltica SH 1
  CDS (1)..(1830)
ttggactcaccccgtccagcaatccccctccaacgacactcgcgatggaatcggcgcatggacctgttaacgacgatcaatcgatgccttgcttttgacaagcaagcggaccaatcaaacgaaggcaaagcgattgccaagcacgctcgtcggcgacgagtcgctggccgcatgcggacgtttgcattggtcgtcggtgcgatcgccgtcggcggatcttccatgcccgcgtttgcacaaggcttcgtgccttcacgtggtcctaccgtttccgcccccaccaacgacgccgaacgcaaactcgaagaacaagagcgtgctcgagcgttgactgatggcattgaactggaagatgccggtcagtggagcgacgcaatcgaccactacgaatcggcaactcgccggttcccgcaggaccgcatcctgtatcagcgactgctgatcagccggttacgatttgacgtcaaccgccgctatcaagatcaaacgtacttgcgatcgctgcgtgacatgacaacgtcgcagtcattggacttgtacagcgagattttggcgaacctgcaaacgcactatgttgacacgattgagtggtcacgagtgttgctgcacggcaccgcggctctcgaaaccgcgttggatgatgaaacgttcgtgcaaacgatgcttcccaatgcgacaccggaacagattgagaagttccgaatggaaatccaccaccggatcagtcagcggtccacccaaagtcgatttgacttgcgagcgaccgtgtctcaggttgcgtccatggctcagcaagaactcggcttgagcggaacggcgacggttctggagttcgtatcgggtgcggtttcgacgttggacacgtacactcgtttgctgtcgcctggacaactagacgacatgttcagcaccattgatggcaacttcgttggactcggcgtcgagttgaagcctggcgaagactgtttgaacattttgtcggtgattccgggtggccccgccgatgaagccggtatcgtcgctggcgatcgaatcatgggcgtggacgcgatttccgccgctgaccgtgaccctgactacgttgccgatttgctgcgtggtcccgagggttcgttggtgtcactcgagatcgcttccgttgatcaacaaccacgttccatccgagtcgcacgacgccgggtcgacgtgccatgtgttgaaaacattcacttggtcgacacggatgccaagattggctacttccgactgacaaattttcaaaagtcgacgcccgcggaagtggagaaagcactttgggcactcagtcgtcaaggaatgcgttcgctgatcatcgatctgcgtgacaatcccggcggattgttgcccgcgtcggtggaagtcgccgatcggttcatcgacaacggtcgaatcctaaccacccgaggtcgcaacgctcgcgaaaactttgactactcggctcaccgtgccaacacatggaatgttccgttggcggtcttgattgaccgaaacagtgcgagtgccagcgagatcttctccggtgcaattcgcgattccaaccgtggaacggtcgtcggcgaaaaaagctatggtaaaggtagcgtgcagggcatcttccgaatgcaagccgcccagttcgggctgtgcctgacaacggcgaagttctactcgccaagcggtcgagcgatcagtcgcaacggagtggaaccacacctgtccgtgccgccaacctacatcgcggctcgcccggatgagaacggacgattggtcacggaattggaagacgacgtgctccaacgagccatcgaacacttggctcaaccggcacactga

SEQ ID NO: 40835 - protein, 609 aa, Rhodopirellula baltica SH 1
MDSPRPAIPLQRHSRWNRRMDLLTTINRCLAFDKQADQSNEGKAIAKHARRRRVAGRMRTFALVVGAIAVGGSSMPAFAQGFVPSRGPTVSAPTNDAERKLEEQERARALTDGIELEDAGQWSDAIDHYESATRRFPQDRILYQRLLISRLRFDVNRRYQDQTYLRSLRDMTTSQSLDLYSEILANLQTHYVDTIEWSRVLLHGTAALETALDDETFVQTMLPNATPEQIEKFRMEIHHRISQRSTQSRFDLRATVSQVASMAQQELGLSGTATVLEFVSGAVSTLDTYTRLLSPGQLDDMFSTIDGNFVGLGVELKPGEDCLNILSVIPGGPADEAGIVAGDRIMGVDAISAADRDPDYVADLLRGPEGSLVSLEIASVDQQPRSIRVARRRVDVPCVENIHLVDTDAKIGYFRLTNFQKSTPAEVEKALWALSRQGMRSLIIDLRDNPGGLLPASVEVADRFIDNGRILTTRGRNARENFDYSAHRANTWNVPLAVLIDRNSASASEIFSGAIRDSNRGTVVGEKSYGKGSVQGIFRMQAAQFGLCLTTAKFYSPSGRAISRNGVEPHLSVPPTYIAARPDENGRLVTELEDDVLQRAIEHLAQPAH

SEQ ID NO: 40836 - DNA, 1488 bp, Rhodopirellula baltica SH 1
  CDS (1)..(1488)
gtgggtgccatcgtgataccatggcgtcgttctcgctcatctccgcaatctgactccgccatgctcccgcgaaacttgactctgctgttgtccgtgctggtcatctcattcgcatgttatgccatctacttgcggacgcgatctgccatgatggtcggtgaagccattgaaatgatcgatcggtactacgttgaaccggtggatcgccgcgaattgctgacatcggcgatggcgggcatgacgtcgacgctggaccagcacagcgaatacattccgccggtcagctaccaagcctttcaggacacgatccaacaagaattcgcgggaattgggatctacgttgatcagccggtcgaaggcgaacccgtccgcgtgatcactccattggtgggctcgcccgctctcagggccggtttgatgccgggagatgcgatcttggaagtggacggcgaatacgttggcgacatggacattcggtccgtcagcgaacgattgagaggaccgatcgcaaccaccgtgcagttattggttgagcgtggtgaagagaaactggaagtgaaggtgcagcgggacaccattcagttggaatccgtcatcggtgactatcgaaacggaggcaatgaatgggtttatcgtttgaagcagcatcccgacatcgtctacgttcggatgaccagttttggcgacaagacagtgagtgaactgcgttcggtcctgagtcggttgatgccgaagccagacgtgtcggggtttgtgctggaccttcgaggcaacggtggcggattgctgaccgctgccgttgatgtttgcgatatgttcttgagttcaggacgaatcgtcagcacaaagactcgcggcggagtggtcgaagacgaggtgtcggcaaccgcgggaacgttggtgccgcccgatatgccggtcgcgattttgatcgatgagcattctgctagtgccagtgaaattgttgcggcggcactgcaggatcacggacgagcgacgatcgttggtacgcgcagctatggcaaaggtactgtgcagaatatcttgccgttggaatatggccgcagtgctttgcgtctgacggtggcgaagtactaccgcccaagtgatcaaaacattcaccgcggtgttgatgacaccgaagaggatgtttggggtgtgagtcctgatccgggcatggatgtcaaaatcgccgaagacgatatacggcaactggctcgattctgggaagaggcttcttacccatcgctgaagaaccgcgatttgaaggacgctcatttaaagctcgcggatcccgatgaagaagtggattcggatgccgcacctgatgcttcttcaaacgaggcttcaaactcgacggaagaggatgctgttgtcaccgagcgatcgcctgccgaatcagcctgggagttggacacgcccttgcgaaccgcggtggaggccattcggtcagccaaatcatccaagcaaatctccgctgccgcctga

SEQ ID NO: 40837 - protein, 495 aa, Rhodopirellula baltica SH 1
MGAIVIPWRRSRSSPQSDSAMLPRNLTLLLSVLVISFACYAIYLRTRSAMMVGEAIEMIDRYYVEPVDRRELLTSAMAGMTSTLDQHSEYIPPVSYQAFQDTIQQEFAGIGIYVDQPVEGEPVRVITPLVGSPALRAGLMPGDAILEVDGEYVGDMDIRSVSERLRGPIATTVQLLVERGEEKLEVKVQRDTIQLESVIGDYRNGGNEWVYRLKQHPDIVYVRMTSFGDKTVSELRSVLSRLMPKPDVSGFVLDLRGNGGGLLTAAVDVCDMFLSSGRIVSTKTRGGVVEDEVSATAGTLVPPDMPVAILIDEHSASASEIVAAALQDHGRATIVGTRSYGKGTVQNILPLEYGRSALRLTVAKYYRPSDQNIHRGVDDTEEDVWGVSPDPGMDVKIAEDDIRQLARFWEEASYPSLKNRDLKDAHLKLADPDEEVDSDAAPDASSNEASNSTEEDAVVTERSPAESAWELDTPLRTAVEAIRSAKSSKQISAAA

SEQ ID NO: 40838 - DNA, 2127 bp, Rhodopirellula baltica SH 1
  CDS (1)..(2127)
atgtcgtttcgtcaaatccttcccgtcgcgttgctcgcggtggggtgcattggttccacactgattcaacttcccgccaccgcgcaggaacgaaccgtcgaacgggctgcaccggaacaagctgctccgccccagccctcgcctcaggacaaagtgatcgcgaagctgatcgcccaactgatgcccagcaatcacgtttctggcaaagatctcaacgatgaaatcagtcgtcgagctttggatttgtttctcgaatccttcgacccgatgaagctgtacttccttcagagcgatgttgacgaattcaatcgctactccgaagtggttgatgaccaagttcgcttgggcgacctcagcttggcttactacatctacggacgattcactcagcgtgtcgatgaacgtgtagccgtggtgatggaattgctcgatggcgatttcgatttcacccgtgacgaacaaatcattatcgatcgcgacgccacccaatttgctcgcgacgcagacgaagctcgcgaccgttggcgccgtcagattaagctagcattgctcgacttgcgaaacgaaaaaacagacgactcagaatccgacgaacctgagatgtcgaaagacgaaatcatggctgacgccaaggatcagctgcgtcgccgctacgctcgatacgctcgccgttggaaacaaaccagctccgatgatttgctggaactgttcctgtcgtcggtaaccaacggctacgaccctcactcgacttacatgtcgccagcaacgctggaagatttcgcgatcagcatgcgtctgaacctggacggcatcggtgcgtccttgggcgagaaagatggcaccacggttgtgcgtcaagtcattcctggtggagcggctgattcacacggcaagctgaaaccagatgacgtgatcgttgccgtcggccaagacgccgaaggccccatggtcgatatcgttgaaatgcctctcaaagaagtcgtcaaactcatccgtggccgtgcgggcagcgttgttcgcttggccgtgcgtcctggtggaaccggcaacgaagaaatcttcaaaatcgttcgtgctcgcatcgaactcgaagactcggccgctcgcggtgaagtcatcgaccacgagatgccagggcagggcaaagtcaaattgggctacatcaatctgcccagcttctacatggacatggaagccgctcgtcgaaacgaaacggactatcgcagcagcacacgcgacgtcgaacgaatcctgcgagacttcaagtcgcaaaacgtcggcggcgtcgtcctcgacctgactcgcaatggcggaggtagcttgaccgaagcgatcagcctgactggattgttcattgatcgtgggccagtggttcaagtcaagaactcggatggatcggttcaacagtactcggacgatcaaagcggcaccgtctgggacggcccattggttgttgtgaccagcaaactgagtgcgagtgccagcgagattttcgccggtgcaatcaaagactatcaccgcggcatcgtggtcggtgacccagccacgcacggcaagggcactgtccaaacgctcatggacatcggacaaagcctgttccgcaacaacaacgccaactacggcgcattgaaagttacattgcaacagttttatctgcccgacggcgagagcactcagctcaaaggcgtcgaagctgacttggtacttccaagcatgaccagcaagctgccagttgccgaaggtgacctcgaatacgcattggaattcgacaaggtgccgttggcgaaacacagcctgtacgcgatgacgccggacagcctgctcaactcgcttcgcatcaactccgccaaccgagtccagcaggacaaggaattcagcgaactgatgcgtcgtatcgagctgtacgttcgcgaaaaagaccagaaaagcatttcgctcaacgaagaagaattcctgcgacgtcgcgccgaacgcaaagctcaaacggaagccgaagaggaggaactcgatgaggtcctcaacaacgacgagattttccgtgacacgtattacaacaaagaggtcatgaacgtggcccacgaatacgtgactggactgcgttctcagaacttggctgttgcaaaatag

SEQ ID NO: 40839 - protein, 708 aa, Rhodopirellula baltica SH 1
MSFRQILPVALLAVGCIGSTLIQLPATAQERTVERAAPEQAAPPQPSPQDKVIAKLIAQLMPSNHVSGKDLNDEISRRALDLFLESFDPMKLYFLQSDVDEFNRYSEVVDDQVRLGDLSLAYYIYGRFTQRVDERVAVVMELLDGDFDFTRDEQIIIDRDATQFARDADEARDRWRRQIKLALLDLRNEKTDDSESDEPEMSKDEIMADAKDQLRRRYARYARRWKQTSSDDLLELFLSSVTNGYDPHSTYMSPATLEDFAISMRLNLDGIGASLGEKDGTTVVRQVIPGGAADSHGKLKPDDVIVAVGQDAEGPMVDIVEMPLKEVVKLIRGRAGSVVRLAVRPGGTGNEEIFKIVRARIELEDSAARGEVIDHEMPGQGKVKLGYINLPSFYMDMEAARRNETDYRSSTRDVERILRDFKSQNVGGVVLDLTRNGGGSLTEAISLTGLFIDRGPVVQVKNSDGSVQQYSDDQSGTVWDGPLVVVTSKLSASASEIFAGAIKDYHRGIVVGDPATHGKGTVQTLMDIGQSLFRNNNANYGALKVTLQQFYLPDGESTQLKGVEADLVLPSMTSKLPVAEGDLEYALEFDKVPLAKHSLYAMTPDSLLNSLRINSANRVQQDKEFSELMRRIELYVREKDQKSISLNEEEFLRRRAERKAQTEAEEEELDEVLNNDEIFRDTYYNKEVMNVAHEYVTGLRSQNLAVAK

SEQ ID NO: 40840 - DNA, 1344 bp, Prochlorococcus marinus subsp. marinus str. CCMP1375
  CDS (1)..(1344)
atgtttaatttaacctttaaaaactgtcctaataatagtaataagaatttgaggaatttgattttatcatttttcatcattatttcaccagctctatcagctccgcagaaaatacattctttaattgaagatagtcctaaggaggttatggatcaggtctggcaaataatataccgagattacatggattcaacaggaaaatatgatcaaaaagaatggtttaaggtaagaagaaaaatgctatctaataaatacgataattattcacaagcttatgagtcaattcgcgtcatgttatcgagtttggaagatccttatacgcgatttttagaacctaaggaatttaatgagatgagaatagatacttctggagaacttacaggtattggaatacaaatatctattgatgagaaaaataatgatgtactagttatttctcctattgaaggtacacctgcctttcaagctggcataaaggcaaaagataaaattatatctatagatggaactttaacaaaaggtatgagtatagaaaatgttgttaagttgataaggggtaaaaaaggtaccgaagttaaattaggaatttcaagagataatcaattttttaaattaactttagtcagggccagaattgaaattcgtactgtcgtaagtaggatcaataaatcaagctctggcaatcattttggatatatacgcttaaaacagtttagtgcaaatgcagctaaggaaatgcgaaaagcattaatctcattggaaaggaatgatcctgatgcttatattattgatgtaagagggaacccgggtggattactggaggcaagtatagatatctcgaggcaattgttagataaaggagtaattgtaagtactaaaacaaaggatgggattactgatgttagaagagccagaggaaatgctttgacacataagcctattgctattttagttaatgaaggttcagcaagcgcaagtgaaatcttgtcaggagctatccaagataataaaagaggaattttaattggtaaaaagacatttggtaagggtcttgttcaatcagttagaccattggttgatggttcaggattaactgttactgtcgctaagtaccttactcctcgcggtactgatattcataaatacggaatcgttcctgatattgaagtggaattgaaatctataaaaggtaatagattttctagcattgatcttggtacagaaaaggatagtcaatattcagtagctgaatcggctttaattagactattaaaaaagtttcaagataaaaaagcttatttgcctaatagctctaactttgaagttgccatatcctctaaataa

SEQ ID NO: 40841 - protein, 447 aa, Prochlorococcus marinus subsp. marinus str. CCMP1375
MFNLTFKNCPNNSNKNLRNLILSFFIIISPALSAPQKIHSLIEDSPKEVMDQVWQIIYRDYMDSTGKYDQKEWFKVRRKMLSNKYDNYSQAYESIRVMLSSLEDPYTRFLEPKEFNEMRIDTSGELTGIGIQISIDEKNNDVLVISPIEGTPAFQAGIKAKDKIISIDGTLTKGMSIENVVKLIRGKKGTEVKLGISRDNQFFKLTLVRARIEIRTVVSRINKSSSGNHFGYIRLKQFSANAAKEMRKALISLERNDPDAYIIDVRGNPGGLLEASIDISRQLLDKGVIVSTKTKDGITDVRRARGNALTHKPIAILVNEGSASASEILSGAIQDNKRGILIGKKTFGKGLVQSVRPLVDGSGLTVTVAKYLTPRGTDIHKYGIVPDIEVELKSIKGNRFSSIDLGTEKDSQYSVAESALIRLLKKFQDKKAYLPNSSNFEVAISSK

SEQ ID NO: 40842 - DNA, 1938 bp, Chlamydophila pneumoniae TW-183
  CDS (1)..(1938)
atgaaaaaacttgtccgtctatgcgtagttcttctttctttacttccgaatgtattattttcttcggatcttttacgagaagagggcatcaaaaagatgatggacaagctgatcgagtatcatgtcgatgctcaagaggtttctacggatatactctcgcgttctttatctagttacattcaatcttttgatcctcataaatcttatctttcaaaccaagaggttgcagtttttctacagtctccggaaacaaagaaacgtctcttaaagaattataaggcaggcaactttgctatttatcgcaacatcaatcaattgattcatgagagtattcttcgtgccaggcagtggagaaacgaatgggttaagaatccaaaagagcttgtattggaggcatcctcatatcagatatcgaagcaacctatgcaatggagcaaatctttagacgaagtgaagcagagacaacgcgctctactcctttcctatctttctttacatcttgctggagcttcttcctctcgttatgagggtaaagaagagcagcttgctgctctgtgtctacgtcaaatcgagaaccatgagaatgtatatttaggtatcaatgatcatggtgttgctatggatcgggatgaagaagcctaccaattccatatccgtgttgttaaagctttagctcatagcttagatgcacatacggcgtatttcagtaaggacgaagcgttggcgatgcgaatccaactagaaaaaggcatgtgtggaattggtgttgttctgaaggaagatattgatggagttgttgttagagaaatcattcctgggggacctgcggctaaatctggggatcttcagcttggagatatcatctatcgggtggatggcaaggatatcgagcatctttctttccgcggtgttttagattgtttacgtggaggtcatggctctactgtagtcttagatatccatcgtggggagagcgatcatacgatcaccttgagaagggagaaaatccttttagaagaccgtcgtgtggatgtttcctatgagccttatggagatggtgtgattgggaaagttacgttacattctttttatgaaggagaaaatcaggtttctagtgaacaagatctacgtcgagcgattcagggattaaaggagaagaaccttcttggattagttctagatatccgagaaaatacgggtggatttttatctcaagcgatcaaagtttctggtttatttatgaccaatggcgttgtggttgtatctcgctatgctgatggtaccatgaagtgctaccgcacagtatctcctaaaaaattctatgatggtcctttggctattttagtatctaaaagttccgcatcagcagcggagattgtagcacaaactctccaagattatggagttgctttagttgttggagatgagcagacctatgggaagggaacgattcagcatcaaacaattactggagatgcctctcaggacgattgttttaaggttactgtagggaaatattattccccttctgggaaatcgactcaacttcagggagtaaaatccgatattttaattccttctctctatgctgaagatcgtctaggagagcgttttctagagcatcccttacctgcagattgctgtgataatgtacttcacgatcctctcacggacttggatactcaaacacgtccttggtttcaaaaatactatcttcctaatctacaaaagcaagagactctttggagagagatgctacctcagcttacgaaaaacagtgagcaaaggctttctgagaattcgaattttcaggcatttttgtcgcagataaaatcatctgaaaaaacggacctatcctatggttccaatgatttacaattggaagagtcgataaacattttgaaggacatgattttattacaacagtgtagaaaataa

SEQ ID NO: 40843 - protein, 645 aa, Chlamydophila pneumoniae TW-183
MKKLVRLCVVLLSLLPNVLFSSDLLREEGIKKMMDKLIEYHVDAQEVSTDILSRSLSSYIQSFDPHKSYLSNQEVAVFLQSPETKKRLLKNYKAGNFAIYRNINQLIHESILRARQWRNEWVKNPKELVLEASSYQISKQPMQWSKSLDEVKQRQRALLLSYLSLHLAGASSSRYEGKEEQLAALCLRQIENHENVYLGINDHGVAMDRDEEAYQFHIRVVKALAHSLDAHTAYFSKDEALAMRIQLEKGMCGIGVVLKEDIDGVVVREIIPGGPAAKSGDLQLGDIIYRVDGKDIEHLSFRGVLDCLRGGHGSTVVLDIHRGESDHTITLRREKILLEDRRVDVSYEPYGDGVIGKVTLHSFYEGENQVSSEQDLRRAIQGLKEKNLLGLVLDIRENTGGFLSQAIKVSGLFMTNGVVVVSRYADGTMKCYRTVSPKKFYDGPLAILVSKSSASAAEIVAQTLQDYGVALVVGDEQTYGKGTIQHQTITGDASQDDCFKVTVGKYYSPSGKSTQLQGVKSDILIPSLYAEDRLGERFLEHPLPADCCDNVLHDPLTDLDTQTRPWFQKYYLPNLQKQETLWREMLPQLTKNSEQRLSENSNFQAFLSQIKSSEKTDLSYGSNDLQLEESINILKDMILLQQCRK

SEQ ID NO: 40844 - DNA, 1446 bp, Bordetella pertussis Tohama I
  CDS (1)..(1446)
atgagcactcgcaagtttcgtggtttcggtctggtagccatcggtgcggtggcgggcatcctgctgagcgtgggcgtgtccgcggtcgcacagcgcggcagtcccctgccgctcgatgaactgcggcagctcagcaatgtgttcgcggccatcaagaacaactatgtcgaggcggtcgacgacaagacgctgatcggcaacgcgatctccggcatggtgtccaacctggacccgcactctgcctacctggatgccgacgctttccgggaaatgcagacggccacgcagggcgagttcggcgggctgggcatcgaggtcggcgccgaagacggcttcgtgaaagtcatctcgcccatcgaggacacgccggccgcgcgcgccggcatccaggcgggcgacctgatcatcaagatcgacgacacgcccaccaagggcatgtcgctcaacgacgcggtcaagctgatgcgcggcgcgcccaagtcgcccatcacgctgacgatcatgcgcgccgaccggccgcagcccatcgtggtcaagatcgtgcgcgacatcatcaaggtgcgcagcgtgcgcagcaagatgctggacagcaacgtggcctacctgcgcatcgcgcagttccaggagaagaccggccccgatctggcgcgccatctgaaggaactcggcgccaagggtgcgcccaagagcctggtgctggacctgcgcaacgatccgggcggcctgctgaccagcgccatcggcgtggccggcgccttcctgccgcccgacgccctggtggtgtcgaccgacggccgcacgcccgattcgcgccacaagtaccgcgccacgcccagcgaatacgcgcgcggcgaaggcaattacctcaacgacctgccgggctgggtcaagaccgtgccgatggtggtgctggtcaacgtgggttcggcttccgcctccgagatcgtggcgggggcgctgcaagaccacaagcgcgccaaggtgctgggcaaccgcacgttcggcaagggctcggtgcaggtcatcctgccgttgagcgaaagcacggcggtcaagctgaccacgtcgcgctacttcacgcccagcggccgctcgatccaggccaccggcatcgaacccgactacgtcgtggccgataccgccgacggcgatctgttccgcctgccgcgcgaagccgacctgcagcgccacctgtcgaaccagcaaagccccgacgccgaggtcaagtcgaacaacgacgacaacaccgaagtggccggcaaggcgttcgagttcggcggcaaggacgacttccagctgcaacaggcgctgaacctgctggccggcaagccggtacagaaaggttcggcccgcgcgcaggccaaggccgacatcaaacccagcgaaggcaagacccagcgcatgacgatcacgccgactggtgtggagcccgccaagagcaaatga

SEQ ID NO: 40845 - protein, 481 aa, Bordetella pertussis Tohama I
MSTRKFRGFGLVAIGAVAGILLSVGVSAVAQRGSPLPLDELRQLSNVFAAIKNNYVEAVDDKTLIGNAISGMVSNLDPHSAYLDADAFREMQTATQGEFGGLGIEVGAEDGFVKVISPIEDTPAARAGIQAGDLIIKIDDTPTKGMSLNDAVKLMRGAPKSPITLTIMRADRPQPIVVKIVRDIIKVRSVRSKMLDSNVAYLRIAQFQEKTGPDLARHLKELGAKGAPKSLVLDLRNDPGGLLTSAIGVAGAFLPPDALVVSTDGRTPDSRHKYRATPSEYARGEGNYLNDLPGWVKTVPMVVLVNVGSASASEIVAGALQDHKRAKVLGNRTFGKGSVQVILPLSESTAVKLTTSRYFTPSGRSIQATGIEPDYVVADTADGDLFRLPREADLQRHLSNQQSPDAEVKSNNDDNTEVAGKAFEFGGKDDFQLQQALNLLAGKPVQKGSARAQAKADIKPSEGKTQRMTITPTGVEPAKSK

SEQ ID NO: 40846 - DNA, 1290 bp, Prochlorococcus marinus subsp. pastoris str. CCMP1986
  CDS (1)..(1290)
atgaattcatcttttaacaaatttttaatattcaaaaaatggatcataatcataatgatctgtattttttctaccaattttttttatattccaagcgccgatgcgcttagtgatagcaagcaatttgtgcttgacgcttggacgttagtaaatgagggatattatgatccagaaaggcttgatgaactccagtggaaaaggattagacaaaaaacattacagaaacaaattgaaacaagtgaagaggcttattccgcaattgaagatatgttgaaacctcttgaagatccttttacaagaatattaaagccaaaagattatgaacttctcaaaacaagcaattttggaagcgaaataaatggagtaggacttcaattaggagaagatgaaataactaaagaaatcaacgttatttcgacattagcgggatctccagccgaagaagcagggataattagtggagatcaaatagttaaggttgatggaatatcttgttccgagttaggtttggcaaatactgcatcaaaacttagaggagaatctggaacaaaggttcttgttcaaattaaatctatctctgatgagactaaagaaattgatttagaaagaagatcagttgatcttagaccagtaagaacaaagagattgagagatgactctcatacaattggatatttaagaataactcagtttagtgaaagtgttccaaaaaaaattgaagaggctctgcaggaactcaaagataaggaagttgagggggtaatacttgatttaaggaataactctggcgggttagtaagttctggaattgcagttgcagactcatttctaagcgaaaaaccaattgtagaaacaaaagatagaaatggcattaaggatgcaataatttctcagaaaaatacttcttttgagggtccgatggtgactttagtaaacaaaggtactgcaagcgcaagtgaaatcctggcaggatccctgcaagataataatagatcaactttaatgggtgaacaaacttatgggaaaggacttattcagtctttgaaaagtttaggtgaagacagtggtatcgctattactgttgccagttatttaacacctcagggtaataatattcagggtaagggtataactcctgataaaattttaggcctacccgaggctagggaatacggcaattctgaggataaatgggtaaaaaatgcagagatattcctaaacgctttatttgatgaaaatgatgtcgaagataaagtaaatgaactagaaaacaaagacattgaaaattaa

SEQ ID NO: 40847 - protein, 429 aa, Prochlorococcus marinus subsp. pastoris str. CCMP1986
MNSSFNKFLIFKKWIIIIMICIFSTNFFYIPSADALSDSKQFVLDAWTLVNEGYYDPERLDELQWKRIRQKTLQKQIETSEEAYSAIEDMLKPLEDPFTRILKPKDYELLKTSNFGSEINGVGLQLGEDEITKEINVISTLAGSPAEEAGIISGDQIVKVDGISCSELGLANTASKLRGESGTKVLVQIKSISDETKEIDLERRSVDLRPVRTKRLRDDSHTIGYLRITQFSESVPKKIEEALQELKDKEVEGVILDLRNNSGGLVSSGIAVADSFLSEKPIVETKDRNGIKDAIISQKNTSFEGPMVTLVNKGTASASEILAGSLQDNNRSTLMGEQTYGKGLIQSLKSLGEDSGIAITVASYLTPQGNNIQGKGITPDKILGLPEAREYGNSEDKWVKNAEIFLNALFDENDVEDKVNELENKDIEN

SEQ ID NO: 40848 - DNA, 1290 bp, Prochlorococcus marinus subsp. pastoris str. CCMP1986
  CDS (1)..(1290)
gtgacaactttttctgggctattggtgagtaatcattcaaaggcgacaattttagaaaataactataaagaggttattgatcacgtttggcaaatagtatatagagacttccttgattcaagtgggaaatttgagagatctaattggattaatttaagaaaggaatttttagcaaaaaaatattcagataataatgaagcttatgatgcaattagagatatgctttcaaatttagatgacccatatacaagatttctagacccaaaagaatttaatcaaatgagaatagatacttcaggagaattaactggagtcggaatacaaattgctaaagataatgaatctgattctataattattatttctcctatagagggaactcctgcttatgaggctggaattaaagctaaagatattattttatcaatcgataatgtatctactaaagggttgaatattgaggatgcagttaaattaataaggggcagaaggggtacaaaagttaaacttgaaatcctaagaaatgggaattctttttacaagtccttattaagagaaaggatagaattaaaatcagtgacaagcaaaatcaataaaactaaagatggattattaataggttacgttagattaaagcagtttaatgctaatgcatcaagagagatgaaagatacattaaaagatttagaaataaaaaaagtttctggatatgttcttgatttaagaagtaatcccggaggattattagaatctagtattgatatttctcgtcaatttattgataaaggcataatcgtaagcaccttatctaaagatggtttgagagaaacaaaaagaggaaatggtaaggctttaacaaaaaaacctttaattgtacttgtcaatgaaggttcggcgagtgcaagtgaaatagtctccggagcaataagagataataacagaggtaaattagtaggtaagaaaactttcggcaaaggccttgttcagtctatgcgaactttggtggatggttcagggttaacagttacggtggcaaaatacttaactcccaatggaacggatataaataagtttggaattactccggatatagaagtcaagatgaattccaatccaattcttcaaagagaaattggtactaaaagagatagacaatatagagctggtgagaaagaacttcttaaaattattaaaaaaactaaattagtaagtcagtttcaacctgattctgcaaatgtattagctgtttttaaaaataatgaaaataatttcgtttattcattgaattag

SEQ ID NO: 40849 - protein, 429 aa, Prochlorococcus marinus subsp. pastoris str. CCMP1986
MTTFSGLLVSNHSKATILENNYKEVIDHVWQIVYRDFLDSSGKFERSNWINLRKEFLAKKYSDNNEAYDAIRDMLSNLDDPYTRFLDPKEFNQMRIDTSGELTGVGIQIAKDNESDSIIIISPIEGTPAYEAGIKAKDIILSIDNVSTKGLNIEDAVKLIRGRRGTKVKLEILRNGNSFYKSLLRERIELKSVTSKINKTKDGLLIGYVRLKQFNANASREMKDTLKDLEIKKVSGYVLDLRSNPGGLLESSIDISRQFIDKGIIVSTLSKDGLRETKRGNGKALTKKPLIVLVNEGSASASEIVSGAIRDNNRGKLVGKKTFGKGLVQSMRTLVDGSGLTVTVAKYLTPNGTDINKFGITPDIEVKMNSNPILQREIGTKRDRQYRAGEKELLKIIKKTKLVSQFQPDSANVLAVFKNNENNFVYSLN

SEQ ID NO: 40850 - DNA, 1362 bp, Prochlorococcus marinus str. MIT 9313
  CDS (1)..(1362)
atgcccatctctagaagtcttcgctcattaggccgccagcgcagttcatggctggtccttctgggcgcgggaggagctgctactgcaattgcacttgcctctccaagtttgggtttaccaaggagttcttcttccgctattagtgatagccccaaagaggtgattgatcaggtctggcagattgtatatcgtgactatcttgattccacaggtaaatataaccctgaagtatggaagggactacgcaaggacttattagccaagaactattcagccacttcagaatcctatgaagcgatccgtggcatgttagcaagcttggatgatccctatacacgattcttagatccaaaggaatttaaggaaatgcagatcgacacctcaggagaattaacaggtgttggcatccagctttctctagacaaggatacaaaagaattagttgtggtttcaccaatcgaaggaactcctgcctctaaggctggtgtccaacctaaggatgtgatcgttttcattaatggacaatccactaagggcatgtctacagcggatgctgttaagttgattcgtggtaaagaaggtagtgaggtcacccttggtctgcgtcgcaggggtgaagttatccaggtcccgttgatacgtgcacgcattgagatacaggcagttgatatccagttaaatacgacagtaagtggtacaaagattggttatatccgcctgaaacagtttaatgcccatgcagctaaaggaatgcgaagtgctatcaagaatttagaaaaagagggtgcgcaaggctatgtactcgacttgcgtagtaatcctggaggtttgcttgaagccagtattgatatcgcacgccaatggcttgatgaaggtacaattgttcgaacaaaaactcgtgatggcattcaagatgtacgccgagcgaatggaagtgccttaacccaacgccctgttgttgttttggtgaatgaaggctcagcaagcgcaagtgagatcctctctggagcactacaagacaatcatcgtggtgtacttgtaggacagaagacctttggcaagggcttggttcaatcagttcgaggcctttctgatggctctggtcttactgtcacgatcgctaagtatctcactccaagcggaacggacattcataaaaatggtatcaagccagatattaaggccgtgatgtctgaaaaagaaatcaataatcttaagcttgaggatcttggttctgggaaggatagtcaatacaaggtggccgaaacaacactaattaaagccctaagcaaaatacttgatggaccaatgtataagcctgtaggagttaaacttcctcaggctattccatcaacgctataa

SEQ ID NO: 40851 - protein, 453 aa, Prochlorococcus marinus str. MIT 9313
MPISRSLRSLGRQRSSWLVLLGAGGAATAIALASPSLGLPRSSSSAISDSPKEVIDQVWQIVYRDYLDSTGKYNPEVWKGLRKDLLAKNYSATSESYEAIRGMLASLDDPYTRFLDPKEFKEMQIDTSGELTGVGIQLSLDKDTKELVVVSPIEGTPASKAGVQPKDVIVFINGQSTKGMSTADAVKLIRGKEGSEVTLGLRRRGEVIQVPLIRARIEIQAVDIQLNTTVSGTKIGYIRLKQFNAHAAKGMRSAIKNLEKEGAQGYVLDLRSNPGGLLEASIDIARQWLDEGTIVRTKTRDGIQDVRRANGSALTQRPVVVLVNEGSASASEILSGALQDNHRGVLVGQKTFGKGLVQSVRGLSDGSGLTVTIAKYLTPSGTDIHKNGIKPDIKAVMSEKEINNLKLEDLGSGKDSQYKVAETTLIKALSKILDGPMYKPVGVKLPQAIPSTL

SEQ ID NO: 40852 - DNA, 1338 bp, Synechococcus sp. WH 8102
  CDS (1)..(1338)
atgcccagcgccaaaggtttgcgcggcgttctgcgttcaggtccgcttctgctgatgctggggctcgggggcatggccgtttcgatggcgggtccaagccttggtctgacgggggcgagcggcggtgcaatcaccgatagccccaaggaggtgatagatcaggtttggcagatcgtgttcagggattatctcgattccaccggcgcctacagcgatgctcgctggcgtcagctgcgtaaggatctgcttgctaagtcctacgccggagacgaagagtcatacgaagcgatccgagggatgttgtccagcctggatgacccctacacgcgctttcttgatcccaaggaattcaaggaaatgcggatcgatacttcaggagagctgatgggggtcggtatccagctgagtttggataaggacaccaaggagctgatcgttgtgtccccgattgaggggacgccggcatcccgtgctggggttcaacccaaagacgtgatcgtcagcattgacggtgcccccaccaaggggatgaccaccgaggaagcggtcaagttgatccgcggaccggaaggaacagaggtcattctgggacttcgtcgcaagggtgttgtcctcaatgtttctctgacccgtgcgcggatcgaaatccatgccgtcaaaaaagccctgaatacttcagctaacggcagtaagattggctatattcgattaaaacaattcaatgcaaatgcatcccgtgaaatgcgggcggcaattcaggacctcgatgagcagggtgctcagggatatgtccttgatctgcgcagtaatccgggcggacttcttgaggccagcattgatattgctcgtcagtggttgaacgaggggacaatcgtcagcacaagaacgcgggagggaattcgggatgtgcgacgggccaccggtagtgccatcaccgacaagccaatggttgtgctgattgaccaaggatcagcaagcgcgagtgaaattctttctggtgcattgcaggagaataagcgagctcaactcgtcggtcaaaaaaccttcggtaaaggccttgttcaggctgttcggggattgtccgatggctcagggatgacagtgacgattgccaagtatctcactccaaatggcactgatatccataaaaacggaatcaaacctgacgttgaggctgcaatgtcggaaaaagagatgaaagatttcaagattgaaaatcttggaacctcgaaagacagtcaataccgtgttgctgaaacaaccttaataaaagtactcagaatgcaaaaaaacgaggcttacaggcctggaagcgccaatctcaaagctgctttgtag

SEQ ID NO: 40853 - protein, 445 aa, Synechococcus sp. WH 8102
MPSAKGLRGVLRSGPLLLMLGLGGMAVSMAGPSLGLTGASGGAITDSPKEVIDQVWQIVFRDYLDSTGAYSDARWRQLRKDLLAKSYAGDEESYEAIRGMLSSLDDPYTRFLDPKEFKEMRIDTSGELMGVGIQLSLDKDTKELIVVSPIEGTPASRAGVQPKDVIVSIDGAPTKGMTTEEAVKLIRGPEGTEVILGLRRKGVVLNVSLTRARIEIHAVKKALNTSANGSKIGYIRLKQFNANASREMRAAIQDLDEQGAQGYVLDLRSNPGGLLEASIDIARQWLNEGTIVSTRTREGIRDVRRATGSAITDKPMVVLIDQGSASASEILSGALQENKRAQLVGQKTFGKGLVQAVRGLSDGSGMTVTIAKYLTPNGTDIHKNGIKPDVEAAMSEKEMKDFKIENLGTSKDSQYRVAETTLIKVLRMQKNEAYRPGSANLKAAL

SEQ ID NO: 40854 - DNA, 1422 bp, Chromobacterium violaceum ATCC 12472
  CDS (1)..(1422)
atgaagaaaatcgcatggttggtggcaggcgccatggccggtggcgtactgaccctcagcatgcaggcgctggccgacaaggaggcctcgccgctgccgctgaacgagttgcgcaccttcgccgaggtgttcagcctgatcaagcagagctatgtcgagccggtgacggacaagaagctgatagacgaagccatcaagggcatgttgaccggcctggacccgcactccgactacatggaccccgaggaattcaaggaactgcgcgaaggcacgcagggcgagttcggcggcctgggcatagagatcggcgccgaggacggcctggtcaaggtggtgtcccctatcgaggacaccccggcgcagaaggccggcatcaagagcggcgacctgatcatcaagatcgacgacactccggtgcgcggcctgtcgctgaacgacgcggtgaaaaagatgcgcggcaagccgggcagcaaggtcacgctgaccatcgcccgcaagaacgaggccaagccgctggtgttcacgctggcccgcgcggtgatcaagaccaagagcgtcaagtaccggatgctggagtcgggctacggctacgtgcgcatcgcccagttccaggaacacaccgccgaggacctggccgccggtctgcagaagctgtatcaggaaaacaagcagccgctgaaaggcctggtgctggacctgcgcgatgacccgggcggcctgctgaacggcgccgtcggcgtcgccgccgccttcctgcccaaggacaagctggtggtctacaccgagggccgcacgccggacgccaagatgcgcctgaccgccacgctgcagaattacgcgcgccagaacggcagcgatccgctggccaagctgccggtggcggtgcgcagcgtgccgctggcggtgctggtcaacggcggttcggcctcggcgtcggaaatcgtcgccggcgcgctgcaggaccacaagcgcgccgtgctggtgggcacgcaaaccttcggcaagggctccgtgcagtccatcctgccgctgggcagccagggcggcatcaagctgaccaccgcccgctacttcacgcctagcggccgctcgatccaggccaagggcatcacgccggacgtggtggccgaggacgcgacgctgaccgccgccgaccaggcgttgcgcgtgcgcgaggcggatctggaaaaccatctggccaatcccaacggcgacgacaagccggccaagacggccaaacccgccgccaagcctgcgcagccgcccgcgccggcgcccgttccggagggcaaggacaaggagccggccgcgccggacgcgcaaggcggacagcggatgccgaacccgaagagcgactaccagctgtcccaggcgctgaacgtgctcaaggtgcagcagatcctgcagaaaaacgagaactga

SEQ ID NO: 40855 - protein, 473 aa, Chromobacterium violaceum ATCC 12472
MKKIAWLVAGAMAGGVLTLSMQALADKEASPLPLNELRTFAEVFSLIKQSYVEPVTDKKLIDEAIKGMLTGLDPHSDYMDPEEFKELREGTQGEFGGLGIEIGAEDGLVKVVSPIEDTPAQKAGIKSGDLIIKIDDTPVRGLSLNDAVKKMRGKPGSKVTLTIARKNEAKPLVFTLARAVIKTKSVKYRMLESGYGYVRIAQFQEHTAEDLAAGLQKLYQENKQPLKGLVLDLRDDPGGLLNGAVGVAAAFLPKDKLVVYTEGRTPDAKMRLTATLQNYARQNGSDPLAKLPVAVRSVPLAVLVNGGSASASEIVAGALQDHKRAVLVGTQTFGKGSVQSILPLGSQGGIKLTTARYFTPSGRSIQAKGITPDVVAEDATLTAADQALRVREADLENHLANPNGDDKPAKTAKPAAKPAQPPAPAPVPEGKDKEPAAPDAQGGQRMPNPKSDYQLSQALNVLKVQQILQKNEN

SEQ ID NO: 40856 - DNA, 1524 bp, Porphyromonas gingivalis W83
  CDS (1)..(1524)
atgaaagaggccctacgtaagctggaaacggctgtgtatgctatcagcagcctgtatgtggacagtgtggacaacaacaagctgaccgaatatgccattcgaggggtcttgagcgaattggaccctcactctgtttattccgatgcagaggagacaaagagcgaattggagcctctaaatgccggattcgacggtataggcgtgcagttcaatatgctcacggatacggtctatgtggtacaggtgattgccggaggcccttcggaaaaggccggattgttggccggtgatcgcattgtatcagtggatgatactgtcattgcaggaatcaagatgaagaccaatgacgtgatgaaacgcttgcgtggtccgcgaggaagcaaggtcaaactcggcgtatggcgggggaacgacagactcaatatcaccgtcaagcgaggccttgtccctgttcatagccgcgaggcctgctatatggtcgacgaacgtacagggtatatcagactgagtagattttcgcgcactacctacgatgagtttgccgagggcatagctcttttgcgaggacgtggtatgcagcagttggtgcttgatctgagattcaatggtggcggtatacttgatcaggctgtggagatggccggaacttttctacccgaaggaagtacggtactgaccgtcagaaacaatcgtatgccacggatcagtgagcgcatggaggctacgagcaataacctcctcccgaaggacttgcctttggtcgttctcgtcaatgagttttcggcttcagccagcgagatattggccggggccatacaagattgggacagaggagtcgttatcggacggcgtactttcggcaaaggactggtacagcgtccattgccctttcaggatggttcgatgatccggctgactatcgcccgctattatacgccttcgggacgtagcatccagaaaccttatgcaaaagggaatttcaaagcatacgaacaggaattgatcggtcgcttcaaacacggcgaatccatccacagcgacagcatccgtttccccgattctcttcgctacaagactctcgtcacggggcgcaccgtttatggtgggggaggcattatgccggatcttttcatcccaacggatacggccttgttcaacaagctgcatcgcgagctgctgaacaagggtatctttaatcgggctgtactcaaatatgtggatgcacatcgtcagaagctgcgccaacgcttccccgacagacagtcatacgccacgtttagcattcccgaagaactgactgaaagcctgaaagcatttgccgaagctgagaaaatcacatggagcaccgaactttttgctcaagccgaagagcttatcaagtgtcagctccatgcctatatcgcacgtgatattctgggggagaacgacttcttctatttcttcaatcgcatggataaggaatatataaaagcactcgatctcctcaatgatcccgacgaatacaaacgtctcctcggaaagtaa

SEQ ID NO: 40857 - protein, 507 aa, Porphyromonas gingivalis W83
MKEALRKLETAVYAISSLYVDSVDNNKLTEYAIRGVLSELDPHSVYSDAEETKSELEPLNAGFDGIGVQFNMLTDTVYVVQVIAGGPSEKAGLLAGDRIVSVDDTVIAGIKMKTNDVMKRLRGPRGSKVKLGVWRGNDRLNITVKRGLVPVHSREACYMVDERTGYIRLSRFSRTTYDEFAEGIALLRGRGMQQLVLDLRFNGGGILDQAVEMAGTFLPEGSTVLTVRNNRMPRISERMEATSNNLLPKDLPLVVLVNEFSASASEILAGAIQDWDRGVVIGRRTFGKGLVQRPLPFQDGSMIRLTIARYYTPSGRSIQKPYAKGNFKAYEQELIGRFKHGESIHSDSIRFPDSLRYKTLVTGRTVYGGGGIMPDLFIPTDTALFNKLHRELLNKGIFNRAVLKYVDAHRQKLRQRFPDRQSYATFSIPEELTESLKAFAEAEKITWSTELFAQAEELIKCQLHAYIARDILGENDFFYFFNRMDKEYIKALDLLNDPDEYKRLLGK

SEQ ID NO: 40858 - DNA, 1710 bp, Porphyromonas gingivalis W83
  CDS (1)..(1710)
atgaaaaagaccaatctgtttttatctctgctggtgatctttatcaccggtagttttatgactgcctgtgcacagaagtccaagacgaacaaactcaccgaagaagatcggagccgcaatgagtatgtacagtcgatggatgtgcttagcaatattatcggtaacgtcaggctgtatttcgtcgataccataagtatcaaacatatgactcggcgtggtatagatgcgatgttgggcgggcttgacccctataccgaatacattccttacgaggaaatggatgaactgaaattgatgactacgggagagtatgccggagtcggagctatcatatcgcagcgcccggatagtgctgtgattatccagagacctatggaaggtatgcccgcagacgaagcaggattgatagcaggcgaccgcatcctgactatcgatgggaaagacttccgcaaatccaccacaccgaaagtaagccaagcactgaaagggatagccggtactgttgcaaaggtgacagtaatgcgctatggcgaaaccaaacctcgtactttttccgtgaaacgtcaaaaagtgattatgaattccgtcacttacagcggaatgctcgatggctcgataggatatatccgcttgaacaactttacggacaaaagtgcagaagaggtgcgcacggccttgttggatcttcgtgacaaacaaggagcgaaaggtctcattttggatttaagaggcaatggtggcggactgatgcaggctgctatcgagatagtcaatctgttcgtccctaagggcaaagaggtggtaacgaccaaaggtcgcattgcagagtcggcgtccgtatttcgcacattgactgaaccgatcgacacgaaactcccgatagtagtcctgatcgatggacaatcggcatcttcctcggagattgtagccggagcactgcaggatatggacagggctgtactgatgggacaaaagagctatggcaaagggcttgtacaaacgactcgtcagctaccatacaacggcgtgatcaaattgactacggccaagtactacatcccaagcggacgttgtattcagcgtttggactacagccgcaccaatcggacaggtatggcaacggccattcctgacagtctgcacaaaatcttttacactgctgccggaagacgtgtagaagatgcaggaggaatcctgcctgacatcgaggtcaaacaagatacagctgcgacattactttattatatggccatcaataatgacgttttcgatttcgtcacaggttatgtgctcaagcataaaacgattgccaagccggaggatttttccataacgaacgaggactatgcagctttctgcaagatgatggaagaaaagaaatttgactatgatcgccagagtggcaagatgcttgacaaactggaggaactggctaagatagaaggctacctgccggaagccaactcggagcttaaagcactacgcgaaaagctaaaacccaacctgtcgcgtgatctgctacgattcaaaaaggagataacaaactatctcaacaatgagattgtcactcgctattattatgagcgaggcagtatccgccagagtttgccggaagataaggtagtcaaagaagctattaagctgctgaaggaccatccggaacaaattcgacagatccttgcagctccgaaagcagagaataaagggtaa

SEQ ID NO: 40859 - protein, 569 aa, Porphyromonas gingivalis W83
MKKTNLFLSLLVIFITGSFMTACAQKSKTNKLTEEDRSRNEYVQSMDVLSNIIGNVRLYFVDTISIKHMTRRGIDAMLGGLDPYTEYIPYEEMDELKLMTTGEYAGVGAIISQRPDSAVIIQRPMEGMPADEAGLIAGDRILTIDGKDFRKSTTPKVSQALKGIAGTVAKVTVMRYGETKPRTFSVKRQKVIMNSVTYSGMLDGSIGYIRLNNFTDKSAEEVRTALLDLRDKQGAKGLILDLRGNGGGLMQAAIEIVNLFVPKGKEVVTTKGRIAESASVFRTLTEPIDTKLPIVVLIDGQSASSSEIVAGALQDMDRAVLMGQKSYGKGLVQTTRQLPYNGVIKLTTAKYYIPSGRCIQRLDYSRTNRTGMATAIPDSLHKIFYTAAGRRVEDAGGILPDIEVKQDTAATLLYYMAINNDVFDFVTGYVLKHKTIAKPEDFSITNEDYAAFCKMMEEKKFDYDRQSGKMLDKLEELAKIEGYLPEANSELKALREKLKPNLSRDLLRFKKEITNYLNNEIVTRYYYERGSIRQSLPEDKVVKEAIKLLKDHPEQIRQILAAPKAENKG

SEQ ID NO: 40860 - DNA, 1635 bp, Porphyromonas gingivalis W83
  CDS (1)..(1635)
atgaaacgttcatccggttccggcagcaccctctcatacatccttatcgctgccatcttcagcgccgttggtgctcttgcctcacatttctatttcactcacaagaatccgagcgatctgaatgaagtgttgaatctgatcgacagaaactatgtcgattcggtagatgtgcggaagttgcagcacaatatgattccctatctgctggagcagctcgaccctcactccgtattccttagcaaggccgacaacgccgaggaagctgccacgcttagcggcggattctgtggtatcggcgtttctttcaatacactgctggatactatcgtggttacgcagatcgtaccgggaggcccgtccgatcgtgcaggtatccgagccggcgaccgtttgcttcaggccggatcgcagaaactgtacggcaagggtgtcgatatgaacaccatcgacgatgtgcttcgtggagaaaaggggtcggtggtcaatatcctgatacggcgcaatggaaaggaatcggtgcatcgggtggtacgagacgatgttcctctgccctcgctcaatgctttttacctgatagaaccctccatagcctacgtgcgaatcgattcttggacaggtaccacacatgcggagttcatagaagccttgggacgtttgcgcaagaaaggggctacgagccttatcctcgatctgcgagaaaatcggggcggtttgctggagccggctattgccatggccaatgaatttttgggtaagaatctccccattcttcagatcgaaggcaaagcgtatccgcgtgaggagatttcgtccgatggcaaaggtatcttgcagcaaattcctctggtagtgctggtggatgagttctcggcaagcagcagcgaggtatttaccggtgccatgcaagaccatgaccgcgctcaaatcatcggtcgccggacgttcggcaagggactggtgcaactgccgttcgatttggcagatggttctgccatccgcctgaccgtagcacgctattatacgccatcgggacgctccattcagaagccgtattcttccggcgtagatgaaaattactatcaggatctgaggaatcgcttcaatcacggagagctatactcggccgacagcataccttcactgggaggaaagatattcaagacagccggtggccgcgaagtctatggtggcggtggcatcataccggatatttttatcccactggatacagccggtcttaattcctatatgatgaaagtggaggattcggatttgatccctcgctatgctttcctgtacagcgatgcgaacagggtttccttgagtcgttttaagacagtcgaggagttgggagcttatctggatcgtacttatctgattttcgactttgcttcttttgcccagcgttacggtatcccgatgcgtacttctttaatcaacgaagctcgcaaccgcataaaaaaatatatcaatgcatacattgcgatgaatttcttcgatctgcaggggtattatcaattgctgctgcatgatgatccttttatcctccaagccatttctctcatcaaagagggcaaaacttttccattgatttatgaccaaaaaggaactcagagcacagatccggcagcgtaa

SEQ ID NO: 40861 - protein, 544 aa, Porphyromonas gingivalis W83
MKRSSGSGSTLSYILIAAIFSAVGALASHFYFTHKNPSDLNEVLNLIDRNYVDSVDVRKLQHNMIPYLLEQLDPHSVFLSKADNAEEAATLSGGFCGIGVSFNTLLDTIVVTQIVPGGPSDRAGIRAGDRLLQAGSQKLYGKGVDMNTIDDVLRGEKGSVVNILIRRNGKESVHRVVRDDVPLPSLNAFYLIEPSIAYVRIDSWTGTTHAEFIEALGRLRKKGATSLILDLRENRGGLLEPAIAMANEFLGKNLPILQIEGKAYPREEISSDGKGILQQIPLVVLVDEFSASSSEVFTGAMQDHDRAQIIGRRTFGKGLVQLPFDLADGSAIRLTVARYYTPSGRSIQKPYSSGVDENYYQDLRNRFNHGELYSADSIPSLGGKIFKTAGGREVYGGGGIIPDIFIPLDTAGLNSYMMKVEDSDLIPRYAFLYSDANRVSLSRFKTVEELGAYLDRTYLIFDFASFAQRYGIPMRTSLINEARNRIKKYINAYIAMNFFDLQGYYQLLLHDDPFILQAISLIKEGKTFPLIYDQKGTQSTDPAA

SEQ ID NO: 40862 - DNA, 1320 bp, Wolinella succinogenes DSM 1740
  CDS (1)..(1320)
atgagcaagactaaatacgcattgaccggatttggcgccaccgttttatccctctcccttctcttctcttctagcttcgcccaaagccccagcgagagccaatcgaggcttgaggcttacaacaagctccgcaaggtgattggaaccgttgaaaactattatgtcgatgaggtgaccatcaatgagatcatcaacaaggcaatcgatggccttctctccaatctagacgctcactcctcctatctaaacgagaagaaatatgaggagctcaaagtccagaccgatggagaatttggcggtgttggaatcactattagcatgaaggatggggcgctcaccatcatctcccccatcgaggacacgccaggagataaggcaggtcttaaaagcggggatattatcctaaagattgacgacaagagcaccctcaacatgaccattgatgacgccatcaatctcatgcggggcaaacccaagacgaaggtgaagctcaccattgtgcgcaaaaatgagcccaaaccctttgttgtggatatcatccgagatgtgatcaaagtggaatctgtctatgctaagcgaatcgagaatagcgaaatgctctatgttcgcgtcacctcttttgacaaaaaagtaggcaagcgagtcgccgaggagctcaagaaagcctcttgggctaagggcgtggtgcttgacctcagaaacaaccccggcgggcttcttaaccaagcggttgagctcaccgaccttttcatcaacgaaggggtgatcgtctcccaaaaaggtcgaatctctagcgaagacgcagagtttaaggcaagcaaaaatagcccctttgcgcagattcccctagccgtgctcatcaacaatggaagtgcaagtgcaagcgagattgtcgcgggcgccctgcaagatcataagcgagcgattctagtcggcgaaaacacctttggaaaaggaagcgttcaggtggtgctccccttggataaaaacgaagggttgcggctcaccatcgctcgatactacctccccagtggacgcacgatccaagcccttggaatcacccctgatctcatcgtccacccaggtgtcgcccctcgagagaaaaaggatgatttcagtatcaaagaatcagagctcaaacaacacctggagaatgaactagaaaagattggcgacaagaaagaggtcaagaaagaggtcaaaagcgatgaggacaacaaaagtgtcatcagcgaagagaatctctggaatgatattcagctcaaaagcgccatggatgccctcaaaacatggagcatcatcaatcccgccaaaaaataa

SEQ ID NO: 40863 - protein, 439 aa, Wolinella succinogenes DSM 1740
MSKTKYALTGFGATVLSLSLLFSSSFAQSPSESQSRLEAYNKLRKVIGTVENYYVDEVTINEIINKAIDGLLSNLDAHSSYLNEKKYEELKVQTDGEFGGVGITISMKDGALTIISPIEDTPGDKAGLKSGDIILKIDDKSTLNMTIDDAINLMRGKPKTKVKLTIVRKNEPKPFVVDIIRDVIKVESVYAKRIENSEMLYVRVTSFDKKVGKRVAEELKKASWAKGVVLDLRNNPGGLLNQAVELTDLFINEGVIVSQKGRISSEDAEFKASKNSPFAQIPLAVLINNGSASASEIVAGALQDHKRAILVGENTFGKGSVQVVLPLDKNEGLRLTIARYYLPSGRTIQALGITPDLIVHPGVAPREKKDDFSIKESELKQHLENELEKIGDKKEVKKEVKSDEDNKSVISEENLWNDIQLKSAMDALKTWSIINPAKK

SEQ ID NO: 40864 - DNA, 1272 bp, Gloeobacter violaceus PCC 7421
  CDS (1)..(1272)
gtggaggccaacttggacaaaccgaacgatgcaaggcccgtccggttgcggcggcacgccgtctgggcggcggcactggcaagcgcggcgcttgccggttgctcggccgaggtgctctccagcaccgccggtcccgcccccaaagaggttctcaccgagacctggacttacatcaacaatgagtacgtcgatcccaagttcaacggccaggactggtggagtgtgcgccagacctatctcgaaaagcccgccgagaccagcgagcaggtctacgagcaaattgcctcgatgctcaagaccctcgacgatccgtacacccgttttttgaatcccaagcagttcaagagcctgcagacgaccaccagcggtgaactctccggggtgggtctgcagattaccctcgacaccgagagcgaactacccgtcgtcattgccgccgtcgaagggtcgcccgcctttcgaggcggtgtcaaagcccgcgatttgatcgtcgaaatcgacggccgaccgaccaagggtcaggccctcgacgacgtggccgaccggctgcgcggcaaaatcggctcccaggtgaatgtcggcttgcgccgcggcgagcgcaccttcgatgtcaccctcacccgcgagaccatccaggtcaacccggtcaccagccaactgaagcgcctcgacggccgacccatcggttatatccgcctgtcccagttcaacggcaacgccgcccaacaggtccgccaggcgatcgagaagctcgaagcccaggacgcggcgggctacatcctcgacctgcgcagcaaccccggcggtctattggaagcgggggtcgaaatcgcccgttattggctgacgccgggtcagaccgtcgtctacaccgtcaaccgccagggcgagcgcgaccaggcccgcgcccaacgcgctcccctcaccgcccggcctctggtggtgctcatcgacggcggtagtgcctcggcgagcgaaatcctggccggcgccctgcaggataaccgccgcgcccaactggtgggcaccaaatccttcggcaaagggctcatccaggccattcacccccttaaggacggctcgggtctggccgtttcgatcgcccgctaccagaccccgtcgcggcgggacatccacaaacaaggcatcgagcccgacgtgaaagtggaactgcccaagagcttctcgctggagcagttggccaccgacgccgacagccagtaccaggccggggcgaaggcgctctcccgcgccctggcttctagccagtaa

SEQ ID NO: 40865 - protein, 423 aa, Gloeobacter violaceus PCC 7421
MEANLDKPNDARPVRLRRHAVWAAALASAALAGCSAEVLSSTAGPAPKEVLTETWTYINNEYVDPKFNGQDWWSVRQTYLEKPAETSEQVYEQIASMLKTLDDPYTRFLNPKQFKSLQTTTSGELSGVGLQITLDTESELPVVIAAVEGSPAFRGGVKARDLIVEIDGRPTKGQALDDVADRLRGKIGSQVNVGLRRGERTFDVTLTRETIQVNPVTSQLKRLDGRPIGYIRLSQFNGNAAQQVRQAIEKLEAQDAAGYILDLRSNPGGLLEAGVEIARYWLTPGQTVVYTVNRQGERDQARAQRAPLTARPLVVLIDGGSASASEILAGALQDNRRAQLVGTKSFGKGLIQAIHPLKDGSGLAVSIARYQTPSRRDIHKQGIEPDVKVELPKSFSLEQLATDADSQYQAGAKALSRALASSQ

SEQ ID NO: 40866 - DNA, 1287 bp, Gloeobacter violaceus PCC 7421
  CDS (1)..(1287)
atgcaagatttctttcgaaagagtgtcctgctcacggtcatcctcagcctcgtcggctccgccgcggtgacggccgcccccaagcagcccgtcaagctgcgcgccgagtacgaagccaggctcgaagattcacccaaggcgatcgtcgatgaagtctggcagacggtggaccgcgagtttgtcgatccgaccttcaacaaacaaaactggatagcggcgcgcgagcagttgctgggccgcgactacaaaagcaaagaagaagcctacgaggcgattcgcaattccttgaaggtgctgggcgatccgtacacccgctttctcgacccgcgcgaatttcaggcgttgcgcgatcagaccagcggcgagctggtgggggtcggcatccaactgggggtctcccaggcgagcaaactgccggtggtggtcaaaaccctcgaagatagccccgccagccgctcgggcatccaggccaaagacgagttgctcgccgtcgacggcaaagcgaccgccaagctcgaaatcggtgaggtctcccggatgatccgcggcgatcgcggcacccaggtgacgctgtcggtgctgcgctcggggcagaagatgagttttacgatcacccgtgctccgatcgagctgaaggtggtcaccagctccctcaaagaagaaaatggccgcaaagtaggctacatccgccttgcggaattttctgaaaaggctcccaacgagatgcagcgggcctttgccaagctgagcgaagcaggggtgcaaggctgggtactcgacctgcgcggcaaccccggtggcctgctcgatgccgccacccgcgtggccagcctggtgctcgatcaaggcacgatcgtctcgacggtcgatcgcgccggcacccaggatcaactgaccgccgaccgccatccggtgaccaacctgcccctggtggtgctggtcgatcaaggttcggcctcggccagcgagattctcgccggcgccatccaggacaaccggcgcggcaccctggtgggcatgaagaccttcggcaaaggggtcatccagcaggtgaacgccctctccgacggttccggggtaaacgtcaccatcgcccactacctgaccccctccggcaacgacatccacaaaaagggcatccagcccgatgtggtcgtggcctttccggaggaggcgcgcaaggctcccatcgagcctgccaccggcgccgacatccagtaccagcgcgctgtgacggtgctggccaagctcatcgagaccaagccggccaccaacgcccgcaagtaa

SEQ ID NO: 40867 - protein, 428 aa, Gloeobacter violaceus PCC 7421
MQDFFRKSVLLTVILSLVGSAAVTAAPKQPVKLRAEYEARLEDSPKAIVDEVWQTVDREFVDPTFNKQNWIAAREQLLGRDYKSKEEAYEAIRNSLKVLGDPYTRFLDPREFQALRDQTSGELVGVGIQLGVSQASKLPVVVKTLEDSPASRSGIQAKDELLAVDGKATAKLEIGEVSRMIRGDRGTQVTLSVLRSGQKMSFTITRAPIELKVVTSSLKEENGRKVGYIRLAEFSEKAPNEMQRAFAKLSEAGVQGWVLDLRGNPGGLLDAATRVASLVLDQGTIVSTVDRAGTQDQLTADRHPVTNLPLVVLVDQGSASASEILAGAIQDNRRGTLVGMKTFGKGVIQQVNALSDGSGVNVTIAHYLTPSGNDIHKKGIQPDVVVAFPEEARKAPIEPATGADIQYQRAVTVLAKLIETKPATNARK

SEQ ID NO: 40868 - DNA, 1302 bp, Gloeobacter violaceus PCC 7421
  CDS (1)..(1302)
atggcgcagcggcttcgccgggtgctaccgcttttggtctggctcggggtgctttgggggccgggtgtgccgaccatccttgcccgacaggctgccgctgaggcacccattaagtcgcgcctggcggattcgcccaaggctctggtagacgaagtttggcagacggtcgggcgcgaattttatgacccggccttcaaccgaatcgactggctgcaggtgcgcagcgaactgctcggccgcgagtacgcctccaaagacgatgcctatcgggccgtccgcacggcgctcaaaaagctcggtgatccctacacccgctttttgaccccccgcgagtatcaaaacctgctggagcagaccagcggcgagtcgatcggggtggggatgaacctgggcacggtcgaaggcagcggggtgccggtgatcgtccggatttttccggacggccccgcggcccgggcaggactccaagtcaaagaccagatcgttgcggttgatcgccagtcggtggcggggttgagcctcgacacggtcagccggcgcgtccgcggcgagaagggcgccgtgctcaccctgacgctgcggcgcgggagcggcaagctgctcaccgtcaccctgacgcgcgccgccatcgaattgccggcgatcaaggcccggctgaagcaagagggcggtttcaagctgggctacatccagttgcagcaattcaacgccaaggccggtcgggaagtgcgcgccgccctcgacgtcctcgggggcgagggtgcccggggatggattttggatctgcgcaacaaccccggtggccgggtggatgccgccaccgaggtgaccagtctgctgctggccgaaggcgcaatcgtctcggtggtcgatcgcaccggtgagcgcgagacgatccgcgccaccggccgtgcccgcaccgacctgccgctggtggtcatggtggaccgcggctccgcctccgccagcgaaatcgtcgccggtgcgctgcaagatcaccgccgcgccaccctggtgggcatgccgacgtttggcaaaggggtcatccagcagatcaacggcctatcggacggctcgggtctcaacgtcaccatcgcccgctaccggaccccctccggccgggaaatccataaaaaagggatctccccggatgtcctggtgagcatcccggagggagtgcgccagaagctcaccgcctccgggcagtggggcagcgaggccgacgagcagtaccgccgggcggcagcggtgctcaccgaacagctgcaaaagaccatcggcctcgaggtgccggacggctga

SEQ ID NO: 40869 - protein, 433 aa, Gloeobacter violaceus PCC 7421
MAQRLRRVLPLLVWLGVLWGPGVPTILARQAAAEAPIKSRLADSPKALVDEVWQTVGREFYDPAFNRIDWLQVRSELLGREYASKDDAYRAVRTALKKLGDPYTRFLTPREYQNLLEQTSGESIGVGMNLGTVEGSGVPVIVRIFPDGPAARAGLQVKDQIVAVDRQSVAGLSLDTVSRRVRGEKGAVLTLTLRRGSGKLLTVTLTRAAIELPAIKARLKQEGGFKLGYIQLQQFNAKAGREVRAALDVLGGEGARGWILDLRNNPGGRVDAATEVTSLLLAEGAIVSVVDRTGERETIRATGRARTDLPLVVMVDRGSASASEIVAGALQDHRRATLVGMPTFGKGVIQQINGLSDGSGLNVTIARYRTPSGREIHKKGISPDVLVSIPEGVRQKLTASGQWGSEADEQYRRAAAVLTEQLQKTIGLEVPDG

SEQ ID NO: 40870 - DNA, 1338 bp, Gloeobacter violaceus PCC 7421
  CDS (1)..(1338)
atgaagacgcctaagtttttgctgccggtcggccttgcctgcgcgaccgttctgagtttgttgagcgcgtttaatatgcccagttgggccaactttaaagacgcgccgaaggagatcatcgacgaagtctggcaggtggtcaaccgcgagtacgtcgatcccacctttaacaaccagaactggcaggagacccgccgcaagtacctggccaaagactataaaagccgcgaggacgcttacaagagcacgcgcgagatgcttaagggcctgggcgatccgtacacgcgctttatggaccccaagcagtacgagagcatgaaagtcgagaccagcggcgactaccagggggtgggtatccagctgggcctcgatgagaagacccacgaactgacagtagtctcacccatcgaggacacgcctgcgtttactgccggggtcaaacccaaagacgtgctcctttcgatcgacggccgttccaccaagggcatggatatcgatcaggcggtcaattttattcgcggccaggcgggcaccagcgtcgcgctcaaatttcgccgcgaaggcaaaccgctcaccctgtcgctggtgcgcacccgcatcgaactcaaacccgtcaaatattcgctgcgcaccgagggcgaccggcgcgtcggttatattcgtctgtcgcagttcaacgcctacgccgccaaggatatgggcaacgccgtggcgaaactcacccgcgagcaggccgacggcttcatcctcgatctgcgcagcaaccccggcgggcttctctacgccagcgccgacatcgcccggctgtggctctccgagggcacgatcgtctcgacggtggatcgcgacggccagcgcgagagcatcaccgtgagccgccccgccatgaccagcaaacccttggtggtactggtggacggtgcttccgcctcggccagtgaaattttgggcggcgcgctgcaggaccatcaccgggcggtgctggtgggcacgcgcacctacggcaaggggttggtgcagtcggtgcattcgctctcggacggttcgggggtggcggtgaccatcgcccactaccagacaccctccggccgggacatcaacaaaaaaggcatcgacccggacatcaaagtcgagctcaccaaagagatggccaagaacctcaaggccgaccaggtggccaccctcgccgacccgcagtacgcccgcgccgtcgatgtgctcggccagcaaatcgccgggatgcccgtcgagcaggtggtggcggcggccggcaaacctttccctgccgagcgccagccggtggccgccgagaaccagacgccggtggcgacgccatga

SEQ ID NO: 40871 - protein, 445 aa, Gloeobacter violaceus PCC 7421
MKTPKFLLPVGLACATVLSLLSAFNMPSWANFKDAPKEIIDEVWQVVNREYVDPTFNNQNWQETRRKYLAKDYKSREDAYKSTREMLKGLGDPYTRFMDPKQYESMKVETSGDYQGVGIQLGLDEKTHELTVVSPIEDTPAFTAGVKPKDVLLSIDGRSTKGMDIDQAVNFIRGQAGTSVALKFRREGKPLTLSLVRTRIELKPVKYSLRTEGDRRVGYIRLSQFNAYAAKDMGNAVAKLTREQADGFILDLRSNPGGLLYASADIARLWLSEGTIVSTVDRDGQRESITVSRPAMTSKPLVVLVDGASASASEILGGALQDHHRAVLVGTRTYGKGLVQSVHSLSDGSGVAVTIAHYQTPSGRDINKKGIDPDIKVELTKEMAKNLKADQVATLADPQYARAVDVLGQQIAGMPVEQVVAAAGKPFPAERQPVAAENQTPVATP

SEQ ID NO: 40872 - DNA, 2052 bp, Photorhabdus luminescens subsp. laumondii TTO1
  CDS (1)..(2052)
atgaacaaattcgtcagactggcttttgtcttaggtgtttcaatttttggtacttgttatgcaaatacaaacagtccagtggctgttcctgttggtattgaacaattacctatattgaagcaagaacctcagcattcaacagttagcgagcgggtaacatcccgcttcactcgttctcattatcgccaatttgatttaaatggtgatttttcggcaaaaatatttgaccgctatctcaatatactggattacagccataacatattattggcgtcagatgttgctcagtatgccgataagaaaaagttgttaggcaaggaattggaaaatgggaatctggaaattccgtatgacttgtttaatttgttacagaaacgtcgctttgagcgttatcagtacgctttatcgcgtcttgaacagccaatgagttttgatggtaacgatacaattgatgttgatcgttccaaagccccttggccacagagtgtggaagagctaaataaactttgggatgctaaagttaaatatgattggctcaacctcaagctcagcggcaaagaggacaataaaatcaaagagatgcttaccaaacgctatcaatccgcgttaaaacgtctgacacaaagccagagtgaagatgttttccaattgattatgacagcgtttgcccgtgaaattgatcctcataccaattatctttcaccacgcaatactgaacagtttaactcagaaatgagtctttccctggaagggattggtgctgttttgcaaatagatgatgactacacggttataaattctttggttgctggtggacctgctgctaaaagcaaagcactaaacgtaggtgataagattatcggcgttgcccagtcaggaaagtctatggtggatattattggctggcgtttggatgatgtggttgcgctgattaaaggacctaaagggagcaaagtacggcttgaggttgtttctgataccaaaggggcaaaaccacgtactgttattttaactcgcgaacagatccgtttggaagatcgggctgtgaagatgtcagttaagacaatcggtcaggaaaaagtgggcgtgcttgatatccccggtttttatgttggtttgactgataatgttaaaactcaattacaaaaactgaccaaacagcatgtcagtgctattgtcattgatttgcgtagcaatggtggtggtgcactgacagaggcggtttctttatcaggcttgtttctgccaagtggcccggttgtccaggttagagataataatgggaaagttcgtcaggattctgatactgatgaagtggtgtactataaaggacctttggttgttctggtggaccattttagtgcttctgcttctgaaatttttgccgcagcaatgcaggattatgggcgagcgttgattgttggtgaaccgacttttggtaaaggtacagttcagcaataccgttctttgagtcgtatttatgatcaaatgatgcgccctgattggccatcactggggtctgtccaatatacgattcagaagttttatcgtgtggatggcggtagtactcagcgtaaaggggtgactcctgatatcgtaatgcctacgggggttgatccggcagaaaccggcgaaagtttcgaagataatgctttgccttgggatagcattcctcctgcccgttatacagggtctaaagttattgctgcattggttcctcagttgaatgttgttcacaatatccgcattacaactgatccagaattcaagtatatcaatgaggatattgctcactataaggcgctgaaagagcataaaaatattgtttctctgaactatgcacaaagagaaaaagaaaataaagaagcggatgctctgaagttgaatcgcataaatgatcgctttaaacgcgaaggtaaaaaaccgttaacttcactggatgatttgcctaaagattatcaggggccagatccctatcttgatgaatcagtgaagattgcacttgatttagcgcaccaacctgctgagaaaatgttggctaaatctaagtaa

SEQ ID NO: 40873 - protein, 683 aa, Photorhabdus luminescens subsp. laumondii TTO1
MNKFVRLAFVLGVSIFGTCYANTNSPVAVPVGIEQLPILKQEPQHSTVSERVTSRFTRSHYRQFDLNGDFSAKIFDRYLNILDYSHNILLASDVAQYADKKKLLGKELENGNLEIPYDLFNLLQKRRFERYQYALSRLEQPMSFDGNDTIDVDRSKAPWPQSVEELNKLWDAKVKYDWLNLKLSGKEDNKIKEMLTKRYQSALKRLTQSQSEDVFQLIMTAFAREIDPHTNYLSPRNTEQFNSEMSLSLEGIGAVLQIDDDYTVINSLVAGGPAAKSKALNVGDKIIGVAQSGKSMVDIIGWRLDDVVALIKGPKGSKVRLEVVSDTKGAKPRTVILTREQIRLEDRAVKMSVKTIGQEKVGVLDIPGFYVGLTDNVKTQLQKLTKQHVSAIVIDLRSNGGGALTEAVSLSGLFLPSGPVVQVRDNNGKVRQDSDTDEVVYYKGPLVVLVDHFSASASEIFAAAMQDYGRALIVGEPTFGKGTVQQYRSLSRIYDQMMRPDWPSLGSVQYTIQKFYRVDGGSTQRKGVTPDIVMPTGVDPAETGESFEDNALPWDSIPPARYTGSKVIAALVPQLNVVHNIRITTDPEFKYINEDIAHYKALKEHKNIVSLNYAQREKENKEADALKLNRINDRFKREGKKPLTSLDDLPKDYQGPDPYLDESVKIALDLAHQPAEKMLAKSK

SEQ ID NO: 40874 - DNA, 1377 bp, Rhodopseudomonas palustris CGA009
  CDS (1)..(1377)
atgatgcgcaagacttcggtaatcctcctcagcgccgtcaccggtgccgcgctgacacttttcgtcacccaacctcgcacgatgctgatgggcgccaccgcccgcgccgccacctccgacacctaccgccagctcaacctgttcggcgacgtgttcgagcgcgtgcgcagcgactacgtcgagaagccggacgactccaaactggtcgaatccgccatcagcggcatgctggccgggctcgatccgcattccagctacatggatgccaagagcttccgtgacatgcaggtgcagacccgcggcgaattcggcggcctcggcatcgaagtcacgatggaggacggcctgatcaaggtggtgtcgccgatcgacgatacgcctgcgtcgaaggccggcattctggctaacgacatcatcaccaatctcgacgacgaggcggtgcagggcctgaccctgaaccaggcggtcgagaagatgcgcggtccggtcaacaccaagatccggctgaagatcgtccgcaagggccaggacaacccgatcgaagtcacgctggtacgcgacaacatccgcgtccgctcggtgcgcgcgcgcgtcgaagacagcgacatcggctacatccgcatcacgaccttcaacgagcagaccaccgaagggctcaagaaggagattgcgaacctgaccaaccagatcggcgccgacaagctgaagggcttcatcctcgatctgcgcaacaacccgggcggtctgctcgaggaagccgtgacggtgtcggacgcgttcctggatcgcggcgagatcgtctcgactcgcggccgcaacgccgaagagacccagcgccgctccgcgcatgcgggcgacctcaccaagggcaagccggtgatcgtgctgatcaacggcggctcggcctcggcgtcggaaatcgtcgccggtgcgctgcaggatcacaagcgcgccaccgtggtcggcacccgttcgttcggtaaggggtcggtgcagaccatcatcccgctcggctccggcaacggcgcgctgcggctgaccacggcgcgctactacacgccgtccggcaagtcgatccaggccaaggggatcactccggatatcgaagtgatgcaggacgtgccggccgacctcaaggcgcggaccgacaccaagggcgaagcctcgctgcgcggccatttgaagggcgccgacggcgatgagaagaccggctcgcagtcctacgtgccgccggaagccaaggacgacaaggcgctgaaggccgcggccgatctgctgcacggcatcaaggtcaacgcttcggccccggccgacaagcagaccaccggcgacaaggccgcgatcgacaagccggccggcaacaaggcggcgaactga

SEQ ID NO: 40875 - protein, 458 aa, Rhodopseudomonas palustris CGA009
MMRKTSVILLSAVTGAALTLFVTQPRTMLMGATARAATSDTYRQLNLFGDVFERVRSDYVEKPDDSKLVESAISGMLAGLDPHSSYMDAKSFRDMQVQTRGEFGGLGIEVTMEDGLIKVVSPIDDTPASKAGILANDIITNLDDEAVQGLTLNQAVEKMRGPVNTKIRLKIVRKGQDNPIEVTLVRDNIRVRSVRARVEDSDIGYIRITTFNEQTTEGLKKEIANLTNQIGADKLKGFILDLRNNPGGLLEEAVTVSDAFLDRGEIVSTRGRNAEETQRRSAHAGDLTKGKPVIVLINGGSASASEIVAGALQDHKRATVVGTRSFGKGSVQTIIPLGSGNGALRLTTARYYTPSGKSIQAKGITPDIEVMQDVPADLKARTDTKGEASLRGHLKGADGDEKTGSQSYVPPEAKDDKALKAAADLLHGIKVNASAPADKQTTGDKAAIDKPAGNKAAN

SEQ ID NO: 40876 - DNA, 1341 bp, Rhodopseudomonas palustris CGA009
  CDS (1)..(1341)
atgcgcaaaatcgtcgtccgctcgcttgccgtcctcggcgtcgtcgcggttcccgtcgtctccgcgctcgccctgcagcgcgagcagaccgccccggccgatctcgacctgatcggcggcgtgatccagctggtgcagcgcgcctacgtccatccgatcccttcggacgagctgaccaaggatgccctgaagggcctgctgaaccggctcgatccgcattcggactacatggacgagaaggaattcaaggacatgcagaccgacatgtcgggccagttcggcggcctcggcatgcagatcaccgctcagggcgggattccgcggattgtgtcgccgatcgacggcaccccggcggcgcgcgccaagctcgagccgggcgacctgatcatcaaggtcggcaccgccaccactcaaggcatgagcctgcgtaacgtcgtcgacatgctgcgcggcgcccccggcaccaaggtcaccatcacggttctgcgcggcaaggacgagccgttcgacgttaccctgacccgtgaaatcatccgcgtcgcttcggtgaagtcggagatcaagccggacggcgtcggctacatccgcatcagccagttcggcgccgacaccgccgacggcttcaccgccgcgctcaccaaactgaagagcgacgccaaggacggcggcctcaaggggctggtgatcgacctgcgcaacgatccgggcgggctgctcaacgccgccgtctcggtggcgggcgacctgctcgacggcggcaccgtggtgtcgatccgcggccgccaggccgacgaccagcgggtgttctcggcgccgtcgaagggcgacaagctgccgggcgtgccgatcgtggtgctgatcaacggcgcctcggcgtcggcgtcggagatcgttgccggcgcgctgcaggaccgcaagcgcgccaccgtgatgggcaccaccagcttcggcaagggctcggtgcagaccgtgattccgatcaagggtcacggcgcggtgcggctgaccacggcgctgtactacacgccggccggccgctcgatccaggacgagggcatcgtgcccgacgtgatcgaagaggcgccgaaggatcagcagatcagcggcggcccgctgatccgcgaaagcgcgctgcacggcgcgatcgccaatccgggccagctcggcaagtcggacgccagcgccaccaaggcgacgccgaagaccggcgagccgaccgacgacaagaccaagtccgcgacctcggcgccgatcaaggcggacctaatcggcaagcccgaggacgcccagctcaacgctgcgctggcgctggtcctgaagaaggacgcggcgccgaagtaa

SEQ ID NO: 40877 - protein, 446 aa, Rhodopseudomonas palustris CGA009
MRKIVVRSLAVLGVVAVPVVSALALQREQTAPADLDLIGGVIQLVQRAYVHPIPSDELTKDALKGLLNRLDPHSDYMDEKEFKDMQTDMSGQFGGLGMQITAQGGIPRIVSPIDGTPAARAKLEPGDLIIKVGTATTQGMSLRNVVDMLRGAPGTKVTITVLRGKDEPFDVTLTREIIRVASVKSEIKPDGVGYIRISQFGADTADGFTAALTKLKSDAKDGGLKGLVIDLRNDPGGLLNAAVSVAGDLLDGGTVVSIRGRQADDQRVFSAPSKGDKLPGVPIVVLINGASASASEIVAGALQDRKRATVMGTTSFGKGSVQTVIPIKGHGAVRLTTALYYTPAGRSIQDEGIVPDVIEEAPKDQQISGGPLIRESALHGAIANPGQLGKSDASATKATPKTGEPTDDKTKSATSAPIKADLIGKPEDAQLNAALALVLKKDAAPK

SEQ ID NO: 40878 - DNA, 1353 bp, Geobacter sulfurreducens PCA
  CDS (1)..(1353)
atgcaaacgagaacgaggataaccctcggcctggtggttgccatactctgcctcaccatcggcgtggccgccggatggcgctactataaccctgctgccgaccaggtcggtgccgagcacctgagactgttccgcgaggtcgtctcgatcgtgcggagcagttacgtggaagaggtgagcgggaaaaagctgctggaaggggccatcaacggcatgctcgcctcgctggacccccacagctcgtatcttccgccggaacccttcaccgaaatgaagacggagatatcggggtccttcggcggcctcggcatcgagatctccatgcgtgacggcaaactgaccgtagttgcccccatcgaggatactcccgcctggcgggccggaatccagtcgggcgaccacatctggaagatcgacgatactcccacccgcggtctcaccatcacccaggcggtcaagcagatgaggggcgagaaggggacccaggtctccctctcgattctgcggaacgggaacggaaaacctctcgtgttccccctggtgcgggacatcatcaagaccaggagcctcaaatcccggactctggagccgggttacggctatgtcaggataagccagttccaagagcggacaggggatgactttgccgctgctcttgccaagcttcggtcagataacggcgggtccctcaaggggctcgtgctcgatctgcggaataatcccggcggccttctggatgccgcagtggcggtggcggggcgcttcgtgggtgaacgcctcgacaacggcctcatcgtctataccgaagggcgcgagcactttgccaagcgaagctacagcgccaccatcggcgagaaagagccgcgctacccccttgtcgtccttatcaacggcggcagcgccagcgcctcggagatcgtggccggtgccctccaggaccacggccgcgccgtcatcatgggaaccaccagcttcggcaagggatcggttcagacggtggtccccctcaaggatggcgccggtctcaagctgaccacggcccgttactacacccccaagggacgttcgatccaggcacggggcatcgagcccgacatcgtcgtagaacgggccgggttcaaggaactgccggacaagggcagggccggattcctcgaaaaggatttggacaaccatctgtccggggcggaatcgggcgagggggaaaagacccccgagcaggacgtgaaaaagctcccggcggcgccggcgactcccgaacacgaggttgacaaggattatcagcttcttcgggcccttgaactgctcaagggctgggatgccatgcgcaaggtggccaccgcgaagcactag

SEQ ID NO: 40879 - protein, 450 aa, Geobacter sulfurreducens PCA
MQTRTRITLGLVVAILCLTIGVAAGWRYYNPAADQVGAEHLRLFREVVSIVRSSYVEEVSGKKLLEGAINGMLASLDPHSSYLPPEPFTEMKTEISGSFGGLGIEISMRDGKLTVVAPIEDTPAWRAGIQSGDHIWKIDDTPTRGLTITQAVKQMRGEKGTQVSLSILRNGNGKPLVFPLVRDIIKTRSLKSRTLEPGYGYVRISQFQERTGDDFAAALAKLRSDNGGSLKGLVLDLRNNPGGLLDAAVAVAGRFVGERLDNGLIVYTEGREHFAKRSYSATIGEKEPRYPLVVLINGGSASASEIVAGALQDHGRAVIMGTTSFGKGSVQTVVPLKDGAGLKLTTARYYTPKGRSIQARGIEPDIVVERAGFKELPDKGRAGFLEKDLDNHLSGAESGEGEKTPEQDVKKLPAAPATPEHEVDKDYQLLRALELLKGWDAMRKVATAKH

SEQ ID NO: 40880 - DNA, 1332 bp, Geobacter sulfurreducens PCA
  CDS (1)..(1332)
atgttcaagaccatcaaaggtaaacgcgtcgcactgttgcttgcctcgctttgtgttgttgccgtgctcggtgccggtgccgttcagaagcggtgcgcagctgagggagggaacgattacgagtccatcgagctcttcactgatgtgttggcgatcgtcaagaaaagctatgttgaagaggtggacaccaagaagctcatctacggagccatcaacggtatgcttgcttcacttgatccacacagctccttcatgcctcccgacatgtacaaggagatgaagatcgatacgaaggggtctttcggcggcctgggtatcgagattacgatcaaggatggactcctcacggtaatatcccccatagaggacactcctgccttcaaggccggcatcaaggcgggagatcaaatcttgaaaatcgaagaccgctttaccaaggacatgaccatcatggatgcggtcaagagaatgcggggccccaaggggacgaaagtaacccttaccattatgcgtgaaggtttcgacaaaccgaaggaatttacgctcgttcgcgataccattcaggtcaagagcgtgcggttcaaatcgatggatcaggggtatggttacataagaatcgcacagttccaggaaaagacggacgatgacctggtcaaggcgctcaaggcactcaaggaagagaatggcggagatttgaggggactcgtcctcgacctccgtaacgatccgggcggacttctcgatcaggctgtcaaggttgccgatcactttgtcgaagatggactcattgtgtacacggaggggcgtgagaaggagtcgcggatgcagtttaccgcccgcaagtccggcactgaacccaactacccgatggttgtgctgatcaacagcggaagcgccagtgcttctgaaattgtcgctggtgcgctgcaggatcataagcgtgccgttgtcatggggacccagagtttcgggaaaggctcggtccagacaatcatccccctctccgatgagtctggtctccgactcaccacggcacggtatttcacgccgagcggtcgttccatccaagccaagggcataacgccggacatcgttgtggagcgcgcggaaatccagtctacagagaagatggaaggccatatccgcgagaaagaccttgagaatcatttcgattccgactcgaaggacggatcggacaacaaacaaaaaggaacagataaaggtgcttcggcagcatccaaggtcgatgagcagttgaagagcgattatcaggtgatgcgcgcgctggatctcctgaaagggtgggaaatcctgaaaacaataagcaaatga

SEQ ID NO: 40881 - protein, 443 aa, Geobacter sulfurreducens PCA
MFKTIKGKRVALLLASLCVVAVLGAGAVQKRCAAEGGNDYESIELFTDVLAIVKKSYVEEVDTKKLIYGAINGMLASLDPHSSFMPPDMYKEMKIDTKGSFGGLGIEITIKDGLLTVISPIEDTPAFKAGIKAGDQILKIEDRFTKDMTIMDAVKRMRGPKGTKVTLTIMREGFDKPKEFTLVRDTIQVKSVRFKSMDQGYGYIRIAQFQEKTDDDLVKALKALKEENGGDLRGLVLDLRNDPGGLLDQAVKVADHFVEDGLIVYTEGREKESRMQFTARKSGTEPNYPMVVLINSGSASASEIVAGALQDHKRAVVMGTQSFGKGSVQTIIPLSDESGLRLTTARYFTPSGRSIQAKGITPDIVVERAEIQSTEKMEGHIREKDLENHFDSDSKDGSDNKQKGTDKGASAASKVDEQLKSDYQVMRALDLLKGWEILKTISK

SEQ ID NO: 40882 - DNA, 1452 bp, Lactobacillus johnsonii NCC 533
  CDS (1)..(1452)
atggcagaagtagaaccaaataattctcatcaaaataaagaaatttcaaataataaaaagaagcatcttcccaaatatgctcaatttttgttaactggtatagctggtgcggcaattggtgcaggtttgacctttggaattatggaagttaaggaactaaagtcacctttttatcaagttgaaaaagtgtatgagcaattacaaggttcatattataaaaaagtctcaccgcaaacattgcgccagggggcaattaacgggatgcttaatagtcttaacgatcctttttctgagggattaagtggagcaaaccaagaacaagttaataatattttagagggttcgagttttggcggagtaggtattcagatggcagtacgcaacaataaagttgttgtggactctattgttgctgactctccagcttcaaaaagtactattaaacctggcgatgagattgttgccgttaataataaaaaagtaagtgcagctcagtttagtaaagtagctcctttagtcagaggaaaaattggtacaaaagtcaccttgaaacttagacgtgctaactctacttttaacgttaccttaaagcgggctaaaatctcccaatctagcttaactaagcgaactgaaggtaatgcaacaattattacaattacacaatttgacgttaatacggctaaagatttaaagagtgctttaaagtcaattgatactaaaaaatatcctaagttaattattgacttgcaagataatcctggtggtgcaatggatgctgctttgaagtctgcatcgtatttcttgccaaataataaaattattatgcaatatcaggatcgcaagcaaaaagaagttattcgctctgataaaaagctttctggtggcttccatacaaacctaaagccaattattttgattaatgctaatacagccagtgccagtgaaatctttaccgcagctcttgttcaaaatcaccgggcagtttctgttggtcaaacgagctatggtaagggaacagtgcaagaagtagggcagacgcaagattcagaatataaatatacaattgctaagtggcttacacccgatggaacttggattaaccaaaaagggttaaagccaacttatcctgttcctgaatcttctttagctaaactacctcaattccaaagcatgagtattctgaagaaatcaatgactggtgttgatgtggcaactctgcagcaatatttgactgccttaggctatatgccaaagcatgttacaggagtttttaatgatgaaactaagaatgcagttattgagtttcaaaaagcccatggcttgacagcagatggtatagtaaatgggcaagtacaagcgcaactttatttagcggttgcacaaaaactgcaagatgataatcccgctttaaagaaggcaatgagtttaaatctaaaggaaatggaggattaa

SEQ ID NO: 40883 - protein, 483 aa, Lactobacillus johnsonii NCC 533
MAEVEPNNSHQNKEISNNKKKHLPKYAQFLLTGIAGAAIGAGLTFGIMEVKELKSPFYQVEKVYEQLQGSYYKKVSPQTLRQGAINGMLNSLNDPFSEGLSGANQEQVNNILEGSSFGGVGIQMAVRNNKVVVDSIVADSPASKSTIKPGDEIVAVNNKKVSAAQFSKVAPLVRGKIGTKVTLKLRRANSTFNVTLKRAKISQSSLTKRTEGNATIITITQFDVNTAKDLKSALKSIDTKKYPKLIIDLQDNPGGAMDAALKSASYFLPNNKIIMQYQDRKQKEVIRSDKKLSGGFHTNLKPIILINANTASASEIFTAALVQNHRAVSVGQTSYGKGTVQEVGQTQDSEYKYTIAKWLTPDGTWINQKGLKPTYPVPESSLAKLPQFQSMSILKKSMTGVDVATLQQYLTALGYMPKHVTGVFNDETKNAVIEFQKAHGLTADGIVNGQVQAQLYLAVAQKLQDDNPALKKAMSLNLKEMED

SEQ ID NO: 40884 - DNA, 1377 bp, Bdellovibrio bacteriovorus HD100
  CDS (1)..(1377)
atgcaatcactcaaacgctactggaaaacctatattttgggcggcgcccttctgctggttttgttcatcatggcagaaacaggtttccaggttagatcctttgctcaggaaaggtatgcggatctgcagaacttcagtaaagttcttaatctgattcagcagtactatgttgaagaagtgaataccaagaagctggtttacggggcgatcaaagggatgctgcgcgaactggatccacacacgaacttcatgccaccggagatgttcaaggattttgagacagaaaccagtggtgagttcggtgggttgggtattgagatttccattcaaaacggcattctgacgatcatttccccgatcgaggatgcaccagcctgggaagcgggcatcaaggctggggataaagttgtatctatcgacgggaccaccacaaaaggcatgagtctggccgaagcttccgtgatgatgcgtggaaaaaaaggcagcaagattgttttgcgagtcgtgcgcgataacgaggaaaaacctcgcgacatcaccgttgttcgtggcagtgtgaaaatcaagtcagtgaagtacacggatctgggggatggttttgcttatgtgcggatcacaagcttcattgaaaacacatccaaggatctgcaaaagactgttgaaaatcatatcaagaacaacaaaaatatggcgggcttgttgattgatatgcgcagaaatccgggtggtttgctggatcaggccatcaaggtcagtgatatgttcctgaaggacgggacgattgtttccactatcggacgtaataaaaacgaaaaagaagtggcgacagcctctaaaaaaggtcagtacacaaacttcccgattgtgattctggtgaatgaatacaccgcaagtgccagtgaaattgtgtccggtgctttgcaggacaacaaacgtgctttgatcgtcggtcaaagaacatttggtaaaggctccgtccagtctgtgatcaagctgggtgatggcagtggtttgaaattgaccgtggctcgttactacacaccgaatggtgtttcgatccaggcagaaggtattcatcctgacatcgaaattgaagatgtggatccggatgctttctctaaggcgattgtgaagtctgtcacaactcgtgaaggtgatatcgcaggtcacttgaaaggtgatcgtgagaaagcggcagagaagctggatgttaaagagggcgcagaagaaggcgcactggcttggtggaaagacgtgggatcgaaaaaagatgaaaagctgtcgccgcgcgataagctgttcaagtctgattatcaagcatatcaagcatttagctatctcaaagcatgggatactttgaaggctttgacgcgctag

SEQ ID NO: 40885 - protein, 458 aa, Bdellovibrio bacteriovorus HD100
MQSLKRYWKTYILGGALLLVLFIMAETGFQVRSFAQERYADLQNFSKVLNLIQQYYVEEVNTKKLVYGAIKGMLRELDPHTNFMPPEMFKDFETETSGEFGGLGIEISIQNGILTIISPIEDAPAWEAGIKAGDKVVSIDGTTTKGMSLAEASVMMRGKKGSKIVLRVVRDNEEKPRDITVVRGSVKIKSVKYTDLGDGFAYVRITSFIENTSKDLQKTVENHIKNNKNMAGLLIDMRRNPGGLLDQAIKVSDMFLKDGTIVSTIGRNKNEKEVATASKKGQYTNFPIVILVNEYTASASEIVSGALQDNKRALIVGQRTFGKGSVQSVIKLGDGSGLKLTVARYYTPNGVSIQAEGIHPDIEIEDVDPDAFSKAIVKSVTTREGDIAGHLKGDREKAAEKLDVKEGAEEGALAWWKDVGSKKDEKLSPRDKLFKSDYQAYQAFSYLKAWDTLKALTR

SEQ ID NO: 40886 - DNA, 2022 bp, Bdellovibrio bacteriovorus HD100
  CDS (1)..(2022)
atgagttcattctcaaaaggcgttagaggtttcatcattgccggatcattggcagtttcatctttggcatcggcccaactgaaagaaggcctggagtgccgttacctgacagtgattgaacagggcttccttgccaaccacgtgaagtattccaaccgcgacaccgatctgcaaaaccgtgtgatcgaacagtatctgaaacgcctggatccttccaaaatctatctgactcaaggtgatgtcgatgcgattcgcaaatctgcgggcaacgtttttgataaaaccaaaaaccgtgactgctcgttcctggatgcagctcagaaaatcgttctggagcgcgtgaaagaccgttctgaatttgctaaaaaatatctgggcaaagacttcaagtttgagtcttccacagaattcacttttgatccggaaaagaaaacctggccgaaggattctgctgacgccaatgaatatctgaaaaagtatatccagttccagatcgggaactacatggcgacagacatgaaaatggatgaagccaaaaagaacgtgatcaaaaactatgagcgtgcagtgaaaagaaccgctgacaccacccaggatgatctgttctctggttacctggattcctttgctcgcgcgttggatccacactccagcttcttctctcgcgatgtgctagaggacttcgaaattcagatgcgtttgtccttggaaggtatcggcgcgacactttcttcccaggatggtttcacagttgtggaacaactggttccgggcggggcggcagcgaaatccggcctgattgagccacaggataaaatcgtggctgtcggtcaggaaaaaggcgcgatggaaaatgtgatcgacatggatttgaaagacgttgtcaaaaaaatccgtggtaacaagggcacgaaagtgcgcctgactattttgagaaaatccggtgaaggcaaaaaacgttttgatgtcactttgacccgtgaaaaggtgaacctggaggacgaagcagcgtccatcatctatcaggatcgtgaaatcaacggtcagaaaaagaaaatcggtgttatcaacttcccatccttctatgcggattcccgtcgtggcggcagatcttctgcggctgacatgaaaaagctgatcaaggaagccaacgaaaagaaagtcgacggcctggtactggatctttccaacaacggtggcggttctcttgaagatgcggtgaaaatcgcgggtctgttcttccagaccgggaacgtggtgaagcagtcctccaaaaatgaaggccgtgcggaatccgcacttcgcgacacagatccaatggtggactggtcaggtccgctggtggtattgaccagccgtatctctgcttccgcttccgagattgtgtctggtactttgcaggattataaacgtgccgttgtcgtgggtggtgatcacacttacggtaaaggttctgttcagtccgtacttccaattccgaacaacctgggcgcgatcaaagtgactgtgggtatgttcttcgtgccgggtggtaaatccactcagcaccgtggtgtggatgcggatatcgttttgccaggcccgttcagtgcggatgacatcggcgaaaaatacatggattactctttgccgccaaaaacgattgagtccttcctgtctccggatgcttacgtgaaagaaggcccgggcgcttggaaagagatcaaaccagagtggctgaagtccctgcgtgaaagatccggtgagcgtgttgctaagaatgatgaattcaaaaaaatcgttgaagagctgaacaaagccaaagcccgcggtaaagtgatccgcgtgagcgaagttcttaaagacaagaacgaaaaagaaaagaaagacaaagctaaaaagaccgctagcaaggccaagaaaaacgaagagtatttgaagcgtcctgacatcatggaagcggaaaatgttcttctggatctgattcagcttgaggacgggaaatccttggtgcctcagcagaaacaggccaacgccaagtag

SEQ ID NO: 40887 - protein, 673 aa, Bdellovibrio bacteriovorus HD100
MSSFSKGVRGFIIAGSLAVSSLASAQLKEGLECRYLTVIEQGFLANHVKYSNRDTDLQNRVIEQYLKRLDPSKIYLTQGDVDAIRKSAGNVFDKTKNRDCSFLDAAQKIVLERVKDRSEFAKKYLGKDFKFESSTEFTFDPEKKTWPKDSADANEYLKKYIQFQIGNYMATDMKMDEAKKNVIKNYERAVKRTADTTQDDLFSGYLDSFARALDPHSSFFSRDVLEDFEIQMRLSLEGIGATLSSQDGFTVVEQLVPGGAAAKSGLIEPQDKIVAVGQEKGAMENVIDMDLKDVVKKIRGNKGTKVRLTILRKSGEGKKRFDVTLTREKVNLEDEAASIIYQDREINGQKKKIGVINFPSFYADSRRGGRSSAADMKKLIKEANEKKVDGLVLDLSNNGGGSLEDAVKIAGLFFQTGNVVKQSSKNEGRAESALRDTDPMVDWSGPLVVLTSRISASASEIVSGTLQDYKRAVVVGGDHTYGKGSVQSVLPIPNNLGAIKVTVGMFFVPGGKSTQHRGVDADIVLPGPFSADDIGEKYMDYSLPPKTIESFLSPDAYVKEGPGAWKEIKPEWLKSLRERSGERVAKNDEFKKIVEELNKAKARGKVIRVSEVLKDKNEKEKKDKAKKTASKAKKNEEYLKRPDIMEAENVLLDLIQLEDGKSLVPQQKQANAK

SEQ ID NO: 40888 - DNA, 1581 bp, Bdellovibrio bacteriovorus HD100
  CDS (1)..(1581)
ttggagcgggtcgggagggccgaagtgctcagttcaccacgttttttcataatctctttaatggttttggtcttgggggccagcctgtatcttgtgcgtctttcgggtaaagacgtcagcaaggtgaagtccggtgaagactattgggctgagacgggcctgggtccggcagccctggaagacctgcttcaggatcagacctgtggcagttccgaacgctatttcctggcgtgtgccaatgccattctgacagttgccaatcgctacaacctgagcctgaacctgcaaggggagctggtcccagttcacgaagccctgtctgccgacatgagctcagagaaaaaacagctggagccgtggaaagaatatttcacttcacaaactgccaaagccacgcagatctctttcttgaaggcatgggaacaactgaagtctgaatacatcaaacccaaacaaagctccatgatggtgggcctcgggttgaatggttttatctcggtcttccgtgatccgcacacatacttcatgccagtaaatcagttccaggaagtgatctcccgcgccgacagccgttcggtgactttgggaattaccctggggagccacaaaggccagtacgttgtgcgcaagctgaccgaaggcagtccggcgaaactttccggcatacaaaaaggggatgtgctgatttccatcaacgacacttcagtcaaaggcctgatgcagccgcgcgtttctgaattgttaaaaggtgaagtcggcgatgtggttcgcatccgtgttgagcgtgatggtgaagccatgaagttccgcctgcgccgtcaggaaatcaccgtggcgactgtttccacacgagtgattgaaggcatcaagccgatcgcggtgattggtattaacaagttcgcccgtggtgcctgtgaaaaggtgaaagagtcgcttgagatcgtgaagcgttcccacgtgcgcggtctgttgctggatctgcgtgacaatcccggcggtcagatggaagaagccgcttgtatcgccagtctgttcgtgggtcctgaaaacaagatcttcgaagttcgttacctggatccaagcaaaaaggctgaggtcttttatggcggtgaagagaagcactttgacatgccgatggccgtcttggtgaatgcggcttccgccagcgcttcagaaatcgtggcgggtgctttgcgtgacctgaatcgcgccgtgctggtgggtgaaagaactttcggaaaaggctctttccaagagggtgaatactggtcccagaacaaaaaaatcgccctgtttgaaaccaaaggtttctattacctgccatcgggacgttccccacagatgaaggggctggagccggatgtggcagttaactttgaagagatctccgtcgtgcgagaggcggagcagttcatcaatcctctgcgtgcaccggaacgtcaggtgcgtgcgatggcgcaatccatgtccagcagtgaatgtctggacttggaagacggttctccttccgatgatttacaactgacaaaagctcgtcaggttcttttctgtacaaaggctgtggcgagggcggggctatga

SEQ ID NO: 40889 - protein, 526 aa, Bdellovibrio bacteriovorus HD100
MERVGRAEVLSSPRFFIISLMVLVLGASLYLVRLSGKDVSKVKSGEDYWAETGLGPAALEDLLQDQTCGSSERYFLACANAILTVANRYNLSLNLQGELVPVHEALSADMSSEKKQLEPWKEYFTSQTAKATQISFLKAWEQLKSEYIKPKQSSMMVGLGLNGFISVFRDPHTYFMPVNQFQEVISRADSRSVTLGITLGSHKGQYVVRKLTEGSPAKLSGIQKGDVLISINDTSVKGLMQPRVSELLKGEVGDVVRIRVERDGEAMKFRLRRQEITVATVSTRVIEGIKPIAVIGINKFARGACEKVKESLEIVKRSHVRGLLLDLRDNPGGQMEEAACIASLFVGPENKIFEVRYLDPSKKAEVFYGGEEKHFDMPMAVLVNAASASASEIVAGALRDLNRAVLVGERTFGKGSFQEGEYWSQNKKIALFETKGFYYLPSGRSPQMKGLEPDVAVNFEEISVVREAEQFINPLRAPERQVRAMAQSMSSSECLDLEDGSPSDDLQLTKARQVLFCTKAVARAGL

SEQ ID NO: 40890 - DNA, 1773 bp, Leptospira interrogans serovar Copenhageni str. Fiocruz L1-130
  CDS (1)..(1773)
ttggccatttttatcctattctgcgagcctacatctggtaagtctccggtcaaggcagactttacgctcaaagattttgataacgtcgtaagtcatgtttctcgttactatatcgacaaaaatatcgataaaaaccgagcttaccgagaagcggcaatctatgctcttttatcccttcctcattctatttatctctatccggaaagttatttcaaggaaagagataaatatgaagaaaaagacgaaatttttccaggtaaaacattcaaaatttccacagacgattcctttatcctttttgatccggattatgcggaagtagaaaagatacgagatcgtaaactcaaagaagacgcaaataaatccaaggtaagcgacgaagaagttaaaaagatcgtagaaagagaaaagatccgtaagaacgtcctcgcttctaaatgggaacgaaccggttttaataaaaaagattttgatagagtactcgcatttatagaaaccaatttagataagtataaggactctcctttaaaagatccttttggagaatctgaagaaaaatccaaagaaccatttacaatgaacgacgtgatccttgcagcagcgaacggttatttatcttctttagatccacatagtaacgttttcttaagatccgcttgggaagaatctatggccaaaattcaagacggaagttttgaaggaatcggtgccattctttccggtggaggtaacaaagaagttgtagtggaaaacccattggaaggaagacctgcggtcaacgccggaatccgttccggagacgtgatccttgcagttgatggaaaatcaatcaaaggaattcttttagacaaggtagtagaaaagatcaaaggtaaaaaaggttctaaagtagcacttaccatccagagaaaaggagttccaggaaccttacacattgaagtagttagagatacaattgaaatcaaaaacctaagtagtaaactcatcgagggtcatgaacatattggttatatcaaactcaccggttttgtgaagtcggaagaaggcccttccgtagacagagaaatcatagaaaaatacaaagaactagataaagaagcccaagcgaaaggcaccagactcaaagcgttgatcttagatctaagaaataacgctggtggttacttagaccttgcaatcgacattgcagatatgtttatcgaaaagggtctgatcgtttccaccaaaagtccgaatcgtagccccgaagacgcttacgcaaaaaacaaggacatcaccaatttaccgttagccgttctgatcaacgctaaatccgcttccgcttctgaaatcgtagccagcgcgatcaaacaccatggaagaggaattttattaggagaaagaactttcggaaaggctactgtgcaaaagttaatgcctttaggaaatgactatttgatcaaacttacacaagctcgttactattctccttctggaaacacgattcaagttgtgggagtaaaaccagacattgacatttcttccgaagaagacggttcgtttccatttcgatttagagaagaaaacatgtggaatcatctttccgaacttcctccagaggctgaagaaaaaagttctttcgacgtgaagaaattagaagcctgggttcaaaagaacggtaaggcgtccgatttcattgcgtctcataaaaacgatcctatcaagccggactaccaattgatccgttccttggattatatagaagccttactctctacacaaaaaaagaaataa

SEQ ID NO: 40891 - protein, 590 aa, Leptospira interrogans serovar Copenhageni str. Fiocruz L1-130
MAIFILFCEPTSGKSPVKADFTLKDFDNVVSHVSRYYIDKNIDKNRAYREAAIYALLSLPHSIYLYPESYFKERDKYEEKDEIFPGKTFKISTDDSFILFDPDYAEVEKIRDRKLKEDANKSKVSDEEVKKIVEREKIRKNVLASKWERTGFNKKDFDRVLAFIETNLDKYKDSPLKDPFGESEEKSKEPFTMNDVILAAANGYLSSLDPHSNVFLRSAWEESMAKIQDGSFEGIGAILSGGGNKEVVVENPLEGRPAVNAGIRSGDVILAVDGKSIKGILLDKVVEKIKGKKGSKVALTIQRKGVPGTLHIEVVRDTIEIKNLSSKLIEGHEHIGYIKLTGFVKSEEGPSVDREIIEKYKELDKEAQAKGTRLKALILDLRNNAGGYLDLAIDIADMFIEKGLIVSTKSPNRSPEDAYAKNKDITNLPLAVLINAKSASASEIVASAIKHHGRGILLGERTFGKATVQKLMPLGNDYLIKLTQARYYSPSGNTIQVVGVKPDIDISSEEDGSFPFRFREENMWNHLSELPPEAEEKSSFDVKKLEAWVQKNGKASDFIASHKNDPIKPDYQLIRSLDYIEALLSTQKKK

SEQ ID NO: 40892 - DNA, 1962 bp, Parachlamydia sp. UWE25
  CDS (1)..(1962)
atgtacaaatttttaatttgtttaatttgtttaacaacttttgttttggaagccaaatcacctgatttgagtcctaaggaagtcacgtttaaagcaaacgaaattatgaaagctcatgcttcgcaaaaacaactttcccccactcttactcgtcgaattttaaataactatttagaaaatttagatcctaataaaacttacttcattgaatcagatatttatgaatggactcatccaacagatgaactcctcacaaacattattgatgattacaataacagtaatttttctacttttgaaagtattcatactgctctaattaaagctattttaaaacgccgtcaactagaaaataaaatagactatcaaagcttgcctaaaaatgttcgagcagaagaatttaaagatattccatgggttcagactgaagaagagcttattgaacgtttaaaacgcatacgagctttacaaattgaaactgcagcaaaattaaacgatcatatgaaggaaaatgctcttcaaagaatcggcaaacgacaagcaaaatacgaagaagaggcattaaatccaaaagaacaagaaaagcaacctttaatcttatctaacgttttaaaagccacagcatctgctttagacgcccatacagcttattttacacctggtgaggctgcacaatttatgattaatgttcaacagcgtttattcggaattggcgctcaattgcgtgatgacattaatggatttactgtaataaaaattattgagggtggccccgcagccttaggtaaagaacttaaattaaaagatcgcattgttgcagtcaatggggaacctgttgtcggaatggatattacagacgcagttgatttaattcgaggggaagaacatactcccgttattttgacagtcattcgagaaacgacaagtactgccggtgaaaaaactgaagaaaaattggatgtgactattttaagaggagaggttattttaaaagaaagtcgtttcaaaagttcttacgaaccttatggaaatgggataatcggttatttaaaattatactctttctatcaggatcgagatagttcatccgcaacagatttggaagaagaaattaacaaacttaaaaagaatcaaaacatgtttggtcttatccttgatttaaggtataattcaggaggccttttatctcaagctgttgccgtaacaagtttatttattactaaagggattgtagtctccattaaagatgaaaacgggaaaattcaacatttaagagacttagatggaacatcaacttgggatggcccactcattattttggtgaatcgcatgagtgcttcagcctcagaaattgtggcgcaaacactacaagactacggtagagcaatcattgttggagatgaccatacatatggaaagggatcgtatcaaacattcactttgacaacaaccgaacacgaacaagtcaatccccaaggggaatataaagtcacaagagggcgttattataccgtttctggtaaaaccccccaattatcaggtgtattatctgacattcctataccaggtgtattatcagagtcagaaattggagagaagtacaccaaatatcctcttgaaaacgatcacatcaaagcaaattttgatgatgatctttcggatgttccctttttacagcgagataaaattcgtaagttgtataaatttggtcttcaagagaagttagacacttatcatccatattttgaagtattaaaaaagaattcttccaaacgcttagaaaatgaccctaattatcaaaatatgcttaaagaaataagaaagaaggaaaatagtgatatagaaagcatggaagactttggtcaaaatgatttacaattagaagaagcttataaaatcatgaaagacttattaattatgatgcaagaaaaaggaattcctcttatttcttcaaaattatag

SEQ ID NO: 40893 - protein, 653 aa, Parachlamydia sp. UWE25
MYKFLICLICLTTFVLEAKSPDLSPKEVTFKANEIMKAHASQKQLSPTLTRRILNNYLENLDPNKTYFIESDIYEWTHPTDELLTNIIDDYNNSNFSTFESIHTALIKAILKRRQLENKIDYQSLPKNVRAEEFKDIPWVQTEEELIERLKRIRALQIETAAKLNDHMKENALQRIGKRQAKYEEEALNPKEQEKQPLILSNVLKATASALDAHTAYFTPGEAAQFMINVQQRLFGIGAQLRDDINGFTVIKIIEGGPAALGKELKLKDRIVAVNGEPVVGMDITDAVDLIRGEEHTPVILTVIRETTSTAGEKTEEKLDVTILRGEVILKESRFKSSYEPYGNGIIGYLKLYSFYQDRDSSSATDLEEEINKLKKNQNMFGLILDLRYNSGGLLSQAVAVTSLFITKGIVVSIKDENGKIQHLRDLDGTSTWDGPLIILVNRMSASASEIVAQTLQDYGRAIIVGDDHTYGKGSYQTFTLTTTEHEQVNPQGEYKVTRGRYYTVSGKTPQLSGVLSDIPIPGVLSESEIGEKYTKYPLENDHIKANFDDDLSDVPFLQRDKIRKLYKFGLQEKLDTYHPYFEVLKKNSSKRLENDPNYQNMLKEIRKKENSDIESMEDFGQNDLQLEEAYKIMKDLLIMMQEKGIPLISSKL

SEQ ID NO: 40894 - DNA, 1287 bp, Desulfovibrio vulgaris subsp. vulgaris str. Hildenborough
  CDS (1)..(1287)
atgcgcgttacgttatgggtggtatcgctgggcctgtgtgccgcggtcgccttttcaggtggagcagtcttcgcgaccaccgaagagtccaagtatgacgcgctgaagcgcttcagtcaggtgctcgacatcgtcgagcgctactacgtgcgcgacgtgccccgcaaggacctcatgaacggagcggtgaagggcatgttgcaggggcttgacccccactccaccttcctctccccggaagaattcaaggagatgcaggagaccacctctggtgagttcttcggcatcggcatcgagatatccagcgagaacgggcaactcaccgttgtgtcgcccatcgaggacactcctgcgttcaaggcgggactcaaggcgggcgacctcattctcgccgtcgacgggcagcccacgcaggagatgagcacgcaggaggccgtatcgcgcattcgcgggcccaagggcagcgaagtggaactgctcatcctgcatcgcgaagccaaggcccccagcacggtgaaaatcgtgcgcgacgccatccccctcgtcagcgtcaagtcgaagcagcttgagcaggggtacgtgtgggtgcgcctcacccgcttcagcgaacgtacgaccagcgacctgctggaagcactgcgcgaggcgaacaagcgcgggcccgtcaagggcgtggtgctcgacctgcgcaacaaccccggcggtctgcttgaccaggccgtgagcgtgtccgacgtgttcctgcgtgacgggggcatcgtctccatccgcgggcgcggcgacgacacggggcgtgagtacaacgccaaggcgcagtccaccgacgtgaccgcgcccatggtggtgctcatcaacgccgggtctgcctccgcttcggagatcgtcgccggggccctgcgcgaccagaagcgcgcgcttctggtgggtgaacgcagcttcggcaaggggtcggtgcagaacgtcatcccgctttccgacggcgcgggactcaagctcacggttgcactgtactacacgcccaatggccgttccattcaggccgagggcatcgaccctgacattgagattcccttcgaagccccgcgtgaggacgacgccaaacccatgcagcgtttcaacatgttgcgggagaaggatctttcgcgtcatctggagaacggtgccgggggcaagcagggcaagaacgaccagtctgacgaggtgcgtgacctgcttgaacgcgacaaccagttgcgcatggcattgcagttcgtgaagcggctgcccgccttgaaggaaatacgctag

SEQ ID NO: 40895 - protein, 428 aa, Desulfovibrio vulgaris subsp. vulgaris str. Hildenborough
MRVTLWVVSLGLCAAVAFSGGAVFATTEESKYDALKRFSQVLDIVERYYVRDVPRKDLMNGAVKGMLQGLDPHSTFLSPEEFKEMQETTSGEFFGIGIEISSENGQLTVVSPIEDTPAFKAGLKAGDLILAVDGQPTQEMSTQEAVSRIRGPKGSEVELLILHREAKAPSTVKIVRDAIPLVSVKSKQLEQGYVWVRLTRFSERTTSDLLEALREANKRGPVKGVVLDLRNNPGGLLDQAVSVSDVFLRDGGIVSIRGRGDDTGREYNAKAQSTDVTAPMVVLINAGSASASEIVAGALRDQKRALLVGERSFGKGSVQNVIPLSDGAGLKLTVALYYTPNGRSIQAEGIDPDIEIPFEAPREDDAKPMQRFNMLREKDLSRHLENGAGGKQGKNDQSDEVRDLLERDNQLRMALQFVKRLPALKEIR

SEQ ID NO: 40896 - DNA, 1311 bp, Bartonella henselae str. Houston-1
  CDS (1)..(1311)
atgattcgtaaagttattcttttggtcgctggggtatttctcggcgcctgttcaatgattatggtgcagtctgttgctgccaataatgagggtgacgtttataaacagcttgccatatttggcgatgtttttgaacgagtccgtatgcaatacgtgacggttcccgatgataaaaagcttattgaaaatgctatcaatggtatgctcacatcgcttgacccacattcatcttatatgaacgctcaagaagccaaggaaatgcgggattctacaaaaggggaattcggaggacttggtattgaggtgaccatggagaaaaacttaattaaagttgtttctccgatggatgatacacctgcttcaaaagcaggtattttggcaggggatctcatttcgaaaattgatggtgtacagacaaatggtcaaacattgaacgaagctgtgaataaaatgcggggcgctcctggaacaccaattacgttgacaattattcgttccggtattgataaaccgcttgaaattaaggttgttcgtgatatcatcaaagtgaaggcggtgaaatatcgtgttgagggtgacattgggtatttaagactcatccaattttctgagcagacttttggcaatcttcaggcagcaattaaagatattcaatctaaaattcctcaagataagctgaaagggtatgttcttgatttgcgacttaatcctggtggactgttagatcaggcggttagtgtttctggtgcttttctcaataaaggtgaaattgtatcgactcgtgggcgcagaaagaatgatgtgacgagatttgatgctaagccaggggatatcatcaagggaaagcccttgattgtacttattaatggtggttcggcaagtgcttctgaaattgtcgcaggtgccttacaagatcatcgtcgtgctacaattttaggcacgcaatcttttggtaagggatctgttcaaacaattattcctttgggtgaaaatggtgctttacgtttgacaacagcactttattacacaccagctggtacttcaattcaaggaacgggaatcacacctgatattattgtagagcaaccactccctgaaaaatataaaggctatgatgtaaagcttggtgaatctgagttaaaaggacatattaaaggggaacgagagaacaataaaggatctggttcagctgcttttgttccaagagaccctaaggaggatgctcagttgaatgaggcttataagctgttgcggggtgaaatggcaaatgcagcatttccaccagatcccaataaagatattttaaagtga

SEQ ID NO: 40897 - protein, 436 aa, Bartonella henselae str. Houston-1
MIRKVILLVAGVFLGACSMIMVQSVAANNEGDVYKQLAIFGDVFERVRMQYVTVPDDKKLIENAINGMLTSLDPHSSYMNAQEAKEMRDSTKGEFGGLGIEVTMEKNLIKVVSPMDDTPASKAGILAGDLISKIDGVQTNGQTLNEAVNKMRGAPGTPITLTIIRSGIDKPLEIKVVRDIIKVKAVKYRVEGDIGYLRLIQFSEQTFGNLQAAIKDIQSKIPQDKLKGYVLDLRLNPGGLLDQAVSVSGAFLNKGEIVSTRGRRKNDVTRFDAKPGDIIKGKPLIVLINGGSASASEIVAGALQDHRRATILGTQSFGKGSVQTIIPLGENGALRLTTALYYTPAGTSIQGTGITPDIIVEQPLPEKYKGYDVKLGESELKGHIKGERENNKGSGSAAFVPRDPKEDAQLNEAYKLLRGEMANAAFPPDPNKDILK

SEQ ID NO: 40898 - DNA, 2184 bp, Acinetobacter sp. ADP1
  CDS (1)..(2184)
atgaaacttcaagttatcgcatgtgccgttgcagttgcaactggcggtttttttttctcccatgccattaatgaggcgcttgctgctacagatactgtttctgttacccagtcgattcagccgaccaaagagcaggcattggtttctcggcagcttgcaacactggtcgatcgccagcattatttgaatatgcgtctggatgcaaccacatccaatcgtattctagatatgtatctcgatagtcttgatccagatcattctattttattggcatcagaagtcgccgaatataagaagaaatatggcccgacctttggtgcagccctcaaagcaggtgatttgtctggtccatttgcaattcatgcacaataccgcgcccgccttaaggcgttttacgaatatgtacttggtgagttgaaaaagccgcaaaatctcaaacaatcgaatgtctatgtcgatacagatcgtgagaaggcgccttactttaaaactgttgctgagcagcaggattactggcgcaaaatgctggtttcccagttgattaaccttaccatcagtaaagaagaagatctggccaagcaaaaagccttgaaagacaatcctgctctagccaatggtcaagaccttgccagcgcagaagatctcacgccagttcaaaccctgaccaagcgttatacacgtcagctcgaacgaattaatcgtgtgaaaagtgatgatgtgctggataagacattgaatgccatgatggcaacttacgatccacacagtaattattatccaccaatcgatgcaatggagttgaatcgtcagaccactttgcaacttgaaggtattggggtgtcgattcgtcctgagcgcggtaatgaagattacaccaaaattgaaaccatcgttgaaggtgggcctgcgagtaaatcaggacagatcaaatcgggtgatcgcattatcggtgttgcgcaagatggcgacaaaatggtggatgtgattggctggcctagctctgaaattgtcggcttgattcgcggtaaacgtgggacaaaagtgactatcaagttacttggaccaggtgctcaaatgagtcaggcacgtactgttacattggtacgtgatgtaattcaagaagatgatgcaggggtgcgttcacgtactgttgagattacccgcgatggtaagaaacatgtatttggtgtgattgaaatcccatcattctatttgaattatcgcgcgcgtcgagcaggcacagagtatcgttctgtttctgaagataccaataatgcattgaaagcactttctgcaaaaaatgtggaaggcatcatcatagacttgcggaataatccaggtggttctttagaagaagttgctcgtatgctcgggcaagtgattaagtcggggcctgttgtacaaatccgtgacggcaatggcaatgtcagcgtttttgaagacaatgacggcggtgctcaaacctatgcaggtccattggctgtattgattaatctggcatcggcatcggccagtgagatttattcggcagccattcaagattatgagcgtggtgtagtgattggaagtaccaccacgggtaaagggactgctcaggtacagctggatagtttggcctatggtcaggcaaccctcacgcagcgtaaattctaccgtgtgacaggcggcagtactcagaataaaggcgtcattccagacgttaagctggtcgatatttatgatgaagagtttggtgagcgtaaagccaagaatgctttgaaatgggatactattccaacagcaccgttcaaacgtgaaggttcaatccagccgtatgtaactaagttatctcagctttctttacagcgtgttgataaagatcctcagtttacttatctggaaacacgtaagtcgattgcacaggaaaccaaagatcagaaacgtgttgtactcgatatcgaccagcgtaaggctgaaattttgtcacttgaaaagcagacattagatgccgaaaacaaacgtcgtcttgcgacaggtttaaaaccgtatgcaaactgggaaagttatcaggcctctctggatgctcttagtgagtctagagccaaaatgaaagccacgcagcgtcctgcacttccagaagaagaagcatttgtgacagaagcgggtaatgtgttattagactattcaaaattgcagggtcattaa

SEQ ID NO: 40899 - protein, 727 aa, Acinetobacter sp. ADP1
MKLQVIACAVAVATGGFFFSHAINEALAATDTVSVTQSIQPTKEQALVSRQLATLVDRQHYLNMRLDATTSNRILDMYLDSLDPDHSILLASEVAEYKKKYGPTFGAALKAGDLSGPFAIHAQYRARLKAFYEYVLGELKKPQNLKQSNVYVDTDREKAPYFKTVAEQQDYWRKMLVSQLINLTISKEEDLAKQKALKDNPALANGQDLASAEDLTPVQTLTKRYTRQLERINRVKSDDVLDKTLNAMMATYDPHSNYYPPIDAMELNRQTTLQLEGIGVSIRPERGNEDYTKIETIVEGGPASKSGQIKSGDRIIGVAQDGDKMVDVIGWPSSEIVGLIRGKRGTKVTIKLLGPGAQMSQARTVTLVRDVIQEDDAGVRSRTVEITRDGKKHVFGVIEIPSFYLNYRARRAGTEYRSVSEDTNNALKALSAKNVEGIIIDLRNNPGGSLEEVARMLGQVIKSGPVVQIRDGNGNVSVFEDNDGGAQTYAGPLAVLINLASASASEIYSAAIQDYERGVVIGSTTTGKGTAQVQLDSLAYGQATLTQRKFYRVTGGSTQNKGVIPDVKLVDIYDEEFGERKAKNALKWDTIPTAPFKREGSIQPYVTKLSQLSLQRVDKDPQFTYLETRKSIAQETKDQKRVVLDIDQRKAEILSLEKQTLDAENKRRLATGLKPYANWESYQASLDALSESRAKMKATQRPALPEEEAFVTEAGNVLLDYSKLQGH

SEQ ID NO: 40900 - DNA, 2016 bp, Erwinia carotovora subsp. atroseptica SCRI1043
  CDS (1)..(2016)
atgaacaacttaatcagaataaccgccattgcaggtttactgctggcgggctctagttttgcaaatgaaaacattacgcgtgttgagcagatccctcagctacatcaggagcctcaacatgctaccgttagcgacagggtggcctcacgtttcctgcgttcgcattatcgtcagtttatgttggatgcgcagttctccgagaaaatttttaaccgctacctcaacatgttggactacagccacaacgtgctgttggcctctgatgtggcgcaattttccgggcaaaaagcccagttgggcgacgcgctgaaatctgggcaactggatattccgtacgcgttgtacaatctggcgcagaaacgccggtttgagcgttttcaatatgcactgtcgctgctggataaaccggtagatttgacgggcaatgacacgtttgaactcgatcgcagcaaagctccttggccgcagaacgcgggcgaacttaaccgcctgtgggatgccaaggtaaaatatgactggctcagcctaaagctgaccggtaaagatgataaagacatcaaagagacgctgaccaagcgttatcagtttgcgattcgccgtttggcgcagagcaacagcgaagatgttttccaactcgtcatgaacgcctttgcgcgtgaaattgacccgcatactagctacctgtcaccgcgtaacaccgaacaattcaataccgaaatgagcctgtcgctcgaagggattggtgcggtgctgcagatggatgacgactacaccatgattaattccatggtgccaggcggtccggcagcgaagagcaaaaacattaccgttggtgaccgtgtggttggcgtaggccaaagcggcaaaccgatggtggatgttatcggctggcgtctggatgatgtggtcgcgctgatcaaagggccgaaaggcagtaaggtgcgtctggaaattctgcccgcaggcaaagggacgaaaacccgtattatcacgctgacgcgcgaacgtattcgtcttgaagaccgtgcggttaaaatgtctgttaagacggtcggtaaagataaagtcggcgtgttggatatccccggcttctatgtcggcctgacggatgacgtaaaagttcagctccagaaactggaaaaacagaacgtcagcagtatcgtgattgacttacggactaacggcggcggtgcgctgacggaagcggtagggctttccggtctgtttatcccaagcggccccgtggttcaggtacgtgataataatggcaaggtgcgcgaagacagcgacactgacggcattgtgtattacaaaggcccgctggtggtgctggtagaccgcttcagtgcttccgcttccgagattttcgcggcggcgatgcaggattatggtcgtgcactgatcgtgggtgagccgacgtttggtaaaggcaccgtacagcagtatcgctcgctgaatcggatttacgatcagatgctgcgccctgactggcctgcgctgggttccgtgcaatacacgattcagaagttctatcgcattgacggcggcagtactcagatgaaaggcgtgacgcctgacgtgatgatgccaacgggcaccgagacggtagataccggcgagaagttcgaagataacgcgttaccgtgggacagcatcaaagcggccaactacatcaagagcggcgatctgaaagcgctgattagcaaactgaatgagcatcatcaggagcgtatcgccaaagatcctgagttccagtttgttgcgcaggacattgcccgctacaacgcgatgaaggataaacgcaacctcgtgtcgctcaatcttgctcagcgtgagaaagagaatgacgacgatgaggcgatgcgtctgaatcggattaacgatcgactggcgagagaaggtaagaaaccgctcaaatcgctggaagatttgccgaaagattatcaggctcccgatccttatctggatgaaacggtgaaaatcgctaacgatttggcgcaagaccagaaagagtaa

SEQ ID NO: 40901 - protein, 671 aa, Erwinia carotovora subsp. atroseptica SCRI1043
MNNLIRITAIAGLLLAGSSFANENITRVEQIPQLHQEPQHATVSDRVASRFLRSHYRQFMLDAQFSEKIFNRYLNMLDYSHNVLLASDVAQFSGQKAQLGDALKSGQLDIPYALYNLAQKRRFERFQYALSLLDKPVDLTGNDTFELDRSKAPWPQNAGELNRLWDAKVKYDWLSLKLTGKDDKDIKETLTKRYQFAIRRLAQSNSEDVFQLVMNAFAREIDPHTSYLSPRNTEQFNTEMSLSLEGIGAVLQMDDDYTMINSMVPGGPAAKSKNITVGDRVVGVGQSGKPMVDVIGWRLDDVVALIKGPKGSKVRLEILPAGKGTKTRIITLTRERIRLEDRAVKMSVKTVGKDKVGVLDIPGFYVGLTDDVKVQLQKLEKQNVSSIVIDLRTNGGGALTEAVGLSGLFIPSGPVVQVRDNNGKVREDSDTDGIVYYKGPLVVLVDRFSASASEIFAAAMQDYGRALIVGEPTFGKGTVQQYRSLNRIYDQMLRPDWPALGSVQYTIQKFYRIDGGSTQMKGVTPDVMMPTGTETVDTGEKFEDNALPWDSIKAANYIKSGDLKALISKLNEHHQERIAKDPEFQFVAQDIARYNAMKDKRNLVSLNLAQREKENDDDEAMRLNRINDRLAREGKKPLKSLEDLPKDYQAPDPYLDETVKIANDLAQDQKE

SEQ ID NO: 40902 - DNA, 1317 bp, Desulfotalea psychrophila LSv54
  CDS (1)..(1317)
atgcgacaacaacaaatcactgccagaaccctaggcgtttgcttaatttttctaacactttttatagcaaacagtgccctggctgaacaaaaatcaacggacaagacctacaaacagcttgaagtattcgccaccagcctgagcatacttgagcaaaactatatccagccactggaccctgagaaatctcttaccgatgccataagcggcatactacagggacttgacccccattcatcctacctctccgccaaagaatttcatgacctgcagtcggagacaagcggttctttttccggtattggcattgaggtctctacccgcaacaacaatctcaccattattgcccctctggatggcagtcctgccgcccaggccgggattgaagcgcaggatcaaataattgaaataaatggcaaaaagactgcggagatgagcagccagcaagcccttatgcttttgcgagggcccatcggttcaagcataagcctgagcctgaaaagagagggtgaagagaaccttctccatatctccttaatacgagagagaatatccctgcaatccgtaagctttctccctcttggcagagatatcttctacagcagaatcaccagctttcaaagcaacaccagccacgattatgttgaaaagctcaatcgcataaaaaagaagagagaaatacgtggactcatactcgatctgcgtaacaatcctggaggattactctcccaggcaatcagtatctccgacctgtttattagctcgggggcaatcgtccacaccagaggtcgagcagcagagcagaacatgacctttgaggccagagaccttggcgaggacaatgatttccccatgcttgtcctgataaacggtggttccgcctcggcctcggaaattgtggcaggggccctgcaggatcaaggacgggcaataattgtgggaaccgactcctttggcaagggttccgtgcagacaataatccccctaccaaacggtgcggccctaaagataacaacggctcaatactatacgcccaaaaatcgatcaatccaggcccagggcatccaccccgacatcaccctatcccgcctaaaaaaaggctccagctgcagagaaagtgccgaccaatccaccgaggccagcttaaccaatcacctggataaccctaacggaaaggcaaagagagccccccgttccgcccgggagaaaaaggtgcaaaaattgctcgccgatgacaatcaaatccgggtcgcccgggatatactacgcggcatcctgcgctactccgcctatcaggatgctcaggttggtgagtaa

SEQ ID NO: 40903 - protein, 438 aa, Desulfotalea psychrophila LSv54
MRQQQITARTLGVCLIFLTLFIANSALAEQKSTDKTYKQLEVFATSLSILEQNYIQPLDPEKSLTDAISGILQGLDPHSSYLSAKEFHDLQSETSGSFSGIGIEVSTRNNNLTIIAPLDGSPAAQAGIEAQDQIIEINGKKTAEMSSQQALMLLRGPIGSSISLSLKREGEENLLHISLIRERISLQSVSFLPLGRDIFYSRITSFQSNTSHDYVEKLNRIKKKREIRGLILDLRNNPGGLLSQAISISDLFISSGAIVHTRGRAAEQNMTFEARDLGEDNDFPMLVLINGGSASASEIVAGALQDQGRAIIVGTDSFGKGSVQTIIPLPNGAALKITTAQYYTPKNRSIQAQGIHPDITLSRLKKGSSCRESADQSTEASLTNHLDNPNGKAKRAPRSAREKKVQKLLADDNQIRVARDILRGILRYSAYQDAQVGE

SEQ ID NO: 40904 - DNA, 2133 bp, Desulfotalea psychrophila LSv54
  CDS (1)..(2133)
atgaaattaatgaaatcgttttttttctcagtccttgtgctgctttttctcagccctgttcttcatgcagattctttgacggcagaagagcaggagagggatagccttattggtcatatgctgagcaagcagttgccgacacttcattatagcgataaagaactcaatgatagcttgggagaggctgcctttagtctttacctgaaacagcttgattatcaaaaacgatttcttctccaggaggatgttgacgttctgcatagtcacgcagattccattgatgataatatgcgttccgggcaggttgttttaccaagtcttggttctgagatacttctaaaacgtgtcgctcaggtgcagcagatggttaccaaaatggttgccgccgagattggccatactcctggcgaggtgtaccagagtgatcctaaaaagctttcctatgcaaaatcactggcagaattagaggatcgctggcgtaagattcttaaggctcaggttatgtctcgttatctggatcttgaagaagaggcgcaggcggcaaagggggcagatcttgcagggaaaaaatctggagaggggacgagaaagtctgttagctccaatttcaagaagatgtgggctgaggcaacagagaaggttgccaagcaaaacaagacctttctgcataggttgactcaagagacactgcaggatcacaccgatcgtttttttaactctgtagcacgtgcctttggtccccatacaaattatattcctccagcgtccaaagaacagtttgatattaatatgcgaggcagccttgaaggtatcggtgccctgttaaaagaagaagacggtatgatcaaggtggtccgggtcatccccgggagtgcctctgccaggcagggtgggcttgagatagaagatgctatcttgagtgtagggcagggtgacgaagagcccgtggatgtgagtgatatgcgcctgcgtgatgctgtacgtttgatcaggggtgctaagggcacggaggttcgtctcaccgtaagaaaaaatggtgggctgaaatctgttgttcctattattcgtgatgttgtgcagatggaagacacctttgtcaaaagcctggtggtgaagggggatgatggggcgcggattggttatattaatatcccaagtttttaccgtgattttgaaaagagtaagaagggtgagaaggggcgcaattcaaccgatgataccagggtcgaggtgcttaagttaaaggccttgggggttgatggtattgttcttgatttgcgtaataatggtggcggagcacttgttgatgccattgatatagctgggctttttgttaaagaaggtcccatggttcaggtgcggaccagcatgggggataagcgcattctttttgatcaggatgagggtattgtttacgctggtcctttggtgattttggtgaacaagttttccgcctcggcctcagaaattgtggctgcggccctgcaggattatcaccgtgccgttattatgggcggggcccatacccatggtaaggggtcggtgcagactgttcttgatcttaatgagtatgtaccctggttgtccatggcaaattacgaagatcttggcgccctgaaaattatgattcaaaagttttatcgggtaaacggtggatccactcagtataagggtgttgagcctgatatcgtcctgccaagtatctatgagcatttgaaatccggggagaggtatcttgattactccctgccctgggatagcattgaggctattgactatacaacctttagcctttcccccgatatagagaagatacgaaaaaacagtcttgtccgggttaagaagaataaggagtttgatattattcgggacgaggtggcaaaggctgaagagcgtagtctggatacctatatttatctggatattgagcgaatgcggggggatcgaagaatggccaaggcggcccgtaagcgtcttggcgctgaggtgggtctcttggaagaggagcctaagtcgacgatttctgaaacagaggcagaaaaagagagtcactggcgccagggggtgagtcgtgacccatgggtgcaggaagcaggaagggttattgcggatattggcaggcaggtgagctga

SEQ ID NO: 40905 - protein, 710 aa, Desulfotalea psychrophila LSv54
MKLMKSFFFSVLVLLFLSPVLHADSLTAEEQERDSLIGHMLSKQLPTLHYSDKELNDSLGEAAFSLYLKQLDYQKRFLLQEDVDVLHSHADSIDDNMRSGQVVLPSLGSEILLKRVAQVQQMVTKMVAAEIGHTPGEVYQSDPKKLSYAKSLAELEDRWRKILKAQVMSRYLDLEEEAQAAKGADLAGKKSGEGTRKSVSSNFKKMWAEATEKVAKQNKTFLHRLTQETLQDHTDRFFNSVARAFGPHTNYIPPASKEQFDINMRGSLEGIGALLKEEDGMIKVVRVIPGSASARQGGLEIEDAILSVGQGDEEPVDVSDMRLRDAVRLIRGAKGTEVRLTVRKNGGLKSVVPIIRDVVQMEDTFVKSLVVKGDDGARIGYINIPSFYRDFEKSKKGEKGRNSTDDTRVEVLKLKALGVDGIVLDLRNNGGGALVDAIDIAGLFVKEGPMVQVRTSMGDKRILFDQDEGIVYAGPLVILVNKFSASASEIVAAALQDYHRAVIMGGAHTHGKGSVQTVLDLNEYVPWLSMANYEDLGALKIMIQKFYRVNGGSTQYKGVEPDIVLPSIYEHLKSGERYLDYSLPWDSIEAIDYTTFSLSPDIEKIRKNSLVRVKKNKEFDIIRDEVAKAEERSLDTYIYLDIERMRGDRRMAKAARKRLGAEVGLLEEEPKSTISETEAEKESHWRQGVSRDPWVQEAGRVIADIGRQVS

SEQ ID NO: 40906 - DNA, 1329 bp, Rickettsia typhi str. Wilmington
  CDS (1)..(1329)
atgttattacgttttattatagcactattttttagtataaattgtgtagtagaaggaaaagaaactgaaaataaaatatcaaatcaagaagcttataagcaatttcaagatgtatttgaacgtatcgaaaaggattacgtgcaggtacctgataggcaaaaaatgatagatgaagcaattaacggtatgttaaactcacttgatcctcattcaaactattacaccgatgaagatttagaagatatttttacttttacaaaaggtgaatttggtggtatcggtgtggaaataatgtatgatagtggtgcaattaagataatatcgtctattgacgatttgccagcttttaaagcagggcttaaaggtggtgattatatagtaggagtgaatgacgaattagtctctacacttggtcctaataaagctataaaagaaatgcgtggtacacctggtactaaggtgagattgttgataatcaaggaagaagaagcaaaaccacaagagctagaacttactcgtgaaatagtaaaaatcaaaccgataaaagcacatctagaaaaaaataatatcgcatatatacgtatcacgacttttaatgagtcaacaatttctgaattgaaggcagcagtaaagaagttaaaaactgaaagcaaagataatcttaaaggtataattctcgatttacgtaataatgctggtggtatacttgatcaagctattgccgttagtgattattttattgattctggtgtcattgttacaacaaaaggtagaactacgtcaagtaatagcgaaactaaagcgaatgagttttcgttaaaagcaccaagagtaccgatgattgttttgataaatggtaattctgcatctgcgtcagaaatagttgctggagctttgcaagatcataaaagagcaataatacttggtactaaatcttttggtaaaggctcagttcaggctttaacacaaattaattctagggctgctgtaaaactaactatatctaaatattataccccaagcggtcgttctattcaagcagaaggaatagagcctgatattttaattgagccggcaaaagttgagtatccagaagttaaaaaaatagataagcgtttttcagaaagttctttaaaaaattacttaaagaatgataatgaaaaaaataaagatagtaaaaaagaaacaaaagccaaaaataataagcaagaagagagtgaattatcggaattatataaaaaagattatcaatttgctcgtgcttatgatgtaattacagggttaattattaatatgaatcttgagacacaagagaacgctaaacaatga

SEQ ID NO: 40907 - protein, 442 aa, Rickettsia typhi str. Wilmington
MLLRFIIALFFSINCVVEGKETENKISNQEAYKQFQDVFERIEKDYVQVPDRQKMIDEAINGMLNSLDPHSNYYTDEDLEDIFTFTKGEFGGIGVEIMYDSGAIKIISSIDDLPAFKAGLKGGDYIVGVNDELVSTLGPNKAIKEMRGTPGTKVRLLIIKEEEAKPQELELTREIVKIKPIKAHLEKNNIAYIRITTFNESTISELKAAVKKLKTESKDNLKGIILDLRNNAGGILDQAIAVSDYFIDSGVIVTTKGRTTSSNSETKANEFSLKAPRVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNEKNKDSKKETKAKNNKQEESELSELYKKDYQFARAYDVITGLIINMNLETQENAKQ

SEQ ID NO: 40908 - DNA, 2079 bp, Yersinia pseudotuberculosis IP 32953
  CDS (1)..(2079)
atgaacaaatttgtcagactagcagcaatcgcaggcttgttactggctggggcgagttacgcaaccgatacaacgtatcgaattgatcaactccctcaattacgtcaggaacctgagcatgcaaccgtgagtgagcgcgtaacatcgcgctttactcgctctcattatcgccaatttgcattggacgatcagttttccgccaaaatatttgaccgctacctcaatatgctggattacagccataacgtattgttggcatcagatgtggcacagttcgcggataaaaagtattcgctggacaaagagttaaaatcaggtcaattagacacgccttttgccttattcaatctggcacagaaacgccgttttgaacgctatcaatatgcgttgtcagtactggaccggccaatggtctttactggtaacgatacgattgatattgatcgggccaaagcgccgtggccaagcagtgaagccgaactgaatgcgctttgggatgcaaaagtaaaatacgaccagcttaatttgaagttagcgggtaaaacggataaagagatcaaagagacgctgacgaaacgctatcaatcagccattaagcgtttgacgcaaagcaacagcgaagatgttttccagttgatcatgaacgcctttgctcgcgagattgacccgcataccaactacctttctccacgtaatactgaacagttcaataccgagatgagtttgtctctggaaggtattggcgcggtattacaaatggatgatgattatacactcatcaattctatggtccctggtggtccggcggcgaagagtaaaacgatagcggtgggtgatcgggttatcggtgtagggcaggcgggtaagccaatggttgatgttataggctggcgtcttgacgatgtggttgctctgatcaaagggccaaagggcagtaaagtacggttagaaattttacctgcgggtaaagggactaaacctcgtactgtaaccttgacccgcgagcgcattcgtctggaagatcgcgcggtgaaaatgtcggtgaaaaccatcggtaaagaacgcgtaggtgtgttggatattccgggtttctatgttggcctgaccgaagacgttaaggtgcaattacagaagcttgagaaacagaatgtcagcagcatcatcattgatctacgcagtaatggtggcggcgcattaaccgaagctgtttcactttctggtttgttcattccgagtgggccagtggttcaggtgcgggataacaatggcaaagtgcgtgaagacagtgatactgacggtgtggtgtattacaaaggcccgctggtggtattggttgatcgctacagtgcgtcggcatctgagatttttgccgccgctatgcaggattatggccgtgcattaattgtcggtgagccaaccttcggcaaaggcactgttcagcaatatcgctcacttaatcgtatatacgatcaaatgctacgccctgagtggccagcgttaggctcactgcaatacaccattcagaagttttatcgggtggatggcggtagtacgcagcgcaaaggtgtgactccggatatcgtgatgcctacaggggttgatccggcggaaacgggtgaaaacttcgaagataatgctttgccatgggacaggatcaatgctgccagttataccaaaacgggtgatttgaaaccctgggagcctgagttactgaagaatcatgctgagcgtatcgccgctaatcctgaattccagtatattcagaaagatattgagcgttataaggctttgaaagataagcgtaacattgtctctctcaattacgcccagcgtgaaaaagagaaccgtgatgatgatatgacgcgcttgactcgtttaaatgaacgcttcatccgtgaaggtaagaagcctctgaaatcgttggatgatttaccaaaagattatcaggagccagacccttatttggatgaaacggtgaatattgccttggatttagcccaccaggaaaaagctcagccacagattgcatctcgccctgtcgctgctgctaccgctaccgctggggcaacggtaaaataa

SEQ ID NO: 40909 - protein, 692 aa, Yersinia pseudotuberculosis IP 32953
MNKFVRLAAIAGLLLAGASYATDTTYRIDQLPQLRQEPEHATVSERVTSRFTRSHYRQFALDDQFSAKIFDRYLNMLDYSHNVLLASDVAQFADKKYSLDKELKSGQLDTPFALFNLAQKRRFERYQYALSVLDRPMVFTGNDTIDIDRAKAPWPSSEAELNALWDAKVKYDQLNLKLAGKTDKEIKETLTKRYQSAIKRLTQSNSEDVFQLIMNAFAREIDPHTNYLSPRNTEQFNTEMSLSLEGIGAVLQMDDDYTLINSMVPGGPAAKSKTIAVGDRVIGVGQAGKPMVDVIGWRLDDVVALIKGPKGSKVRLEILPAGKGTKPRTVTLTRERIRLEDRAVKMSVKTIGKERVGVLDIPGFYVGLTEDVKVQLQKLEKQNVSSIIIDLRSNGGGALTEAVSLSGLFIPSGPVVQVRDNNGKVREDSDTDGVVYYKGPLVVLVDRYSASASEIFAAAMQDYGRALIVGEPTFGKGTVQQYRSLNRIYDQMLRPEWPALGSLQYTIQKFYRVDGGSTQRKGVTPDIVMPTGVDPAETGENFEDNALPWDRINAASYTKTGDLKPWEPELLKNHAERIAANPEFQYIQKDIERYKALKDKRNIVSLNYAQREKENRDDDMTRLTRLNERFIREGKKPLKSLDDLPKDYQEPDPYLDETVNIALDLAHQEKAQPQIASRPVAAATATAGATVK

SEQ ID NO: 40910 - DNA, 1431 bp, Borrelia garinii PBi
  CDS (1)..(1431)
atgaaaaataaatttttaatatgcgcgtattttttactgactctgagcataagttctttagtaattgttgaatctatttttgctgttgatgagtctaataataataagttgtcaagatctagttatgagcagatgatgattcaagcttttgaatttgtaaaagaaaattatgttgaacctgtaaacgatgaagtgatttttgaaggtgctttaaaaggaatatttcaagccctaggggatccttattctcaatatttgacaaaaaaagatttagaagaaatttcaaaaacaacagtaggagattatgttggtattggaatttctataataaaaaaaatgcattctcaagataagcaagacaaggcaaaaaatcttgattctaatagcttttgtgtttctattgttacaccttttgagggaggtccggcttataaggctggaattaaatctggagattgtattatcgctgttgatggcaagagtgtttcttctatggaagtagatcaagttgttgatcgtttaaaaggcaaagagggtacaaaagttaaagtgtctattcttaggggaaaagatttaacattagattttgaacttacaagagaaaagatagaaatacaaacaatcaagtatgatgttattaatccagatattggttatataagaatagtaagctttaatccatacacttctgtagattttagcaaagctttagacaatcttaagaatagaaatattaaatctttaattctggatttaagacttaatactggtggatattttcaggcagctataaaaatggcagatgatattttatctaaaggaaccattgtttctacaaaatcaagaaattctagcaagcctattgattacaaggcaagctcaaaacaagttttgccttcagatataaaaatcgttgctttaatagatagatcatcggcgtcagcgtcggaggtttttgtaggggctttgaaagataataagagagcctatattataggcgaaaagtcttacggcaagggagttattcagcatgtagttcctttttatactggtggatttaaaattacaagctcaaagtattatactccatctggaaagagtatccacaaagttgggattgagcctgatttagaaataaaatctccagatttttctgaggaagaagcagtaatatataaagaaatttttgataaaaagctaatagaaggctttttaaaaggcaaaaaatccattactgagcaagagattgatttttttgttgagaatcttgttaaagaaaatccaaaatataaaattgataaagaatttttaggcaagtatgtgttttttaattactatcaagataataataaagaactcccaatttataatctacattatgacaaggttttaaaagcagcttgtgagtatttatctaaattaggtaattaa

SEQ ID NO: 40911 - protein, 476 aa, Borrelia garinii PBi
MKNKFLICAYFLLTLSISSLVIVESIFAVDESNNNKLSRSSYEQMMIQAFEFVKENYVEPVNDEVIFEGALKGIFQALGDPYSQYLTKKDLEEISKTTVGDYVGIGISIIKKMHSQDKQDKAKNLDSNSFCVSIVTPFEGGPAYKAGIKSGDCIIAVDGKSVSSMEVDQVVDRLKGKEGTKVKVSILRGKDLTLDFELTREKIEIQTIKYDVINPDIGYIRIVSFNPYTSVDFSKALDNLKNRNIKSLILDLRLNTGGYFQAAIKMADDILSKGTIVSTKSRNSSKPIDYKASSKQVLPSDIKIVALIDRSSASASEVFVGALKDNKRAYIIGEKSYGKGVIQHVVPFYTGGFKITSSKYYTPSGKSIHKVGIEPDLEIKSPDFSEEEAVIYKEIFDKKLIEGFLKGKKSITEQEIDFFVENLVKENPKYKIDKEFLGKYVFFNYYQDNNKELPIYNLHYDKVLKAACEYLSKLGN

SEQ ID NO: 40912 - DNA, 1398 bp, Symbiobacterium thermophilum IAM 14863
  CDS (1)..(1398)
gtggtggcgcggctgtggcgcagtttcgcggcgtccctcctggcgctcttcctgacggcggccctgtggaccgggccggcgtatgcggcgtctgatccggcccactggggcgacgccagcgcagagctgtggatggtctaccatgtggtccagaggtaccatgtcaacggcgccgacctggacgccttcctggaaggggccgtcaggggcgggctcgacgcgctgggcgatccctacaccgagtacctcggcccgcaggactatcagagcttcttggacagcgttgacggcaacctgaccggcatcggcgtctacctggagaaggtgggcgattacatcacgatcgtccggccgattcgcagcagccccgccgaggcggccggcctccgggcgggcgaccgcatcgtggccgctgacggcgtcagcctggtcggcgagtccatcgagaagacccagcagctggtgcgcggcgagcccgggacgaaggtcgtgctcaccatcgagcggcccgacgaggggcggcgctttgacgtcaccatcacccgggccttcatccacgtgccccaggtggactaccggatgctggaggacggcatcggctacctggaactctcgggattcggtcagcaggctgcggaggagttcttcgccgcggtcgccgagctgaaggaggccggagccacccgcctggtcctggacctgcggtacaacagcggcggctgggtggcgtcggcgctggagatcgccgaggcgtatgtgccggcgggcgagcccattatgttcgagatcacccgggacgagcggcgggtctaccggagcgagggcagccccctcggcctgccgaccgccgtgctggtgagtgagtacaccgcctcggcggcggagatcctcgccggcgcggttcaggactacggaaccggcgtgctgatcggcacgcagacgttcggcaagggaaccgtgcaggagctggtggacctgcccggcggcggcgccgtcaaggtgaccacggccgagtacctgaccggccggcagcgccgggtgcaccaggtgggcctgaccccggacctggtcgtggagccgtatcagccgcccgtgcacctgcagacgcccctggtcgcggaccgggtcatgaccaccggccacgtggggctggacgtgctggggctgcaggagcggctggcgctgctgggctaccgcaccgaccgggacgggtacttcaagggccagaccaccctggcggtgctgcagttcgcccgggaccacgggctgaatgaggtgccgatggtcgacaaggcgttcgtggaggcgctcaacgcggcggtcgcggcgaagctggcggccgctgagtggccggacacccagctggaggcggccatccggtacctgaaggaaaagtag

SEQ ID NO: 40913 - protein, 465 aa, Symbiobacterium thermophilum IAM 14863
MVARLWRSFAASLLALFLTAALWTGPAYAASDPAHWGDASAELWMVYHVVQRYHVNGADLDAFLEGAVRGGLDALGDPYTEYLGPQDYQSFLDSVDGNLTGIGVYLEKVGDYITIVRPIRSSPAEAAGLRAGDRIVAADGVSLVGESIEKTQQLVRGEPGTKVVLTIERPDEGRRFDVTITRAFIHVPQVDYRMLEDGIGYLELSGFGQQAAEEFFAAVAELKEAGATRLVLDLRYNSGGWVASALEIAEAYVPAGEPIMFEITRDERRVYRSEGSPLGLPTAVLVSEYTASAAEILAGAVQDYGTGVLIGTQTFGKGTVQELVDLPGGGAVKVTTAEYLTGRQRRVHQVGLTPDLVVEPYQPPVHLQTPLVADRVMTTGHVGLDVLGLQERLALLGYRTDRDGYFKGQTTLAVLQFARDHGLNEVPMVDKAFVEALNAAVAAKLAAAEWPDTQLEAAIRYLKEK

SEQ ID NO: 40914 - DNA, 1263 bp, Symbiobacterium thermophilum IAM 14863
  CDS (1)..(1263)
ttgtttgccacagagaggatgacgctgaacatggacgagcgccgcacgagattcgggctgtcgctgctcctggtcgcggtgacgggcgtggtcagctacgcgctgggggcgctgggatggccgcccgcgcttcaggaatcgatgtcgcaactcagggaccgactgccggtggcgggctcgtcgctgtcggggctccaggtggagcggctggaggaggtcatgcgggcgattcaggggcagtacgtggaagaggtggacgtcgaggctctgaacgtcggcgcgctccggggcatggtggaggccctgggcgaccggtattccaccttcttcaccccagaggagtaccgctcgttcgtcgaggggttcgagcccacgttcagcggcattggggtgacggtggagatctcccagcagaccggcctgctcaccgtggtttcgcccatcaaggggagcccgggggcgaaggccgggctgcgcacgggtgatgcgatcatccaggtggacggccgcgacatcacggggatgagcctgaacgaggccgtcgcgctcatcaaggggccgaagggcacccaggtccggctgctggtgaagcgggagggcgagcccgagccgctggagttcgtcatcacccgcgacacgatcaccgtgccggtgctcgactaccggatgatcgatcaggaggcgggcatcgggtacatccagctgttcgagttcagcaagaagggcgccgcgagccaggtgaaggaggccattgccgagctgcggagccagggcatgacccggttgatcttcgacgtccggcagaacccgggcggcctgctggatgaggtggtggagatcgcctcgttcttcctgccgaccggcgatcccgtggtgcacatcgtggagcgggcgaaggagccgcgggccctgacggccaaggaggccgaaaagtggaccggtccgctggtcgtgctggtcgacggcggcagcgccagcgcctcggagatcctggccggggccgtgaaggacgccggcgtcggcacgctgatcggcgcgaagacctttggcaaggggtccgtgcagaccttctggcggctccaggacggctcgggcatcaagctgaccacggccaagtacctgaccgccggcggccactccatcgacggccagggcgtggagcccgacatcgtcgtggggaatccgaaccgcatcatcccgggagagcccggcgacccgcagctggaggccgccgtccgccacatccgggagatggagccgtaa

SEQ ID NO: 40915 - protein, 420 aa, Symbiobacterium thermophilum IAM 14863
MFATERMTLNMDERRTRFGLSLLLVAVTGVVSYALGALGWPPALQESMSQLRDRLPVAGSSLSGLQVERLEEVMRAIQGQYVEEVDVEALNVGALRGMVEALGDRYSTFFTPEEYRSFVEGFEPTFSGIGVTVEISQQTGLLTVVSPIKGSPGAKAGLRTGDAIIQVDGRDITGMSLNEAVALIKGPKGTQVRLLVKREGEPEPLEFVITRDTITVPVLDYRMIDQEAGIGYIQLFEFSKKGAASQVKEAIAELRSQGMTRLIFDVRQNPGGLLDEVVEIASFFLPTGDPVVHIVERAKEPRALTAKEAEKWTGPLVVLVDGGSASASEILAGAVKDAGVGTLIGAKTFGKGSVQTFWRLQDGSGIKLTTAKYLTAGGHSIDGQGVEPDIVVGNPNRIIPGEPGDPQLEAAVRHIREMEP

SEQ ID NO: 40916 - DNA, 2157 bp, Mannheimia succiniciproducens MBEL55E
  CDS (1)..(2157)
atgaagttgaataaatctaaaacttatctggcaactttagtcgtgagcgcggtaatcggtatgagcggaaacgcatttgccgtgcatccgactttaaaagcaagtgatattgttattccacaaccaacagaggaaaacggattagcaactaagcgcgcgacgacaagattaacgcaatcccattatcgcaaattccagcttgacgatgaattttctcacaagatcttcgctcgttatttggattttctggattatagccataatttatttattaaatccgatattgacgaattgcaggctaaatatgcggcgttacttgatgacgaactgaatgaaggaaaattggatattgcctttgctatgtatgacttaatggcaaaacgtcgttatgaacgctatgaatatgcgttgtctttacttgataaagaaccgagcttaaaagatgatgatcaaattgaaattgatcgtaaaaaagctgcatggccggcaagcgtagaagaggcgaataagctttgggcggctcgggtcaaaaatgacattattgacttaaaattaaaagacaaaaaatggtcggaaattaagaaaaccttaaccaaacggtataatttagcgattcgtcgtttgactcaaaccaatgcggatgatattacgcaattatttttgaatgcttttgcccgcgaaattgatcctcataccagttatttagcgccgcgcacggctaaaagtttcaatgaaagtatgaatctttcgttggaaggtatcggtgcgacattacagcaggaagatgacgttactacaattaaatctttagtaccgggcgcgccggcggaacgcagtaaaagaattaaagccggcgataaaattatcggtgtaggtcaggcaaaaggcgagattgaagatgttgtcggttggcgtttggaagacgtggtcgataaaatcaaaggcaagaaaggctcgaaggttcggttggaaattgagccggcaaaaggcggtaaaagtaaaattattaccttggtacgggataaagtgcgtattgaggatagcgccgcaaaattaaccgttgaaaaagttaacggtcaaaatgttgcggtaattaaaattccgactttttatatcggcttaactgcggatgtgcgtaaattattggaacagatgaaggcgaaaaaagcgacttcattaattattgatttacgtgaaaacggtggtggcgctttaacggaagcggtggaattaagcggattgtttatcagtgacggtccggttgttcaggttcgcgatgcttataatcgtatccgtgtgcatgaagatccggataacgcacaggtttacaccggtccactcttagtgatgacaaaccgtttcagtgcatcggcatcggaaattttctccgctgctatgcaggattataaccgtggtattattattggtcaggatacgttcggtaaaggtacggttcaacaaagtcgttcgctgaatttcgtgtatgacctagatcaggaaccgttgggttttattcaatatacgatccaaaaattctatcgtatcaatggcggcagtactcaattgaagggagttacagcggatattaatttcccggcaattattgatactaaagaaaacggtgaggaaaaagaagataatgctttaccttgggataaaattccggcggcaacttattcacaagtcagccatgcaagggatgcggtagaggtactcaagtctaaacacttagatcgtatttctaaggatcctgaatttattgccttagcggaggatttaaaaattcgggacgagcgtagcgagcgtaagtatttatcgttgaattacgaaaaacgtaaagcggaaaatgataaagatgatgcccgtcgtttgaaagcgttaaatgagcgttttgcccgtgaaggtaaaaaagccttaaaagatattaatgatttagcgaaagattatgaagcgccggatttcttcctgaaagaagcggaaaaaatggcatcggatttggctaaatttgaaactgataaggaatcaatacaggctaaggctatgtcgttagaaaacaaagcggatacaaaggatgtgaaagccgaaagtaaaaaaactgcggaagtgaaaacggagacagtgaagtcaaaggaagacgttagaccggaaactaaataa

SEQ ID NO: 40917 - protein, 718 aa, Mannheimia succiniciproducens MBEL55E
MKLNKSKTYLATLVVSAVIGMSGNAFAVHPTLKASDIVIPQPTEENGLATKRATTRLTQSHYRKFQLDDEFSHKIFARYLDFLDYSHNLFIKSDIDELQAKYAALLDDELNEGKLDIAFAMYDLMAKRRYERYEYALSLLDKEPSLKDDDQIEIDRKKAAWPASVEEANKLWAARVKNDIIDLKLKDKKWSEIKKTLTKRYNLAIRRLTQTNADDITQLFLNAFAREIDPHTSYLAPRTAKSFNESMNLSLEGIGATLQQEDDVTTIKSLVPGAPAERSKRIKAGDKIIGVGQAKGEIEDVVGWRLEDVVDKIKGKKGSKVRLEIEPAKGGKSKIITLVRDKVRIEDSAAKLTVEKVNGQNVAVIKIPTFYIGLTADVRKLLEQMKAKKATSLIIDLRENGGGALTEAVELSGLFISDGPVVQVRDAYNRIRVHEDPDNAQVYTGPLLVMTNRFSASASEIFSAAMQDYNRGIIIGQDTFGKGTVQQSRSLNFVYDLDQEPLGFIQYTIQKFYRINGGSTQLKGVTADINFPAIIDTKENGEEKEDNALPWDKIPAATYSQVSHARDAVEVLKSKHLDRISKDPEFIALAEDLKIRDERSERKYLSLNYEKRKAENDKDDARRLKALNERFAREGKKALKDINDLAKDYEAPDFFLKEAEKMASDLAKFETDKESIQAKAMSLENKADTKDVKAESKKTAEVKTETVKSKEDVRPETK

SEQ ID NO: 40918 - DNA, 1686 bp, Bacteroides fragilis YCH46
  CDS (1)..(1686)
atgaaaaagtttctgaatagacgaaatggtgtcctgttggcagcagtgttggttgctgtagcattctttagtttcaagagcggtgacgaccgtaacttccagattgctaaaaatctggatacctttaattctatcgtcaaagaactcgatatgttttacgtagatacgcttgatccgaataagacggtccgtgaagggatcgactatatgttgtcttcgctcgatccctatacggaatactatccggaggacgatcaggccgaactgcagcaaatgttgaatgcctcgttcggaggtatcggatctttgatcacgtacaatcaaaagctgaaacgttcgatgatagccgaaccgtttgagggaactcctgcagctaaggtcggattgaaggccggtgatatactgatggagattgacggaaaagatttggcggggaaaaataaccaggaagtcagccagatgctccggggagcagtaggtaccagtttcaagctgaaagtggagcgtccggacgaaaaaggaggaacacggccattggaatttgatattgtgcgtcaaaccatccagactccgatgattccttatgataccatttttaataagaatgtaggttacatcaatctgagtactttttccggcactccttcgaaagattttaagaagacctttctgaaactgaagaaagaaggtatcacttcattggtgattgacctgcgtggtaacggtggcggacgcttggaagaagcggtagagattgctaattttttcttgcctcgtggtaaagtgattgtaacgacgaagggaaagaccaaacaggccagcaatacttataagacattacgtgaaccgctggatctcgatatcccgattactgtactggtgaacggtgctacggcttccgcttccgaaatcctttccggagctttccaggatttcgaccgtgccgtgattgtaggtagccgtacgtttggaaaaggactggtgcagaccacccgcccattgccttatggaggagtaatgaagcttactacttctaagtattacattcccagcggacgctgtgtgcaggccatcgactataaacaccgcaatgaagatggcagtgtaggtactatccccgatagtctgactaccgtgttccatacggcagccggtcgtgaagttcgtgatgggggaggagtgatgccggacatcgaagtcaagcaggagaaattgcctaatattcttttctatctggtacgtgataacctgattttcgattatgcgacgcagtattgcctgaagcatccgagtattccttctccacaggagttcaaggtgaccgatgccgactataacgactttaaagcgatggtgaagaaagctgatttcaagtacgatcagcaaagtgagaagattatgaagacgctaaaagaggctgccaagttcgaaggttatctggatgaggcttcggaagagattaaggcattggagaagaagctgactcataacctggaccgtgacctcgactatttctctaaagatatcaggtcgatgatcgccgatgaaatcattaagcgttactactacacacgtggcggcatcatccagcaattaaaagatgacgacgggctgcaagctgctcttaagatattggccgatccggtgaaatataaagagaccttgagtgctccggtaaagaaataa

SEQ ID NO: 40919 - protein, 561 aa, Bacteroides fragilis YCH46
MKKFLNRRNGVLLAAVLVAVAFFSFKSGDDRNFQIAKNLDTFNSIVKELDMFYVDTLDPNKTVREGIDYMLSSLDPYTEYYPEDDQAELQQMLNASFGGIGSLITYNQKLKRSMIAEPFEGTPAAKVGLKAGDILMEIDGKDLAGKNNQEVSQMLRGAVGTSFKLKVERPDEKGGTRPLEFDIVRQTIQTPMIPYDTIFNKNVGYINLSTFSGTPSKDFKKTFLKLKKEGITSLVIDLRGNGGGRLEEAVEIANFFLPRGKVIVTTKGKTKQASNTYKTLREPLDLDIPITVLVNGATASASEILSGAFQDFDRAVIVGSRTFGKGLVQTTRPLPYGGVMKLTTSKYYIPSGRCVQAIDYKHRNEDGSVGTIPDSLTTVFHTAAGREVRDGGGVMPDIEVKQEKLPNILFYLVRDNLIFDYATQYCLKHPSIPSPQEFKVTDADYNDFKAMVKKADFKYDQQSEKIMKTLKEAAKFEGYLDEASEEIKALEKKLTHNLDRDLDYFSKDIRSMIADEIIKRYYYTRGGIIQQLKDDDGLQAALKILADPVKYKETLSAPVKK

SEQ ID NO: 40920 - DNA, 1623 bp, Bacteroides fragilis YCH46
  CDS (1)..(1623)
atgaaaagaataatatacctgcttatcggtttgtgttccgttttgggactacaggcacagaactttggctcacccgccatgcgaaaattacaactggcagagttcgccatctctaatttatatgtagatacggtcaatgaaaacaaactcgttgaatcggccatcatagaaatgctggcacaactcgaccctcattccacctattcggatgccgaagaggtgaagaaaatgaatgaaccgctccaaggcaatttcgaagggataggtgtacagtttcagatgatcgaagatacgctgctcatcgtacaaccggtgagtaatggcccgtccgaaaaggtaggtatcctggcaggagaccgtatcatcgcggtgaatgacacagccatagcaggcgtaaaaatgggaacagaagaaatcatgggacgcctgcggggccccaaagattcgaaagtaaacctgaccattatccgcagaggtgtgaaagaaccgcttttatttaatgtaaaacgagataaaattccaatcctcagcctggatgctgcttatatgattcagcctaaaataggatacatccgtatcaaccgttttggagcaactaccgccgaagagtttctaaaagccctgaaagagttacagaaaaaagggatgaaagacctgattctggacctgcaaggcaacggaggtggttatctgaatgccgccatcgatctggcaaacgagttcctgggacaaaaagaactgattgtctacacagaaggacgttctgcacaacgcagtgagttttttgccaaaggtaacggaaacttccgtaacggacgtctggtggtattggtagacgaatattcggcttcggcaagtgagattgtgacaggtgccattcaggattgggacagaggagtggtggtaggacgccgttctttcggtaaaggactggttcaacgcccgatcgaccttccggacggttctatgatccgcctgaccattgcccgctactatacacctgcaggacgttgcatacaaaagccttatgacagcagcatcaacgaaaaaccgggaaaaggaaaaagcagtgaaagcagcatcgaaaaatacaaccaggatctgatcgaccggtataatcatggcgaaatggtcagtgcagacagcatccacttcccggattcactgaaatgccagactaaaaaactgggacgtacggtttatggtggaggaggtatcatgccggactacttcgttccggtagacacaacgctgtataccgactatcaccgtaacctggtagccaaaggggtagtcattaaaaccacaatgaacttcattgaaaagaaccgaaaggctttattggataaatataagacattcgagaaattcaatgaaaagtttgaaatcgacgaccagctattgaactacctgagagaagctgccgataaagaaaagattgaattcaacgaagagcagtacaacaaagccctgccactgattaaagcgcagctgaaagctttgatagcccgtgacttatgggatatgaatgaatatttccaagtaatgaatgccaccaataagagtgtggagcgggcactggaaatcttaaatgacaaagagtacgaaaagatattgaaataa

SEQ ID NO: 40921 - protein, 540 aa, Bacteroides fragilis YCH46
MKRIIYLLIGLCSVLGLQAQNFGSPAMRKLQLAEFAISNLYVDTVNENKLVESAIIEMLAQLDPHSTYSDAEEVKKMNEPLQGNFEGIGVQFQMIEDTLLIVQPVSNGPSEKVGILAGDRIIAVNDTAIAGVKMGTEEIMGRLRGPKDSKVNLTIIRRGVKEPLLFNVKRDKIPILSLDAAYMIQPKIGYIRINRFGATTAEEFLKALKELQKKGMKDLILDLQGNGGGYLNAAIDLANEFLGQKELIVYTEGRSAQRSEFFAKGNGNFRNGRLVVLVDEYSASASEIVTGAIQDWDRGVVVGRRSFGKGLVQRPIDLPDGSMIRLTIARYYTPAGRCIQKPYDSSINEKPGKGKSSESSIEKYNQDLIDRYNHGEMVSADSIHFPDSLKCQTKKLGRTVYGGGGIMPDYFVPVDTTLYTDYHRNLVAKGVVIKTTMNFIEKNRKALLDKYKTFEKFNEKFEIDDQLLNYLREAADKEKIEFNEEQYNKALPLIKAQLKALIARDLWDMNEYFQVMNATNKSVERALEILNDKEYEKILK

SEQ ID NO: 40922 - DNA, 1575 bp, Burkholderia pseudomallei K96243
  CDS (1)..(1575)
atgcgtatgaaattgaagaacatcggcctgattgccgcgggcctcgcgactggcgtcttcgcgacgctgcaaatctccgcgtcggcccagcaggccgtcacgacggccgccgcgccgctgccgctcgaccagttgcggctcttcgccgaagtgttcgggcagatcaagcgcgaatacgtcgagcccgtcgacgacaagaagctgctgaccgcggcgatcaagggcatggtgtcgagcctcgatccgcactcgtcgtacctcgacaagaccgattaccaggaactgcaggagcagacgaagggccgcttcgccggcctcggcatcgagatttcgcaggaagacggcctcgtcaaggtgatctcgccgatcgaggacacgcccgcgttccgcgccggcatccgtccgggcgacctgatcacccgcatcaacgatcgcccggtgcgcggcatgacgctcgacaaggcggtcaagcagatgcgcggcgagcccggcacgaaggtcacgctgacgatcttccgcaagagcgacgaccgcacgttccccgtcacggtcacgcgcgcggtgatccgcgtgcagagcgtgaagatgaagctgctcgatccgggctacgcgtacatccgcatcacgagcttccaggagcgcacgacgcccgatctcgccgcgaagctgcaggacatcgcgcgccagcagccgaacctgaagggcctgatcctcgatctgcgcaacaacggcggcggcctgctgcaaagcgccgtcggcgtcgcgggcgcgttcctgccgccggattccgtcgtcgtgtcgacgaacggccagatccccgattcgaagcagatctaccgcgacaactacgagaactaccgcctgccgtcgttcgactccgatccgctgaagaacctgcccgccgtcttcaagacggtgccgatgatcgtgctgacgaacgcgtattcggcgtcggcctcggagatcgtcgcgggcgcgctgcaggattcgcaccgcgcggtgatcatgggcaaggcgacgttcggcaagggctcggtgcagacggtgcggccgatgacagccgattccgcgctgcgcctgacgaccgcgtactactacacgccgagcggccgctcgatccagaacaagggcatcctgcccgacattccggtcgatcagtacgcggacggcgatccggacgacgtgctcgtcacgcgcgaggtcgattacacgaaccacctcgcgaacacgcaggatccgaacgagaagaaggagctcgaggaacgcgagcagcgccggatggagcagttgcgcatcctcgaggagcagaacgacaagaagacgcccgagcagcgtcagaaggatcgcgagcgcaagccgatcgaattcggcagcgccgacgatttcatgatgcagcaggcgctcaacaagctcgaaggcaagccggtcgagcagtcgaagatgatcgccgccgacagcaccgcgaagagcgccgccgccaaggcgggcgtcgcctcggcggcgaagggcgcgtcgggcgcggcggccaagcccgcgtcggcagccaagccggcgtcggcgccgcaaccgcagtaa

SEQ ID NO: 40923 - protein, 524 aa, Burkholderia pseudomallei K96243
MRMKLKNIGLIAAGLATGVFATLQISASAQQAVTTAAAPLPLDQLRLFAEVFGQIKREYVEPVDDKKLLTAAIKGMVSSLDPHSSYLDKTDYQELQEQTKGRFAGLGIEISQEDGLVKVISPIEDTPAFRAGIRPGDLITRINDRPVRGMTLDKAVKQMRGEPGTKVTLTIFRKSDDRTFPVTVTRAVIRVQSVKMKLLDPGYAYIRITSFQERTTPDLAAKLQDIARQQPNLKGLILDLRNNGGGLLQSAVGVAGAFLPPDSVVVSTNGQIPDSKQIYRDNYENYRLPSFDSDPLKNLPAVFKTVPMIVLTNAYSASASEIVAGALQDSHRAVIMGKATFGKGSVQTVRPMTADSALRLTTAYYYTPSGRSIQNKGILPDIPVDQYADGDPDDVLVTREVDYTNHLANTQDPNEKKELEEREQRRMEQLRILEEQNDKKTPEQRQKDRERKPIEFGSADDFMMQQALNKLEGKPVEQSKMIAADSTAKSAAAKAGVASAAKGASGAAAKPASAAKPASAPQPQ

SEQ ID NO: 40924 - DNA, 1326 bp, Methylococcus capsulatus str. Bath
  CDS (1)..(1326)
atggtgaaagtgacgggcatgcgtgcactcaagatcggtttgttggtcggtgtggtgtcggcggcgagttgggcagaagacaagcccacgtccgcgggggcggtcaatatcccgttcgaggggttgaagaccttttccgaggtctacggccgcatccagcaggactatgtcgagccggtaccggacgacaagctgctggaggacgccatccgcgggatgttgtcgggcctcgatccgcactccacctatctggaccaggagcagtacaacgaattgaaggtcgggaccaccggccagttcggcgggctgggcatcgaagtcggaatggagaacggcttcgtcaaagtgatcgcacccatcgacgacacgccggcattccatgcaggcatcaaggcgggcgacctgatcatccgcctcgacgacaagccggtgaaaggcatgtccctcaacgatgcggtcaagatgatgcggggtgaaccgggcagcccgatcgtgctgaccgtggtccgtgaaggcgtcgagcagccgctcaagatcaccatcacccgcgacatcatcaagatcaagagcgtcaagagccggattctcgaggatggctacggctatctgcgcatcaccagtttccagtccaagaccggggacaatgtgatcgaggccatcgacgagatgaagaagaagggggcactgaaaggactcgttctcgacctgcgcaacaatcccggcggagtgctcaatgccgcggtggcggtcagcgacgctttcctcgaaagcggtctgatcgtttacaccgatggccgggtggaggatgccaagatgcgcttctcggcgacgcccaacgacgtcatcggcggtgcccccatggtggtgctgatcaacggtggttcggcttcggcctcggagatcgtggcgggtgcgctgcaggatcacaaacgggcggtcatcatgggcgagaagaccttcggcaaaggctcggtgcagactatcctcccgaccagcaacggcggcgcggtcaagctcaccacggcgcgctactacacgccgtcggggcgttcgatccaggccgagggcatcacgccggatgtgccgatctcccgggtcaagctggaaatggcggcgaagtcggagttcgcccccatcaaggaggctgatctcaccggccatctgagcaacgacaaggccaagaaaggcggcgaggcgaaggatgcgaaggacaaggagtcggacaaggtcgacgacacgctcgccctgcaggactatccgctgaatgaagcgctcaacctgctcaagggcatcaacatcgtgcacaaaaacggcgtcaagaactga

SEQ ID NO: 40925 - protein, 441 aa, Methylococcus capsulatus str. Bath
MVKVTGMRALKIGLLVGVVSAASWAEDKPTSAGAVNIPFEGLKTFSEVYGRIQQDYVEPVPDDKLLEDAIRGMLSGLDPHSTYLDQEQYNELKVGTTGQFGGLGIEVGMENGFVKVIAPIDDTPAFHAGIKAGDLIIRLDDKPVKGMSLNDAVKMMRGEPGSPIVLTVVREGVEQPLKITITRDIIKIKSVKSRILEDGYGYLRITSFQSKTGDNVIEAIDEMKKKGALKGLVLDLRNNPGGVLNAAVAVSDAFLESGLIVYTDGRVEDAKMRFSATPNDVIGGAPMVVLINGGSASASEIVAGALQDHKRAVIMGEKTFGKGSVQTILPTSNGGAVKLTTARYYTPSGRSIQAEGITPDVPISRVKLEMAAKSEFAPIKEADLTGHLSNDKAKKGGEAKDAKDKESDKVDDTLALQDYPLNEALNLLKGINIVHKNGVKN

SEQ ID NO: 40926 - DNA, 2001 bp, Photobacterium profundum SS9
  CDS (1)..(2001)
atgaactgtcgattccgtttttccctgatcgctgctggcatgatgctggcagcctcagcgcaagccctagaggctaagtattcattaagtgatttgccacaacttgcgcctgaaaagcagcatgctacggcaagtaaaagggttgcttcgcggtttacacgttcgcactacaagcaattctctcttaatgatcaattttcttctgacatgttcgatcgttatgtcgaaatgttggacttcaataaaagcttccttactgcggctgatgttaggctacttgaaaaatggcaaaacaaattcgatgaccaacttaaagttggtgatacatcgggggcttttgaaattttcaataaagtgcttcaacgtcgttatgatcgctatcaatacgcgttaacattgctagataacgaaattaaatttaatactaatgatgactttgttgtcgatcgttcagaattggattgggctgcagatcgtaatgcattaaatgaaatttggcgccaacgtgtaaaatacgatgcgttaaatctgaaacttgcagataaagattggaaagaaattaaagaaaccttgagcaagcgttataacaatgcgttaaagcgtctcacacaaactcatagcgaagatgtatttcaaatttacatgaatgcatttgcacgtgaagttgatccgcataccagctatttatctcctcgtaatgcagaacaattccaatcagagatgaacctatctttggaagggatcggtgctgtgcttcaagttgttgatgattacactgttattcgttcgcttgttgctggtggccctgcgtcatcatctaaaaagcttgctgcaggcgaccgaattattggtgttgcacaagacggaaagagcgttgtcgatgttattggctggcgtttggacgatgttgttcagttgattaaaggccctaaaggtagcaaggttaaacttgagattcttccggaaggaaagaacgccaaaagttacgatataactattgtgcgtgataaaatccgtttagaagatagagcggtgaaatctgaagtgaaaacagtcggcagtaagaaaataggtgtaattgaagtacctagtttctacgttggtttggctgaagacacgaaaaaagagatcgcaaaactaaacgaatcacaagtcgatggtgtggttatcgatcttcgtaataacggtggtggtgcgcttacagaggcaacagcattaaccggtttatttataaacagtggcccggttgttcaagttcgtgacagttatggccgtgtaaaagtaaatggtgattctgatgatcgcgtttattttgatggaccgttaaccgtactacaaaatcgatacagtgcatctgcttctgaaatttttgccgctgcaacacaagactatggtcgagctgttgtgattggtgagcaatcttttggtaagggtactgttcagcagcaccgttcactgaatcatatctatgatttgtttgataagcctttaggtcatgtccaatatacaattcagaaattctaccgtattaacggtggtagtactcagaatttaggtgttgtacctgatattgctttcccaacggctgtcgatccagctgaaacgggtgagagtgttgaagataacgctttaccgtgggacagcattaaacctgcaagttatcaaaaattagtaaattattccccaatattgccttctttaaaagcgaagcatgagcaacgcataagcaaagatatggaattcggttttattcgtgatgacattcaagaatacaaaaaggataaagatattaagaccatttctttgaatgagaaaatgcgtattgcggaacaggataagacagacagtaaacgattagcacgtttgaataagcgccagaaagtattaggtaaaaaaccttttgctacactggaagatgtgccgaaagattatgagtcaccagatgcttaccttgatgaagctgttgatataacagcggatttagttaacgctcaaagttaa

SEQ ID NO: 40927 - protein, 666 aa, Photobacterium profundum SS9
MNCRFRFSLIAAGMMLAASAQALEAKYSLSDLPQLAPEKQHATASKRVASRFTRSHYKQFSLNDQFSSDMFDRYVEMLDFNKSFLTAADVRLLEKWQNKFDDQLKVGDTSGAFEIFNKVLQRRYDRYQYALTLLDNEIKFNTNDDFVVDRSELDWAADRNALNEIWRQRVKYDALNLKLADKDWKEIKETLSKRYNNALKRLTQTHSEDVFQIYMNAFAREVDPHTSYLSPRNAEQFQSEMNLSLEGIGAVLQVVDDYTVIRSLVAGGPASSSKKLAAGDRIIGVAQDGKSVVDVIGWRLDDVVQLIKGPKGSKVKLEILPEGKNAKSYDITIVRDKIRLEDRAVKSEVKTVGSKKIGVIEVPSFYVGLAEDTKKEIAKLNESQVDGVVIDLRNNGGGALTEATALTGLFINSGPVVQVRDSYGRVKVNGDSDDRVYFDGPLTVLQNRYSASASEIFAAATQDYGRAVVIGEQSFGKGTVQQHRSLNHIYDLFDKPLGHVQYTIQKFYRINGGSTQNLGVVPDIAFPTAVDPAETGESVEDNALPWDSIKPASYQKLVNYSPILPSLKAKHEQRISKDMEFGFIRDDIQEYKKDKDIKTISLNEKMRIAEQDKTDSKRLARLNKRQKVLGKKPFATLEDVPKDYESPDAYLDEAVDITADLVNAQS

SEQ ID NO: 40928 - DNA, 1320 bp, Thermus thermophilus HB8
  CDS (1)..(1320)
atgaagcgacgcgcgtggttcatggtagggctcggggcgctcctcgccctggtgtacgcccagcttccccggcctcaggcggagaccttcctgcagaaccccaacggccaggccctcctggaggtctaccagaggatccaacaggactacctggagcccctctccaaggagaagctggacaagctcctggaaggggccatcggcgggatggtccaggccctcgaggaccccttcaccagctactccccgccccagcgctccaccctgcgccaagaggacctaaggggcgagttcttcggcatcggggccaccctctcggccgcgaaccccgacggcacgggagcgcggattgagggggtcatgaaggggcttcccgcccagcgggcgggcctcagggccggggacgtgattttggaggtggacggggaggacgtgaccaagctccccctcctggacatcgtggcgaagatccgggggcgggagggaaccaaggtcaccctgaaggtgcggcgggaaggcgtgcccgcccccctggtctttgagctcgtgcgcgagcgggtggagatcatctccgtgtccaccgccaaggtgggggacgtgggctacgtggccctggaaaccttcgccaacttcaaggtggaggaccagctgaagcgggccatagaagagctcaaggcccagggcgtgaagaagctgatctttgacctgagggacaacggcggagggctcctggaccaggggtgcgccgtggccagcgccttcctcaaggagggccccatcgtctacacccgcaccaagaacctcacccgcgtctggtgcgaggccacgggccaaaccctctgggacgggcccatggtggtcctggtgaacggcaactccgcttcggcgagcgagatcgtggccggggccctccaggactacggccgggccaaggtcatcggggagaagaccttcggcaagggcgtgggccagaccccctacaccctggcgaacggcggggagctcaccctggtcacctttgagtggctcacccccaagcgccgctccatcaacaaggaggggatcaccccggacatcgtggtgaaggacacccgcttccccacgcccttctccctgcaaggggcgggggcgccgccgggggcggagatcgccgtgaccctgaacggcaagaccgtcaaggtgaaggcggacgcggaaggcaagttctcctacgccgagccgcagcggcagaggcctcttcccgaggaccggggccaggcggttctggacctggagaacgacgccatcctcaagcgggccctggaggagctaaaccgctag

SEQ ID NO: 40929 - protein, 439 aa, Thermus thermophilus HB8
MKRRAWFMVGLGALLALVYAQLPRPQAETFLQNPNGQALLEVYQRIQQDYLEPLSKEKLDKLLEGAIGGMVQALEDPFTSYSPPQRSTLRQEDLRGEFFGIGATLSAANPDGTGARIEGVMKGLPAQRAGLRAGDVILEVDGEDVTKLPLLDIVAKIRGREGTKVTLKVRREGVPAPLVFELVRERVEIISVSTAKVGDVGYVALETFANFKVEDQLKRAIEELKAQGVKKLIFDLRDNGGGLLDQGCAVASAFLKEGPIVYTRTKNLTRVWCEATGQTLWDGPMVVLVNGNSASASEIVAGALQDYGRAKVIGEKTFGKGVGQTPYTLANGGELTLVTFEWLTPKRRSINKEGITPDIVVKDTRFPTPFSLQGAGAPPGAEIAVTLNGKTVKVKADAEGKFSYAEPQRQRPLPEDRGQAVLDLENDAILKRALEELNR

SEQ ID NO: 40930 - DNA, 1449 bp, Geobacillus kaustophilus HTA426
  CDS (1)..(1449)
gtgaaaaaatcgacgacggccgcattgatggccatatcgatgctcattggggcgggagggacgtacgctggccttcagttggcggaccgcccgatggaaggctcgctttcgacgattgtttcgaatgagccgtccaagtcgacgaacgacagcgaagagatgaaaaaaatccggcaagcttatgagctcattaagaatcggtacgtggagaaagtggatgaagaaaaactgacggaaggcgccattcaagggatgatcaacacgctccatgacccgtattccgtctacatggatgcggaaacgacggagcagttcaacgagtcgctcgactcatcgtttgaggggatcggcgccgaagtgagcatgatcgacggcaaggtgacgatcgtggctccgatcaaaaactcgccggcggaaaaagcggggctgaagccgaatgaccaaattttgcgcgtcaacggagaaagcctggaagggcttgatttatatgaagcggtattgaaaatccgcggcaagaaaggaacaacggtggagcttgacattttgcgccccggcgtcaaaaacgtgatgaaagtcaaggtcgtccgcgacgaaattccgattcagacggtgtatgactcgatcaaaacatacaacggcaaaaaggcgggctatttgcaaattacgtcgttttcggaaaacacggccgccgactttaaaaagaagttggcgaagcttgaggccgaacatattgatggcttgatcatcgatgtgcgcggcaatccgggcggctatttgcaaagcgttgaggaaattttgaagcagctcatcccgaaaggcaaaccatatgtacaaattgaagaacgcgatggcgatcggcaaaagttttattccgatttaacggcgaaaaagccatacccgatcgttgtgctcatcgacaaaggaagcgcctcggcgtcggaaattttggcaggtgcgatgaaggaagcgggcggctacaagctggtcggcgagacgacgtttggcaaggggacggtgcagcaggcgattccgatgggcgacggcagcaacatcaaattgacgctgtacaaatggctgacgccggacgggcattggatccataaaaaaggcattaagcccgatgtcgcggtggtacagccggattacttccacgtcgctccgcttcatgtggaaaaaccgcttcggtatgacatgaacgacgagcaaatcgccaatgcgcaaaaaatgctcaaagggcttggcttcaacccgggccgcacggacggctacttcagcaaagaaaccgaacaggccgtccaagcgttccaaaaagcgaatcagctgccggttacgggacgaatcgatgaggcgacggcggatgcgctgcaaacgaaaatcatggaagccgtccgcgatccgaaccatgatgtgcagctgaaaaaagcgcttggcgtgttgtttccgtcgtaa

SEQ ID NO: 40931 - protein, 482 aa, Geobacillus kaustophilus HTA426
MKKSTTAALMAISMLIGAGGTYAGLQLADRPMEGSLSTIVSNEPSKSTNDSEEMKKIRQAYELIKNRYVEKVDEEKLTEGAIQGMINTLHDPYSVYMDAETTEQFNESLDSSFEGIGAEVSMIDGKVTIVAPIKNSPAEKAGLKPNDQILRVNGESLEGLDLYEAVLKIRGKKGTTVELDILRPGVKNVMKVKVVRDEIPIQTVYDSIKTYNGKKAGYLQITSFSENTAADFKKKLAKLEAEHIDGLIIDVRGNPGGYLQSVEEILKQLIPKGKPYVQIEERDGDRQKFYSDLTAKKPYPIVVLIDKGSASASEILAGAMKEAGGYKLVGETTFGKGTVQQAIPMGDGSNIKLTLYKWLTPDGHWIHKKGIKPDVAVVQPDYFHVAPLHVEKPLRYDMNDEQIANAQKMLKGLGFNPGRTDGYFSKETEQAVQAFQKANQLPVTGRIDEATADALQTKIMEAVRDPNHDVQLKKALGVLFPS

SEQ ID NO: 40932 - DNA, 1407 bp, Geobacillus kaustophilus HTA426
  CDS (1)..(1407)
atgaatgtgattcagcgatgggcggcggctcttctgttgtttgcggctccatttttggcttggagcccaccggcggaggcggcgccggcgtcaacgaaggtgctcgaagaagtgagggagttggttcgtcagtattatgttgaacccgtaagcgatcgagtgctgaaagccagcaccccgcaagatattgtcaaacagcttgacccgtattctgcctatatgacaaaacaagaatacgaggaatttttgaagtggattgacatggagtctgtcggcatcggcgtgatggttgaggaagatgaggacggcgtccacatcctgtctgtcttggacaatggaccagccgcccgcgccgggctgcagccgggcgatgtgattcgggcggttgacgggcagccggtaacaaatgagactatggaaaaagtattgagcttgatcgcaggggaagaaggaacgacggtggccgtaaccgtttggcggccgtcgaccgaggaaaccgtcagcgtcaccatcaagcgggaaaaaatcgactggccgaacgttgagttcaaacggctggcagggaatatcggctatattcagctatatagttttgatgagacagcgcccggtgagatcgaacgcgccatccgctcgttaagcggggtgaaagggtggatttttgacctccgcgacaatcaggggggatatgtggaaacggcgcagaaaatcgccggctttttcccgaatgtgaaacaggcgtttcagttgcgcgaccgttcgaatcacccagaagtgtatgccgctgtcaaacagccggtgcaaatgacgggaccgatccggctgcttgtcaacgcgtcgagcgcgagtgcgtcggaaatgttggcggcggcggtgaaggagcaaaaggcggccgttttgtatgggcaacggacgtttggcaaaggatcgatgcaggaaatgtttgagctgtcggacggcagcatgttgaagttgaccgtcgcccactttttctcgccaaaagggacgccgattcataacgttggggtgaagccggatgtgccgacggtcgttgggaaagagctgtatgccgctcaccgcgatttgctgattgggcagctgaaagggtatcagtcgctcggcaagctgcgcaatgcgccggtcgataagacgtttgtcgtccgtttctctcgtccgctcgccaataccgcggtaagcggagtaaaattgtatcaattaggtggacaggaagtagcggtgacggcgcaaatccgccgggggacggagcttttgatcaaaccggcagcgaagctggccaaagggcagagctatttgttggtcattccgccggtgttaaaaagcaaagacggtgtggcgatgaaaaaaggcgcttacatggagattcaaaccgctgcttctacgaaataa

SEQ ID NO: 40933 - protein, 468 aa, Geobacillus kaustophilus HTA426
MNVIQRWAAALLLFAAPFLAWSPPAEAAPASTKVLEEVRELVRQYYVEPVSDRVLKASTPQDIVKQLDPYSAYMTKQEYEEFLKWIDMESVGIGVMVEEDEDGVHILSVLDNGPAARAGLQPGDVIRAVDGQPVTNETMEKVLSLIAGEEGTTVAVTVWRPSTEETVSVTIKREKIDWPNVEFKRLAGNIGYIQLYSFDETAPGEIERAIRSLSGVKGWIFDLRDNQGGYVETAQKIAGFFPNVKQAFQLRDRSNHPEVYAAVKQPVQMTGPIRLLVNASSASASEMLAAAVKEQKAAVLYGQRTFGKGSMQEMFELSDGSMLKLTVAHFFSPKGTPIHNVGVKPDVPTVVGKELYAAHRDLLIGQLKGYQSLGKLRNAPVDKTFVVRFSRPLANTAVSGVKLYQLGGQEVAVTAQIRRGTELLIKPAAKLAKGQSYLLVIPPVLKSKDGVAMKKGAYMEIQTAASTK

SEQ ID NO: 40934 - DNA, 2058 bp, Idiomarina loihiensis L2TR
  CDS (1)..(2058)
atgaaacactgggctgtaaagaaatgtgcattggcactgatgtgtgttgttcctgttgcggttgccataccgccagagcacaagatcagtgaattaccagagttagagcaggaagctcagcatgatacagccagtgagcgtattgcgtcctattttacccgttatcatttcagtagtttgacgctggataacgagttatctgagcaaattcatgagcgctactttgacttgctggattacagcaaaatgtttcttctgaaagaggatatagaagccgcccaggagtatcgtcatttgtttgatgacatgctgaaacggggggagcttgatgttgcttacgacatttatcagaaaagtcttgagcgacgttttcagcgttacgagtatgcgctttctatattggatgaagacaagcccatggatttttcggttgagggtgacaagtactactacgatcgtgaagatgctgattgggcggagtccaaagaagagttggacgagctttggcaaaaccgtgttaaatacgatgcgcttaatttgaaactggccggtaaagagtggccagagatagttgagacactcggcaagcgttataacagtgcattaaatcgactgacaaaatcgaaaagcgaagatgtttttcaaaccgttatgaacgcgtttgcccgttcagttgagccgcatacaagttacctatcgccttccaactcagagcgatttcagcaaaatatgaatctcgaactggaaggaattggcgcagtacttcagtcagaatacgattacacaataattcgcagtttagtcccaggcggtcctgcggataaaaccgatgagctttctccagaagataagatcatagctgtaggccaaggctccggcgaggatgaagaggagtttgttgacatcattggcatgcgtctggacgatgtcgttgagttaattaaaggacccaaaggaacaaccgtccgtttgcaggttttaaaagccagccaaggtgccggcggcactccaagtgaagttgaaattgtccgcgacaaggtcaaactggaggatcgtgcagcaaaagccgaagtcaaagagttcgaagaggggccttataaagggcgtcgtcttggtgttatcgaaattcctgggttctacaataacctaacagctgatgtcaaaaagctgattgaggatttagaaagccagaaagtagaaggcttagtgattgatttgcgcggtaatggtggcggtgctttaaccgaagctattggtttgagcggactatttattgataaaggcccagtagttcaggtgagtgacgggcgcgggcgtgtcgatgtcagtgaagacaaagacggtaaaacctactatgacgggccattgttcgttatggttgaccgttacagtgcttcagcgtctgaaatttttgccgcggccatgcaggattatgaacgtgccttaataataggtgaaaatacctttgggaaaggtactgtgcaacaacatcgaggacttgcccggcgcttcgatttctacgataagccactaggcagcgttcaatataccattgcgaaattctaccgcatagatggtggcagtacacagttaagaggtgttcagccagacgttgttttcccttcgtttgttgaagcttcagactggggtgaaagcaaagaagacaacgcgttaccctgggataaaatagataaggcgagttatagtcccgttggtgaaattaacagtgctgaagtaaaagatttgcaacagcagttaaatcagagaattgaagatgacccagaattttcttacatatttgaagaaatagaacgttatagagaagagaaagataaaacatgggtcagcttggtgttaactgagcgtgaaaagaaacaagagcagcaaaaagctaagcaacttgagcgagttaacgaacgcctgaaacgtgcgggaaaagagccaatcgagaacgttgaagacgctcccgatgaatttaccgaggtagatcccttcctcgatcaagccgctttggttgcatttgatttcattgataaaaatcaacttgcctcgaattaa

SEQ ID NO: 40935 - protein, 685 aa, Idiomarina loihiensis L2TR
MKHWAVKKCALALMCVVPVAVAIPPEHKISELPELEQEAQHDTASERIASYFTRYHFSSLTLDNELSEQIHERYFDLLDYSKMFLLKEDIEAAQEYRHLFDDMLKRGELDVAYDIYQKSLERRFQRYEYALSILDEDKPMDFSVEGDKYYYDREDADWAESKEELDELWQNRVKYDALNLKLAGKEWPEIVETLGKRYNSALNRLTKSKSEDVFQTVMNAFARSVEPHTSYLSPSNSERFQQNMNLELEGIGAVLQSEYDYTIIRSLVPGGPADKTDELSPEDKIIAVGQGSGEDEEEFVDIIGMRLDDVVELIKGPKGTTVRLQVLKASQGAGGTPSEVEIVRDKVKLEDRAAKAEVKEFEEGPYKGRRLGVIEIPGFYNNLTADVKKLIEDLESQKVEGLVIDLRGNGGGALTEAIGLSGLFIDKGPVVQVSDGRGRVDVSEDKDGKTYYDGPLFVMVDRYSASASEIFAAAMQDYERALIIGENTFGKGTVQQHRGLARRFDFYDKPLGSVQYTIAKFYRIDGGSTQLRGVQPDVVFPSFVEASDWGESKEDNALPWDKIDKASYSPVGEINSAEVKDLQQQLNQRIEDDPEFSYIFEEIERYREEKDKTWVSLVLTEREKKQEQQKAKQLERVNERLKRAGKEPIENVEDAPDEFTEVDPFLDQAALVAFDFIDKNQLASN

SEQ ID NO: 40936 - DNA, 1386 bp, Azoarcus sp. EbN1
  CDS (1)..(1386)
atgcgtaacaagcttcagaaagcgggtttgatcatgaccggcgtgttcgccggggtgctgatcagtctcaatttccccgccagtgccgacaaagtttcagctgccccgctgccggtcgaggagctgcgcgcatttgccgacgtgttcaacgcgatcaagcagggctacgtcgaacccgtcgaggacaagaaactcatcaaccacgcgatcagcggcatgctgagcgggctcgatccccactccgcgtacctcgacgtggaagcgtacaaggagctgcaggtcggcacgcacggcgagttcggcgggctcggcatcgaagttggcatggaagacgggttcgtcaaggtcatttcgccgatcgaggatacgcccgcgttccgctccggcgtcaaggccggcgacctgatcgtcaagctcgacgaaacgccggtcaagggcatgacgctcagcgacgcggtcaagcggatgcgcggcaagccgaagaccgacatcacgctgaccatcgtgcgcaagggcgaggaccgcccggtggtggtgacgctgacgcgcgaagtgatcaaggtgcagagcgtcaagtcgaagatggtcgagcccggctatggttacctgcgcgtcgcgcagttccaggaaaacacttcgcaagccgtcgccgagcaccttgccaagctcgccaaggaaggagacatgaaaggcctggtgctcgacctgcgcaacgatccgggtggcttgctgcacggcgccgtcggcgtcgcttcggcgttcctgccggcgaatgcgctggtggtgtcgacggacggacggaccgatgacgcgaagcgtgaatatcgcgcgcgggcggacgactacctgcgcggcagccgtgaggatttcctcaaggacttgccggcgggcgcgcggacgctcccgatggtcgtgctcgtcaatgccggttcggcctcggcttccgaaatcgtagcaggcgcgttgcaggaccaccgacgcgcggtcgtgatgggaacgcagacgttcggcaagggctcggtccagacgatcctgccgctcaacagcaacaccgcgatcaagctgacgacagccaggtactacacgccgagcggccgctcgatccaggcgaaaggcatcgagcccgacatcatcgtcgaggaaacggcaaacggctcctcgcgtcgcctgcgcgaggccgacctggagcgtcacctcggcaatgaccgcgatcccgaggcagagccgaagaaggccgacgaaccgaaagcgggcgaccagtcgcctgccgacgacgaggccgaagcgctgccgcgtccggaactcgcgagcaaggacgactaccagctgaaccaggcgatcaaccttctcaaggggctgcagatcgtccagaataagaaggaataa

SEQ ID NO: 40937 - protein, 461 aa, Azoarcus sp. EbN1
MRNKLQKAGLIMTGVFAGVLISLNFPASADKVSAAPLPVEELRAFADVFNAIKQGYVEPVEDKKLINHAISGMLSGLDPHSAYLDVEAYKELQVGTHGEFGGLGIEVGMEDGFVKVISPIEDTPAFRSGVKAGDLIVKLDETPVKGMTLSDAVKRMRGKPKTDITLTIVRKGEDRPVVVTLTREVIKVQSVKSKMVEPGYGYLRVAQFQENTSQAVAEHLAKLAKEGDMKGLVLDLRNDPGGLLHGAVGVASAFLPANALVVSTDGRTDDAKREYRARADDYLRGSREDFLKDLPAGARTLPMVVLVNAGSASASEIVAGALQDHRRAVVMGTQTFGKGSVQTILPLNSNTAIKLTTARYYTPSGRSIQAKGIEPDIIVEETANGSSRRLREADLERHLGNDRDPEAEPKKADEPKAGDQSPADDEAEALPRPELASKDDYQLNQAINLLKGLQIVQNKKE

SEQ ID NO: 40938 - DNA, 1347 bp, Zymomonas mobilis subsp. mobilis ZM4
  CDS (1)..(1347)
atggctttggccagcacgggtatgttgattccggcgcttacctcttccatggcagcggtcgatagccagaataaagatacctatcatcagcttgaccagtttatgagagtctttgaacaggtcaaaagtagctatgtcgataaggttgatgaccaaaaattgatacaaggggcgattgacgggatgctgtctaatcttgacccccatagttcttatatgaatgctcatcaattcgcgaatatcaaaacccaagccgatggaaattatggcggtttgggtttaaccgtgatggcgcaggacggtattttaaaggtcatcagcccgatgaaagatactccgtcatggcgtgccggtttgaaagcgggcgattatatcacccatattgatggccaatttatttatggctccaatattgatgactcggtttctaaaatgcgagggaaacccggaacatcggtcaaattaaccgtagttcgccccggtcgcgacaaagaatttgatgtcactttgacccgcgagattattcaggttcagtctgttaaatgggcagtaaccaatcatatcggggtgattacggtcagttctttctcccataatgtcggggcagatgttaccaaagccatcgccgatattgaaaaacagaataaaggcgctcctttaggctatattcttgatttgcgttctaaccccggtggattgttggatcaggccgttgccctttccgatatcttcctcgatcatggtgaagtcgtttctgaacgcggcagagaaaaaaccgatatccggcgttatttttcaaaaccgggtgatctggcgaatggcttgccattgattgtattagtcgatggtggatcggcttcggcttcggaaattgtttccggtgccttgcaagaccatcatcgtgccttgattatgggcacccgcagttttggaaaaggctcggttcagactttgctgcctttgggggatgatacggcattacgtctgacgactgcccgttattataccccgtcaggtcgatccgttcaggaaggcggaatcgaaccggatattattgtgccacagctttctgatcctgattacaaaacacgccccaaattgcgcgaagcagatttgttgcgtcatcttgtaaatcaggctaatacagacaatagtctactggaagatgataacggtaaaaccgatccccagtttacggcgacaccagaaagtctgaaaaaagaaaatattacggattttcagcttgattatgcgctgaaaaccattggcagaattagtcggcaaccttctcctatcacaaaagagataccagccggtaaatccgccaccccatcgggtcgggaataa

SEQ ID NO: 40939 - protein, 448 aa, Zymomonas mobilis subsp. mobilis ZM4
MALASTGMLIPALTSSMAAVDSQNKDTYHQLDQFMRVFEQVKSSYVDKVDDQKLIQGAIDGMLSNLDPHSSYMNAHQFANIKTQADGNYGGLGLTVMAQDGILKVISPMKDTPSWRAGLKAGDYITHIDGQFIYGSNIDDSVSKMRGKPGTSVKLTVVRPGRDKEFDVTLTREIIQVQSVKWAVTNHIGVITVSSFSHNVGADVTKAIADIEKQNKGAPLGYILDLRSNPGGLLDQAVALSDIFLDHGEVVSERGREKTDIRRYFSKPGDLANGLPLIVLVDGGSASASEIVSGALQDHHRALIMGTRSFGKGSVQTLLPLGDDTALRLTTARYYTPSGRSVQEGGIEPDIIVPQLSDPDYKTRPKLREADLLRHLVNQANTDNSLLEDDNGKTDPQFTATPESLKKENITDFQLDYALKTIGRISRQPSPITKEIPAGKSATPSGRE

SEQ ID NO: 40940 - DNA, 1332 bp, Silicibacter pomeroyi DSS-3
  CDS (1)..(1332)
atgaagaaagtcgttttggccgggctggccgggaccctggcagggatcatcgccacaacccagatcgccggaccgctggttgcgcaagaggcaaaggcaaattccaacgtctacgaacagctcgacctgttcggcgatattttcgagcgcatccgagcgcaatatgtcgaagaggtcgacgcgggcgaactgatcgaggcagccatcgacggcatgctcacctcgctggacccgcattccagctatctctcccccgatgacgcggcgcagatgcgggtgcagacccggggcgaattcggcgggctggggatcgaggtcacccaggaagagggcttcgtcaaggtggtctcgcccatcgacggcaccccagccgacgaggccgggatcgaggcaggcgatttcattacccatgtcgatggcgaaagcgttctgggcctgaccctggacaaggcggtcgacctgatgcgcggcccggtgggcagcgagatcgtgatcaccgtggtacgcgaaggcgaggacgagccgtttgacgtgtcgatcatccgcgacaccatcaagctgaccgccgtgcgcgcccggaccgaaggcaccagcgtggtgctgcgcgtgaccaccttcaacgaccagacctattccaacctcgaagacgggctggccaaacaggtcgaggccgccggcggtatcgacaagatcaacggctttgtgctggacctgcgcaacaatcccggcggcttgctgacccaggcaatcaaggtctcggacgcgttcctggacagcggcgagatcgtgtcgacacgcggccgcaaccccgaggacggcgagcggttcaacgcaacgctgggcgacctggcccagggcaagccggtcgtggtgctgatcaatggcggctcggcctcggcctcggaaatcgtcgccggcgccctgcaggatcaccgccgcgccatcgtggtgggcaccaagagcttcggcaaaggatcggttcagacggtgatgccgctgcgcggtgacggtgccatgcgcctgaccaccgcgcgttactacacgccctcgggccgctcgatccaggcgctgggtgtcagccccgatatcgtggtcgaacagccgcgccgccgccccgaagccgaggaagagcgggtcacgccgcgttcgcgctccgaggccgatctgcgcggacgcctgaacaatgacagcctgagcgaggacgagatccgccagatcgaggaagaccgcgccaaggccgaggccaccgccgaactgcggcaagaggattaccagctggcctatgccatcgacatcctcaagggcctgtccgccttcgcaccggccgactga

SEQ ID NO: 40941 - protein, 443 aa, Silicibacter pomeroyi DSS-3
MKKVVLAGLAGTLAGIIATTQIAGPLVAQEAKANSNVYEQLDLFGDIFERIRAQYVEEVDAGELIEAAIDGMLTSLDPHSSYLSPDDAAQMRVQTRGEFGGLGIEVTQEEGFVKVVSPIDGTPADEAGIEAGDFITHVDGESVLGLTLDKAVDLMRGPVGSEIVITVVREGEDEPFDVSIIRDTIKLTAVRARTEGTSVVLRVTTFNDQTYSNLEDGLAKQVEAAGGIDKINGFVLDLRNNPGGLLTQAIKVSDAFLDSGEIVSTRGRNPEDGERFNATLGDLAQGKPVVVLINGGSASASEIVAGALQDHRRAIVVGTKSFGKGSVQTVMPLRGDGAMRLTTARYYTPSGRSIQALGVSPDIVVEQPRRRPEAEEERVTPRSRSEADLRGRLNNDSLSEDEIRQIEEDRAKAEATAELRQEDYQLAYAIDILKGLSAFAPAD

SEQ ID NO: 40942 - DNA, 1278 bp, Synechococcus elongatus PCC 6301
  CDS (1)..(1278)
atggctttttctaatcgcaagctcatcgccggtatttgtgcttctgcgatcgcgaccgtagctgtggtgggggcagggaatcactgggcgagggggcaagcgctctttcaagaaagcccaaaagagatcattgatgaagtctggcaagttgtcgatcgcaactacgttgatagcgttggcacttttgatcgcaacaaatggcgtcagctgagacgcgaatatcttgcccggaattacaagacgcgggaagaggcctacagcgctgtcaaagagatgctgaagacgctgggggatccttacacccgcttcatggatccggatgagtttaaagacatgcaaattgacacttcgggtgaactcaccggggtgggaattcagcttagccaggaccctgatacaaaagagctgatcgttgtttcaccgatcgaaggttctccggctgctgcggcaggcattcgatcgcgggacgtcatcgtcaaaattgaccaaaagaccacgcaaggcatgtcttccgatgaggcggtcaaactgatccgtggccccgtcggtagcaagatcacgctgaccatccgccgcgagaaagaaacgatcgccttcccgatcgtgcgggaacggattgagattcactccgtgagtgcccgcgttcaagagtcgccaaccggccccgtcggctacatccgcctgcggcaatttagtgccaactcggcaccagaaatgcggcaagccatcaaggatttggaggccaaaaatgttaagggctatgtgcttgacctgcgatccaatccaggcgggttgctctacgcgagcatcgacattgctcggatgtggctaccgaaaggcgtaattgtctcgaccaaagatcgcagcggcatttcggagcaagcatcggcgaacaaccgtgcactgaccgataagcctctcgtcgttttggtggatggcggttcagctagcgctagcgaaatcctctctggtgctctgcaagacaacaaccgagctgtcctgattggttccaagacctttggtaaaggtcttgtgcaatccgtgcggccgctgggcgatggctctgggttagcggtcacgatcgccaagtacctaacccccagtggtcgggacatcaataagcagggaatcgagcccaatattgttgctgaactgaccgatgctcagcgcgaagatctcagcaaaaatcaggatcaaattggaacggctagcgatcctcaattccaatcagctctgaaagtgctgacccaacagattgcaacagcttcgaataagtaa

SEQ ID NO: 40943 - protein, 425 aa, Synechococcus elongatus PCC 6301
MAFSNRKLIAGICASAIATVAVVGAGNHWARGQALFQESPKEIIDEVWQVVDRNYVDSVGTFDRNKWRQLRREYLARNYKTREEAYSAVKEMLKTLGDPYTRFMDPDEFKDMQIDTSGELTGVGIQLSQDPDTKELIVVSPIEGSPAAAAGIRSRDVIVKIDQKTTQGMSSDEAVKLIRGPVGSKITLTIRREKETIAFPIVRERIEIHSVSARVQESPTGPVGYIRLRQFSANSAPEMRQAIKDLEAKNVKGYVLDLRSNPGGLLYASIDIARMWLPKGVIVSTKDRSGISEQASANNRALTDKPLVVLVDGGSASASEILSGALQDNNRAVLIGSKTFGKGLVQSVRPLGDGSGLAVTIAKYLTPSGRDINKQGIEPNIVAELTDAQREDLSKNQDQIGTASDPQFQSALKVLTQQIATASNK

SEQ ID NO: 40944 - DNA, 1323 bp, Synechococcus elongatus PCC 6301
  CDS (1)..(1323)
atgtcgctgttcagtcgccttcgtttttcggtttacggttcggctctgctggctgcgagtggggcagtctgcattgggatttcagcagaacatgcccgagcgttgccctggcaggacagccccaaggtcgtgctcgatcaagcttggcaactcatcgatcgcgagtacgtcgaccccacctttaatcgtcaagactggcaggccgtgcggcgcgaactcctcagccgcaactacggttccaatgaagaggcctatgctgccttgcgatcagctctgcgccggctcgatgacccctacacccgtttcctagcgcccgaacaattcaaaaccctgacggagcaaacggctggggaagcctcagggattggcatcgagattattcctgacagcaaagatagtcggccgcggattcaggccattctcgacaactcacccgccagcaaaggagatgttcaagttggcgatcgcatcttggcgatcgatgccgactccacccgcgaactcaccctcgatgaagttcgcaaccgccttcagggcaaggtgggcagcgagatcgacctcaaactgcagcggggcgatcgcattttttctgtcaagctgacccgcgtccagattgaaattcccagcgttaccgccgagctgcggcaacatagtggccgatcggtgggctacatccagctccgagaatttacagctcacgcggcgcgggaaatgcggacttcgattcgtagtctcgatgagcaaggcgctacctcctacgtgctcgatctacggggcaatccgggcggactgctctactccagcatcgagatcgcccgcatgtggcttaacaacggcacgatcgtcaagaccgtcgatcgcaatggcaaatcggagacaatcaacgccaacaacagcgccatcaccaacaaaccgctggccgtcctcgtcgatcagaactctgccagttccagcgagattctggtcggagcactgaaggataacaatcgcgccgtggtcatcggccgccaaacctttggtaaagccctcgtgcagtcagttcacacccttgccgatggttcgggcttagctgtcactgtggctcactactacacgcccaacggcaccgatttgggtaatcggggtattcaacccgatgtcgaggtgcgcctcaatcagcggcagcaggctctgcagcgcagcgaccctagcttcttgggttccaatcaagaccccacctacggccaagcgatcgcaaccctcgagcagcgcactgccgaaagcacgcccagcccagcgagctcgccccagttgagtcaacgccccagcgagattcgcccttga

SEQ ID NO: 40945 - protein, 440 aa, Synechococcus elongatus PCC 6301
MSLFSRLRFSVYGSALLAASGAVCIGISAEHARALPWQDSPKVVLDQAWQLIDREYVDPTFNRQDWQAVRRELLSRNYGSNEEAYAALRSALRRLDDPYTRFLAPEQFKTLTEQTAGEASGIGIEIIPDSKDSRPRIQAILDNSPASKGDVQVGDRILAIDADSTRELTLDEVRNRLQGKVGSEIDLKLQRGDRIFSVKLTRVQIEIPSVTAELRQHSGRSVGYIQLREFTAHAAREMRTSIRSLDEQGATSYVLDLRGNPGGLLYSSIEIARMWLNNGTIVKTVDRNGKSETINANNSAITNKPLAVLVDQNSASSSEILVGALKDNNRAVVIGRQTFGKALVQSVHTLADGSGLAVTVAHYYTPNGTDLGNRGIQPDVEVRLNQRQQALQRSDPSFLGSNQDPTYGQAIATLEQRTAESTPSPASSPQLSQRPSEIRP

SEQ ID NO: 40946 - DNA, 1224 bp, Synechococcus elongatus PCC 6301
  CDS (1)..(1224)
atgatccagccatttctgaagcgatcgctcctttggctcacgctgttgttctggtttgcgacagcgacgccggcgttggccctgacggaagagcagaaactgttcaatgaggcctggcgcattgtcaaccagtcctacgtcgatcccagctttaaccacagcaactggttccagttgcgcgagaagattctgaaaaagccgctggacaatcgggatcagacctacaccgcgatcgaaggtttgctagccaaactagatgacccatttacgcggttgctacggccagatcaatatcgcaacctccaagtctcgacggccggtgagctatcgggcgtcggtttgcagattggctttgaggccgaaagtggcgatgtggtggtgattgccccgatcgaaggttcgccggcagccctggcgggtctgctgtcgggcgatcgcatcctgacggtggatggggtggcgatttccggtcgagatctggatgaagcggcggctcggatgcgcggacctcgcgggacgacggtggcgctccaagtcctgcgcgatcaacaaaccttggattttgaactagttcgcgatcgcatcagtctcaaccccgtgcgatcgcagctggatcgcgatggcgatcatccaccgattggctacattcgcctcagccaatttaatgccaatgcctcggtagaagtggctcatgcgatcgcccaactcgatcagcagggagccgaagccttcgtccttgatttgcgcaataactcaggcggactgctgaccgctggcatcgagattgcgcgggaatggctgaacgaaggcgcgatcgtctacaccgtcaatcgtcagggggtgctggatagctttgcggcaaatggccaagcgctgacggataaacccttggcactcctcgtcaatcgcggcactgctagcgccagcgaaattctagccggcgcactacaagacaatgaacgcgccattttggtgggcgatcgcacctttggcaaaggtttgattcagtcgctgttcgaactgtcggatggggcgggtttggcggtcactgtcgccgaatacgaaacgcccaaccacaacgacatcaataagcagggcattcagcccgatctcgcagttgaacagtctgaaccgctgtttgcggaggcgattgcttccgctgccgttcgccaatatcaggcagcggtaacggcgctgacagagcaagtgaggcatcgtgcctag

SEQ ID NO: 40947 - protein, 407 aa, Synechococcus elongatus PCC 6301
MIQPFLKRSLLWLTLLFWFATATPALALTEEQKLFNEAWRIVNQSYVDPSFNHSNWFQLREKILKKPLDNRDQTYTAIEGLLAKLDDPFTRLLRPDQYRNLQVSTAGELSGVGLQIGFEAESGDVVVIAPIEGSPAALAGLLSGDRILTVDGVAISGRDLDEAAARMRGPRGTTVALQVLRDQQTLDFELVRDRISLNPVRSQLDRDGDHPPIGYIRLSQFNANASVEVAHAIAQLDQQGAEAFVLDLRNNSGGLLTAGIEIAREWLNEGAIVYTVNRQGVLDSFAANGQALTDKPLALLVNRGTASASEILAGALQDNERAILVGDRTFGKGLIQSLFELSDGAGLAVTVAEYETPNHNDINKQGIQPDLAVEQSEPLFAEAIASAAVRQYQAAVTALTEQVRHRA

SEQ ID NO: 40948 - DNA, 1335 bp, Campylobacter jejuni RM1221
  CDS (1)..(1335)
atgatggagcttattttgaaaacaaaacgattttttgcgggtcttgcaggctttgccactacttttattttatgtctatttttaacaagtcatttacaagctaaagttgatcaaaaagaagagcaggttcaaaaacgcctagaagctttagataagcttacaaaaactcttgctatagtagagcaatactatgtggatgatcaaaatatcagcgatttggtggataaatctttatcagggcttttaagcaatcttgatgcgcattcttcttttttaaatgaaaaagattttaatgatatgaaaattcaaactaatggtgaatttggcggccttggtataaccgtaggtatgaaagatggtgctttaacagttgtttctcctatagaaggaacaccagcagataaagcagggataaaatcaggagatattattttaaaaattaatgatgaggccactttaggaattaatctcaatgatgctgtagataaaatgcgtggtaagccaaaaactcaaatcactttaaccatttttagaaaaggtgcaacaaaaccttttgatgttacacttacaagagaaattattaagatagaaagtgtttatgcaaaaatgatagaaaatgaaaacattctttatcttagggttacaaattttgataaaaatgttgtagatgtggcaagtaaagaacttaaaaaatatcctaatgttaaaggagttattttagatcttagaaataatcctggtggacttttaaatcaagccataggacttgtaaatttatttgtagataaaggtgttattgtttctcaaaaaggacgcatcgcaagtgaaaatcaagaatataaagccgatcctaaaaacaaaatttctaatgcttctttggttgtgcttgtaaatggtggaagtgctagtgcaagtgaaattgtaagtggagctttacaagatcttaaacgcggtgttattgtgggtgaaaatacttttggaaaaggtagtgttcagcaaatcatacctattaataaaactgaagctttaaggcttactattgcaagatattatcttccaagcgggcgtactattcaagcagtgggtgtaaaacctgatattgaagtttttccaggtaaagtaaatactcaagaagatggtttttctataaaagaaagcgacttaaaacaacatttagaaagtgagcttgaaaaaatagataaaaataaaaaagaagataagcaagaaaataaagacaataaaaatctaatcagtcaaaaacaaatcaatgatgatgcacagttaaattcagctattgatactattaaaattttaaatatcaaacaaggacgataa

SEQ ID NO: 40949 - protein, 444 aa, Campylobacter jejuni RM1221
MMELILKTKRFFAGLAGFATTFILCLFLTSHLQAKVDQKEEQVQKRLEALDKLTKTLAIVEQYYVDDQNISDLVDKSLSGLLSNLDAHSSFLNEKDFNDMKIQTNGEFGGLGITVGMKDGALTVVSPIEGTPADKAGIKSGDIILKINDEATLGINLNDAVDKMRGKPKTQITLTIFRKGATKPFDVTLTREIIKIESVYAKMIENENILYLRVTNFDKNVVDVASKELKKYPNVKGVILDLRNNPGGLLNQAIGLVNLFVDKGVIVSQKGRIASENQEYKADPKNKISNASLVVLVNGGSASASEIVSGALQDLKRGVIVGENTFGKGSVQQIIPINKTEALRLTIARYYLPSGRTIQAVGVKPDIEVFPGKVNTQEDGFSIKESDLKQHLESELEKIDKNKKEDKQENKDNKNLISQKQINDDAQLNSAIDTIKILNIKQGR

SEQ ID NO: 40950 - DNA, 1134 bp, Dehalococcoides ethenogenes 195
  CDS (1)..(1134)
atgactttgagaataaaagtattgctgggtactattctggctatggtcggtttgctggtttctttcggggtgggttatctaagcggcgggatagccgccttaaatagcgatgaaaacctgtccagcattgtaaatgcctggcagattatcactaccgaatacgtagagccggatagtattgaccaggcagctctggctgaagcggccataaagggcatgatggatgaactggatgaccctcattccgtttatctgaatgccgaagactaccagtccagcctggaatatgatgacggaaagtatgtgggcataggtgctactgtccagatagaagatgaagctattgtcctggttccttatgatggttctccggcagctctggccggtatacaggccggtgatattttgctggaagtggacgggcagtcagtggccgggttcagtttggcagacctgtccccgctggtaaggggagaaaaggggacttcgttaaccctgctggtggaaagaagctcctctgaccagccgctgctgtttgaagtcacccgtgatgaaatactgatttccagcgttacctccgagatgatgggtgatatagcatatatacgtatcagccgtttcagcgaaagaacagatgaggaactggagcaggtgcttaaaaacctgggcagtgcggaaggtattgtgctggatttgcggggtaatcccggcggtctggtaagctcggttataaacgtaaccagccgctttgtaagcagcggggtggttttgactacggtggacaatgaaggaaactcctctgaatatagtgtagtgcctaaaacggtaacgaccagtttgcccatggtagttttggtagaccagtacagcgccagcggctcggaagccctttccggtgctttgcaggactacgggcgggcaactattgcgggaaaaaccacctatggcaaaggcagcgtaaaccgcaccttcaatgtaacgccggatacgggtatctacctgactataggccgctggtatacacccaacgggcggatgatagaagggcagggtattaccccggatatagagctggagctgaccggggatgaggctgtcagctgggcattaggtttcctgcatggggacacctga

SEQ ID NO: 40951 - protein, 377 aa, Dehalococcoides ethenogenes 195
MTLRIKVLLGTILAMVGLLVSFGVGYLSGGIAALNSDENLSSIVNAWQIITTEYVEPDSIDQAALAEAAIKGMMDELDDPHSVYLNAEDYQSSLEYDDGKYVGIGATVQIEDEAIVLVPYDGSPAALAGIQAGDILLEVDGQSVAGFSLADLSPLVRGEKGTSLTLLVERSSSDQPLLFEVTRDEILISSVTSEMMGDIAYIRISRFSERTDEELEQVLKNLGSAEGIVLDLRGNPGGLVSSVINVTSRFVSSGVVLTTVDNEGNSSEYSVVPKTVTTSLPMVVLVDQYSASGSEALSGALQDYGRATIAGKTTYGKGSVNRTFNVTPDTGIYLTIGRWYTPNGRMIEGQGITPDIELELTGDEAVSWALGFLHGDT

SEQ ID NO: 40952 - DNA, 1347 bp, Rhodobacter sphaeroides 2.4.1
  CDS (1)..(1347)
atgaggaaatacatgatggccgcgctcggcggcacggtggccggcgtcctgctggcgacccaggtggcggggcccctcatcgcgcaggagcagcagcggtcgaaatcggtctacgagcagctcgacctgttcggcgacatcttcgagcgcatccgcgcgcaatatgtcgaggaagtggagaccgacaagctgatcgaggccgcgatcaacgggatgctgacctcgctcgatccgcattcgagctacctgccgcccgacgatttcgacgacatgcaggtgcagacccgcggcgagttcggcggcctcggcatcgaggtcacgcaggaggagggcttcgtcaaggtcgtgtcgccgatggacggcacccccgcggacgcggccggcatccagtccggcgacttcatcacccatgtgaacggcgaatccgttctgggcctgacgctcgatcaggcggtggacatgatgcgcgggccggtcggctccgagatcctcatcacggtggtgcgcgaaggcacccccgagcccttcgacgtctcgatcgtccgcgacacgatcaagctcgtggccgcccgcagccgcgtggtgggcaacacggtcgtcgtgcggctgaccaccttcaacgaccagaccttctcgggcctgaaggagggtctcgagaaggagatcaaggcgctcggcggcgaggacaagatcaacggcgtggtgctcgacctgcgcaacaaccccggcgggctcctgacccaggcgatccaggtctcggacgccttcctcgacaagggcgagatcgtctcgacgcgcggccgcgccgcgggcgacggcgagcggttcaacgcgacgccgggcgatctgatcgacggcaagcccatggtcgtgctcatcaacggcgggtcggcctcggcctcggagatcgtggcgggcgcgctgcaggaccatcgccgcgccatcgtcgtgggcaccaagagctttggcaagggatcggtccagaccgtgatcccgctgcggggcgagggggccatgcggctgaccacggcgcgctactacacgccctcgggccgctcgatccaggcgctcggcgtggcgcccgacatcgtggtgaaccagccgcccgcgaagcccgccgtccccgaggaggaggagagccccgcgacgagcgccgcccgcaaccggtcggaggccgacctgcgcggcgtcctgtcgaacgattcgatgaccgaggacgagaagaagcagctggaagccgaccgcgcccgggccgaggaatccgcgaaactgcgcgacgaggattaccagctcgcctatgcggtggacatcctcaagggcctctcggccatcgaagtgaagccctga

SEQ ID NO: 40953 - protein, 448 aa, Rhodobacter sphaeroides 2.4.1
MRKYMMAALGGTVAGVLLATQVAGPLIAQEQQRSKSVYEQLDLFGDIFERIRAQYVEEVETDKLIEAAINGMLTSLDPHSSYLPPDDFDDMQVQTRGEFGGLGIEVTQEEGFVKVVSPMDGTPADAAGIQSGDFITHVNGESVLGLTLDQAVDMMRGPVGSEILITVVREGTPEPFDVSIVRDTIKLVAARSRVVGNTVVVRLTTFNDQTFSGLKEGLEKEIKALGGEDKINGVVLDLRNNPGGLLTQAIQVSDAFLDKGEIVSTRGRAAGDGERFNATPGDLIDGKPMVVLINGGSASASEIVAGALQDHRRAIVVGTKSFGKGSVQTVIPLRGEGAMRLTTARYYTPSGRSIQALGVAPDIVVNQPPAKPAVPEEEESPATSAARNRSEADLRGVLSNDSMTEDEKKQLEADRARAEESAKLRDEDYQLAYAVDILKGLSAIEVKP

SEQ ID NO: 40954 - DNA, 1455 bp, Xylella fastidiosa Dixon
  CDS (1)..(1455)
atgcgtgtcgttgggttgtcattggccataagtgtggtcttgttgtctttctcgttgtcggcgaagaatcccagcggtgttgttatgtctcctccggttgaagagatggaaatgccggagagcaacgatgttaacgtgccgttagatgaaatccgccgctttgtttctgtgtataacgccatcaagcaagcctatgttgatccggtcaatgacaggaagctgatgcattcggcggtgcgaggtctgctttcggatctggatccgcatagtacctattttgataaggaggatgccgatgccttcgacgagcaaaccagcggtgtttacgatgggatcggtgtggagctgcaagagcagtcggacaacacgttgaaggtgatcgcgccgattgatgatacgccagcagcgcgtgctggtttgcgtccaggtgatctgatcgtggcgatcaacggcaagccgcttgccaatgtcgatgcgatgaagccgctgcgcggtgcgccaggcagtcaagtcactttgacgattgtgcgcgataagaatggcaagccattcgatatgacaatcaagcgtgagacgatacacatcgctagtgtgcgtagccgtatgcttgagcctggttatggctatatccgtattagtgttttccaggccgatacgggtaacgatttccataagcatttgggacagcttaagcagcaggcgggtggtaggttgcgtggtctgttattggacttgcgtagtaatcctggtggattgctgacggcagcggtgcaggttgctgatgctttgttggataagggaaacattgtcagtacgcgtggccgtatttcggcgagtgatacgcgctttgatgcaacgccgggggatttactggatggtctcccgttggtggtattggttgatgctggttcggccagcgcttcggaggtgttggtgggtgcgctgagtgacaatcatcgtgcgcgcgtcattggcagctgtaccttcggtaagggatcggtgcagacgttgttgccgcttgataatggcgattcggtcaaattgacgacggcgcgttattacactccgagtggtcgttcgatccaagctaggggtattgttcctgatctgctgctcaagccagatggtgttggagcggctgatctttcaggcagcgggattgatcgcagtgaggcagggcttccaggccatttgcgtggtactgatgaaggggtgccaggttgtacttccagtgatccgttgccgggcgatacgccgatcatgacggcgttgttggagctaaagcaaccgggttcagcggtgcaggctaaaaaagcgatccctgtaaaagtggtcagcgatgttaagtcggcaacaaagagtccgttgtcagtgtttggtaaggatagggctgtcaagcgagtgccggtggtgtctcctacaagtgagcaagttgatggtcagccaagcaaatag

SEQ ID NO: 40955 - protein, 484 aa, Xylella fastidiosa Dixon
MRVVGLSLAISVVLLSFSLSAKNPSGVVMSPPVEEMEMPESNDVNVPLDEIRRFVSVYNAIKQAYVDPVNDRKLMHSAVRGLLSDLDPHSTYFDKEDADAFDEQTSGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGRLRGLLLDLRSNPGGLLTAAVQVADALLDKGNIVSTRGRISASDTRFDATPGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGVPGCTSSDPLPGDTPIMTALLELKQPGSAVQAKKAIPVKVVSDVKSATKSPLSVFGKDRAVKRVPVVSPTSEQVDGQPSK

SEQ ID NO: 40956 - DNA, 1455 bp, Xylella fastidiosa Ann-1
  CDS (1)..(1455)
atgcgtgtcgttgggttgtcattggccataagtgtggtcttgttgtctttctcgttgtcggctaagaatcccagcggtgttgttatgtctcctccggttgaagagatggaaatgccggagagcaacgatgttaacgtgccgttagatgaaatccgccgctttgtttctgtgtataacgccatcaagcaagcctatgttgatccggtcaatgacaggaagctgatgcattcggcggtgcgaggtctgctttcggatctggatccgcatagtacctattttgataaggaggatgccgatgccttcgacgagcaaaccagcggtgtttacgatgggatcggtgtggagctgcaagagcagtcggacaacacgttgaaggtgatcgcgccgattgatgatacgccagcagcgcgtgctggtttgcgtccaggtgatctgatcgtggcgatcaacggcaagccgcttgccaatgtcgatgcgatgaagccgctgcgcggtgcgccaggcagtcaagtcactttgacgattgtgcgcgataagaatggcaagccattcgatatgacaatcaagcgtgagacgatacacatcgctagtgtgcgtagccgtatgcttgagcctggttatggctatatccgtattagtgttttccaggccgatacgggtaacgatttccataagcatttgggacagcttaagcagcaggcgggtggtaagttgcgtggtctgttattggacttgcgtagtaatcctggtggattgctgacggcagcggtgcaggttgctgatgctttgttggataaaggaaacattgtcagtacgcgtggccgtatttcggcgagtgatacgcgctttgatgcaacgcagggggatttactggatggtctcccgttggtggtattggtcgatgctggttcggccagcgcttcggaggtgttggtgggtgcgctgagtgacaatcatcgtgcgcgcgtcattggcagctgtaccttcggtaagggatcggtgcagacgttgttgccgcttgataatggcgattcggtcaaattgacgacggcgcgttattacactccgagtggtcgttcgatccaagcgagggggattgttcctgatctgctgctcaagccagatggtgttggagcggctgatctttcaggcagcggtattgatcgcagtgaggcagggcttccaggccatttgcgtggtactgatgaaggggggccaggttgtacttccagtgatccgttgccgggcgatacgccgatcatgacggcgttgttggagctaaagcaaccgggttcagcggtgcaggctaaaaaagcgatccctgtaaaagtggtcagcgatgttaagtcggcaacaaagagtccgttgtcagtgtttggtaaggatagggctgtcaagcgagtgccggtggtgtctcctacaagtgagcaagttgatggtcagccaagcaaatag

SEQ ID NO: 40957 - protein, 484 aa, Xylella fastidiosa Ann-1
MRVVGLSLAISVVLLSFSLSAKNPSGVVMSPPVEEMEMPESNDVNVPLDEIRRFVSVYNAIKQAYVDPVNDRKLMHSAVRGLLSDLDPHSTYFDKEDADAFDEQTSGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGKLRGLLLDLRSNPGGLLTAAVQVADALLDKGNIVSTRGRISASDTRFDATQGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGGPGCTSSDPLPGDTPIMTALLELKQPGSAVQAKKAIPVKVVSDVKSATKSPLSVFGKDRAVKRVPVVSPTSEQVDGQPSK

SEQ ID NO: 40958 - DNA, 2184 bp, Xylella fastidiosa Ann-1
  CDS (1)..(2184)
atgagcttacgaatccttaactccttgaaagttgccctactaaccctggctatcactacctctccagcgttgatggccaaatcggacagtgcatctcctcaagtggcgacgccagatcaaaccacagcgaccaagctggtgtatggtctgctttcagatagtcgttatgcttatcggctgcgcccgcttgacgaaacgatgtccaaagacattttcaagcgctacttggaagccctagacaacaataagcaattttttactgaagccgatatcgacaacttctcagcattcaaagctgagatacctgattcaatccgcaacggcaatctcaagccagcgtttagtatatttacggtgtataaaaagcgcgttgctgaacgtgttacctatgcaaatcagttactgaaacaaaacttcgatttttccgggcaagaaaaatacgaatacgatcgtagcaaagcgccatggccagccagcccgcaagatctggacgacatctggcgacgatcaataatgaacgactggctacgcctgaagttggccggaaaaaagcccgaagacattcggaaaactcttaaaaaacgctacgccaaccttcttaagacagtgaacgaactaaaaggtgaagacgtctttcagttgtatctgaacgcctacactaattcgatcgatcctcataccgactacttcactccacgcacagccgatgctttcaaccagcagatgtcattgtcactagaaggtatcggtgcccagctgcaaaagcaggaagacatggtgatcatccgtgaggtgattcctggaggccccactgcgttggatggcacactgaaacccggtgatcgcatcgtcggcgttggtcagggcaaaggcggcccaattgaagatgtcatcggcttacgcatcgacgatgtcgtctccaaaatccgcggcaagaaagacacccaggtacgacttgaatatattccagccgaatctggaatcgacggcgcacaccgtatcgtgactcttacacgacagaaggtacgcttagctgagcaggccgcgaagggcgaaaccattaccatagagggtagcaacggcgacgcacagcgccgcatcggcatcatcaagctgccaacgttctacgaggatttcgaagggcgtcgccgcaacgtcgccaactatacgtctgcaacacgagatgtagcgaagcttttaaccaacttcaaaactgacaaagtcgatggcgtggtactcgatctgcgtaacaacggcggcggatcgctggatgaagccattcagctcactggtctattcatcgaacaaggtcctgtggtgcaagtacgtgaatccgggggccgtgtcactgtcaacggtgatcgagacgacaaagtcacctgggacggcccgctggcagtattgatcaatcgtggctccgcttctgcatcagaaatttttgcaggtgccatccaagactatgggcgtggtttggtgattggagaaaccagctttggtaaaggcacagtccaaaatattgttgacctggatcgttggccggccaacgaaagcagacgatttggccaagtcaaattgaccattgctcaattcttccgtatcagcggatccagcacccagcacaaaggagtattaccagacattgcgttcccagcaagcgtaggtgcaactgagtttggggagagcacttatgaaaatgccttgccttggactcgaattgcctcgctccaacacacccaatatggcaatttcagcccaatattatcgaaactgaaaaaaattcatatcagtcgcactgccaatgacattgaattcaaatggtggcaagaggatgtacataatttcagtctggaaaaggaaaagaagtacgtcatactcaacgaagccgaacgtcttgcagaacgtagaaaacaagaaactcaacatagagaacgccaaactattcggaaaaaccttggcttgcagctagatcctttgtctgaggagagtgacgacggattgattggcaacgagcgtgatatcgccaaggacactgcacgcgaaaagctggccgacaagcgtcctgaccctttattgcatgaatcagccgcaattctgaccgatacaattaacctactggaaaaagaccagatactatcggcacaggtacttttacagtccaccacaccgggacactgggccaattga

SEQ ID NO: 40959 - protein, 727 aa, Xylella fastidiosa Ann-1
MSLRILNSLKVALLTLAITTSPALMAKSDSASPQVATPDQTTATKLVYGLLSDSRYAYRLRPLDETMSKDIFKRYLEALDNNKQFFTEADIDNFSAFKAEIPDSIRNGNLKPAFSIFTVYKKRVAERVTYANQLLKQNFDFSGQEKYEYDRSKAPWPASPQDLDDIWRRSIMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNVANYTSATRDVAKLLTNFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTRIASLQHTQYGNFSPILSKLKKIHISRTANDIEFKWWQEDVHNFSLEKEKKYVILNEAERLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 40960 - DNA, 1350 bp, Magnetospirillum magnetotacticum MS-1
  CDS (1)..(1350)
atgattcgcaagatcctgatcgcggcgggtaccttcgccctgctgtcgacgaccgccctcacccccgtttccgccgccgagcgcaaggaaacctacaagcttctcgacctgttcggcgaagtgctggaaaaggtgcgcagcgagtatgtggagcccgtcaatgacgaggacctgatcgaggcggcgctgaatggcatgctggcctcgctggatccccattccagctatctcaaccccaagaactccaaggacatggacatccagacccgtggcgagttcggcgggctgggcctggaagtgaccatggagaacggctgggtcaaggtggtgtcgcccatcgacgacaccccggcctatcgcgcgggcatgcagcccggcgatttcgtcacccatctggacggcgagcaggtccagggtctgtccctgtcggaagcggtggatcgcatgcgcggcaccgtcaataccgacatcaagctgaccgtgcgccgcgccggggtggaacagcccttcgacatcaagctgacccgcgccgtcatcaaggtgcagaccgtcaagggccagacccacggcgatatcggctatatccgcatctcccagttcagcgccaccacccacgccgatctggtgcgcatcatggcccagttgaagaaggatatcggcaagacgccgaccggcttcgtcattgatctgcgcaacaatcccggcggcctgctggaccaggcggtggcggtgtccgacgacttcctggacaagggcgagatcgtatcgacccgttcgcgccgtcccgaggatacccagcgcttcaacgcccggcccggcgacatcgccgacggcctgccgctggtggtgctgatcaatgacggctcggcctcggcctcggagatcgtcgccggtgcgctgcaggatcacaagcgcgccgtgctgctgggcacccgctcgttcggcaagggctcggtccagaccctgatgccgctgcatggccacggctccttgcgtctgaccacggcgcggtactacacgccatcgggccgctccatccaggcggtgggcatcgaacccgacatcaaggccgcccagtccaaggtcgagccggtggcgggcgccgtggtggagcgccgctcggaagcgtccttgcgcaaggccctgcccaatcccaatggggaaaaggccaagcccgccgaaaaggaaaaagccgaggaaaccaaggcccccgaacagcccaagggcgaaggcggcaaggccgaggctccggcgcccatcaagttgggcgatccggcccaggactaccagctggcccgcgccctggatctgttgcgcggcctgtcgctgtaccgtccggcccagcggtaa

SEQ ID NO: 40961 - protein, 449 aa, Magnetospirillum magnetotacticum MS-1
MIRKILIAAGTFALLSTTALTPVSAAERKETYKLLDLFGEVLEKVRSEYVEPVNDEDLIEAALNGMLASLDPHSSYLNPKNSKDMDIQTRGEFGGLGLEVTMENGWVKVVSPIDDTPAYRAGMQPGDFVTHLDGEQVQGLSLSEAVDRMRGTVNTDIKLTVRRAGVEQPFDIKLTRAVIKVQTVKGQTHGDIGYIRISQFSATTHADLVRIMAQLKKDIGKTPTGFVIDLRNNPGGLLDQAVAVSDDFLDKGEIVSTRSRRPEDTQRFNARPGDIADGLPLVVLINDGSASASEIVAGALQDHKRAVLLGTRSFGKGSVQTLMPLHGHGSLRLTTARYYTPSGRSIQAVGIEPDIKAAQSKVEPVAGAVVERRSEASLRKALPNPNGEKAKPAEKEKAEETKAPEQPKGEGGKAEAPAPIKLGDPAQDYQLARALDLLRGLSLYRPAQR

SEQ ID NO: 40962 - DNA, 2082 bp, Azotobacter vinelandii
  CDS (1)..(2082)
atgaagcgccttctccccagcaccctcttcgccttcaccctcggcctcagtgcttcgctgctggcccagacggccgacgccggcaactgggacaccctgcagccggaccgtgaccaggtgatcgccagcctgaacgtggtggagctcctcaagcgccatcattacagcaaaccaccactcaacgatgcgcgctcggaaaagatctacgagagctacctcaagttgctcgatccggcccgcagctacttcaccgcggcagacatcgccgaattcgaccgctggcgcacccagttcgacgactttctgaaaagcggcgatctgcaacccggtttcaccatctacaagcgccacctgacccgtctggccgagcgtctggacttcaccctgggcctgctcgagaaaggcgtggacagcttcgacttcgaacgcgacgagagcctgctggtcgatcgcgagaaggcaccctgggcaccggacaaggccgccctcgacgacctctggcgcaagcgcctgaaggacgaggtgctgcgcatgaagatcgccggcaaggagccgaaggccatccaggagctgctcatcaagcgctaccgcaaccagttggcgcgcctggaccagacccgcggcgaagacatcttccagacctacatcaacgccttcgcgcagacctacgacccgcacaccaattatctgtcgccggacaacgcggaaaacttcgacatcaacatgagtctgtcgctggaaggcatcggcgccgttctgcaaagcgacaacgagcacgtcaaggtggtccgtctggttcccgccggcccggcggagaagagcaagcagctcgcgcccgcggacaagatcgtcggcgtcgcccaggctaacggcgaaatggtcgacgtgatcggctggcgcctggacgaggtggtcaagctgatccgcggaccgaagggctcggtggtacgcctggaaattattccggccggcaacgcgcccaacgacgaaaccagcaaggtggtcgcaatcacccgcgaagcggtcaagctggaagaacaggccgccaagaagtccgtactcgaacttccccacgaaggccgcacctacaagctcggcgtgatcgaaatcccggccttctatctggacttcaaggcattccgcgccggcgaccccgactacaagagcactacccgcgacgtgaagcgcctgctcagcgaattgaaggccgagaaggtcgatggcgtggtcatcgatctgcgcaacaacggcggcggctcgctgcaggaagccaccgaactgaccggtctgttcatcgaccaggggcccaccgtgctggtgcgcaacaacgacggtcgggtcgacgtgctcgccgacgagaatggcggcacttattacaccggcccgatggcggtactggtcaaccgtctctccgcctcggcttcggaaatcttcgccggcgccatgcaggactaccaccgggccctgatcattggtggccagaccttcggcaaggggaccgtacagaccattcagccgctcaaccatggcgaactgaagctgaccctggcgaagttctaccgggtttccggacagagcacccagcatcagggcgtgattccggacatcagctatcccgatgaggtcgacacgcaggaaatcggcgagagcgccctaccggaagccatgccctgggacagcatccgcccggcgattcgcccggaaatcgacccgttcagaccgctcctcaacgagctcaaggcccgtcatgaccagcgcacggcccaggaccccgacttcgtctttacccgcaaccgcctcgatctgagccggcagttgatgcaggaaaccactgtcagcctcaacgagagcaagcggcgcgcccagcacagctccatcgagtccaaacagctggctatcgaaaacgagcggcgcaaggccaagggcgaagagctcctgaccaagctgaaggaagaggacgaaaataccctgccgttggcggacgacaagaacaagaaacccgaggacgatgcctatctggcggaaacggggcgtatcctgctcgattacttgagcctgagagcctcggtggccaagcactga

SEQ ID NO: 40963 - protein, 693 aa, Azotobacter vinelandii
MKRLLPSTLFAFTLGLSASLLAQTADAGNWDTLQPDRDQVIASLNVVELLKRHHYSKPPLNDARSEKIYESYLKLLDPARSYFTAADIAEFDRWRTQFDDFLKSGDLQPGFTIYKRHLTRLAERLDFTLGLLEKGVDSFDFERDESLLVDREKAPWAPDKAALDDLWRKRLKDEVLRMKIAGKEPKAIQELLIKRYRNQLARLDQTRGEDIFQTYINAFAQTYDPHTNYLSPDNAENFDINMSLSLEGIGAVLQSDNEHVKVVRLVPAGPAEKSKQLAPADKIVGVAQANGEMVDVIGWRLDEVVKLIRGPKGSVVRLEIIPAGNAPNDETSKVVAITREAVKLEEQAAKKSVLELPHEGRTYKLGVIEIPAFYLDFKAFRAGDPDYKSTTRDVKRLLSELKAEKVDGVVIDLRNNGGGSLQEATELTGLFIDQGPTVLVRNNDGRVDVLADENGGTYYTGPMAVLVNRLSASASEIFAGAMQDYHRALIIGGQTFGKGTVQTIQPLNHGELKLTLAKFYRVSGQSTQHQGVIPDISYPDEVDTQEIGESALPEAMPWDSIRPAIRPEIDPFRPLLNELKARHDQRTAQDPDFVFTRNRLDLSRQLMQETTVSLNESKRRAQHSSIESKQLAIENERRKAKGEELLTKLKEEDENTLPLADDKNKKPEDDAYLAETGRILLDYLSLRASVAKH

SEQ ID NO: 40964 - DNA, 1320 bp, Azotobacter vinelandii
  CDS (1)..(1320)
atgccgtacctgccccgccccctgtcgctggccctggtcgccgccctggcgctcggcgctcccctcctgcgcgccgaggaggcgcccgcgccagccgccgagacgcgaggcaagcccctcctgcccctcgaagagctgcgcaccttcgccgaggtcatggaccgcatcaaggccgcctatgtcgagccggtggacgacaagaccctgctggaaaacgccatcaagggcatgatcagcaatctcgatccgcactcggcctacctcgagcccgaggaattcctcgacctgcaggagagcaccagcggcgagttcggcggtctcggcgtcgaggtcggcatggaggacgaccagctcaaggtggtcgcgccgatcgacgacacgccggcggccaaggccggcatcgaggccggcgacctgatcgtccggatcgacggccagccgaccaagggcatgtccatgctcgaagccgtggacaagatgcgcggcaagcccggcagcaagatcgagctgaccctggtgcgcgagggcggcaggccgttcgatgtcagcctgaccagggcggtgatcaaggtcaagagcgtgaagagccagtcgctcgagtccggctacggctacctgcgcatcacccagttccaggtcaacagcggcgaggaagtcggcaaggcgctggcgcgcctgaagcaggagaacggcggacagaagctgaagggcctggtgctggacctgcgcaacaaccccggcggcgtgctgcagtcggccgtcgaggtgaccgaccatttcctcaccaagggcctgatcgtctacaccaagggccgcatcgccaactccgaactgcgcttctccgccgacccggccgacgccagcgaaggcgtgccgatggtgacgctgatcaacggcggcagcgcctcggccgcggagatcgtcgccggcgccctgcaggatcacaagcgggcggtgctgatgggcaccgacagcttcggcaagggctcggtgcagaccgtgctgccgctgaacaacgaccgcgccctgaagctgaccaccgctctctacttcacccccaacggccgttcgatccaggctcagggcatagtgccggacatcgtggtggagcgcgccaagctgacccaggacgcccagcaggaacacctgcgcgaggccgatctggccggccacctgggcaacggcaacggcgggccggacaagcccagcggcaaggccgggcaggaaggcaaggcgcgtccgcaggacgacgactaccagttgagccaggcgctcaacctgctcaagggcctcaacctgacccgcggactgcagcggtaa

SEQ ID NO: 40965 - protein, 439 aa, Azotobacter vinelandii
MPYLPRPLSLALVAALALGAPLLRAEEAPAPAAETRGKPLLPLEELRTFAEVMDRIKAAYVEPVDDKTLLENAIKGMISNLDPHSAYLEPEEFLDLQESTSGEFGGLGVEVGMEDDQLKVVAPIDDTPAAKAGIEAGDLIVRIDGQPTKGMSMLEAVDKMRGKPGSKIELTLVREGGRPFDVSLTRAVIKVKSVKSQSLESGYGYLRITQFQVNSGEEVGKALARLKQENGGQKLKGLVLDLRNNPGGVLQSAVEVTDHFLTKGLIVYTKGRIANSELRFSADPADASEGVPMVTLINGGSASAAEIVAGALQDHKRAVLMGTDSFGKGSVQTVLPLNNDRALKLTTALYFTPNGRSIQAQGIVPDIVVERAKLTQDAQQEHLREADLAGHLGNGNGGPDKPSGKAGQEGKARPQDDDYQLSQALNLLKGLNLTRGLQR

SEQ ID NO: 40966 - DNA, 1668 bp, Desulfitobacterium hafniense DCB-2
  CDS (1)..(1668)
atgatgaccaaattcagtatgttttgcagcaagttgattaaagccaacacaaaagcgggaagaatccttacggcttccgctttggccttgatcttaaccgtatccgctccggctgcggctttagggagtccggtagacgatgtgcgatccttattggagagccaatatgtggatccagtggatccctgggtgctcagcgcttccagtgttgaggaaatgcttaagcgattggacgatcctcacactgtcttttttacgcaaaaagagtaccagaatttccttaattccatggacttaagtttttccgggattggagtatatattgaactggagccgcggggcttagagattgtcggtatcatcccgggttcaccggctgaggaggccaaactcaaaacaggggatattattgctcaagtcggcggccaaagcctggcggggctttctcaagatgcggcgaccactctgatcaagggccccgaagggaccactatagatatcgtggtcctgcggggagaagagcgcctcagcttaaaggtggcccggagagcggtggaagttcctaccgtgagcggggaaatgctcaatgaagatatcggctatgtggccatagagtcttttggggagaccactgaagaactattcgagcaagtgattaaggagttggacaaacaaggggccgatgcctgggtcatggatctgcgcaataatccgggcggatatttggactcagccttaagcctggcaggatatttcattggtgaacagacagccttgcaaacgaaagaccgctcacagaagtttgagccttaccaggcagaaaagcaggaatttataattgctgagccggtgatattcttaaccaatgaaaacagtgccagtgcttcagagatcctgacggcagtggttaaggactaccaaaaggcagtggtggtaggaaccaatacttatggcaagggctctgtccagagcttatggcagctcaccgacggggatgttctgaagattacagtggctaagttctattctccttatggaaaagagatcaatggggtagggatttctcccgatgtggagattctggaaaatgatcccctggagatggctgtattgatgttggcaggatctattcaagggaatgatgatggacaggaagtcgcggaccttgttcagttcaccgccgggggtaaggattggaacatttcccttgaggaagcgaggaatcctgaatactggtcggcttatcgggaacttattcaaaacaactccttccccggaggattttcctggcgacataactcagactgggcagcgatttcccagagtgaacaagatgccttatggcctttattctatccgggctatcatggaatgaaagagcttaaagatcttgccgttgataagacctttacagtgcggtttacagctcccatcgattttaagagtgtgaccgagaattctttcgaactgattgagagtgagagcggcaagcgcatgcctgtgacctttgagcaagtggatgaacgttcagttaaagtgattccgcaaggccttctcgaaccggagaaaacctactggctccttacccatcaaggaattgccgctaaggatggctctatcctgaaagaaggagcgctgaccgtcgggaccaccggggcaggtcattag

SEQ ID NO: 40967 - protein, 555 aa, Desulfitobacterium hafniense DCB-2
MMTKFSMFCSKLIKANTKAGRILTASALALILTVSAPAAALGSPVDDVRSLLESQYVDPVDPWVLSASSVEEMLKRLDDPHTVFFTQKEYQNFLNSMDLSFSGIGVYIELEPRGLEIVGIIPGSPAEEAKLKTGDIIAQVGGQSLAGLSQDAATTLIKGPEGTTIDIVVLRGEERLSLKVARRAVEVPTVSGEMLNEDIGYVAIESFGETTEELFEQVIKELDKQGADAWVMDLRNNPGGYLDSALSLAGYFIGEQTALQTKDRSQKFEPYQAEKQEFIIAEPVIFLTNENSASASEILTAVVKDYQKAVVVGTNTYGKGSVQSLWQLTDGDVLKITVAKFYSPYGKEINGVGISPDVEILENDPLEMAVLMLAGSIQGNDDGQEVADLVQFTAGGKDWNISLEEARNPEYWSAYRELIQNNSFPGGFSWRHNSDWAAISQSEQDALWPLFYPGYHGMKELKDLAVDKTFTVRFTAPIDFKSVTENSFELIESESGKRMPVTFEQVDERSVKVIPQGLLEPEKTYWLLTHQGIAAKDGSILKEGALTVGTTGAGH

SEQ ID NO: 40968 - DNA, 1188 bp, Desulfitobacterium hafniense DCB-2
  CDS (1)..(1188)
atggatttgcaggagagtcgttggaaagagtatttaaaaaacctgggatgggttcttgccatagggagtttgatttttacggtggttgtcggggggttcattgtaaccaacctggatcatttaggccgcttggcaagagtagtcaagcttgttgaaagtgattatttggaggaagtgtctgtagacaccctgatcgaaggtgccaccaaaggaattgtggattccttgggcgatccttattcaagttatatgaatgctcaagagaatgaagagcttatgcaacaaatcgaagggaaattcggcggcgtggggattattttaagtctgaaagatcctcagaaacttgtggtcctaagacccattaaaaacactccggccgctaaagccggactacagcctggagatgtgattattaagatcgatgatgtggacgccaccaccatcgatcaggaaaaagccgtctccctgatgcgcgggaacccggggactaacgtgactctggtggtctatcgggaaagcattaagcagaatgtgaccgttcctttaacccgggaaaatatcgcagtacccacggtggagggactggctctgccagggaattcggatatagcttatatcggaatttcccagttctcctcccatacagctcttgaactcaatgaagtgctgcgcaatatggatatcagcaaatacaaagggatgatcttggatttacgctataatcatggcggggaattagaatctgctgtaggagtagccagttattttgttcagcccggccccattgtctatattgtggataaaggaggcaatgctgtaaccaaggcttcggaaggcaattatttaggcattccctttgtggttttggtcaatgaggaaagcgcttccgcagctgaaatcgtttccggggccatcaaagatcggggaacgggcacccttgtgggtaccaagaccttcggtaaagggattgtgcagacgatttatcaactggatagggggaccagtgtgaagctgaccaccgccaagtatttgacccctaataagatcgatattcataaaaagggcatcgagcctgatgtggaagtgaagctgaaggatggagaggaagcaactctttctcctactacgaaagcctttgatactcagctcacggaagctcttaaggtgcttcgccaacagatgaaataa

SEQ ID NO: 40969 - protein, 395 aa, Desulfitobacterium hafniense DCB-2
MDLQESRWKEYLKNLGWVLAIGSLIFTVVVGGFIVTNLDHLGRLARVVKLVESDYLEEVSVDTLIEGATKGIVDSLGDPYSSYMNAQENEELMQQIEGKFGGVGIILSLKDPQKLVVLRPIKNTPAAKAGLQPGDVIIKIDDVDATTIDQEKAVSLMRGNPGTNVTLVVYRESIKQNVTVPLTRENIAVPTVEGLALPGNSDIAYIGISQFSSHTALELNEVLRNMDISKYKGMILDLRYNHGGELESAVGVASYFVQPGPIVYIVDKGGNAVTKASEGNYLGIPFVVLVNEESASAAEIVSGAIKDRGTGTLVGTKTFGKGIVQTIYQLDRGTSVKLTTAKYLTPNKIDIHKKGIEPDVEVKLKDGEEATLSPTTKAFDTQLTEALKVLRQQMK

SEQ ID NO: 40970 - DNA, 1341 bp, Nostoc punctiforme PCC 73102
  CDS (1)..(1341)
atgaaccaatctgcgaaaagttactcaccgctccaagtagccttgattggtggagcgatcgctacgactgctacgatgtctgtattcggctccgcttggactcgtggtgtccgtgccgccttagctctacaagacagcccaaaaacgatagttgaccaagtttggcaactggtaaatcatgagtatgttgatggcaaatttaatcaacaagattggcaagcaactagacaaagcctgttgagcaaagactattcttctcgggaagaagcttatgctgccatccgcgaagctttacaaaagttgggagatccttacactcgattcatggaccccaaacagtttgaagccttgactagtcaaacatctggggaagtctctggtattggcgttcggatggaagtaaacgaaaaaactcagcgcctcactgttgtcgaagccatagaaaattctccagcactgaaagctgggatcaaagcaggcgatgaaattttggcaattgacggcaaatccactctcaaaatgaaagtggatgacgcttccaagttaattcgtggcaaagcaggtactcccatcaaactccgactgggacgagcagggcaaaatgcctttgaattgaaactgacaagagcaagtattgaagtaccaacagtacgttataccctcagacaagaaggaaatcgccgcgttggttatatccgtttgcgggaatttagcgcccacgccgcagatcaaatgcaacgagccattcgcgatttgaacactaagaaagttgattcttatgttttagatttgcggggaaatcctggcgggttgttacaagcgagtattgaaattgctcggatgtggtataatgacggcggaattgtcaaaacagtagaccgtgtgggcggtactgaagaaactaaagctaatcgcactgctctaacaaatcgtcccttggcagtattagtggatggtaattcagctagtgctagtgaaattctcacaggggcactcaaggataataagcgggcagtagtcgtaggtggtcaaacctttggtaaagcgctagtgcagtcagttcatgaacttgcagatggttccggcttggctgtcaccattgcccattactacactccggcgggaacagatattaaccataaagggattgccccagatgtcaagctagacttgacagaggcacaagagcggcagttagcttctaatccagatttaatcggaactaagagcgatccgcaatatgcccgagcgatcgccattttatcaaataacaacttcgcccagccgccagcaaatcagcccactcgacccatgagccgcgccgataacctgaaattttag

SEQ ID NO: 40971 - protein, 446 aa, Nostoc punctiforme PCC 73102
MNQSAKSYSPLQVALIGGAIATTATMSVFGSAWTRGVRAALALQDSPKTIVDQVWQLVNHEYVDGKFNQQDWQATRQSLLSKDYSSREEAYAAIREALQKLGDPYTRFMDPKQFEALTSQTSGEVSGIGVRMEVNEKTQRLTVVEAIENSPALKAGIKAGDEILAIDGKSTLKMKVDDASKLIRGKAGTPIKLRLGRAGQNAFELKLTRASIEVPTVRYTLRQEGNRRVGYIRLREFSAHAADQMQRAIRDLNTKKVDSYVLDLRGNPGGLLQASIEIARMWYNDGGIVKTVDRVGGTEETKANRTALTNRPLAVLVDGNSASASEILTGALKDNKRAVVVGGQTFGKALVQSVHELADGSGLAVTIAHYYTPAGTDINHKGIAPDVKLDLTEAQERQLASNPDLIGTKSDPQYARAIAILSNNNFAQPPANQPTRPMSRADNLKF

SEQ ID NO: 40972 - DNA, 1281 bp, Nostoc punctiforme PCC 73102
  CDS (1)..(1281)
atgttcaagcaaaaatcgatcgtcaggatagaactcgccgttattgccgcaatcctggcaggaactagtctctacacttctgaagttctaggtaaaactcaagctagccctcaaaaactagtggatgaggtgtggcaaatcctagataaaaattatgttgatagcaattttaaccatcaagattggaaagcaattcgacagcagtatcttagccgatcttatagttctaagaaagaggcttatggcgcaattcaagaaatggtgtctaaattaggcgatcgctacaccgagttttacgacccccaggaatttaaagccctaaatagcgatatttctggcaacctcagtggtgtagggctggaactggcagaaaatgaaaagactaaagctttaactgttgttgctccaattgaaggaacgcctgcttttaaagcgggtattttgccgggtgatttaattgtccagattaacggtcaaatcactcaaggaatgaaaatagaggatgccgttaagcggattgtgggcccagtgggaaccgaagtagtactcacgattaaacggggtagccaatcccaaactttcaagcttacccgtgcaaatattgctatccaccctgtaacttacaacacccaaacgacggcagcgggtaagattggttatattcgtttaccagagtttacgcagactgcacccgcccagatgcatcgggcaattgaagcactagaaaaacaacaggtgcaaggttacgttttggatctgcgttccgatccaggtggactgctggatgcgagtttgcaaattgccagtatgtggttaaaacaaggagcaatcgtgtctttggtaaatcgagatcgagttaaagatagttacaatgcgtcgggacatcctctcaccaacaaacccttagtgatactggtcgataaaggatctgccagcgccagcgaaattctgtcaggagcgctgcaagatgataatcgcgccacgttagtagggactcgcactttcgggaaaggtttagttcaagctgtagagccactggacgatggttcggggttgaaactaacgatcgccaaatactacacaccaaaaggtcgagatatcaatcatgttggcattgcaccagatattaccgtggagttaagcgaggcacaacagaaagcattagtagaaaaccgaaccttggggacattagccgatcctcagtatgctagcgccgttgctgacttgggcaaattgattcagtctggggccaatcgtgtgagtttgcagggtgagaaataa

SEQ ID NO: 40973 - protein, 426 aa, Nostoc punctiforme PCC 73102
MFKQKSIVRIELAVIAAILAGTSLYTSEVLGKTQASPQKLVDEVWQILDKNYVDSNFNHQDWKAIRQQYLSRSYSSKKEAYGAIQEMVSKLGDRYTEFYDPQEFKALNSDISGNLSGVGLELAENEKTKALTVVAPIEGTPAFKAGILPGDLIVQINGQITQGMKIEDAVKRIVGPVGTEVVLTIKRGSQSQTFKLTRANIAIHPVTYNTQTTAAGKIGYIRLPEFTQTAPAQMHRAIEALEKQQVQGYVLDLRSDPGGLLDASLQIASMWLKQGAIVSLVNRDRVKDSYNASGHPLTNKPLVILVDKGSASASEILSGALQDDNRATLVGTRTFGKGLVQAVEPLDDGSGLKLTIAKYYTPKGRDINHVGIAPDITVELSEAQQKALVENRTLGTLADPQYASAVADLGKLIQSGANRVSLQGEK

SEQ ID NO: 40974 - DNA, 1284 bp, Nostoc punctiforme PCC 73102
  CDS (1)..(1284)
atggtgattacaaaaagtaggcttgttttgggtgctacggcggtgacactctccacgatcgcagttactagccttggcattcactcgcgaggtcaggctttatttaaagcaagtcccaaagaaatagtagatgaagtttggcaaattgttcagcgccaatatgtagatggtactttcaatcaggtagattggcaggctgttcgtaaggagtacttaagcaagtcctacagtaatccccaggaggcttataaatctattcgggaaatgttgaaaaagctggatgacccatacacccggtttatgaacccagaagaattcaagaatatgcaagtggacacttctggagaattgatcgggattgggatcactatcagtcaagatgaaaaaactaagcaactggttgtaattgcgccaatcgaagacacgccagcatttaaagctggcgttttggcaaaagatgtcatccttaaaatcgacaacaaaagcaccaaggggatggatactaatcaagcagtagccctgattcgaggtgaagccggaacgcaagttagcctaacgattcagcgcgacggtcagataaaacaattagacatcaaacgggcgcggattgaaattcatccagttaaatattcccaaaagcaaactccagcaggtaatcttggctacattcgcctgaaccagttcagcgctaatgctggtaaagaaatgcaaacagctatcaaggatttagaaagcaaaaaggtagctggatatattctggatctacgtggtaatcctggtggcttactgttctccagtgtagacattgcccggatgtggataaataaaggtaagattgtctccaccgttgaacgccaaggagaggcagaaaaagaagaggccaacggacgcgccttgacagataaacctttggtggtgctggtagataaaggttcagccagtgccagtgaaatcctttcaggggctttgaaggacaacaagcgtgctactttggttggtactcaaacctttggtaagggactagtgcaatcggtacgtcccttagaagatggctcaggattggcggtaacaattgctcattactatactcctaatggtacagatattaatcacaaaggtattaatccagatgtgaaggtagagttgaccaaagagcaaatgcaggaattatggctccatgaacgcgataaactcgctaccttacaagatccacaattcgctaaagcagtagaagtgataggtaaaaaaattgctgctaagggtacagccacagcagaaaagtga

SEQ ID NO: 40975 - protein, 427 aa, Nostoc punctiforme PCC 73102
MVITKSRLVLGATAVTLSTIAVTSLGIHSRGQALFKASPKEIVDEVWQIVQRQYVDGTFNQVDWQAVRKEYLSKSYSNPQEAYKSIREMLKKLDDPYTRFMNPEEFKNMQVDTSGELIGIGITISQDEKTKQLVVIAPIEDTPAFKAGVLAKDVILKIDNKSTKGMDTNQAVALIRGEAGTQVSLTIQRDGQIKQLDIKRARIEIHPVKYSQKQTPAGNLGYIRLNQFSANAGKEMQTAIKDLESKKVAGYILDLRGNPGGLLFSSVDIARMWINKGKIVSTVERQGEAEKEEANGRALTDKPLVVLVDKGSASASEILSGALKDNKRATLVGTQTFGKGLVQSVRPLEDGSGLAVTIAHYYTPNGTDINHKGINPDVKVELTKEQMQELWLHERDKLATLQDPQFAKAVEVIGKKIAAKGTATAEK

SEQ ID NO: 40976 - DNA, 2028 bp, Haemophilus somnus 129PT
  CDS (1)..(2028)
atgaaattacctcaacaacttcgttatttgctttgtttgctgtttggctttgttttaagtttaaattacgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaatgtatgcggataaaattgatgatgtgttaaatgagggaaacctggatattgcttttgatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggtctgaaattcaaacgaggttagttaaacgttataatttagctattcagcatctaagtaaagtaaaatctgatgatattgtacaattgtatttgaatgcttttgcaagagagatcgatccccacaccagttatctagcgcctcgcaaagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaagctgctaaactaacagttgaaactgttgctggtaacaagatcgccgtgattaaaattccggggttttataatggcttaactgaggatgtacgtaaattacttgttgaagttgaagctaaaaaagcggaagctttaatcattgatttacgtggaaatggtggtggctctttaccggaagctattgagttaaccggtttatttattactgatggtcctgtggttcaagttcgggacgcacatcaacgtattcgtatatatgatgatcctgatacagagcaagtttattccggtcccttgcttgttatgattgaccgatttagtgcatccgcatcggagattttttcagctgcgatgcaagattataatcgagccattatccttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttgccttgggataaaattccatcagcgtcatattctgaagtcggtaatgcacgcctgccagtagatatattgaatcagaaacatcttgaacgtattgcgaaagaccctgagtttattgcactggatgaagatttaaagattcgtgatgaaagaaaagaacgtaagtttttatcgttgaactttgctcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctcagaagattgcagtagatttaattgaatttaataaaaaaatggctgagtaa

SEQ ID NO: 40977 - protein, 675 aa, Haemophilus somnus 129PT
MKLPQQLRYLLCLLFGFVLSLNYAVAVEPKLKLTDLVIPQITQENQLATKRTAARLVHSHYQAVELNDEFSQRIFDRYLKALDFNRNTFLQSDIDNMRAMYADKIDDVLNEGNLDIAFDMYELLMKRRYERYRYALSLLDEEPDLNGNDQIEIDREKADWPKNETEANKLWEHRVKNDVINLKLKGKKWSEIQTRLVKRYNLAIQHLSKVKSDDIVQLYLNAFAREIDPHTSYLAPRKAKNFNENMNLSLEGIGATLQSEDGETTIKSLVPGAPADRSKKLKAGDKIIGVGQATGEIEDVVGWRIDDVVDKIKGKKGTKVRLEIEPAKGGKSQIITLVRDRVRLEDQAAKLTVETVAGNKIAVIKIPGFYNGLTEDVRKLLVEVEAKKAEALIIDLRGNGGGSLPEAIELTGLFITDGPVVQVRDAHQRIRIYDDPDTEQVYSGPLLVMIDRFSASASEIFSAAMQDYNRAIILGQNTFGKGTVQQSRSLNFVYDSNSMAPLGLLQYTIQKFYRINGGSTQLKGVAPDIIFPSSIDDEEYGEEKEDNALPWDKIPSASYSEVGNARLPVDILNQKHLERIAKDPEFIALDEDLKIRDERKERKFLSLNFAQRKAENDKDDEKRLKDLNARFKREGKKPLKDLDALPKDYEDPDFYLKEAQKIAVDLIEFNKKMAE

SEQ ID NO: 40978 - DNA, 1338 bp, Pseudomonas syringae pv. syringae B728a
  CDS (1)..(1338)
atgctgcatttgtcccgcctcacctcgctggccctggcaattgccatcgttatcggcgcgcctctggcgcaagctgccgaaaagaccgcgccagccacgcctgcagcagtctcgcccgccaaaaccaacgccaccgcaaagccgccgctgccgctcgacgagttgcgcacctttgccgaggtcatggaccgggtcaaggcggcctacgtggagccggtcgacgacaagactctgctggagaacgccatcaaaggcatgctcagcaaccttgatccgcactctgcctacctcggcccggaagatttccaggagctgcaggaaagcaccagcggcgagttcggtgggctgggcatcgaagtcggcgtcgaggacggtttcgtcaaggtggtttcgcccatcgacgacacaccggcttccaaggctggcatcgaggcaggcgacctgatcgtgaagatcaacggtacgccgacccagggccagaacatgcaggaagcggtcgacaagatgcgcggcaagatcggcgaaaagatcaccctgacgctggtccgcgatggcggcacgccgtttgacgtgaccctggcgcgggcaaccattcaggtcaagagcgtcaaggcgcagatgctggaaaatggctacggctatatccgcatcacccagttccaggtcaagaccggtgacgaagtcggcaaggcgctggccaaattccgcaaggacaacggcaagaagatgagcggcctgattctcgacctgcgcaacaacccgggcggcgtgctgcaatcggccgtgcaggtggcggatcacttcctcaccaaaggcctgatcgtctacaccaaaggccgcattgctaactccgaactgcgcttctcggcagacccggcagacgccagcgaaggcgtgccactggtggtgctgatcaacggcggcagcgcctcggcatcggaaatcgttgccggtgccctgcaagaccagaaacgcggcatcctgatgggcactgacaccttcggcaaaggctcggtgcagaccgtcctgccgctgaacaacgatcgcgccctgaagatcactaccgcgttgtactacacgccgaacggccgctcgatccaggcccagggcatcaacccggacatcgtggtacgtcgggccaaggtcaccaacgaagcggacggcgagaactacaaggaagccgacctgctgggtcacctgggcaatggcaacggcggcgcagacaaaccgaccgtcaagagtggcgcagccgccaaggcgcgtccgcaggatgacgacttccagctcagccaggcgctcagcctgctcaaggggctgagtatcacccgcggcaactga

SEQ ID NO: 40979 - protein, 445 aa, Pseudomonas syringae pv. syringae B728a
MLHLSRLTSLALAIAIVIGAPLAQAAEKTAPATPAAVSPAKTNATAKPPLPLDELRTFAEVMDRVKAAYVEPVDDKTLLENAIKGMLSNLDPHSAYLGPEDFQELQESTSGEFGGLGIEVGVEDGFVKVVSPIDDTPASKAGIEAGDLIVKINGTPTQGQNMQEAVDKMRGKIGEKITLTLVRDGGTPFDVTLARATIQVKSVKAQMLENGYGYIRITQFQVKTGDEVGKALAKFRKDNGKKMSGLILDLRNNPGGVLQSAVQVADHFLTKGLIVYTKGRIANSELRFSADPADASEGVPLVVLINGGSASASEIVAGALQDQKRGILMGTDTFGKGSVQTVLPLNNDRALKITTALYYTPNGRSIQAQGINPDIVVRRAKVTNEADGENYKEADLLGHLGNGNGGADKPTVKSGAAAKARPQDDDFQLSQALSLLKGLSITRGN

SEQ ID NO: 40980 - DNA, 1290 bp, Desulfovibrio desulfuricans G20
  CDS (1)..(1290)
atgcgtttgtccctgtggacagccacgtttattgtttttctgacgctgaccgtgtccatcgggccgggcaatgccacggacggtcccggccggtttgagtcgctcaagcgtttcagtcaggtgcttgaccttgtcgaacgcttttatgtgagcgatgtttcacgcgacgaactgatggaaggtgccatcaggggcatgttgcagaacctcgatccccattctgcgtttctggatgccgcggaataccgtgaaatgcaggagagcacttccggcgagtttttcggtatcggtatcgagataacccagcagaacgacaggcttgttgttgtggcacccattgccgatactcccgcagcccgtgccggactgcgggccggtgatatcattctggccgtggacggcaagctgacgcaggaaatgactctgcgcgaatctgtcagcaggattcgcggccccagaggcagcaccgtcaaactgaccattctgcacgaaggcgaaaattcgcccgagactgtcagcatagagcgtgattccattccgcttatcagtgtgaagtctcatgaacttgagccgggctacctgtgggtgcgtctcagccgcttcagcgagcggaccaccaacgaactgcatgacgccatacgcgaagaacgtaagcgcggtcccataaaaggccttatccttgacctgcgcaacaatccgggcgggcttcttgatcaggccgtgcatgtggccgatacgttcctttccgaaggtaccatcgtctccataaaaggccgtatcgaatccaacaacagggattttaaagccactgcgcaggccactgatgtaaaagctccgctggttgtgctggtgaacgccggatccgcttctgcttctgaaatcgttgccggtgccctgcgcgaccacaagcgcgggctgctgctgggcgagaggacgttcggcaagggctcggtgcagaacgtcattccccttgcagacggttccggtcttaaactgaccattgccctgtaccatacgcctgacggcacttccattcaggcggaaggggtcgaacccgatatcaagctgccttttgtccagcctgccagagaagaagaaagcaaggcaaagcatcctttcggcatcatgcgtgaaaaggaccttgcacgacatcttgaaaacggcgaggacaaaaagagccccgaaaccgagcgggacaaggaatccgtagcaagccttgagcgcgacaaccagctgcgcatggctttgcagctggtcaaacagctgccgcgcctgcaggctatccactag

SEQ ID NO: 40981 - protein, 429 aa, Desulfovibrio desulfuricans G20
MRLSLWTATFIVFLTLTVSIGPGNATDGPGRFESLKRFSQVLDLVERFYVSDVSRDELMEGAIRGMLQNLDPHSAFLDAAEYREMQESTSGEFFGIGIEITQQNDRLVVVAPIADTPAARAGLRAGDIILAVDGKLTQEMTLRESVSRIRGPRGSTVKLTILHEGENSPETVSIERDSIPLISVKSHELEPGYLWVRLSRFSERTTNELHDAIREERKRGPIKGLILDLRNNPGGLLDQAVHVADTFLSEGTIVSIKGRIESNNRDFKATAQATDVKAPLVVLVNAGSASASEIVAGALRDHKRGLLLGERTFGKGSVQNVIPLADGSGLKLTIALYHTPDGTSIQAEGVEPDIKLPFVQPAREEESKAKHPFGIMREKDLARHLENGEDKKSPETERDKESVASLERDNQLRMALQLVKQLPRLQAIH

SEQ ID NO: 40982 - DNA, 2013 bp, Actinobacillus pleuropneumoniae serovar 1 str. 4074
  CDS (1)..(2013)
atgaaaataaatcaacttagccgtcttattgctatttgtttcgggactatcgtaagcagtgcatttgcggtagaaccgcaaattcaagagagtgcgttagtaaccccgaaaccgacggaacaacacagcctttcaactaaacgtgttacagcgcgtttgacacaatctcactaccataagtttaaattagacgatgagtttgcggataagatttttaaccgatatatggattggttagacggagcgcataatacttttttacaatccgatattgatgagatgcgcgccaaatatgcggcgaaattagatgatgagctgtatgaaggtaagttggattccgcatttgaaatctatgatttaatgaccaaacgtcgttatggacgttataagtatgcgttgtctttattagataaagagccgaatttaaaagggtcggatcaaatcgaaaatgatcgtgaaaaggcggcgtttcccgcaacggttaaagaagccaatcagctatgggaacaacgtgttaaaaacgatgtaattaatctctatcttaaagataaaaaatggcctgaaattaagaaaacgttaattaaacgctataatttagcaatcaaacgtttgacgcaaattaaagcggacgatgtattgcaaacgtatttaaatgcgttcgcacgtgaaattgatccgcacacaagttatctttcgcctcgtgcggcaaaagcattccaagaaagtatgaatttgtctttggaaggtatcggtgcgacgcttgctatggaagacgacgtaaccacgattaaatctctcgtgccgggtgcgcctgccgctcgtagtaaaaaactggtggtcggcgataagatcgtaggtgtcggtcaggataacgatgagattgaagatgttatcggctggcgtttagatgatgttgtcgataagatcaaaggtaaaaaaggtactaaagtccgtttagaaattgaaccggaaaaaggcggtaaaacgaaagttatcactttggttcgagataaagtccgtttagaagacagtgcggcgaaattaaccgttgataaaattaacggtaaaaatgtcgcggtaattaaaatttcaacgttttacatcggtttgaccaatgatgtgcgtaaattattagatgaaatgaaaactaaaaaagtggacggtttaattatcgatttacgtgaaaacggcggcggttctctgacggaagttgttgaattaaccggactctttattaaagacgggccggttgttcaggttcgagatgcgttcaaccgtattaaagtgcatgaagatccggaagcggataaatcgctttatgacggtaagatcatggttatgattaaccgccacagcgcgtcggcatccgaaatttttgctgcggcgatgcaagattacaatcgtgcaattatcgtagggcaacaaaccttcggtaaaggtacggttcaacaaagtcgttcgttaaattttgtatatgacttggatcaggaaccgttaggctttattcaatacacaatccaaaaattctatcgtattgacggcggcagcactcaattgaaaggcgtcgaagcggatattaaattccctgaaattattaatgcggagaaaaccggcgaaagttttgaagataatgctttaccttgggataaaattcctgcggcaagctatcaagaagccggacatgcaagagatgcggtttccgcattaactgctaagcatgaagaacgtattgcgaaagaacctgagtttattacgttaaacgaagatattgcaatccgtaaagaaagagacgctcgcaagtattcgtcactgaatctggaagagcgtttgaaagaagatcgtgccgacgaagcgaaacgtctgaaagatctgaatgcacgctttgcaagggaagggaaaaaagcgattaagaatattgacgccttaccgaaagactatgaagcgccggactttttcttaaaagaagctgaaaaaatgatggttgattggttagaaattgataagaagtcataa

SEQ ID NO: 40983 - protein, 670 aa, Actinobacillus pleuropneumoniae serovar 1 str. 4074
MKINQLSRLIAICFGTIVSSAFAVEPQIQESALVTPKPTEQHSLSTKRVTARLTQSHYHKFKLDDEFADKIFNRYMDWLDGAHNTFLQSDIDEMRAKYAAKLDDELYEGKLDSAFEIYDLMTKRRYGRYKYALSLLDKEPNLKGSDQIENDREKAAFPATVKEANQLWEQRVKNDVINLYLKDKKWPEIKKTLIKRYNLAIKRLTQIKADDVLQTYLNAFAREIDPHTSYLSPRAAKAFQESMNLSLEGIGATLAMEDDVTTIKSLVPGAPAARSKKLVVGDKIVGVGQDNDEIEDVIGWRLDDVVDKIKGKKGTKVRLEIEPEKGGKTKVITLVRDKVRLEDSAAKLTVDKINGKNVAVIKISTFYIGLTNDVRKLLDEMKTKKVDGLIIDLRENGGGSLTEVVELTGLFIKDGPVVQVRDAFNRIKVHEDPEADKSLYDGKIMVMINRHSASASEIFAAAMQDYNRAIIVGQQTFGKGTVQQSRSLNFVYDLDQEPLGFIQYTIQKFYRIDGGSTQLKGVEADIKFPEIINAEKTGESFEDNALPWDKIPAASYQEAGHARDAVSALTAKHEERIAKEPEFITLNEDIAIRKERDARKYSSLNLEERLKEDRADEAKRLKDLNARFAREGKKAIKNIDALPKDYEAPDFFLKEAEKMMVDWLEIDKKS

SEQ ID NO: 40984 - DNA, 1593 bp, Psychrobacter sp. 273-4
  CDS (1)..(1593)
atgcattttatcaatcctatcagtcctatcattcgtacattttcattgacctctaaaagagtagagcagtcagtgagcacgatattcacttattctaacgtcttaaagccgacacttattatgggtctgttgggcttaagtgtgatgactatgccagcacaagcggctgtcaaggatagtactgcagggcacaatgctagtcgtacggaaagcttacaactgatccgtttaaataccgataatgtaccattagacaacggcgcggatgatttatcagatattgctgatatgcttgagtctgctgatcaaactgacgatttaattgatagcgtagcggatgaaagtgtattgaacaatgagtcggctgtgattaataccgacattcctgctgaagtcgctcaagtatcattaaatgccatttctcctgaaacgttaaagacttttgttactttgattgacttggtgcgccgtgaatatgttgatacggtcaatgatgaagagctgtttaataatgccatgagcggcatgttaaccaagctcgatagccatgctgaatttttggatgctgaagcctatgaaaatctgcgtgcttttactgaaggtgatgtcggcgatattggcatcaaggttgagtatcagtcagccttgggctattgggtcatcacggaggtacttgatgattcacctgccgataaaaaaggcatcgccgttggtgattatctacaccaagtcgatgagtttaagcttggcgaagatgaagaaagtaatgatattgagcagctactgacagggattgcagggacgcaggtagatgtggtgacttccaaggcaggacgccgtaaacatatcaccacgttacaacgtaatagtagccatcctcaaatcattgaaactcgttttgtagatggtatggccgttgttcggttgcccgcatttcaaaataacagccgcgaaaaactgctgcaaagtttgattgatttaaataaacccgtcacaggaatattattggatttgcgtgacaatccgggcggcgtattggcatcagctgtgagcgttgctagcttatttatgacagatacggatgtggtgcagataaagagtcgtcaggctgattcgcgtacgttatcgaccaaaggtgcagcattattcaagtcactgccagtagtggtactgcaaaatcgctactcggcgtcagcggcagaagtgttgaccagcagcttgcaggcgcaaaagcgagccactatcttaggtgagatcagttatggcaaaggctcagtacaatcagtgataccgcttaatgatgcgcaagcagtcaagctcacggttgccaactatatgaccgctttaggtaagaagatagacggtattggggtagagcccgatgtcgcactatcggggagtgagagcacgtgggaggagcaagcgcttaatttattacgaaagaaagcgcttacttcaggtattcaatttgtatacagggcagcattagaggatctctctaagaaaaaatctgatcctaaaaacagtgttattaagaacaatactgttataaataatgttatcgaaaaaccgacatttaaggagaaatcctaa

SEQ ID NO: 40985 - protein, 530 aa, Psychrobacter sp. 273-4
MHFINPISPIIRTFSLTSKRVEQSVSTIFTYSNVLKPTLIMGLLGLSVMTMPAQAAVKDSTAGHNASRTESLQLIRLNTDNVPLDNGADDLSDIADMLESADQTDDLIDSVADESVLNNESAVINTDIPAEVAQVSLNAISPETLKTFVTLIDLVRREYVDTVNDEELFNNAMSGMLTKLDSHAEFLDAEAYENLRAFTEGDVGDIGIKVEYQSALGYWVITEVLDDSPADKKGIAVGDYLHQVDEFKLGEDEESNDIEQLLTGIAGTQVDVVTSKAGRRKHITTLQRNSSHPQIIETRFVDGMAVVRLPAFQNNSREKLLQSLIDLNKPVTGILLDLRDNPGGVLASAVSVASLFMTDTDVVQIKSRQADSRTLSTKGAALFKSLPVVVLQNRYSASAAEVLTSSLQAQKRATILGEISYGKGSVQSVIPLNDAQAVKLTVANYMTALGKKIDGIGVEPDVALSGSESTWEEQALNLLRKKALTSGIQFVYRAALEDLSKKKSDPKNSVIKNNTVINNVIEKPTFKEKS

SEQ ID NO: 40986 - DNA, 2211 bp, Psychrobacter sp. 273-4
  CDS (1)..(2211)
atgaaaaaacaaccagcacagtggttactcagtgcagcgtcagtgggcatcgcaggtttaattcttacccaaagctatggcaccgcagtagctgataccaataccgaaggctttaaacaaacgcctgagcaacaggttaccacgcgccaagtagcggcattgctggatcgcagtcattatcttaatcagccactcgatacggcgactggtagcgagattttgtctatgtatatcgatagccttgacccaaaccatacgctgtttttgcaatctgatgtcgatgagtttaagaaaaagtatgccgatgagtttggcgtgcgcttaaagcgtggtgatttatctgctggggtagaggtgtttgagcgctatcgtaaacgctcaaatgagtattttgccatggcaaaaaagatgctaaaaacggatattaatttaaccagcaaggataccattgtccttgaccgtgaaaaactcaatcattttaaaaccaaaaaagagcagcgcgactattggacaagtcagttgaagtttcagttgatgagtattactttaggtaaagaagatgagaaagcaaaagaaaaggtatttttagacaacccagatatcacgcgcggtcaagatttagtacgtaatgacgaacgtacgcctagtgagattttgcttaatcgtttatctcgtcagcaagaacagtttacccgtctaaaagatgatgagattatggaaaccatcttaaacacggcgatgctgacctacgatccgcacagtaattattatgcaccgattcaagccaatgagctacaaatccaatctagtttacagttagaaggcgttggggtatctatccgtcctgatcgcaaaaacccagactatacgcgcattgtaactttagtcgatgggggtcctgcggcaaagtcgggtcaaattaagcccaatgacttaattattggtattgcccaagacggtaagactatgaccgatgtagttggctggtcaacgcgtgaaatcgtcagcctaattcgtggtaagcgcggcacatcggtgacgattaaagtacgtcagcccaatacccctgatgccagtgcccgtaatgtgactgtggtgcgtgatatcattcaacaagaagaatcaggtgttactcagcgtgtcgttgaagttcagcgtccaaatattgataagaccccaaagcgtatcggtgtccttgagatcccgagtttttatctaaactaccgcgctcgccgtaatggtgaggactaccgtagcgttagtatcgataccgaaaaagcacttaaagagcttaatacaaagaatatagacggtctagtcgttgatctacgtaacaatccgggtggctcgctagatgaagttgccaagatgctaggcttctttattaagagtggtccgctggtacagattcgtgataatcgtggcaatatccaagtttaccgtgatgacgatggtggtgagcagttgtatgatggcaaggtagtcgttctgacgaacctagcgtctgcgtcagcaagtgaaatctttgcagccgccattcaggattatggacgtggcttggtggtcggtagtaccacgacaggtaaaggctcagcgcaaatccaattagacagtttggcacttggttctgcaacgttaacgcagcgtaaattctatcgtatcactggtggtagtacacagaataaaggcgtggtgcctgatgttgaattggtcaatatctatgacaatgcaacctttggcgagcgcgcacagaaaaaagccttgccttgggatacgataaagacagcaccgtataagcctgaaggtaaatttacgtcgaataccttagcgacgctaaaccaacaatcaaaaattcgtcaacaaaaaaatcctcagttcgtttatttatcaacgctcaatgatatccgtaatatggaagatgagaaaaagccagttgcgctcgatatcaataaacgccgtgctaaaatgcagctgatagaaaaacgctcattagaggttgaaaataagcgtctgattgcaactggtgagcgtccttatgccaactggaatacttatcaagcggcaatggatgctaagtttgaagagcgtagtcagatgaaggcgggtgagcgtccagagttaccagaagatgaagccttcatcaatgaagcggcttatatcatgctgagtactgagccgaaaacgctaagcagtcctgaagaaaagccataa

SEQ ID NO: 40987 - protein, 736 aa, Psychrobacter sp. 273-4
MKKQPAQWLLSAASVGIAGLILTQSYGTAVADTNTEGFKQTPEQQVTTRQVAALLDRSHYLNQPLDTATGSEILSMYIDSLDPNHTLFLQSDVDEFKKKYADEFGVRLKRGDLSAGVEVFERYRKRSNEYFAMAKKMLKTDINLTSKDTIVLDREKLNHFKTKKEQRDYWTSQLKFQLMSITLGKEDEKAKEKVFLDNPDITRGQDLVRNDERTPSEILLNRLSRQQEQFTRLKDDEIMETILNTAMLTYDPHSNYYAPIQANELQIQSSLQLEGVGVSIRPDRKNPDYTRIVTLVDGGPAAKSGQIKPNDLIIGIAQDGKTMTDVVGWSTREIVSLIRGKRGTSVTIKVRQPNTPDASARNVTVVRDIIQQEESGVTQRVVEVQRPNIDKTPKRIGVLEIPSFYLNYRARRNGEDYRSVSIDTEKALKELNTKNIDGLVVDLRNNPGGSLDEVAKMLGFFIKSGPLVQIRDNRGNIQVYRDDDGGEQLYDGKVVVLTNLASASASEIFAAAIQDYGRGLVVGSTTTGKGSAQIQLDSLALGSATLTQRKFYRITGGSTQNKGVVPDVELVNIYDNATFGERAQKKALPWDTIKTAPYKPEGKFTSNTLATLNQQSKIRQQKNPQFVYLSTLNDIRNMEDEKKPVALDINKRRAKMQLIEKRSLEVENKRLIATGERPYANWNTYQAAMDAKFEERSQMKAGERPELPEDEAFINEAAYIMLSTEPKTLSSPEEKP

SEQ ID NO: 40988 - DNA, 2076 bp, Dechloromonas aromatica RCB
  CDS (1)..(2076)
ttgaagcaactctgctggatcgtcctcggccttaccgtcagcgcacaagcggccgaactggcaccgcaaccgcagcaccagcgcgtcgtccggatcagcgccgccctgctcggccattaccattacaaaccggcagtcctcgacgatgccctgtcagaggcgatcttcgagcgctatctgaagacgctcgatagcgaaaaatactatttcacccagagcgacatcgaccagctcagtgaataccgaacccggctcgacgatgcgatcatcgaagagaacctgcaagcgccatttgccatcttcaacctttacgcgcgccgggcggaggaacacttttcctatgcccgcagcctgctcaaaggcggtttccgcttcgatcagaacgaccgcttcacctttgtccgcgacaaggccgaatgggcaagctccgacgaagcattgcgcgaaatctggcagcagcgcgtcaagaacgactggctgcgcctgaaactggctggcaagagcgatcctgagatcgttaccgccctcgacaaacgctatgagcaatcgatccggcgcatcaaccgtctgaagagcgacgacgctttccagatgttcatgaacgcctacaccaccgccatcgagccccataccacctacctcgggccgcgtgcttcggctgacttcgacatatcgatgcgcctgtcactgaccggcattggtgcggtgctgcaggaacgaaacgattacaccatggtccgcgaagtgacccccggcgggccggccgcccgttccggccagctcaaggctggtgaccgaatcgttgccgtcgcccagggcgagaaaggcgccttcgtcgatgtcgtcggcgcccgtctcgatgacacggttgccctgatccgcggcgcggccgacagcgtggttcgcctcgacattttgccggccaacgctggcccggatgccaaacatcgacagataacgctggtccgcaagaaggtcgacctggcccagcaagcggccaagaaagccgtcctcgacgtcacggacaatggcagcgcccggcgcatcggcgtgattaccctgcccgccttctacgacgacttcgaaggccgccgcaagggcgacccgaactttcggagcgccacccgcgatgtggcgaagctgctcaaggaactgggcaaggagaaggttgatggggtcgtgctcgacctgcgccacaacggcggcggttcgctgaaggaagccatcgagctgaccggactgttcatcgacaccgggccggtcgtcatggaacgcaatgcacagggccaggtttttgtcgatggcgacactactcccggcaccgcctgggatggcccgctgggggtactgatcgatggcgaatcggcctcggcctccgagatttttgcggcagccattcaggactacggccggggtatcgtcatcggcgagcagagttatggcaagggcaccgtccagaccgtactcaacctcgaccaggctgtcggcagcgagaagccggcgcttggcgaactgcggatgaccatcgcccagtttttccggatcaatggcagcaccacgcaagtacgcggcgtccagccggacatcgccctgccggccgccaatgatccgacgctgaccggtgaggccagcaacgacaatgccctgccctggacgcacatccgcgctgccgcctacgaccgggttgccgacaagggcgaggtgattcccgccctgctcgcccgccatgtcgcgcgggcggccaacgacccggaatttcagcgcctcgaagaaacggcctcggaactccagcgattacgcctgcaaacgagcgtctccttgaacgaagcagaaagacgccgcgaaaatgaaagcctggaaaaacgcctaagcgggctggctcgtgccgacgacggcctgctcgatagcgaacgcgaacccgatacggacggcaaggatgaaaaggcgggcaacaaagccaaggatacccgactgctcgcggcagcccgcatcatcgcggacgaagtcgatctacaacgcgagaagggcaaaccgggcgctctcgagcggccaaaccaggcggcaatcaaccgatag

SEQ ID NO: 40989 - protein, 691 aa, Dechloromonas aromatica RCB
MKQLCWIVLGLTVSAQAAELAPQPQHQRVVRISAALLGHYHYKPAVLDDALSEAIFERYLKTLDSEKYYFTQSDIDQLSEYRTRLDDAIIEENLQAPFAIFNLYARRAEEHFSYARSLLKGGFRFDQNDRFTFVRDKAEWASSDEALREIWQQRVKNDWLRLKLAGKSDPEIVTALDKRYEQSIRRINRLKSDDAFQMFMNAYTTAIEPHTTYLGPRASADFDISMRLSLTGIGAVLQERNDYTMVREVTPGGPAARSGQLKAGDRIVAVAQGEKGAFVDVVGARLDDTVALIRGAADSVVRLDILPANAGPDAKHRQITLVRKKVDLAQQAAKKAVLDVTDNGSARRIGVITLPAFYDDFEGRRKGDPNFRSATRDVAKLLKELGKEKVDGVVLDLRHNGGGSLKEAIELTGLFIDTGPVVMERNAQGQVFVDGDTTPGTAWDGPLGVLIDGESASASEIFAAAIQDYGRGIVIGEQSYGKGTVQTVLNLDQAVGSEKPALGELRMTIAQFFRINGSTTQVRGVQPDIALPAANDPTLTGEASNDNALPWTHIRAAAYDRVADKGEVIPALLARHVARAANDPEFQRLEETASELQRLRLQTSVSLNEAERRRENESLEKRLSGLARADDGLLDSEREPDTDGKDEKAGNKAKDTRLLAAARIIADEVDLQREKGKPGALERPNQAAINR

SEQ ID NO: 40990 - DNA, 1287 bp, Anabaena variabilis ATCC 29413
  CDS (1)..(1287)
atggtgattacaaaaagtaggcttgttttgggtgctacggcagtgacactctccacgatcgcagttactagccttggcatccactcgcgcggtcaggctttatttaaagcaagtcccaaggaactggtagatgaagtatggcaaatcgttcagcgtcaatacgtagacggcacttttaaccaagtggattggcaggctgttcgtaaggaatacttaaacaagtcctacagtaaccagcaggaagcttataagtccatacgggaaatgctcaaacgcctgaatgatccatacactcggtttatggaccctcaggagttcaagaatatgcaggtggatacctccggagaacttacagggattggtatcaccatcagtcaggatgaaaaaactaagcaattggtagtgattgcaccaattgaagacaccccagcttttaaagctggcattttagctaaagatgtcatcctcaaaattgatggtaaaagcaccaaggggatggatactaatcaagctgtaaatttgatccgaggtacagctggctcacaagtaaccttgacgattcagcgcagcaatcaagaaaaacaattcaaaatcacaagggcgcggattgaaattcatccggtgcgctattctcaaaagccaacctctgttggtaaagtaggctacattcgtctcaaccagttcagcgccaatgctggtaaagagatgcaggaagccatcaaaaatttagaaaaacaacaagtagctggttatattctggatttacgtggtaatcctggtggtttactcttttccagtgtagaaattgcgcggatgtggatggataaaggcacaattgtctctactgttgaccgccaaggagaacgagaaagagaagtggcgaacggacgcgctttgacaaacaaacctttagtaattttggtggataaaggttcagccagtgctagtgaaattctctccggcgcattgcaagataataagcgtgctgttattgtaggtactcaaacttttggtaagggcttagtacaatcagtccgtcctctagatgatggctcaggattggcagtaacaatcgccaaatacctaactcccaatgatagggatattaacaagcatggtattgatcccgatgtgaaagtagaattaacggatgcccaacgccaagatttgtggctacgtgagcgcgaaaaactcggcacattggacgatttgcaatttgctaaagcagtggaaatcttaggtaaacagattgctgccaaaggtacgccaacagcagaaaagaagtaa

SEQ ID NO: 40991 - protein, 428 aa, Anabaena variabilis ATCC 29413
MVITKSRLVLGATAVTLSTIAVTSLGIHSRGQALFKASPKELVDEVWQIVQRQYVDGTFNQVDWQAVRKEYLNKSYSNQQEAYKSIREMLKRLNDPYTRFMDPQEFKNMQVDTSGELTGIGITISQDEKTKQLVVIAPIEDTPAFKAGILAKDVILKIDGKSTKGMDTNQAVNLIRGTAGSQVTLTIQRSNQEKQFKITRARIEIHPVRYSQKPTSVGKVGYIRLNQFSANAGKEMQEAIKNLEKQQVAGYILDLRGNPGGLLFSSVEIARMWMDKGTIVSTVDRQGEREREVANGRALTNKPLVILVDKGSASASEILSGALQDNKRAVIVGTQTFGKGLVQSVRPLDDGSGLAVTIAKYLTPNDRDINKHGIDPDVKVELTDAQRQDLWLREREKLGTLDDLQFAKAVEILGKQIAAKGTPTAEKK

SEQ ID NO: 40992 - DNA, 1245 bp, Anabaena variabilis ATCC 29413
  CDS (1)..(1245)
atgcaaaaacagttttttcggctaggattttcgctattggtggctttgagtttggctgtaggagtagtagttcaaccagccacagcattgacggaggaacagaaactagtttcggaagtgtggcgaattgtcaatcgctcttatttggatgagacgtttaaccatcaaaattgggcgaatgtgagacagaaggcattggaaaagccccttacagaccataaagctgcttatggggcgattcagaatatgctcaagactttaggtgatccttttacgagatttttagaccctgagcaataccgcagcttacaggttagtacttctggagaactgaccggagtgggtttacaaatcgccttaaatccacagagtggaaagttggaggtggtttctccgattgcgggttcgccagcagatcaagcgggtattaaaccgcgcgatcgcattgtgaaaattgaaggcatttccacgacagatttgactcttgacgaagcagccaccaggatgcgcggccccataggtagtttagtcacccttgtaattgaacgtgacggagaaggggaaaaagaaatcagaatagtgcgcgatcgcattgctcttaatcctgttgtggcagaattacgctcatcccccgaaggtaagtctttcggttatcttcgcctcactcaattcaatgccaatgcctcaatggaattagcacacgctatctctagtctagagaaaaaaggtgctgctgcctacattttggatttgcgaaataatccaggcggtttactgcaagccggcattgagattgcccgtcagtggttagattccggcacaattgtctacactgtcaatcgccaaggtattcagggtagctttgaagcctttggccctgccttgacagatgatccattaataattttagttaaccaaggaaccgccagtgctagcgaaattctcgccggcgcactccaagataacggtcgcgctcagttggtgggtgaaactacctttggcaagggtttaatccagtctttatttgaattatccgatggttctggcttggcggtgacaattgctaagtatgaaactcctaatcacagagatattaacaagttaggcattaaaccggatacagttgttacccagcaaatactcacccgcgatgaaattgccacagaaacagatttgcaatatcaagcagcgttggatctgttgagtaaaaattctgtagtagccgggattgggaataaaggctag

SEQ ID NO: 40993 - protein, 414 aa, Anabaena variabilis ATCC 29413
MQKQFFRLGFSLLVALSLAVGVVVQPATALTEEQKLVSEVWRIVNRSYLDETFNHQNWANVRQKALEKPLTDHKAAYGAIQNMLKTLGDPFTRFLDPEQYRSLQVSTSGELTGVGLQIALNPQSGKLEVVSPIAGSPADQAGIKPRDRIVKIEGISTTDLTLDEAATRMRGPIGSLVTLVIERDGEGEKEIRIVRDRIALNPVVAELRSSPEGKSFGYLRLTQFNANASMELAHAISSLEKKGAAAYILDLRNNPGGLLQAGIEIARQWLDSGTIVYTVNRQGIQGSFEAFGPALTDDPLIILVNQGTASASEILAGALQDNGRAQLVGETTFGKGLIQSLFELSDGSGLAVTIAKYETPNHRDINKLGIKPDTVVTQQILTRDEIATETDLQYQAALDLLSKNSVVAGIGNKG

SEQ ID NO: 40994 - DNA, 1599 bp, Ralstonia eutropha JMP134
  CDS (1)..(1599)
atgcgtaagacgctcaagaacatcagcctcgtttcggtcggactcgtcgccggcgtgctggccacgctgcagatttcagccaccgcgcagaattccgccggccccctgccactcgaccagttgcggctgatggccgacatcttcgggcagatcaagcgcgaatatgtagagccggtcgatgacaagaagctgctgaccgaagccatcaagggcatggtcgcgagccttgacccgcattcggcctatctggacgagaaagacttcaaggaactgcaggaaggcacgcgcggccgcttcgccggcctcggcatcgagatctcgcaggaagaaggcctggtcaaggtcatcaacccgatcgaggacacccccgcgttccgtgccggcatccagcccggcgacctgattacccgtatcgacgacaagcccgtgcgcgggctgccgctggaacaggcggtcaagcgcatgcgcggcgagcccggcaccaaggttacgctgacgatctatcgcaaaagcgaagagcgcaccttcccgatttccatcacccgtgccgaaatccgcgtccagtcggtcaagaccaagatgctggacaacaacaccatcggctgggtgcgcctgaccagcttccaggaacgcacggtcggggacctgggccgccggctcaacgagatggcccagaagaacccgggcctgaagggtatcgtcctggacctgcgcaacaacggcggcggcgtgctgcagggcgcggtcggcgtagcggcggcgttcctgccggacgattcgacggtggtgtccaccaacggccaggtgcccgacgccaagcgcgtgtacaaggcgacgttcaacaactaccgcctgtcgtcgctcgaggacgatccgctcaaggacctgccggcgctgtacaagaaaatcccgatggtcgtgctgaccaacgcctattcggcgtcggcgtccgagatcgtggctggcgcgctgcaggaccaccaccgcgcgctgatcatgggcaagaccacgttcggcaagggttcggtgcagaccgtgcggccgctgaccaatgacaccggcatcaagctgaccatcgcgtactactacacgccgacgggcaagtcgatccaggccaagggtatccgcccggacattccggtcgaccagaacccggaaggtgacccggacgacgcgctgatcacgcgcgaaatcgacaccgagcgccacctgcacaacaagcaggaatcggaagagccggaaatgaacgagcgtgaacagcgccgcgtggaagaactgcgccgcctggaagaagagaacgcgaagaagacgccggaagagcgcgagaaggaacgtcgcaagaagccgatcgaattcggttcggccgacgacttcatgttgcagcaggccatcgcccagctcgacggccggccggtcaagcgctccaagtcgaagctcgaaaccaacccgcccgccgacaagccggccaaggccgcgcctgcgaagaagggcgccagcgccccggctgccaagcccgccgcgccggcgcccggcaagcagccgccggccagtgcgccgatcggcgagccgctgggcacgccgaccggcaaggcgccctga

SEQ ID NO: 40995 - protein, 532 aa, Ralstonia eutropha JMP134
MRKTLKNISLVSVGLVAGVLATLQISATAQNSAGPLPLDQLRLMADIFGQIKREYVEPVDDKKLLTEAIKGMVASLDPHSAYLDEKDFKELQEGTRGRFAGLGIEISQEEGLVKVINPIEDTPAFRAGIQPGDLITRIDDKPVRGLPLEQAVKRMRGEPGTKVTLTIYRKSEERTFPISITRAEIRVQSVKTKMLDNNTIGWVRLTSFQERTVGDLGRRLNEMAQKNPGLKGIVLDLRNNGGGVLQGAVGVAAAFLPDDSTVVSTNGQVPDAKRVYKATFNNYRLSSLEDDPLKDLPALYKKIPMVVLTNAYSASASEIVAGALQDHHRALIMGKTTFGKGSVQTVRPLTNDTGIKLTIAYYYTPTGKSIQAKGIRPDIPVDQNPEGDPDDALITREIDTERHLHNKQESEEPEMNEREQRRVEELRRLEEENAKKTPEEREKERRKKPIEFGSADDFMLQQAIAQLDGRPVKRSKSKLETNPPADKPAKAAPAKKGASAPAAKPAAPAPGKQPPASAPIGEPLGTPTGKAP

SEQ ID NO: 40996 - DNA, 1431 bp, Methylobacillus flagellatus KT
  CDS (1)..(1431)
atgcgcaaacttaaaaagatcggcttgatcgtcgcaggcccgttgcttggtgtcatgctgagcttgagttactccgccattgcggacaaggagactaagccgcagctgccgctggacgacttacgcacctttgccgaagtatttggcaagatcaagagcgactatgttgaacccgttgaagacaagaagctactcaccgaggcaatcaatggcatgctcgccggcctggaccctcactcggcctatctggatgctgatgccttcaaggacttgcaggccggcacccagggagaattcggtggactgggcattgaagtcggcatggaagacggcttcgtgaaggtcgtggcccccatcgaggacacgcctgcatacaaggccggcctcaagagcggcgacctgatcatgaagcttgacgataccccagtgaaaggcatgacactcacggatgctgtcaaacgcatgcgcggcaagcctgataccaagatcaccctgaccgtcctgcgcaaaggtgaggccaagcccctgactttcgtgctcacgcgcgccatcatcaagacccagagcgtcaagtacaaactgtctgaacccggctatgcctatattcgcatcacccagttccaggaacataccggggaagacctcgccaaggcgctgaagaccatgcgcgaacagaacaaggaagccttcaaggggctgatcctcgatctgcgcaacaatcctggcggattgctgaatgcaggcgtcggtgtttctgccgccttcctgcccaaaggtgagctggtggtttacacagaaggccgaggcgaagaagccaagatgcgcctgaccgcgaatcccgagaattacgttcgcggcggcgcccgcgccgactacctgcgcgaccttcctgcagaaatgaagacattgcctattgtcgtgctggtcaacggcggctcggcttccgcttcggaaatcgtcgcgggtgcattgcaggatcacaagcgtgccatcatcatgggcacccagactttcggcaaaggatcggtgcaaaccatcctgccgatgaacaatggggcggccatcaagctcactaccgcgcgttacttcacgccaaagggacgctcgatccaggccaagggtatcgtgcccgacatcgtggtggaagaagccacggtcagctcgcaagaacatgcagcgatgctgcgcgaagcagacctgagccgccacctgagcaaccccaaggaaggggaagaagcgcctactgtccagcctgctccagccgagccagagaataccaagccagaggctcctgctaccgagcctgacagcaaggatcagaaagacaagcctgctgcaaacggcccgatcgagccaggctccaaggcagactaccagttcaatcaggcgctcaacctgctgaagggtctgcagatactgcaacgcaaataa

SEQ ID NO: 40997 - protein, 476 aa, Methylobacillus flagellatus KT
MRKLKKIGLIVAGPLLGVMLSLSYSAIADKETKPQLPLDDLRTFAEVFGKIKSDYVEPVEDKKLLTEAINGMLAGLDPHSAYLDADAFKDLQAGTQGEFGGLGIEVGMEDGFVKVVAPIEDTPAYKAGLKSGDLIMKLDDTPVKGMTLTDAVKRMRGKPDTKITLTVLRKGEAKPLTFVLTRAIIKTQSVKYKLSEPGYAYIRITQFQEHTGEDLAKALKTMREQNKEAFKGLILDLRNNPGGLLNAGVGVSAAFLPKGELVVYTEGRGEEAKMRLTANPENYVRGGARADYLRDLPAEMKTLPIVVLVNGGSASASEIVAGALQDHKRAIIMGTQTFGKGSVQTILPMNNGAAIKLTTARYFTPKGRSIQAKGIVPDIVVEEATVSSQEHAAMLREADLSRHLSNPKEGEEAPTVQPAPAEPENTKPEAPATEPDSKDQKDKPAANGPIEPGSKADYQFNQALNLLKGLQILQRK

SEQ ID NO: 40998 - DNA, 1386 bp, Crocosphaera watsonii WH 8501
  CDS (1)..(1386)
atgaacaatatcataaaatacttgtgccgtcatcattcactctttttaggtggaactctagctacgattttcttacacactttagccctacctgtaaatagtgcgcctgaaccagaagttctagaaaataatcccaaagccattgtggacgaaatctggcaaattgtgaataacgaatttgtcaatccagattttaatcgggttaattggcaagaaaaacggagagaattattatcccaagattacgatagtccaaaacaggcatataaagccattcgtgaagccctagaggacttaagcgacccctatacccgctttttaccccccaatgaattttctgtgttaaccagccaaaccgtcggagaagtatcgggtattggggtgagattagccatcgataagcgtaccagcgaaatttatatcgtggaagcagtgaagaactctcctgccatcaacgcaggattaaaacgaggcgatcgcctgattcgcattaacggcaaacccacagctttaatgagtatagaacaggccaaagaagctcttgctggggaactgggaacagaagtcagtttacaactatcacgacggaataaaggggtgtttcaagttactttggaacgagcgcaaatcgagattcctgcagtaacttacaaccttcaagaagacggaagccatcgcatcggttatatcaaactcgatgagtttagttcccacgctaccgaacaaatgaaattagccatcgaagacttaggacaacaagaggtttctggctatgttctcgatctacggggcaaccctggaggactattgttcgccagtgtggacattgctcgtctttggttgaaaaaaggagaaattgtcagtacagttgatcgtagaggaggcgatcgccatttcttggctaatggtacttccttaaccgacttacccttagtcattttagtcaatgaatggtcggccagtgccagtgaaattttggctggggccctcaaagaaaacggtcgtgcgacggtagtggggactagcacctatggtaagggtacagtgcagtctgttcataacctttccgatggttccgggttagcggtaactatagcccgttattacccccccagtggcaccgatatcaaccagaaaggcattagtcctaatgtttatttagagttgaccatggagcaagcagttcgcctcaaaaacgatcctagcttgatgggaaccaatgctgatccccaatacacaagggctgtttctattttaaaaggtcgcactcaacccatttctgcccctgcaactcctaaacctgttggactgcgttgggaagagttacaagaaaccctcaaagatcccgatcctcgctgggaaagaatgcaggaaacagtcaattaa

SEQ ID NO: 40999 - protein, 461 aa, Crocosphaera watsonii WH 8501
MNNIIKYLCRHHSLFLGGTLATIFLHTLALPVNSAPEPEVLENNPKAIVDEIWQIVNNEFVNPDFNRVNWQEKRRELLSQDYDSPKQAYKAIREALEDLSDPYTRFLPPNEFSVLTSQTVGEVSGIGVRLAIDKRTSEIYIVEAVKNSPAINAGLKRGDRLIRINGKPTALMSIEQAKEALAGELGTEVSLQLSRRNKGVFQVTLERAQIEIPAVTYNLQEDGSHRIGYIKLDEFSSHATEQMKLAIEDLGQQEVSGYVLDLRGNPGGLLFASVDIARLWLKKGEIVSTVDRRGGDRHFLANGTSLTDLPLVILVNEWSASASEILAGALKENGRATVVGTSTYGKGTVQSVHNLSDGSGLAVTIARYYPPSGTDINQKGISPNVYLELTMEQAVRLKNDPSLMGTNADPQYTRAVSILKGRTQPISAPATPKPVGLRWEELQETLKDPDPRWERMQETVN

SEQ ID NO: 41000 - DNA, 1242 bp, Crocosphaera watsonii WH 8501
  CDS (1)..(1242)
atgagaaaacgcgcattttgggtaactcttctggttattttttccctcttgttcaactgttttgcttggactcccaatgctgatgctttcacagaaaaccaaaagctactcttgcagtcgtggcggttggttaatcaatcctatttagatgataccttcaaccaccaaaactggtggttattaagacaagatttgctgaaacgttctttagataatcgtgaagaaacctacgatactatcgaagaaatgttagcaacccttgatgaaccttttacccgtttattaagacccgaacagtatcataatttacaagttagtaccgcagggcagttgtcaggtgtgggcttacaaattaatatcaatcccgatacagggaacctagaagttgtctctcccatcgaaggatctcccgctgacgcagccggaattaaagcccgcgatcgcattttaaaaatcgatgatgtggataccaccacattaaccttagacgaagcagccaccagaatgcgtggtcctagaggtactaaggtatatttaaccatattacctcataaagaaacctctgatattcgtgaagtagaaatcacccgtaaccgcatttctttgagtccggttactgctagtttaaatcagcccactcccaaccttcccattggttatattcgtctaaatcaattcagtgctaatgctgctgaggaaatggcaaacgctatcaataacctcgaaaaagaaggagccgaaggttacattttagacctcagaaataaccctggtggactattgcaagcaggtatcgaaattgcccgtctatggatggatcaaggtaccattgtttacacagtcaatcgtcaaggggtgcaagatagttttagcgcattaggaaccgccttaaccgatgatcccttagtcttattagttaatcaaggaactgccagtgctagtgaaattttagccggtgctttaaaagataatcgcagggcgacattagtaggggaaaaaacctttggtaaaggattaattcaatccttatttgagttacctgatggtgctggtttagccgttaccgttgctaagtacgaaacccctaatcataacgacatccataaattaggaattgaaccggataaagtggttaatcaagagcctatttcctacaggcaaattgctacaaaagatgacgtacaatatgaggctgctgttgaacttttaacaggaaactctgtattagctaatgcaggttaa

SEQ ID NO: 41001 - protein, 413 aa, Crocosphaera watsonii WH 8501
MRKRAFWVTLLVIFSLLFNCFAWTPNADAFTENQKLLLQSWRLVNQSYLDDTFNHQNWWLLRQDLLKRSLDNREETYDTIEEMLATLDEPFTRLLRPEQYHNLQVSTAGQLSGVGLQININPDTGNLEVVSPIEGSPADAAGIKARDRILKIDDVDTTTLTLDEAATRMRGPRGTKVYLTILPHKETSDIREVEITRNRISLSPVTASLNQPTPNLPIGYIRLNQFSANAAEEMANAINNLEKEGAEGYILDLRNNPGGLLQAGIEIARLWMDQGTIVYTVNRQGVQDSFSALGTALTDDPLVLLVNQGTASASEILAGALKDNRRATLVGEKTFGKGLIQSLFELPDGAGLAVTVAKYETPNHNDIHKLGIEPDKVVNQEPISYRQIATKDDVQYEAAVELLTGNSVLANAG

SEQ ID NO: 41002 - DNA, 1302 bp, Crocosphaera watsonii WH 8501
  CDS (1)..(1302)
atggtcaattacaaaaaagggttagttcttggtgcaactgctgccgttttaacagccatcgccgttacaggagcagggttacgtcttccccgtagcgttgcttatcttcaagataatcctaaaaaattagtcgatgaagtttggcaagttattaatgatacttatgttgatgccacctttaatcaggtagactggcttgctgttcgccaaaagtatgtaggaaagtccaaaacctacaatagtaaggaagaggcttataaagcgattcgggagatgttagaacaactcgacgatccctacactcgttttatggatccccaagagttccaaaatatgcaaattgatacctccggagagttaaccggtgtgggtatccaaattactaaggatgaagaaaccaaagaattaaccgtagttgctcccatcgaagatactcccgcttttgaggcaggaattcttgctaaggatgtgatcacaaaaattaacggcaaaaccaccgaaggtatggaagtggaagatgcggttaaactcattcgtgggaaaccaggtagcaaagttactttaaccattcgtcgttccaacgaggaatttaattatcccatcatcagagcgcgcatcgaactccaccctgttaaagctcgtatagaagaaactccttcagggaaggttggttatatccgtttgactcagtttagtgcgcaggccagcaaggaaatgcgtgacgctattcgtgatgctgaagccgccaatgtcaacggttatattcttgacttacgctctaacccaggcggactcctttattccagtatagaaattgctcggatgtggctcgatcaaggccgtatcgtctcaacggtgagtcgtaacggtgaggtagaagcgcaacgggcaaccaaccgtgctttgactgataagcctctggtgattatggtagatggtggttccgctagtgccagtgaaattctttcaggtgctttacaggataacaaccgcgctactttagtgggaactaagacttttggtaagggtttagtacagtccgttcgacgcttaggagatggtacatctggacttgctgttactattgctaagtatttaacccccagcggtcgagatatcaataaacagggaattgaacctgatattgtcgtagaattgaccgaagctcaaagaaaggatcttcaacaggaacgagataaaattggtgattttggtgatcctcaatttgacagggcttatgaagagttagaaaaggaaatcgctaagtctaacggtacgaatgcccgtggtactatgcgataa

SEQ ID NO: 41003 - protein, 433 aa, Crocosphaera watsonii WH 8501
MVNYKKGLVLGATAAVLTAIAVTGAGLRLPRSVAYLQDNPKKLVDEVWQVINDTYVDATFNQVDWLAVRQKYVGKSKTYNSKEEAYKAIREMLEQLDDPYTRFMDPQEFQNMQIDTSGELTGVGIQITKDEETKELTVVAPIEDTPAFEAGILAKDVITKINGKTTEGMEVEDAVKLIRGKPGSKVTLTIRRSNEEFNYPIIRARIELHPVKARIEETPSGKVGYIRLTQFSAQASKEMRDAIRDAEAANVNGYILDLRSNPGGLLYSSIEIARMWLDQGRIVSTVSRNGEVEAQRATNRALTDKPLVIMVDGGSASASEILSGALQDNNRATLVGTKTFGKGLVQSVRRLGDGTSGLAVTIAKYLTPSGRDINKQGIEPDIVVELTEAQRKDLQQERDKIGDFGDPQFDRAYEELEKEIAKSNGTNARGTMR

SEQ ID NO: 41004 - DNA, 1422 bp, Exiguobacterium sp. 255-15
  CDS (1)..(1422)
atgaaaaaatcgacaacggccgtcatagcggtcagtacgtttggtttgggtcttggagcaggggctgtcgggatgttagcggcaggtggaacggattcagtggcgacgagttcttcgtctaacgcaacgggagattggaaaaaaattgatcaggtcagacagatgatttcccaaaattatctcgaggacgtgacggatcaggagttgctcgaaggggcactgacgggaatgacggaagtcctcgacgatccgtattccgtctacatggacgaatcggaaacggcatcgttcaacacgaatttgtcgtcttcattcgaaggcatcggtgcgaccctcgaacaaaaaggcgaatcgattgtcatcgtctcaccaatcaagggatcgcccgctgaaaaagccggtatcaaaccgggggatattattttagaaattgacggtaaatcaacaaaaggacagaaaacggatcaagcggtcaagaaaatccgcggcgaaaaagggacgaaagtcgtcttgatgattcaacgcggcggacaggatccgatgaagatttcaatcgtccgcgatacgattccgattgaaaccgtctattcgaagacggaaaaagtcaacggcaagacgattggtgtcctgcaggtgacacaattctcggatccgacggcaaaagagttcgagaaacaactcgcagccctcgaggagaaaaacattgatggtcttgtcatcgatgtccggggaaatccgggcggcttgctgacagctgtttcacaaatgattgcgccgttcatcccgaaagacacaccgattttccaggtggaagacaacaaaggggagcggacgcaggaattcgggaaagcggaagagaagaaaccttataagctcgttgtcctcgaagacagcggatcggcctcggcttcggaaattctggccgccgggttaaaagaaggcgccggtgccgaagtagtcgggacgaaatcgttcggaaaaggaatcgtccaaagcgcttatgatttaaaagacggcagtgatttaaagctgacgacgaataaatggctgacaccggacggcaactggattcataaaaaaggcgtcaagccgacggtcgaagtcaaacagccggattactttaacgtcacgaagattttgacggataataagacgcttgcaagcggcgattacggcaagcctgtcgaaaacgcacacctggttcttgaagcgatcggttttgatccgaaaggacaggacggttacttcggcgatacgatgaaacaggcggtcgagcgtctccaaaaagacgcgaagcttgaggtgaccggaaaaatcaatcaggtgaccgcttccgagatggaaacacgtctcctgaagaaactggaagacgaaaaaaatgatgtccagcgtatcaaggcgttggaagtcgctgcacaataa

SEQ ID NO: 41005 - protein, 473 aa, Exiguobacterium sp. 255-15
MKKSTTAVIAVSTFGLGLGAGAVGMLAAGGTDSVATSSSSNATGDWKKIDQVRQMISQNYLEDVTDQELLEGALTGMTEVLDDPYSVYMDESETASFNTNLSSSFEGIGATLEQKGESIVIVSPIKGSPAEKAGIKPGDIILEIDGKSTKGQKTDQAVKKIRGEKGTKVVLMIQRGGQDPMKISIVRDTIPIETVYSKTEKVNGKTIGVLQVTQFSDPTAKEFEKQLAALEEKNIDGLVIDVRGNPGGLLTAVSQMIAPFIPKDTPIFQVEDNKGERTQEFGKAEEKKPYKLVVLEDSGSASASEILAAGLKEGAGAEVVGTKSFGKGIVQSAYDLKDGSDLKLTTNKWLTPDGNWIHKKGVKPTVEVKQPDYFNVTKILTDNKTLASGDYGKPVENAHLVLEAIGFDPKGQDGYFGDTMKQAVERLQKDAKLEVTGKINQVTASEMETRLLKKLEDEKNDVQRIKALEVAAQ

SEQ ID NO: 41006 - DNA, 1254 bp, Rubrobacter xylanophilus DSM 9941
  CDS (1)..(1254)
atgtggagaacgggcatcaccaagagaaagcggggccgcggcccgctcgtgagggtgctgctcctcgcggccctgctcgtggcggtggggtacggggcctacgagtacggcaagtcccagagccccgccggcctctccggcccggacagggagagcctcaggctctacgccgaggcgctggacgccgtccgcgacggctacgtggaccgcgaggccatagaccccaagaagcagacctacggcgcgatagaggggatgctcgactcgctcggcgacgaggggcacacccgctttctgacccccgaggagcgcagggagaacgagcagggactctcgggcgactacgtcgggataggggtgcagctcgaggaccgggacgggcgggtggtggtggcctcccccatagagggctccccggcggaccgggcggggatcgagtcgggggacgtgctggtcgcggtgaacggccggagcgtgagcgggcaggagctcgaccgcatcgccgaccgggtgaaggggccggagggcacgcgggtgaagataacggtgctgcgcgacggggaggagagaaccttctacctggagcgggcggagatagagtccccggccgtctcgtgggcgatggtgccggggaccggcgtggcgcacatccgcctctcctccttctccgacgacagcgcccgggagctcagggcggcctttgaggaggcgcggctggacggcgcggagcgctttgtcctggacctgcgggacaacccgggcggcaggctggagcaggcggtggagatggccgggttcttcctggagcccggaagcgtcgtgtacatccgccgggacgcctccggggagcgcacgccggtgagggccgacggcgaggcccagcttgcggaggtgccgctcgccgtcctggtgaacggcggctcggcctccagcgccgagatcctcgccggggcgctgcgggacaacgaccgggcgacggtcatcgggcagcggacgttcggcaccgggacggtgctctcggagttcgtgctgagcgacgggtcggccatcctgctcggggtcgccgagtggctgacgccggacggggactttatccgggacacggggatagagccggatatccgggtggggctcgacgagggggaggagccgctctccccctcgcagaccgaagggctctctcgggaggagatctcccgccgcgacccgcagctctggcgggccgtgcgcgagcttgcgggcgggagggtgtag

SEQ ID NO: 41007 - protein, 417 aa, Rubrobacter xylanophilus DSM 9941
MWRTGITKRKRGRGPLVRVLLLAALLVAVGYGAYEYGKSQSPAGLSGPDRESLRLYAEALDAVRDGYVDREAIDPKKQTYGAIEGMLDSLGDEGHTRFLTPEERRENEQGLSGDYVGIGVQLEDRDGRVVVASPIEGSPADRAGIESGDVLVAVNGRSVSGQELDRIADRVKGPEGTRVKITVLRDGEERTFYLERAEIESPAVSWAMVPGTGVAHIRLSSFSDDSARELRAAFEEARLDGAERFVLDLRDNPGGRLEQAVEMAGFFLEPGSVVYIRRDASGERTPVRADGEAQLAEVPLAVLVNGGSASSAEILAGALRDNDRATVIGQRTFGTGTVLSEFVLSDGSAILLGVAEWLTPDGDFIRDTGIEPDIRVGLDEGEEPLSPSQTEGLSREEISRRDPQLWRAVRELAGGRV

SEQ ID NO: 41008 - DNA, 1296 bp, Mesorhizobium sp. BNC1
  CDS (1)..(1296)
atgggcgcatccgccatgagcctcgtctacgggacgaatggcacggcagcgatcgcggcggacaccgacacatacagacagcttgccatcttcggcgacatcttcgaacgtgtgcgcgcgcagtatgtgacaccgccggatgacaaaaaattgatcgagaatgccatcaacggcatgctcacctcgctcgatccgcactcctcctacctcaatgccgaggcggcgcaggatatgcgcgtgcagaccaaaggcgagttcgggggccttggcatcgaggtcacgatggagaacgagctggtcaaggtcgtggctccgatcgacgacacacccgcttcgcgcgccggaatcctttcgggcgacctcatcgagaagatcgatggcgaggaagtacgtgggatgacgctcaatgatgcggtcgacaagatgcgcggtctcgtcaacacacccatcgagcttaccgtcctgcgggaggggcagagcaagcccctgaccttcaagatcattcgcgacacgatcaaggtgaaggccgtcaagtcgagggttgaaggcgacgatatcggatatctcaagatcacctccttcacggagaagacgacggacgacctgcgcgcggccattgaggacatccgcaagcaggtgcctgaagacaagctgaagggctatgtgctcgacctgcggctcaatcccggcggtctgctcgatcaggcggtcaatgtatcggacgcttttctggagcgcggtgaagtcgtctcaacgcgaggccgcgagtctggggatatcgcacgattcagctctcaggctggtgacctcaccggcggcaagccactggtcgtcctgatcaatggcggttctgcaagcgcctctgaaattgtggccggtgcgttgaaagaccatcgccgggcgacgctggtcggcacgcgatcgttcggcaagggctccgtgcagacgatcattccgctcggcgaaaatggtgctctgcgtttgacgaccgccctgtactacacgccttcgggcgagtcgatccaaggcaaaggcatcacgcctgatatcaaggtggaacagcctttgcccgaggatctgcaggatgtcgatctttcgcgcggcgagtccgacctgcgcggtcatattcgcggcgcggaggaagacgaagaagggtccggctcgatcgcatatgtgccgcaggacccgaaagaggacgtgcagctttcctacgcactcgatctcatccgcggcgtgaagacggatcctgcatatcctgccagcccagataaagcggtgatgaaccagcagcagtaa

SEQ ID NO: 41009 - protein, 431 aa, Mesorhizobium sp. BNC1
MGASAMSLVYGTNGTAAIAADTDTYRQLAIFGDIFERVRAQYVTPPDDKKLIENAINGMLTSLDPHSSYLNAEAAQDMRVQTKGEFGGLGIEVTMENELVKVVAPIDDTPASRAGILSGDLIEKIDGEEVRGMTLNDAVDKMRGLVNTPIELTVLREGQSKPLTFKIIRDTIKVKAVKSRVEGDDIGYLKITSFTEKTTDDLRAAIEDIRKQVPEDKLKGYVLDLRLNPGGLLDQAVNVSDAFLERGEVVSTRGRESGDIARFSSQAGDLTGGKPLVVLINGGSASASEIVAGALKDHRRATLVGTRSFGKGSVQTIIPLGENGALRLTTALYYTPSGESIQGKGITPDIKVEQPLPEDLQDVDLSRGESDLRGHIRGAEEDEEGSGSIAYVPQDPKEDVQLSYALDLIRGVKTDPAYPASPDKAVMNQQQ

SEQ ID NO: 41010 - DNA, 1536 bp, Burkholderia cepacia R1808
  CDS (1)..(1536)
atgaaattgaagaacatcggcctgattgccgcgggcctcgccacgggcgtattcgccacgctgcagatttcggcgtcggccgagcagacggccacggcgccgcttcccctcgaccaactccgtctgttcgcggaagtgttcggccagatcaagcgcgagtacgtcgagccggtcgacgacaagaagctgctgacggcggcgatcaagggcatggtgtcgagcctcgatccgcactcgtcgttcctcgacaagaccgactacgacgaactgcaggagcagaccaagggccgcttcgccggcctcggcatcgagatctcgcaggaagacggcctcgtcaaggtgatctcgccgatcgaggacacgcccgcgttccgcgccggcatccgtccgggcgacctgatcacccgcatcaacgacaagccggtgcgcggcatgacgctcgacaaggccgtcaagcagatgcgcggcgagccgggcaccaaggtcacgctgacgatcttccgcaagagcgacgaccgcacgttcccggtcacggtcacgcgcgcgatcatcaaggtccagagcgtcaagatgaagatgctcgacccgggctacgcctacatccggatcacgagcttccaggaacgcacgacgcccgacctcgccgcgaagctgcaggacattgcgcgtcagcagccgaacctgaagggcctgattctcgatctgcgcaacaacggcggcggcctgctgcagagcgcggtcggcgtcgccggcgcgttcctgccgccggattccgtcgtcgtatcgaccaacggccagattccggattcgaagcaggtctaccgcgacacctacgacaactaccgtctgccctcgttcgacggcgatccgctgaagaatctgccgccgatcttcaagaccgtgccgatggtcgtgctgaccaacgcgtattcggcgtccgcgtcggaaatcgtcgccggcgcgctgcaggattcgaagcgcgcgcagatcatgggcaagacgacgttcggcaagggctcggtgcagacggtgcgcccgatgacggccgacacggcgctgcgcctgacgaccgcctactactacacgccgagcggccgctcgatccagaacaagggcatcacgcccgacgtgccggtcgatcagtacgcggacggcgatccggacgacgtgctcgtgacgcgcgaggtcgattacacgaaccacctcgcgaacacgcaggatccgaacgagaagaaggaacaggaagagcgcgagcagcgccggatggatcagctgcgcctgctcgaagagcagaacgacaagaagacgccggagcaacgccagaaggatcgcgatcgcaagccgatcgagttcggcagcgccgacgacttcatgatgcagcaggcattgaacaagctcgaaggcaagccggtgcaggaatcgaagtcgctgctcgccgaaagcacgaccaagagcccggccggcaaggccgcgtccgccgcgaaggcgtcgggcgcaaaggcagccgcaccgaagccggcgtccgcgccgcagtaa

SEQ ID NO: 41011 - protein, 511 aa, Burkholderia cepacia R1808
MKLKNIGLIAAGLATGVFATLQISASAEQTATAPLPLDQLRLFAEVFGQIKREYVEPVDDKKLLTAAIKGMVSSLDPHSSFLDKTDYDELQEQTKGRFAGLGIEISQEDGLVKVISPIEDTPAFRAGIRPGDLITRINDKPVRGMTLDKAVKQMRGEPGTKVTLTIFRKSDDRTFPVTVTRAIIKVQSVKMKMLDPGYAYIRITSFQERTTPDLAAKLQDIARQQPNLKGLILDLRNNGGGLLQSAVGVAGAFLPPDSVVVSTNGQIPDSKQVYRDTYDNYRLPSFDGDPLKNLPPIFKTVPMVVLTNAYSASASEIVAGALQDSKRAQIMGKTTFGKGSVQTVRPMTADTALRLTTAYYYTPSGRSIQNKGITPDVPVDQYADGDPDDVLVTREVDYTNHLANTQDPNEKKEQEEREQRRMDQLRLLEEQNDKKTPEQRQKDRDRKPIEFGSADDFMMQQALNKLEGKPVQESKSLLAESTTKSPAGKAASAAKASGAKAAAPKPASAPQ

SEQ ID NO: 41012 - DNA, 1485 bp, Bacillus cereus G9241
  CDS (1)..(1485)
atgccttttgctacaccacctgtgtgttttggaaaggggaattccgcattgaaacgtagagttgcaattattggaatggttgttgcatttttaattggtgctggcggaatgtttgcaggtatgtctttatttggggttaacccagcagaagtaacgcaaacaatttcgagtggaaacgctagcactgcgcaagggaatttggcaaaaattaatgaggcgtatgcactaattgattcacgttatgtggaagacgtgaaagatgaaaaattagtcgaaggtgcaatacaaggcatgttgtctacgctgaaggacccttattccacgtatatggataaagaaacggctaaacagtttagtgaatcgcttgatcctgagttagaagggatcggggctgaggtgaacaaaacggacggtaagcttattatcgtatctccaattaaaggatcaccggcagaaaagattggaattaaaccgaatgaccaaattttatctgtagatggaaatagtgtgaaagatttatcacgtgaagaagcggtattaaagattcgtggtaaaaaaggaacgactgttgcgattgaaattaagcgtgcaggagtagctgatccgattgtgtttaaaattaagcgtgaaaaaattccaatcttcacagtgtttagttctgtgaaacaagagagcggaaaagatatcggttatatgcaaatcacttcttttgctgaaaatacagcgaaagaatttaaggatcagttaaaagagttagagaagaaaaacataaaaggcctagttattgatgtgcgcggtaatcctggtggctacttaaatagtgtagaagagatactaggggaaattatgacggataaaaagccgatgctacaagtagagcaacgaaatggtgagaagaagaaattctctacggaactgaaagagagaaagccatatccaatttcagtattaattgataacggaagtgcttctgcttcagagattttagcgggtgcgctaaaagagggagaaggatacgatttaattggtgaaaaaacgtttggtaaaggtactgttcagcaagctgttccatttaaagatggcagtaacatcaaattaacgatgtttaaatggctaacaccggatggaaactggattcataaaaaaggaatcgcgccaacagtagaagtgaagcagccagattattatcatgcgacaccaattcaaattgagaagacactttcatacaattcaaatgatgtacaagtaaaacacgcacaagaaatgcttaagagtttaggatatgtaacaggacgtgaagatggatactttagtaaagagacagaatcagcactgaaagcattccaaaatgcgaataagatggaagcaacaggacagctggataaaaagacagctgaggcgattcaaacaaaaattattgaaaaaatccgttctggagaaaatgatttacaattacagtcagcattaaaattaatggcgaaataa

SEQ ID NO: 41013 - protein, 494 aa, Bacillus cereus G9241
MPFATPPVCFGKGNSALKRRVAIIGMVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIAPTVEVKQPDYYHATPIQIEKTLSYNSNDVQVKHAQEMLKSLGYVTGREDGYFSKETESALKAFQNANKMEATGQLDKKTAEAIQTKIIEKIRSGENDLQLQSALKLMAK

SEQ ID NO: 41014 - DNA, 1425 bp, Rubrivivax gelatinosus PM1
  CDS (1)..(1425)
atggctggctggatcgtcgtcggggcggtcgcgggtgccttgaccacgatgcaactgaccgcgacggcgcgcaacccgtctgcggccttgccgctggaggagctgcagcagctcgccgcggtattcggcatggtgaagagcgactacgtcgaaccggtcgatgagaagaagctgatcaccgacgccatcggcggcatggtcgccggcctcgacccgcactcccagtacttcgacaagaagaccttcaaggaattccgcgaaggcaccagcgggcgcttcgtcggtgtcggcatcgagatcggcatggaggacgggctggtcaaggtggtctcgccgatcgagggctcgccggccttccgggccggcgtgaagagcggcgacctgatcaccaagatcgacgacagcttcgtcaagggcctgacgatggaccaggccgtcaagaagatgcgtggcgagcccaacaccaaggtcgtgctgacggtgttccgcaaggccgagagccgcagcttcccggtcaccatcacccgcgaggagatccgcgtgcagagcgtgcgcgcgaagatgatcgagcccggctatgcctggctgcgcgtgagccagttccaggaccgcaccgtcgaggatttcgccaccaagctggccgacctgtacaagcaggaccccaacctgaagggcctggtgctcgacctgcgcaacgacccgggcggtctgctcgaggcgtcggtggcgatctcggccgccttcctgcccaaggacgtgacagtggtctccacgaacgggcagatcgccgaatcgaaggccgtgttcaaggccaatccggagttctactcgcgccgtggcagcgacccgctgaagaagctgcccgaggggttgaagagcgtgccgctgatcgtgctggtgaacgaaggctcggcctccgccagcgagatcgtcgccggcgccctgcaggatcacaagcgcgccacggtgatgggcagccagaccttcggcaagggctcggttcagacggtgcgccagctttcgcccgacacggcgctgaagatcaccaccgcccgctattacacgccgagcggacgctcgatccaggccaccggcatcgtgcccgacgtgtggctcgacgaaactgccgaaggcaacgtgttcgccgccatccgcacccgcgaggctgacctggagaagcacatctccagtggccagggcccggaggtcaaggacccggcgcgcgagaaggcccgagaggaagcgctgaagaagctggaagaggcgaacggcaaggacaaggacaaggcgcccaagccgctgcccgagttcggcagcgccgaggacttcccgttgcagcaggcgctgaatcgcctgaagggcaagacggtgctggcctcgaagacgcagaccgagcgcaagcccgaggacaccaagaccaactga

SEQ ID NO: 41015 - protein, 474 aa, Rubrivivax gelatinosus PM1
MAGWIVVGAVAGALTTMQLTATARNPSAALPLEELQQLAAVFGMVKSDYVEPVDEKKLITDAIGGMVAGLDPHSQYFDKKTFKEFREGTSGRFVGVGIEIGMEDGLVKVVSPIEGSPAFRAGVKSGDLITKIDDSFVKGLTMDQAVKKMRGEPNTKVVLTVFRKAESRSFPVTITREEIRVQSVRAKMIEPGYAWLRVSQFQDRTVEDFATKLADLYKQDPNLKGLVLDLRNDPGGLLEASVAISAAFLPKDVTVVSTNGQIAESKAVFKANPEFYSRRGSDPLKKLPEGLKSVPLIVLVNEGSASASEIVAGALQDHKRATVMGSQTFGKGSVQTVRQLSPDTALKITTARYYTPSGRSIQATGIVPDVWLDETAEGNVFAAIRTREADLEKHISSGQGPEVKDPAREKAREEALKKLEEANGKDKDKAPKPLPEFGSAEDFPLQQALNRLKGKTVLASKTQTERKPEDTKTN

SEQ ID NO: 41016 - DNA, 2118 bp, Pseudomonas fluorescens PfO-1
  CDS (1)..(2118)
atgcgttatcaattgtccccgcgtcgaatcagcatgaagcatctgctccccagcaccgccctcgctcttttcatcggtatcggtctgttgccggtgtcgggcaccacattcgcagccaacagctgggacaagttacagcctgatcgcgacgaagtgatcgccagtctgaacgtcgtcgagttgctcaagcgtcaccactacagcaagccgccgctcgacgatgcgcgctcggtgatcatctacgacagctacatcaagctgctcgacccgtcgcgcagctatttcatggccagcgacatcgccgaattcgacaagtggaagacccagttcgacgacttcctcaagagcggcgacctcaacgccgggttcaccatctacaagcgctatctggatcgcgtgaaggcgcgtctggacttcgcccttgccgagctgaacaaaggcgtcgacaagatggacttcaccaccaaggaaaccttgctgatcgatcgcaaggacgctccgtggctcaagtccaccgccgaactcgatgacctgtggcgcaaacgcgtcaaggacgaagtgctgcggcagaagatcgccggcaaagagccgaagcagatccaggaaaccctgaccaaacgctacaagaatcaactggcgcgtctggaccagacccgcgccgaagacatcttccaggcgtacatcaacaccttcgccatgtcttacgatccgcacaccaactatctgtcgccggataacgcggagaacttcgacatcaacatgagcctgtccctcgagggcatcggcgccgtgttgcagagcgacaacgatcaggtgaaagtcgtgcgtctggtgccggcaggcccggccgacaagaccaagcaggttgctccggccgacaagatcatcggcgttgcccagggcaacaaagagatggtcgacgtggtcggctggcgtctggacgaagtggtcaagctgatccgtggcccgaaaggcaccgtggtgcgtctggaagtcatcccggccagcaatgcgccgaacgatcagaccagcaagatcgtgccgattacccgcgaagcggtgaagctcgaagaccaggccgtgaagaaatccgtgctgaacctgaaacaggacggcaaggactacaagctcggcgtgatcgagattccggcgttttacctcgacttcaaggccttccgtgctggcgatccggactacaagagcaccactcgcgacgtcaagaaactgctgaccgagctgcagaaagagaaagtcgacggcgtggtcatcgacctgcgcaacaacggcggcggttccctgcaggaagccaccgagctgaccagcctgttcatcgacaagggcccaaccgtgctcgtgcgtaacgccgatggccgggtcgatgtacttgaagatgaaaacccgggcgcgttctacaaaggcccgatggcgctgctggtcaaccgcctgtccgcctcggcttcggagatcttcgccggcgccatgcaggactaccaccgtgcgctgatcatcggtggccagaccttcggcaaaggcaccgtgcagaccattcagccgctgaaccatggcgaactgaaactgactctggccaagttctaccgggtttccggtcagagcacccagcatcagggcgtactgccggacatcgattacccgtcgatcatcgacaccaaggaaatcggcgaaagcgccctgccggaagccatgccgtgggacaccatccgtgcggcgatcaaaccggcgagcgatccgttcaagccgtacctggcccagctgaaatccgagcatgacacccgttccgccaaggacgcggagttcgtgttcatccgcgacaagctggccctggcgcagaagctgctggaagagaaaaccgtcagcctcaatgaagccgaacgccgtgcccagcacgccgacatcgacgccaagcaactggcgatggagaacatccgtcgcaaggccaaaggcgaagaaccgctcaaagagctgaaaaaagaagacgacgacgccctggcagccgccgagccggacaaggtcaaaccggaagacgacgcctacctgagcgagaccgggcgcgtactgctggattacctgaagctgagcaatcaggtcgcaaagaagtaa

SEQ ID NO: 41017 - protein, 705 aa, Pseudomonas fluorescens PfO-1
MRYQLSPRRISMKHLLPSTALALFIGIGLLPVSGTTFAANSWDKLQPDRDEVIASLNVVELLKRHHYSKPPLDDARSVIIYDSYIKLLDPSRSYFMASDIAEFDKWKTQFDDFLKSGDLNAGFTIYKRYLDRVKARLDFALAELNKGVDKMDFTTKETLLIDRKDAPWLKSTAELDDLWRKRVKDEVLRQKIAGKEPKQIQETLTKRYKNQLARLDQTRAEDIFQAYINTFAMSYDPHTNYLSPDNAENFDINMSLSLEGIGAVLQSDNDQVKVVRLVPAGPADKTKQVAPADKIIGVAQGNKEMVDVVGWRLDEVVKLIRGPKGTVVRLEVIPASNAPNDQTSKIVPITREAVKLEDQAVKKSVLNLKQDGKDYKLGVIEIPAFYLDFKAFRAGDPDYKSTTRDVKKLLTELQKEKVDGVVIDLRNNGGGSLQEATELTSLFIDKGPTVLVRNADGRVDVLEDENPGAFYKGPMALLVNRLSASASEIFAGAMQDYHRALIIGGQTFGKGTVQTIQPLNHGELKLTLAKFYRVSGQSTQHQGVLPDIDYPSIIDTKEIGESALPEAMPWDTIRAAIKPASDPFKPYLAQLKSEHDTRSAKDAEFVFIRDKLALAQKLLEEKTVSLNEAERRAQHADIDAKQLAMENIRRKAKGEEPLKELKKEDDDALAAAEPDKVKPEDDAYLSETGRVLLDYLKLSNQVAKK

SEQ ID NO: 41018 - DNA, 1323 bp, Rhodospirillum rubrum
  CDS (1)..(1323)
atgacctggaagacttggatctcggccagcgcgatcgccttcacggcgttcacggctggacagctttatcataccgaacaggccgaggcggcccggggagaggagacctatcagcttctcgacctgttcgccgacgttttcgagcgggtcaaacgcgactatgtcgaggaagttggcgatgaccaactgatcgaagccgcgatcaacggcatgctgacctcgctcgatccccactccagttacctgaacgccaagcacttcgaggacatgcaggtccagaccaagggcgaattcggcggccttggcattgaagtgacccaggaggacgggtttatcaaggtggtctcgccgatcgacgagacccccgccgccctggccggactgcagcccggcgatttcatcacccatctcgacggcgaaagcgttcttgggctgtcgctggccgatgcggtggaaaagatgcgcggcccggtgggcaaggaaatccgcctcaccattcagcgggtgggcaaggaacccttcgacgtcaccctcaagcgcgacaccatcaagatccagtcggtcaaatcccgcatggaaggcgatgtcggctatgtccgcatcaccagcttctccgagcagaccgagaaatccctgcgcgaggcgctcgacgatctgcgctccaagggcggggactcgatcaagggctatgtgcttgatctgcgcaacaaccccggtggcctgctggaacaggcgatcgccgtgtccgatgtcttcctcgacaagggcgagatcgtctcgacccgcgcccgcgacgccaaggacacccagcgcttcaacgcccggccgggtgatctgaccaagggcatgcccgtggtcgttctgatcaacagcgggtcggcctcggccagcgaaatcgtcgccggcgccttgcaagatcatcatcgggcgctgatcgtcggcaccaagtcctttggcaagggctcggtccagaccatcatgccgctgcccggccatggcgccatgcgcctgaccacggcccgctactacacgccgtccgggcgctccatccaggcgctgggcatcgatcccgacatccaggtcgaacccgcccggatcgaggcgatcagcgcccagaacgagatgcgcagcgaagccgaactgcgcaacgccttgaagaacgacaccctcaagccgagcctgggggtcaagccggccaatggtctgccgcccagtcaggttcgcaacgaccagactccgcaggccgataccgactatcagctcgcccgcgccgtggatctgatccgcggtctggcgatctatcgctccaagtccatccagtaa

SEQ ID NO: 41019 - protein, 440 aa, Rhodospirillum rubrum
MTWKTWISASAIAFTAFTAGQLYHTEQAEAARGEETYQLLDLFADVFERVKRDYVEEVGDDQLIEAAINGMLTSLDPHSSYLNAKHFEDMQVQTKGEFGGLGIEVTQEDGFIKVVSPIDETPAALAGLQPGDFITHLDGESVLGLSLADAVEKMRGPVGKEIRLTIQRVGKEPFDVTLKRDTIKIQSVKSRMEGDVGYVRITSFSEQTEKSLREALDDLRSKGGDSIKGYVLDLRNNPGGLLEQAIAVSDVFLDKGEIVSTRARDAKDTQRFNARPGDLTKGMPVVVLINSGSASASEIVAGALQDHHRALIVGTKSFGKGSVQTIMPLPGHGAMRLTTARYYTPSGRSIQALGIDPDIQVEPARIEAISAQNEMRSEAELRNALKNDTLKPSLGVKPANGLPPSQVRNDQTPQADTDYQLARAVDLIRGLAIYRSKSIQ

SEQ ID NO: 41020 - DNA, 1635 bp, Rhodospirillum rubrum
  CDS (1)..(1635)
atggttcttaccctgttggccggcttgaccggctgcgcccatcccgcaccgctggcgtccaccgcccttccgcaggcgacagcggtttcgcacagtggcaaaatcccgccgaccgccgtttggacggtgccctccgccttcgacaaggggctgcgcggcgagaccgaggacttgttctcctatggctacggcgccattgccgaccgctatatcgacgaagtgaacctgcgggaactgggcgtcgagggcttgagcggcctgaccagccttgatccggcgatcaccgtcgccccggtgggggcgatgctcgatgtctatcggaacggcacggtcgtcggccgctttccgctggccggggcccgcgactcggcgggttggggcgtcttgaccgccaatgtggtgatgctggcgcgcgatttgtcgccaagcctgaacgccagcgatcccgaagagatctatcaggcgatcttcacctcggcgctcggcggccttgatcccttttcacgctacgccagccgcgacgatgccgaggtcaaccgcggccaacgcaacggctttggcggcatcggcgtcatgtacgacgtgggtggacgcggcgcgaccatcacccaggtcatgcccggcaccccggccgccgatgcccgcttgcgcctgggcgacgtcatcgtcgcggtgaatggtcagagcacccggggggccacacgccacgatctgcgcgaatggctgcgcggaccgaccagcagcgaggtcaccttgacccttgtcagcgccgacacgccgaccgaacgcacgctgaccctgacccgcgccctgatcatcatgcccaccgtcgacctccatctcgacgaaggcgtcggtttcatcaccgtctcaagcttcaaccagggcacgacgacgcgggtcgccgaagccatcggcgaggcccgccgacagttgggcgccgatctgcgcgggctggtcatcgatctgcgcggcaatcccggcggcctgcttgatcaggcggtgacgatgagcgacctgttccttgacaccggccccatcgtctcgactcgcggccgcaatcccgacgcccgacagttctatgcctcgagcggcggcgatatcgcccagaatttgccgatcgtcgccctgatcgacggcgacagcgcctcggccgccgaaatcgtcgccgccgccttgcaagacaacggccgggcggtggtgatcggcacctcgtcgtttggcaaaggcacggtgcaaaccctgatccaattgcccaatggcggcgaattgaccctgacgtggtcgcgcttccacagcccctcgggctatgtccttcatggcctgggcgtgctgccggtcgcctgcaccagcggcatcgccgaggccagccgcgaggatggcgcgccggccgacaaggtgctgaccaccatgcgccgcgaccagtcggaaatcgccgcgcatgtcgccttgtggcgccaaaccgacatgcgcgacgccagccgccgtctggcgctgcgcgacgcctgcccggccgaacaccacccgcgcgccctgatcgacgaaacggtagcccgcaagctgatcgccgaccaggggctttatggccgcgccctgcgcctgaccgccccggcccaatcggccagcggactgtga

SEQ ID NO: 41021 - protein, 544 aa, Rhodospirillum rubrum
MVLTLLAGLTGCAHPAPLASTALPQATAVSHSGKIPPTAVWTVPSAFDKGLRGETEDLFSYGYGAIADRYIDEVNLRELGVEGLSGLTSLDPAITVAPVGAMLDVYRNGTVVGRFPLAGARDSAGWGVLTANVVMLARDLSPSLNASDPEEIYQAIFTSALGGLDPFSRYASRDDAEVNRGQRNGFGGIGVMYDVGGRGATITQVMPGTPAADARLRLGDVIVAVNGQSTRGATRHDLREWLRGPTSSEVTLTLVSADTPTERTLTLTRALIIMPTVDLHLDEGVGFITVSSFNQGTTTRVAEAIGEARRQLGADLRGLVIDLRGNPGGLLDQAVTMSDLFLDTGPIVSTRGRNPDARQFYASSGGDIAQNLPIVALIDGDSASAAEIVAAALQDNGRAVVIGTSSFGKGTVQTLIQLPNGGELTLTWSRFHSPSGYVLHGLGVLPVACTSGIAEASREDGAPADKVLTTMRRDQSEIAAHVALWRQTDMRDASRRLALRDACPAEHHPRALIDETVARKLIADQGLYGRALRLTAPAQSASGL

SEQ ID NO: 41022 - DNA, 1608 bp, Ralstonia metallidurans CH34
  CDS (1)..(1608)
atgcgtaagacgctcaagaacattagcctcgtctcaataggcgtcgttgccggcgtgctcgccacgctgcagatttcggcgaccgcccagaatacgaccgggccgctgccgctggaccagttacggctgatggccgatatcttcgggcagatcaagcgcgagtacgtggagccggtcgacgacaagaagctgctgaccgaagccatcaagggcatggtcgccagcctcgacccgcactcggcctacctggacgagaaggatttcaaggaactgcaggaaggcacgcgcggacgattcgccggcctgggcatcgagatttcccaggaagagggcctggtcaaggtcatcaacccgatcgaggacacgcccgcgttccgcgcaggcatccagccgggtgacctgatcacgcggatcgacgacaagccggtgcgcggcctgccgctggaacaagcggtcaagcgcatgcgcggcgagccggggaccaaggtcacgctgacgatttaccgcaagagcgaggaacgcacgttcccggtgtcgatcacgcgcgcggaaatccgcgtgcagtcggtcaagaccaagatgctcgacaacaacaccatcggctgggtgcgcctgacaagcttccaggaacgtaccgtgaccgatctgggccgtcgcctcaaggagatggctgataagaatccgaacctgcgcggtatcgtgctggacctccgcaacaacggtggcggcgtgctgcaaggcgcggtaggcgtggccgcggccttcctgcccgaggattcggtcgtggtatcgaccaacggccaggtgccggatgccaagcgcgtctacaaggcgtcgttcagcaactaccgcctgtcgtcgctcgaggacgatccgctcaaggacctgccggcagagttcaagaagctgccgatggtcgtgctgaccaacgcctactcggcgtcagcatcggaaatcgtggccggcgcgctgcaggaccacaagcgcgcgacgctcatgggcaagacgacgttcggcaagggctcggtccagaccgttcgcccgctgaccaacgacaccggcatcaagctgacgatcgcgtactactacacgccgtcgggcaagtcgatccaggccaagggcatccgcccggatatcccggtcgaccagaaccccgatggcgatccggacgacgcgctgatcacgcgtgaaatcgacaccgaacgccacctgcacaacaagcaggagtcggaagagccggaaatggccgaacgcgagcagcgccgcgtggaagaactgcgccgcctggaagaagagaacgccaagaagacgccggaagagcgcgagaaggaacgcaagaagaagccggtggaattcggttctgctgacgacttcatgctgcagcaggccatcgcacagctcgacggcaagccggtgcaacgttcgaagtcgcgcctggaagccaccggcacggctggcaagccggacagctccgacaacccgaagccggccagcaaggcgcccgccaaaccggcagccaagccggcggccccggccaagccttccagcccgccgcccgcgagtgccccgatcggcgaaccgctgggtacgccgaccggcaagaagtaa

SEQ ID NO: 41023 - protein, 535 aa, Ralstonia metallidurans CH34
MRKTLKNISLVSIGVVAGVLATLQISATAQNTTGPLPLDQLRLMADIFGQIKREYVEPVDDKKLLTEAIKGMVASLDPHSAYLDEKDFKELQEGTRGRFAGLGIEISQEEGLVKVINPIEDTPAFRAGIQPGDLITRIDDKPVRGLPLEQAVKRMRGEPGTKVTLTIYRKSEERTFPVSITRAEIRVQSVKTKMLDNNTIGWVRLTSFQERTVTDLGRRLKEMADKNPNLRGIVLDLRNNGGGVLQGAVGVAAAFLPEDSVVVSTNGQVPDAKRVYKASFSNYRLSSLEDDPLKDLPAEFKKLPMVVLTNAYSASASEIVAGALQDHKRATLMGKTTFGKGSVQTVRPLTNDTGIKLTIAYYYTPSGKSIQAKGIRPDIPVDQNPDGDPDDALITREIDTERHLHNKQESEEPEMAEREQRRVEELRRLEEENAKKTPEEREKERKKKPVEFGSADDFMLQQAIAQLDGKPVQRSKSRLEATGTAGKPDSSDNPKPASKAPAKPAAKPAAPAKPSSPPPASAPIGEPLGTPTGKK

SEQ ID NO: 41024 - DNA, 1581 bp, Burkholderia fungorum LB400
  CDS (1)..(1581)
atgcgaaagaacctgaaaaatatcggcctgattgccgcgggccttgctaccggtgtatttgccactctgcagctttccgcttcggcgcagcaaccggctagcgccgcctccagcgccgttgcaccgctgccgctggaccagctccggctgtttgccgaagtgttcgggcaaatcaagcatgaatacgtcgaaccggtcgacgacaaaaagcttctcaccgccgccatcaagggcatggtgtcgagcctcgacccgcactcgtcgtatctcgacaagaccgattacgaggaactgcaggagcagaccaagggtcgcttcgccggtctcggcatcgagatctcgtcggaagacggcctgatcaaagtgatttcgccgatcgaagacacgcccgcgttccgcgccggcatccgtccgggcgacctgatcacgcgtatcaacgacaaacccgtgcgcggcatgacgctcgaccaggcggtcaagcagatgcgcggcgacccgggcaccaaggtcacgctcaccatcttccgcaagaccgacgaccgcacgttcccgctcaccgtgacgcgcgcgatcatcaaggtccagtcggtcaagatgaagatcctcgcgccgggttacgcctatgtgcgtatcaccagcttccaggaacgcaccacgcctgatctggccgcgaagctgcaggacatcgcgcgtcagcagccgaatctgaaaggtctcgtgctcgacctgcgcaataacggcggcggtctgctgcaaagcgcggtcggcgtagccggcgcgttcctgccgccgaattcggtggtggtgtccaccaacggccagattccggattcgaagcaggtctatcgcgacacttacgacaactaccgcctgcagtctttcgacagcgatccgctgaaggacgaagcgcccatcttcaagaccgtgccgatgatcgtgctgaccaacgcgtactccgcgtcggcgtcggaaatcgtcgcgggcgcgctgcaggatcagcaccgtgcgctgatcgtcggcaagaccaccttcggcaaaggttcggtgcagaccgtgcggcccatgacggcggacacggcactgcgtctgaccacggcgtactactacacgccgagcggccgttcgatccagaacaaaggcatccgccctgacatcgcggtcgaccaatacgcggaaggcgatccggacgacgcgctcgtcacccgcgaagtcgactactcgaatcaccttgcgaatacgcaggacccgaacgagaagaaggaagcggaacagcgcgaacaggaacgcatggaccagttgcgccagcttgaagagcagaacgacaagaagacgccggaacagcgtcagaaggatcgtgagcgcaagccggtggaattcggttcggccgacgacttcatgctgcaacaggctctgaacaagctggaaggcaagccggtgcaggagtcgaagtcgctgaccgagcgtcgtctcgcgcagaacaagccaccggcgtcggcttccgcgccggtcgcggtcaagcccacgcaaccggtgcccggtgcatcggctccggcctcggcgcctgctacgccaagcaactaa

SEQ ID NO: 41025 - protein, 526 aa, Burkholderia fungorum LB400
MRKNLKNIGLIAAGLATGVFATLQLSASAQQPASAASSAVAPLPLDQLRLFAEVFGQIKHEYVEPVDDKKLLTAAIKGMVSSLDPHSSYLDKTDYEELQEQTKGRFAGLGIEISSEDGLIKVISPIEDTPAFRAGIRPGDLITRINDKPVRGMTLDQAVKQMRGDPGTKVTLTIFRKTDDRTFPLTVTRAIIKVQSVKMKILAPGYAYVRITSFQERTTPDLAAKLQDIARQQPNLKGLVLDLRNNGGGLLQSAVGVAGAFLPPNSVVVSTNGQIPDSKQVYRDTYDNYRLQSFDSDPLKDEAPIFKTVPMIVLTNAYSASASEIVAGALQDQHRALIVGKTTFGKGSVQTVRPMTADTALRLTTAYYYTPSGRSIQNKGIRPDIAVDQYAEGDPDDALVTREVDYSNHLANTQDPNEKKEAEQREQERMDQLRQLEEQNDKKTPEQRQKDRERKPVEFGSADDFMLQQALNKLEGKPVQESKSLTERRLAQNKPPASASAPVAVKPTQPVPGASAPASAPATPSN

SEQ ID NO: 41026 - DNA, 1245 bp, Magnetococcus sp. MC-1
  CDS (1)..(1245)
atgttagatctggttcgcacacaatatgtggaagaggcagacgaagaaaaactgctctacggggcgattggcggcatgctggaaaccctagatccccactcctcctttttgaacccggatagtttcaaagagatgaaggtggataccaagggtgaatttgggggtcttggtattgagatcacccgtggtgagcaagcgatcaaggtggtggctccgattgcggatacccccgccgaccgggcgggcatgaaagctggggacctgatcatcaagattgaggatgagagcacccaggatatgaacctgatggatgcggtcaagcgcatgcgcggcaagcccgatactgacataaaactgacggtcgtgcgtgagggtgagcctaagccgctggtgtttaccctgacccgtgccatcattaagatcagcagtgtcaagtggcgggccgagcagaataacctagcctatgtgcgcattacctctttcaacgaacaggcgcggcccttgttggataaggcgctggatgagattgaagccgagctaaaaggtaatgtgcgtggtctggtattggatctgcgcaacaatcccggtggcctgttggatcaagcggtgcaggtgagtgatgcctttttgaacaaggggcgtattgtttacaccaagggtcgcattcctggtaaagatctctcttttgacgcccgcaatggcgacttgatggagggggcgcccattgtggtgctggtcaatggtggttcggcctcggcttcagaaattgtggccggtgcgttgcaggaccacaagcgggcggtcattatggggacccaatcctttggtaagggttcggtacagaccattttgcccctctctgatggttctggtgtgcgtttgaccactgcgctctactacacccccagtgggcgcaccatccaggccaagggtattgtgccggatatcgtggtggaagatctgaccctcatcaagcgtaaggatcgtttggagcggaccaaagagaaggatctaaaaggtcactttaacaacgatggcaaacgttccatggatgataaagaagagaccacctcaacaacagaggatagcgcgaaaaagggtgacaccaaatccacagaggatgaggatgatcaggccgagcgtgatagcgtgacaggtcgcagcaaggacgattaccaattgaagcgggctttggatttgctgcgcggtctgcaagtttttcagaccaccgctgcgcagaactaa

SEQ ID NO: 41027 - protein, 414 aa, Magnetococcus sp. MC-1
MLDLVRTQYVEEADEEKLLYGAIGGMLETLDPHSSFLNPDSFKEMKVDTKGEFGGLGIEITRGEQAIKVVAPIADTPADRAGMKAGDLIIKIEDESTQDMNLMDAVKRMRGKPDTDIKLTVVREGEPKPLVFTLTRAIIKISSVKWRAEQNNLAYVRITSFNEQARPLLDKALDEIEAELKGNVRGLVLDLRNNPGGLLDQAVQVSDAFLNKGRIVYTKGRIPGKDLSFDARNGDLMEGAPIVVLVNGGSASASEIVAGALQDHKRAVIMGTQSFGKGSVQTILPLSDGSGVRLTTALYYTPSGRTIQAKGIVPDIVVEDLTLIKRKDRLERTKEKDLKGHFNNDGKRSMDDKEETTSTTEDSAKKGDTKSTEDEDDQAERDSVTGRSKDDYQLKRALDLLRGLQVFQTTAAQN

SEQ ID NO: 41028 - DNA, 1374 bp, Geobacter metallireducens GS-15
  CDS (1)..(1374)
atggtgcagacgagaacgaagattaccctgggactcatggctgtgattgcctgcctcgccttcggcggtgccaccctctggcggcttgccgcaaccgcccccgaccgtgaaggggtggcttccctgaagcttttggccgaagtgctccgccaagtggaagagaactacgtggagagggtggaccggaagaagcttctggaaggggccgtcaacgggatgctcgccgccctcgatccccacagtgcctatctacctcccgagccgttctcggagatgaaggtggagatatccggctctttcggcggcctcggtatcgagattgccctgaaggagggaaagctcacggttatttcacccattgaggatacccccgcctggcgggccggcatcaaggccggagaccatatctggaagatcgacggcacccccacccgcgacctcaccatcgttcaggcggtgaaaaaaatgcggggggagcgggggacgaaggtgactctcacgatcctgcgcaatggcgaaacggagccccgggagtttcccctcgtgcgggacattatccagaccaagagcctcaaggccaggagcctggagcccgggtacggctatgtgcggatcagccacttccaggagcggaccggagaggatttcgccaatgccctgcggaacctcagggccgagaacggcggtactctcaaggggctcgtgctcgacctgcgcaacaaccccggcgggcttctggaggtggcggtggcggtggccggccgcttcgtgggtgagcggctcgacaatggcctcatcgtctacaccgaggggcgcgaggagttcgccaagcggcgtttcagtgccaccgtcggcgagaaggaacccccgtatcccctggtggtgctcatcaacagcggcagcgccagtgcctcggagatcgtggccggcgcgctgcaggactatggccgggctgtcatcatgggaacccccagcttcggcaaggggtcggtccagaccgtaatccccatgaaggacggcgccgggctcaagctcaccacggccctctactacactcccaaggggcgctccatccaggctaggggaatcatacccgacgtcatcgtggagaatgccgaactgaagagcgtgaccaaggacaggcgggaggacttccacgagaaggatctggacaatcacctggggggagggaaggacgcggttcccgcaaaggggccgattgaaaagaacgaggagagtgggaaaaaggggcaacccgcacggcacgccgttgggccggaggatgatgcgaagaaggactttcagctcgcccgtgccctggatctcctgaagagctgggaggtgctgcagaaggtggcgggggggatcaagtaa

SEQ ID NO: 41029 - protein, 457 aa, Geobacter metallireducens GS-15
MVQTRTKITLGLMAVIACLAFGGATLWRLAATAPDREGVASLKLLAEVLRQVEENYVERVDRKKLLEGAVNGMLAALDPHSAYLPPEPFSEMKVEISGSFGGLGIEIALKEGKLTVISPIEDTPAWRAGIKAGDHIWKIDGTPTRDLTIVQAVKKMRGERGTKVTLTILRNGETEPREFPLVRDIIQTKSLKARSLEPGYGYVRISHFQERTGEDFANALRNLRAENGGTLKGLVLDLRNNPGGLLEVAVAVAGRFVGERLDNGLIVYTEGREEFAKRRFSATVGEKEPPYPLVVLINSGSASASEIVAGALQDYGRAVIMGTPSFGKGSVQTVIPMKDGAGLKLTTALYYTPKGRSIQARGIIPDVIVENAELKSVTKDRREDFHEKDLDNHLGGGKDAVPAKGPIEKNEESGKKGQPARHAVGPEDDAKKDFQLARALDLLKSWEVLQKVAGGIK

SEQ ID NO: 41030 - DNA, 1359 bp, Novosphingobium aromaticivorans DSM 12444
  CDS (1)..(1359)
atgaagtccgcctccttcaagttcgccggactcctgcgcgtcaccgcgctcgtttctgccgtcgcgctcattcccgccacgaccgccggcctcgctgcggtcgatgcccgcaccggccccgaattcggcaagctcatcgcggtctacgagcgggtgaaggccaactacgtcgagccggtcgacgacgagaagctcctcaagggcgcgatcgacggcatgctcgccacgctcgacccccacagctcctatctcgacgcccgcgatttcgagaacctgcgcacccagaccgaaggctcctacggcggcctcggcctgtcggtcacgatggacgacggcgcggtgaaggtcatcgcgccgaccaagggcagccccgcagacctcgccggggtcaaggcgggcgatttcatcacgcacctcgatggcaagctgatctacggcggctcgcttgacgaggcggtcgaccagatgcgcggcgtgccgggcaccaagatccgcctgtcggtcttccgccccggccgcgacgagccgttcgacgtgaccatcacccgccagatcatcgaactaaagccggtggagtgggaaatgcgcggcaacgtcggggtcatctcggtctccagcttcagcgcggacgtcggcacctctgtccagaaggcgtggaacgaaatccgcgccaggtcgggcggcaaggtcgcgggcctcgtgctcgacctgcgcggcaatccgggcggactgctcgacgaggcggtcgccctgtcggacctgttcctcgacaagggcacgatcgtgtcgcagcgtggccggtatgcccgggacaacgaggtctacccggccgagatcgataccaagggcgacatcgccaagggcacgccgatgatcgtgctgatcgacgaaggctccgcctccgcgtccgagatcgtcgccggcgcgctccaggaccagcaccgcgcggtcgtgatgggccagcgcagcttcggcaagggcagcgtgcagacgctgatcccgctgacgcgcgacaccgccatcaagctcaccaccgcgcgctactatacgccttcgggccgttcggtgcaggaaggcgggatcgagcccgatatcgccgtgccgcagatttccgatcccgacctgcgcaagcgccagcttcgctcctaccgcgagagcgacctgcgcggccacctgatcaacgagatcaagctcgaggacaaggatctcgagaaggacaagaccgaagacccgcgcttcaagatgacggcggaagagctgaaggcgaaggacatcaaggatttccagctctactacgcggtccagaccctgtcgcgcaccgcgccccgtggtgcacttgcggcgaaggtgaagggataa

SEQ ID NO: 41031 - protein, 452 aa, Novosphingobium aromaticivorans DSM 12444
MKSASFKFAGLLRVTALVSAVALIPATTAGLAAVDARTGPEFGKLIAVYERVKANYVEPVDDEKLLKGAIDGMLATLDPHSSYLDARDFENLRTQTEGSYGGLGLSVTMDDGAVKVIAPTKGSPADLAGVKAGDFITHLDGKLIYGGSLDEAVDQMRGVPGTKIRLSVFRPGRDEPFDVTITRQIIELKPVEWEMRGNVGVISVSSFSADVGTSVQKAWNEIRARSGGKVAGLVLDLRGNPGGLLDEAVALSDLFLDKGTIVSQRGRYARDNEVYPAEIDTKGDIAKGTPMIVLIDEGSASASEIVAGALQDQHRAVVMGQRSFGKGSVQTLIPLTRDTAIKLTTARYYTPSGRSVQEGGIEPDIAVPQISDPDLRKRQLRSYRESDLRGHLINEIKLEDKDLEKDKTEDPRFKMTAEELKAKDIKDFQLYYAVQTLSRTAPRGALAAKVKG

SEQ ID NO: 41032 - DNA, 1653 bp, Cytophaga hutchinsonii
  CDS (1)..(1653)
atgaacattaagcgttggggagttattacagctgttgccataggatcagttgctttgttgtctgcatttaaacaaacagataagtattttgaaattgccaaaaacatggagcttttttctgccgtgtataaagaggtgaatttattatatgttgacgaagttaatccgtcacaaacgatgacaacaggtattgatgcaatgttggagtcattagatccgtatacaaattatatccctgaagataaaattgaagattttcggacacaaatgacgggtcaatacggtggtataggtgctgttattggtgagcgtaaagacaaaataatcatcctgatgccgtatgaaggtttcccggcacaaaaagcaggtcttcagattggtgatgaaattcttagtgtagatggcattgtgacgacaagtaaaaattcaggtgatgtaagtaaattattaagaggacaggcagacacaccgcttaaaattaaagtaaagcgttttaacacacctgaaccgttagagtttacgctggtaagacagaaaatcaaaatcagcaatgtgccatacttcggtatggtgaatacaaatacaggttatatcaaactttctgactttacacaagccgcttctattgaagtgaaaaaagcattgactgatttgaaagctaaaggagctacacagatcatttttgatttaagaggaaacccaggtggtttgctgaacgaagccgttaatatatcgaatatctttattccgaaagataaattagtagtaagtacaaaagggaaagtttctgaatggaatacaaaatatataacagagcttgttccagacgatttgaatattccaattgctgtattagttagcggacgcagtgcttcagcttctgaaatcgttgccggagtaattcaggattatgacagaggggtaattatcggtcagcgttcgtatggaaaaggccttgtgcaaacaacacgtgaactgccatataattctcagatcaaagttacaaccgctaaatattatacaccaagcggacgttgtattcaggcaattgattacgcacacagagctgcagacggttctgtatctaaatttgcagattcgctgcatgtagcgtttaaaactacaaatggaagaacggtatatgatggcggcggtgtaactcctgatattactgtcgttcaggattctatttctccgatcctggttgcattggtttccaagagtctgttgttcgattatgcaaccgaataccgttcaaaacacgaaagcattggcgatgccagaacatttaacctgtcagatagagattatcaggattttgttacctggttaaaagacaaagattactcctatacaactaaagttgaaaagacattagatgaaatgacaaagcagtccaagcaggagaaatattttgatgccatgaaagatcagctggatcaaatgaaaaaagttatcgcaaaagataaagagaatgatctgattaaatttcaaagccagattatggaatatttagaagaagaaattgcttccagatactatctgcaaaaaggtatcattgaatcatctttcgatagcgacaaagacatacagtcagcgcttgaagtattaaataataagacgaaatacaattcgatcttatccggaaaataa

SEQ ID NO: 41033 - protein, 550 aa, Cytophaga hutchinsonii
MNIKRWGVITAVAIGSVALLSAFKQTDKYFEIAKNMELFSAVYKEVNLLYVDEVNPSQTMTTGIDAMLESLDPYTNYIPEDKIEDFRTQMTGQYGGIGAVIGERKDKIIILMPYEGFPAQKAGLQIGDEILSVDGIVTTSKNSGDVSKLLRGQADTPLKIKVKRFNTPEPLEFTLVRQKIKISNVPYFGMVNTNTGYIKLSDFTQAASIEVKKALTDLKAKGATQIIFDLRGNPGGLLNEAVNISNIFIPKDKLVVSTKGKVSEWNTKYITELVPDDLNIPIAVLVSGRSASASEIVAGVIQDYDRGVIIGQRSYGKGLVQTTRELPYNSQIKVTTAKYYTPSGRCIQAIDYAHRAADGSVSKFADSLHVAFKTTNGRTVYDGGGVTPDITVVQDSISPILVALVSKSLLFDYATEYRSKHESIGDARTFNLSDRDYQDFVTWLKDKDYSYTTKVEKTLDEMTKQSKQEKYFDAMKDQLDQMKKVIAKDKENDLIKFQSQIMEYLEEEIASRYYLQKGIIESSFDSDKDIQSALEVLNNKTKYNSILSGK

SEQ ID NO: 41034 - DNA, 2118 bp, Cytophaga hutchinsonii
  CDS (1)..(2118)
atgataggttttattctctcccgtattcaactaattgttttattgctgctgacatttgtagcaattccggcatctgcacaaaccagtaaaacagagcagccatcctgttcaaaaaaaacagatgcattatgggtattgctaactaaaaaacatattgctccgatacaattcaatcatactgtttctgtagaaattgcagatttgttattaacggaacttgattataaaaaaatacatttctatgaatcagacagacaaaacttattaatacagatacaaaatcttaaaccttcttctgccaaagatctttgtacgctgatcgccggaatatctgaattgtatcaaaccagaataaaagaaagccaggctattcttcagacgcttgccgcgaatgaattgaatttcagcgaaaatgaaattgttactttttcttcttccaaaagacaattcatggaatcgaaagaaaaaaaaataagccgatggaaacggaacattaaatttcttgtattgaataatctgtattacgccgtcgactctgcacacagcaccgatgttgctgccccaagcaattttttagcagataaaaataaaattacccgtacgattattgataaggaattaaaaaaaataaatgcattagctgatccttcaaccgattttactgcaactgttgaaaatgccttgctgaatgcaatctgcaagcgctttgatccgcatacggagtattataattacacggcatttaaagaattttcagaacacctgcagtcgaaggtcttaacctttggtgtatttttcggagaaacagcattcggaaatttatccatccgttacgtagcgccgggaagtacggcatggttttccaatgtgatacaagagaatgatgttgtattgtggttcaaattgaatcagcaggtgtttgatgtatctgcattaacacacacagaagcgaatgccttgcttcaaaacgaaaaatattcgcttttggaaatcggtttaaaaaaagataacggatcaagtgagacgattaaattaaaacgtgaagcaataaagtttgaaaacaataccgttaaaagttatatcattaaggatgctaaaaaaataggttacatatctattccttctttttattcggacgattcaaatcccaatgctttaggcgctgccaatgaattgtcgaaagaaattttaaaattaaaaaatgaaaacattgaaggattaatcattgatctgcggaacaatggcggaggttctttgtatgaagctgttggcatgtcaggtttatttatcgacataggcccgttgttttatgttctggaacgcagcggaaaagcaactttaaccaaagatatgaaccgcggtaccgtgtatgacggaccattgtgcattatggtgaatggatacagtgcatctgcttcagaaatattcagtgcagccatgcaggacaatcaccgtgcactgatcgttggagaacaaacatacgggaaagctaccggccagagtatttcacagttggatacaacaaaatcaatcagcacattttctgccactgataacatgggcgcgacgaagatcacggaaataaaattgtaccgcacatcaggcttcagctaccagggtaaaggtgtaacgcccgacataatacttccgtatctggatgtattatctgaaaaagaaaacacagaaccattttatcttaaaggtgactcgattgccaaaaaagctgtttttgcatttccggaagcgctgcctgttgcatccttaaatgagatgaacaatatacggataaaagaaaacccgcagtataagcaactgaaacatgtttcggactcgctgcatacaacacaagatgatgatattatcattcatttaactgctgcaggcttctggaaagacatgcgtatattgaaagcagaaaatgaaaaagaatctgcagccggctcatttgtacgtccgggatttgaagtatattacaaccgccttgaaagtgactttttaagttacgatgcgaattataaaaaactgtataccggctatctggatgaattaaaaacagacctgatcttacagcagacacatgatatcatgtgtgattttattaaacttaaacaaaaataa

SEQ ID NO: 41035 - protein, 705 aa, Cytophaga hutchinsonii
MIGFILSRIQLIVLLLLTFVAIPASAQTSKTEQPSCSKKTDALWVLLTKKHIAPIQFNHTVSVEIADLLLTELDYKKIHFYESDRQNLLIQIQNLKPSSAKDLCTLIAGISELYQTRIKESQAILQTLAANELNFSENEIVTFSSSKRQFMESKEKKISRWKRNIKFLVLNNLYYAVDSAHSTDVAAPSNFLADKNKITRTIIDKELKKINALADPSTDFTATVENALLNAICKRFDPHTEYYNYTAFKEFSEHLQSKVLTFGVFFGETAFGNLSIRYVAPGSTAWFSNVIQENDVVLWFKLNQQVFDVSALTHTEANALLQNEKYSLLEIGLKKDNGSSETIKLKREAIKFENNTVKSYIIKDAKKIGYISIPSFYSDDSNPNALGAANELSKEILKLKNENIEGLIIDLRNNGGGSLYEAVGMSGLFIDIGPLFYVLERSGKATLTKDMNRGTVYDGPLCIMVNGYSASASEIFSAAMQDNHRALIVGEQTYGKATGQSISQLDTTKSISTFSATDNMGATKITEIKLYRTSGFSYQGKGVTPDIILPYLDVLSEKENTEPFYLKGDSIAKKAVFAFPEALPVASLNEMNNIRIKENPQYKQLKHVSDSLHTTQDDDIIIHLTAAGFWKDMRILKAENEKESAAGSFVRPGFEVYYNRLESDFLSYDANYKKLYTGYLDELKTDLILQQTHDIMCDFIKLKQK

SEQ ID NO: 41036 - DNA, 1629 bp, Cytophaga hutchinsonii
  CDS (1)..(1629)
atggagaacgaaaaacctaagaataccctcttccagatgcgcttgccgatctttttagcattggcagtaatctgtggaatttttattggtgctgctttatctaaaaagggcacggaacaaaatatcgccggcaattatttacgctttgcagaaatattaaattatgtacagcaggattatgtagatacagtagatgtcgataagctcgttgattattccatcagccagatgctggaaaaattagatcctcatacttcctacatcccggcaagcgaacgtcagatcgcggattctcatttagagagcgattttgaaggtattggtattgaattcaatattataaaagataccatctatgttgtttctcctatcagcggcggcccatctgaaaaggcgggtttaatggctggcgataaaattattaaagtagatagcatacaaatggcaggtaacggtgttacgtctgcagatgtattcaaacggcttcgcggtaaaaaaggaacaaaggttttgctgactgtaaaacgcagcaactccagcaaactgcttacgtacaccatcatccgggataaaataccaacgtattccattgatgctgcttacatgatcgataaaacaactggttatatcaagatcagccgtttcggtgataaaacctacaatgaatttttaactgccttgacagacctgaaaacacaaggtatgcagcgattaatgattgatttgaaagacaatggcggcggttacctggatcgtgcaacaaacattgccgatcaattaattgatggtaataaaatgattgtatatacaaatggtaaaggaacaaaatacgatcaggaaatacgtgcacgtgttacaggtgcatttgaaacaggtccggtagttgtattgatcaacgaaggcagcgcatctgcctcggaaattctttcaggtgccttgcaggataacgaccgcggattaatcgtgggcagaagatcctttggaaaaggtttggtacagatgccgatcaacttaaatgacggatctgaattgcgtctgacgatctcccggtactatactccaagcggcagaagcattcagaagccatatgataaagaagatgcatcggcatatgaatctgatctgttgtcgcgttatgaacatggcgagttcttccatgcagacagtattcactttaatgactcgttaaaattcaaaacattaaaaggaagaaccgtatatggcggcggcggtattatgccggatgtatttgtaggaagagacacatctgagtacacaaaatatttaatggaactgtttaatcagaacgtgatcagagagtatacattaaattactatcagacaaataaagcagcgcttacaaaaatgacatttgaagaatatttcaaatcgtttaccgtaacagaggcgatgctgaaagatatgcttgaccttgctgctaaaaccggcgttaaatataatgaggttcaatacaaacgttcaaaagatttcattaaaaataacataaaagcctatattgcccgcagtgcttggggaaacaaaggattctatccgatctataaccagaaagatgaaatctataacaaaggcttgaatgcatttaaagaagcggaaaaaatatctcaataa

SEQ ID NO: 41037 - protein, 542 aa, Cytophaga hutchinsonii
MENEKPKNTLFQMRLPIFLALAVICGIFIGAALSKKGTEQNIAGNYLRFAEILNYVQQDYVDTVDVDKLVDYSISQMLEKLDPHTSYIPASERQIADSHLESDFEGIGIEFNIIKDTIYVVSPISGGPSEKAGLMAGDKIIKVDSIQMAGNGVTSADVFKRLRGKKGTKVLLTVKRSNSSKLLTYTIIRDKIPTYSIDAAYMIDKTTGYIKISRFGDKTYNEFLTALTDLKTQGMQRLMIDLKDNGGGYLDRATNIADQLIDGNKMIVYTNGKGTKYDQEIRARVTGAFETGPVVVLINEGSASASEILSGALQDNDRGLIVGRRSFGKGLVQMPINLNDGSELRLTISRYYTPSGRSIQKPYDKEDASAYESDLLSRYEHGEFFHADSIHFNDSLKFKTLKGRTVYGGGGIMPDVFVGRDTSEYTKYLMELFNQNVIREYTLNYYQTNKAALTKMTFEEYFKSFTVTEAMLKDMLDLAAKTGVKYNEVQYKRSKDFIKNNIKAYIARSAWGNKGFYPIYNQKDEIYNKGLNAFKEAEKISQ

SEQ ID NO: 41038 - DNA, 1518 bp, Clostridium thermocellum ATCC 27405
  CDS (1)..(1518)
atggatgtgacgggtaaatcattaaaacggatactgttatctttggctgttttttgtattttaataacgggcccgggaattgcctgtgccgaggaagccacgacgcaagaaaaggaaattttgttttccgactatttcaaaagcatgatggacatggcgcaagacaaatacaaaggtgaaataaccgaaaagcaaatgctggaaggcgcgctgaaaggcatattcagcacaatggattcttacaccgtctattacactgtggaagagtcgcaagacttttttaccgatataaacggctcttacacgggaataggtgtggtaatgtcggaagttgacggtaaaatagtgatagacaaggtgtatccgtcctcaccggcggaggaagcagggataaaaaaaggcgatgttatagcccaggttgacggtaaaagcgttgagaacctttctttggaagaagtggccgggctcataaagggaccgtcgggtacgaaagttgtaatcggtgtgttaagaaacggaacagacggggtaatagagctggaagttacaagaaggcagataattataaatcctgtcacccataagatagaaggcgatataggttatataaagctggaatcgttcaattccaatgcaagcaaggctatggaagaagccttgaaacaaatggataaaaacaatataaaaaagataattcttgatttacgggacaatccgggcggagatgtgggccaggcggtttcaattgccaggaagtttgtaaaaaaaggccttattacaaagctggattttaaatcggaatcccaaaaggatgaagagtattattcctatttggaggaattaaaatataaacttgtggtattggtgaacgaaaacagcgcaagcgcttcggaaatattggcgggagcgatacaggatacaggttcgggtattttggttggtacaacaacctttggaaagggaaaagtccagaatctttatcccatactgactccggaggcggtggaaaaatatcggaaagaaaccggagaaacatttgtgaacggatacgatttattggaaaaacacggcatctatccttccgatgaagaaataatcggatgggtgaaaataacaaccggggaatattatacccccaacggaaggatgatagacggagtaggtcttgagcccgacgtttatgttgaaaatgaaccggagggaaaatataaaatccttgaaggtgtggaaaaacttcgcaaggtgacaaaaccttctttaaatgctcaaagtgaggatgtcctgaatgcggaaaaaattttatcggcactggggtatgatgttgacactccggacaatttaatggatgaaaagaccgtcaaggcggtggcagagtttcagagagactgcggattgtattcttacggagttttggactttgccacacagcaggcgctgaatgacaaattggatgaattgcttcttgtaaagaacagagacaaacagtatgaaaaggcggtggaactgcttgaaaattag

SEQ ID NO: 41039 - protein, 505 aa, Clostridium thermocellum ATCC 27405
MDVTGKSLKRILLSLAVFCILITGPGIACAEEATTQEKEILFSDYFKSMMDMAQDKYKGEITEKQMLEGALKGIFSTMDSYTVYYTVEESQDFFTDINGSYTGIGVVMSEVDGKIVIDKVYPSSPAEEAGIKKGDVIAQVDGKSVENLSLEEVAGLIKGPSGTKVVIGVLRNGTDGVIELEVTRRQIIINPVTHKIEGDIGYIKLESFNSNASKAMEEALKQMDKNNIKKIILDLRDNPGGDVGQAVSIARKFVKKGLITKLDFKSESQKDEEYYSYLEELKYKLVVLVNENSASASEILAGAIQDTGSGILVGTTTFGKGKVQNLYPILTPEAVEKYRKETGETFVNGYDLLEKHGIYPSDEEIIGWVKITTGEYYTPNGRMIDGVGLEPDVYVENEPEGKYKILEGVEKLRKVTKPSLNAQSEDVLNAEKILSALGYDVDTPDNLMDEKTVKAVAEFQRDCGLYSYGVLDFATQQALNDKLDELLLVKNRDKQYEKAVELLEN

SEQ ID NO: 41040 - DNA, 1320 bp, Microbulbifer degradans 2-40
  CDS (1)..(1320)
atgcaggcccaaacacccagcaacgaaccagaagacgccgacaccattagcgtgttgccattggaagacttgcgtgtgttcaccaaagcttacgaacacattcgctcttcttatatagaagagatagacgatcgcaccctgctggaatatgccattcgcggtatgctcgacgagctagacccgcactcagcattcctggatgccagctccttcgacgacctacaagtgcataccagcggcgaatttggcggcttgggtatagaagtaggtattgaagatggctttgttaaggttatctcgccaatagacgatacccccgcacaaaaagcaggtgtagaagccggcgaccttattattaaaattaacggcacctcggtgaagggcattaccctaagcgatgctgtagaaaaaatgcgcggcgcaccgggtaccgatattaccctcaccattatgcgcaaagacgtagagcaacccttcgacttggtgcttacccgcgacaagataaaagtgcgcagcgtgcgctcggatattgtcgagcacgactttgcctacctgcgcgttgcacagtttcagttgcgcaccggccaagacctcgccaacgaaattaaaaaactgcagaaaataaactcagaccttaagggcgtgattttagatttgcgcaacaacccgggcggtgtattaactgcctcggtagaagtagccgacctattcttaaacgacggtttgattgtgtataccgaaggccgcatgcacgatgccaacagccagtactctgccaccccaggcgacgccgttgacggcctacctatggtcgtgctgattaacggcggcagcgcgtcggcgtcagaaattgtggctggtgccctgcaagaccaaaaccgagcactggtgcttggcacccgcagtttcggtaaaggctcggtgcaaaccgttatttcgattaccgaagatcgcgccattaaaattactaccgcgctttacttcacccctaacggccgctcgatacaagcccagggaatcgaacctgatatagaggtagaacgagtaaaaattactgccgtgcaaccgcaggcagacataaccgaagccgatttaagcggccacctaaagaacgctaaaggcggcgctgaagtaaaagctagcgatagaggcaagcgcaaaaacgaactgcacgagcgcgatagccaattgtacgaagcggtaaatattctgcgcggcctgcacctttttcaaaaggcacagcaagccaaggcagaaaaagaactagaaaaaagccaagctgctgaacaagccgctgccgaaaccacagaaacaccatag

SEQ ID NO: 41041 - protein, 439 aa, Microbulbifer degradans 2-40
MQAQTPSNEPEDADTISVLPLEDLRVFTKAYEHIRSSYIEEIDDRTLLEYAIRGMLDELDPHSAFLDASSFDDLQVHTSGEFGGLGIEVGIEDGFVKVISPIDDTPAQKAGVEAGDLIIKINGTSVKGITLSDAVEKMRGAPGTDITLTIMRKDVEQPFDLVLTRDKIKVRSVRSDIVEHDFAYLRVAQFQLRTGQDLANEIKKLQKINSDLKGVILDLRNNPGGVLTASVEVADLFLNDGLIVYTEGRMHDANSQYSATPGDAVDGLPMVVLINGGSASASEIVAGALQDQNRALVLGTRSFGKGSVQTVISITEDRAIKITTALYFTPNGRSIQAQGIEPDIEVERVKITAVQPQADITEADLSGHLKNAKGGAEVKASDRGKRKNELHERDSQLYEAVNILRGLHLFQKAQQAKAEKELEKSQAAEQAAAETTETP

SEQ ID NO: 41042 - DNA, 2112 bp, Microbulbifer degradans 2-40
  CDS (1)..(2112)
atgataaagaatattgccgtaagcctcgtttttattttctctgtcacctgcgctgtagctaaaccaccagaagcgcctaagctgattcctacaaaagtacaatcgcaaaccattgttgacgtaatagctcagttaaatgcgagacattatcgcaaccaagcaattgacgattccttgtctacgcgattcctagaaagctatatcgacagcctcgaccctgcccatatgtttttctacacaaaagatgtagaaaacttcaaaaagcacaaccttaaatacgatgattatttccgtaagggcaagctagaagaaggttttgaggtgtatagaacctaccgcgcccgtgttgtttcgcgcttagagtctgctatagagatgctggccgacgaaaatgttaagtttgactttaacgctaaagacgaaattatattagatcgctctgaattgccttggccaaccacccaagccgaagccgacgagctttggtacaagcgcacaaaattaagcctgcttaacttaaaactagcaggtaaaaccttagaagaagccaaagaaacggttacaaagcgctataaaaaccagctcaatcgcatattgcagcaagatagcgccgatgtatttgaaataatggtgaattcattaacgctgctatttgacccgcatacaaattattggtcgccgcgcacttccgagaacttcaacattaatatgtcgctttctttagagggcatcggtgcggtattacaatctgaagatgaattcaccaaggtagtaagcctagtgcctggcggccctgcttcgaagcaaggccaattaaagccagccgatagaattgttggtgttggccaaggcgacgaaggtgaagttgtcgatgttacaggttggcgattagatgaagttgtagaccgtattcgcggccctaagaacacagttgtgcgcctagaagtgttgcccgctaaagaaagcaatggcgaaactgcggtaattcgtattaaacgcgatgaggttaaactagaagaccaagccgctaaaaaaggcgtattggagctaagtgatgaagagcgcctatacaaaattggtgtcattaacctgcctgctttttatattaacttcgataaagcaaatagtcgcgacccagactatcgcagtagtacccgcgatgtatctcgcctactagacgagctacaagcagaaggcgtagacggtattattttagatttacgcaacaatggcggcggttcactgcgcgaagcaaccatgcttaccgatttgtttatcgaccacggtaccgttgtgcagattcgtactccagatggctacatagctcgccataaccacgcccgtttacgtgctaaatatcgcggcccgctaatcgtgcttgtaaatcgattaagtgcatcggcttcagaaatttttgccggcgcaattcaggattacgacagagggctaattgtaggcactcaaacttttggtaagggtacggtgcaatctgtggcccctactgttgaaggcaaaattaaattaactgaatcaaaattctaccgcgtttctggcgatagcacccagcatcgaggcatcattccagatatcgagctacctatgctagtggatatgaaggaagtgggcgaatccgcttacgacaatgccctgccgtgggacactatccacccagtaccacatgcaaaatactttgatcttgatgcgagcattccctacctaaccgaagcccataaaaagcgtattgctcatgacccagactttaactacctgctcgatcaaatagctgtaatggaagagaacaagcgtaaaaaagcagtatctcttaacgaaaaacagcgaattgcagagaaagaaaacctagaaaaacaagcgatggttatcgagaacaagcgtcgcaccggcaaaggtcaagacccgtacaaaacgttagctgagtaccgagccgcgcaagaagaagaaaacccggaggacgctcctgtagtatcctctcgtgaaacagtcatcgatttagatggcgataccctattgaacgaatctggcaacatattaattgactacattcgttttcaaactacaaacgctcaaaaacaggcttcaaactttagcaaatga

SEQ ID NO: 41043 - protein, 703 aa, Microbulbifer degradans 2-40
MIKNIAVSLVFIFSVTCAVAKPPEAPKLIPTKVQSQTIVDVIAQLNARHYRNQAIDDSLSTRFLESYIDSLDPAHMFFYTKDVENFKKHNLKYDDYFRKGKLEEGFEVYRTYRARVVSRLESAIEMLADENVKFDFNAKDEIILDRSELPWPTTQAEADELWYKRTKLSLLNLKLAGKTLEEAKETVTKRYKNQLNRILQQDSADVFEIMVNSLTLLFDPHTNYWSPRTSENFNINMSLSLEGIGAVLQSEDEFTKVVSLVPGGPASKQGQLKPADRIVGVGQGDEGEVVDVTGWRLDEVVDRIRGPKNTVVRLEVLPAKESNGETAVIRIKRDEVKLEDQAAKKGVLELSDEERLYKIGVINLPAFYINFDKANSRDPDYRSSTRDVSRLLDELQAEGVDGIILDLRNNGGGSLREATMLTDLFIDHGTVVQIRTPDGYIARHNHARLRAKYRGPLIVLVNRLSASASEIFAGAIQDYDRGLIVGTQTFGKGTVQSVAPTVEGKIKLTESKFYRVSGDSTQHRGIIPDIELPMLVDMKEVGESAYDNALPWDTIHPVPHAKYFDLDASIPYLTEAHKKRIAHDPDFNYLLDQIAVMEENKRKKAVSLNEKQRIAEKENLEKQAMVIENKRRTGKGQDPYKTLAEYRAAQEEENPEDAPVVSSRETVIDLDGDTLLNESGNILIDYIRFQTTNAQKQASNFSK

SEQ ID NO: 41044 - DNA, 1371 bp, Pediococcus pentosaceus ATCC 25745
  CDS (1)..(1371)
atgattttaggagttttaattactattgtcagtggtttagtattttttgtagggattttaggtcataccgatggtgagaaaaatgattttaatcgtgtagcgagtgtttataatcaaattaatagtgattattataaaaaagtcgacacttctaaattagctacaggagcaattgatggaatgttgagcactttaaatgacccattttcggactatttaactgatagtgatgctactagtttgaatgatagtgtttcaggagccttcggtggtgttggtattcaagttgtaaagaagaatcaccaaattgaagttatgactaccattgatggtacaccggccaaaaaagcgggtctgaaagccggagatgtgattttagaagtagatggtaagaaattaactaatcaatccctttctaaagccaccaccttaatgcgaggaaaagttgggactaaagtaaaggttaaattgcagcgaggaaatgatacctttgataaggtgctaactcgttctaaaattccagttgagaccgtcacggctaagatgttgaagaataaagtaggttatataactatctcaacagtggctgaaaaaacttctagtgaacttaaacgggcgcttaaacgtttagataaacagggagctaaatcttatattattgatgtccgaaataatccgggtggtctgatgcaggaagctttaaagatgtcttcgatgtttttaaagaatggcaaaactattatgcaagttaaagctcggactggtaaagcagaagtatacaaggcgtctaaaaagtatgatggtggctataaagttactaaacctactacagttgttattaatggcgaaagcgctagtgcagctgaaatttttgctgcagctttacaccaatcggctaatgttccacttgtaggttccaaaagttatggaaaaggcaccgttcaaaatattacccaatatacagatagtgatgaattaaagctaacgattgcaaaatggttaacgccaaacggtacttggattcatggaaaagggttaaaaccagactatcaggctgattatcctgccatggcatacattacagaatttgatcagaaaaaaacgtactccgtgggagagagcaattcagatattaaaaatattcaaattgccttaaagggattaggttactatgatgataaaatttctaaagagtatactgagaaagtcaagcaggcagtggaagcttatcaagaaaagaatcagctagctgttactggaaaagttgatgcgaagacaatgcgttcaatcgaacagaatgtcattaaaactttagctaaaaatgatcctgctctagaaaaagcgcaaaaagttatgaatgacgaaaaataa

SEQ ID NO: 41045 - protein, 456 aa, Pediococcus pentosaceus ATCC 25745
MILGVLITIVSGLVFFVGILGHTDGEKNDFNRVASVYNQINSDYYKKVDTSKLATGAIDGMLSTLNDPFSDYLTDSDATSLNDSVSGAFGGVGIQVVKKNHQIEVMTTIDGTPAKKAGLKAGDVILEVDGKKLTNQSLSKATTLMRGKVGTKVKVKLQRGNDTFDKVLTRSKIPVETVTAKMLKNKVGYITISTVAEKTSSELKRALKRLDKQGAKSYIIDVRNNPGGLMQEALKMSSMFLKNGKTIMQVKARTGKAEVYKASKKYDGGYKVTKPTTVVINGESASAAEIFAAALHQSANVPLVGSKSYGKGTVQNITQYTDSDELKLTIAKWLTPNGTWIHGKGLKPDYQADYPAMAYITEFDQKKTYSVGESNSDIKNIQIALKGLGYYDDKISKEYTEKVKQAVEAYQEKNQLAVTGKVDAKTMRSIEQNVIKTLAKNDPALEKAQKVMNDEK

SEQ ID NO: 41046 - DNA, 1239 bp, Trichodesmium erythraeum IMS101
  CDS (1)..(1239)
atgaaaaaaagatttttgcaaattccacttctattaatactaccaattcttctgagttggggactttggatatcttctgcaacagcattaactgaagaacagggcttattgggagaagcttggcgtatagtcaatttggcttatgttgatgattctttcaatcatcaaaactggtggtttgtgcgtcaaaatttgatgaagaaacccctgacaactagagaagaaacctatagcactattcaagaaatgttagctagcctagaagacccattcacgcgacttctaaaaccacagcagtatcgtaatttacaggttgatacttctggagaattaacaggagtgggtttacaaattgccctggactctcaaacaggagaactaatagttatttctcccttagaaggttctcctgctgaaactgctggtatccaggcaggcgatcgcgtcgtcaagattgatggccatccaaccacagagttttcattagacgaagctgcaaatagaatgcggggcactgttggctctcctgtgatactaacaattttgaaagaaagtagggaccaaccccaagacataaccataattcgggatcaaatagagattaatccagtttacgccaagttaaagtctaactctcaagctggacctatcggttatattcgtctgagtcaatttaatgctaacgctacggcagaaattagccaagtaatagagagttttgagcagaagggagctattggctatatacttgatttacgaaataatccaggtggactattacaagctggtgtaggaattgctcgtctgtggttagacgacggtacaattgtttacacggttaatagacaaagagttcttggtagttttgaggctgttggtattgctataaccaatgccccattagttgtattaactaataagggaactgcgagtgctagtgaaattctagctggcgcactccaggataatggtcgtgcaatgcttgtaggagaaaaaacttttggcaagggtttaattcaatctttatttgatctatctgatggatcgggattagcagttaccgttgccaagtatgaaacgccaaaccatatagatattaataagcaggggattatccctgatgttgtgattaaacaagacccgattttgcctaaccaaattaccacagaagctgacaaacaatatcaagccgcactagaacttataacatctcaatttgtattaacaaatgcagcttaa

SEQ ID NO: 41047 - protein, 412 aa, Trichodesmium erythraeum IMS101
MKKRFLQIPLLLILPILLSWGLWISSATALTEEQGLLGEAWRIVNLAYVDDSFNHQNWWFVRQNLMKKPLTTREETYSTIQEMLASLEDPFTRLLKPQQYRNLQVDTSGELTGVGLQIALDSQTGELIVISPLEGSPAETAGIQAGDRVVKIDGHPTTEFSLDEAANRMRGTVGSPVILTILKESRDQPQDITIIRDQIEINPVYAKLKSNSQAGPIGYIRLSQFNANATAEISQVIESFEQKGAIGYILDLRNNPGGLLQAGVGIARLWLDDGTIVYTVNRQRVLGSFEAVGIAITNAPLVVLTNKGTASASEILAGALQDNGRAMLVGEKTFGKGLIQSLFDLSDGSGLAVTVAKYETPNHIDINKQGIIPDVVIKQDPILPNQITTEADKQYQAALELITSQFVLTNAA

SEQ ID NO: 41048 - DNA, 1305 bp, Trichodesmium erythraeum IMS101
  CDS (1)..(1305)
atgaacatagcttcaatacactctctttttaaaaatattttatatagtggagcgatcgccacaacagcagctatatctttattggcccctagcttaagtaaacctgctgaagcaaatttagaaaatagccccaaagtagttttggacgaagcatggcaaattgtcaaccgcgagtatgttgatggtagttttaatcatacagactggaaagctactcgcaaaagtttattagagaaaaactatacttcccaggaaaaagcttacgaggcattaaggcaagctctagaccaactcaatgatccttatactcgttttttagacccagaacagtttaaagctctaacgagtcaaacatcaggagaaatgtctggagtgggaatgcaactgaagcaagaagaacttaccaagacgatcgttgtagtagacgttgtggaaaattctccagcgatgaagggaggtttattaccaggagatcaaattcaagaaattgatggtaaatctacttctgatttaagtgtatcggcagcggctaaactgattcgaggtgatgtgggtacaaaggtaatgctaggagttattcgccctggagatagggaatttgaggtgactttgacaagggcaagaattgaattacaggcagttcgttacgatctcaagcaggaaaaaaatcaacgtattgggtatatccgtttacaagaatttagcgcccatgctggagaacagatgcaaagagcaatagagaaattgaataatcaaaatcctgatggttatgttttagacttacggggcaacccagggggtttattgcgtattagtatagatattgctaggatgtggatggataaaggtgctattgtcagcactgtagaccgagatggtgacagacaagaagtgttggcagaccgttctgctttgactgataaaccaatagtggttttagtagatggtgactcggcaagtgctagtgaaattctggcaggagcgctcaaagataatggtcgtgctacaattataggggatcagacttttgggaaagctttggtacagtcggtgcattcgttatcagatggttctggtttggctgtaactattgctcactactatactccgaaaggaactgatattagtaaaaaaggtgtgactcctgatgtggttcttaatttgacggactctcaaaaacgacgcttatatcggcgtccagaagcgatcgcgactagttctgacccctattatgctcgagctattaatcttttgagaaatgaagtattgttaagtccattgatcttaggggaacaagaaaattaa

SEQ ID NO: 41049 - protein, 434 aa, Trichodesmium erythraeum IMS101
MNIASIHSLFKNILYSGAIATTAAISLLAPSLSKPAEANLENSPKVVLDEAWQIVNREYVDGSFNHTDWKATRKSLLEKNYTSQEKAYEALRQALDQLNDPYTRFLDPEQFKALTSQTSGEMSGVGMQLKQEELTKTIVVVDVVENSPAMKGGLLPGDQIQEIDGKSTSDLSVSAAAKLIRGDVGTKVMLGVIRPGDREFEVTLTRARIELQAVRYDLKQEKNQRIGYIRLQEFSAHAGEQMQRAIEKLNNQNPDGYVLDLRGNPGGLLRISIDIARMWMDKGAIVSTVDRDGDRQEVLADRSALTDKPIVVLVDGDSASASEILAGALKDNGRATIIGDQTFGKALVQSVHSLSDGSGLAVTIAHYYTPKGTDISKKGVTPDVVLNLTDSQKRRLYRRPEAIATSSDPYYARAINLLRNEVLLSPLILGEQEN

SEQ ID NO: 41050 - DNA, 1293 bp, Trichodesmium erythraeum IMS101
  CDS (1)..(1293)
atggttatagcaaaacgtggacttatccttggtgtaacagcattaatgttaacaggcgtcactgtaattggcgctggtattcatctttcctctcaagcatcattaagtaataatgctccgaaagaattaatcgacgaagtttggcaaattattgataaaacttatgtagatggtactttcaatcaagtagactggaaagcaactcgcaacgagtatcttgataaaacatataccagtgaagaacaagcttatgatgcgattaaggaaatgctaaaaaagttagacgatccttacacccgctttatggatcccgaagagtttaaaaatatgcaaatagatacttctggggaactaacaggtgtaggtattcagctaacccaagacccagattcaaaaaaattggtagttatttcaccaatagaagatactccagcttttgatgcaggtattcaagctaaggatattattagcaaaattgacggtcaaagcactaagggaatgaatattaatgaggcggtaagtctgattcgcggtccaattggtagtcaagtaattttaactattaaacgagaaaatctggaaatagagtttcctattgttcgggcaaaaattgaaattcatcctgttaagtattctcagaaagagagttacaattctttaggcaaagttggttatattcgcttaagccaatttagtgcgaatgctgctggtgagatgcgagaggcaataggtaatttggaaactcagaaggtatcaggttatattctggatttacgttctaatcctggtggattgctatatgctagcatagaaattgctaggatgtggctaaagcggggagatattgtttccacggtagaccgcaatggtgtcactgatcgccaaaaggctaataataggtctttgacagataagcctttggtggttatggtagatggggggtctgcaagtgccagtgagattctttctggtgcactgcaagataacaagcgagcgacattagtcgggacaaagacttttggtaaagggttagtgcagtcagtgcgtagtgttggtaagggtgcagggatagcggtgacgatcgctaaatactttacccctaatggtcgcgatattaacaaattgggaattcaaccagatgtaaaaatacccctgagtgaaaaacaaaaagaaactttgcaaaaaaatcgtgacaaaataggtactatagaagcagatcctcaatacgcaaaagcattagacatcttaaataaagaaattgctgaattccaaaatcagacagctcagtggtag

SEQ ID NO: 41051 - protein, 430 aa, Trichodesmium erythraeum IMS101
MVIAKRGLILGVTALMLTGVTVIGAGIHLSSQASLSNNAPKELIDEVWQIIDKTYVDGTFNQVDWKATRNEYLDKTYTSEEQAYDAIKEMLKKLDDPYTRFMDPEEFKNMQIDTSGELTGVGIQLTQDPDSKKLVVISPIEDTPAFDAGIQAKDIISKIDGQSTKGMNINEAVSLIRGPIGSQVILTIKRENLEIEFPIVRAKIEIHPVKYSQKESYNSLGKVGYIRLSQFSANAAGEMREAIGNLETQKVSGYILDLRSNPGGLLYASIEIARMWLKRGDIVSTVDRNGVTDRQKANNRSLTDKPLVVMVDGGSASASEILSGALQDNKRATLVGTKTFGKGLVQSVRSVGKGAGIAVTIAKYFTPNGRDINKLGIQPDVKIPLSEKQKETLQKNRDKIGTIEADPQYAKALDILNKEIAEFQNQTAQW

SEQ ID NO: 41052 - DNA, 1164 bp, Moorella thermoacetica ATCC 39073
  CDS (1)..(1164)
ttgccgaggatctggcgtcagatcggccgcgggcttctagccctctgcgtgttggtgaccctggccgtgggagtgggggtggctacccacttccgggaagtggagcagggtgttaagacctacgccctgctgcgcttccaggccttgcagcctatcagcactgataaactcatggaaggggccatcaggggtatggttgaagcccttgatgacccttattctacttacctggacgctgaaacctaccgcaaattgcaggagagcgtcaccggcagttacggcggggtcggcctgctgattaccctggatgaaaaggacaagcgggtggtggtcgtttctccctttaaaggaacgccggcccagcgggccgggattaaaagcggggattatatcacggccatcgacggccgcgataccaccggcatggacctggagacggcctcgaaccttatgcagggcgagccgggtaccagggtggagctgaccatcctgtctgcgggcgacagcaaccccaggaaagtcgccctcacccgggagattatcaaggtaccgacggtggacggcaggatgctccccgggcatccgggggtcggatatatcagcgtgaccatgtttaatgaacagacaggagccgacctggggcgggagttaaacgacctgcgccagcagggtatgcagaagttaattctggatctgcgcaacaaccccggcggcgccctcccggcggcggtggatgtggccagttactttgtaccccaggggccggtagtctatatcgccgaccagaaaaccagcgagcccctcatggcccgggggtatgctcaaccccttcccctggttgtcctggtgaataaaggcagcgccagcgcggcggagattgtggccggggccatcaaggatacgaagagcggcaccctggtaggcgagacgaccttcggcaagggcatcgtccagaccatctttcccttgcccggcgatgcggcggtgaagatcaccacccaaaaatacctgactccgggcaagcacgatataaacaaaaaggggatcacccccgactatgtcgttcccatggacccccagctggagcagcaggtcctggcccacgccccggatctggagcgggacgtccagttgcagaaggccctggaggtgctggggaaatag

SEQ ID NO: 41053 - protein, 387 aa, Moorella thermoacetica ATCC 39073
MPRIWRQIGRGLLALCVLVTLAVGVGVATHFREVEQGVKTYALLRFQALQPISTDKLMEGAIRGMVEALDDPYSTYLDAETYRKLQESVTGSYGGVGLLITLDEKDKRVVVVSPFKGTPAQRAGIKSGDYITAIDGRDTTGMDLETASNLMQGEPGTRVELTILSAGDSNPRKVALTREIIKVPTVDGRMLPGHPGVGYISVTMFNEQTGADLGRELNDLRQQGMQKLILDLRNNPGGALPAAVDVASYFVPQGPVVYIADQKTSEPLMARGYAQPLPLVVLVNKGSASAAEIVAGAIKDTKSGTLVGETTFGKGIVQTIFPLPGDAAVKITTQKYLTPGKHDINKKGITPDYVVPMDPQLEQQVLAHAPDLERDVQLQKALEVLGK

SEQ ID NO: 41054 - DNA, 1407 bp, Thiobacillus denitrificans ATCC 25259
  CDS (1)..(1407)
atgacacagaagtcgaaattcgttctcgtcggtgtggccggcgtgctggcgggcgctgccctcacgctcaatctttcggcgatcgccgacaaggaggccggggcgccgctgccaatcgaggagttgcgcgcattcaccgacgtgttcgcgcgggtcaagaacgactacgtcgagccggtcgaggacaagaaactcatcaccgaggcgatcaacggcatgctgaccggcctcgatccgcactccgcctatctcgacgtcgagggattcaaggacctgcaggtcgggacccagggcgaattcggcgggctgggcatcgaagtcgggatggaagagggcttcatcaaggtcgtttcgccgatcgaggatacgcccgcattcaaggccggcgtgaagcccggcgacctcatcgtcaagctcgacgacaccccggtgaagggcatggcgctcaacgacgccgtcaagcgcatgcgcggcaagccgggttcgaaaatccggctcaccgtcgcgcgcaagggcgtcgacaaaccgatcgtgctgacgctcacgcgcgcgatcatcaagatccgcagcgtcaagtcgaagctcatggaaagcggctacggctatgtgcgtgtcacccagttccaggagcacaccggggaactgctggcggaagccctgaacgcgctgtacaagaacaacaaggcgccgctcaagggcctcatcctcgacctgcgcaacgaccccggcggtcttctcaacggcgcggtcgccgtcaccgcagcgttcgtcaagcccgacgcactcgtcgtctacaccgaggggcgcacgccggatgccaagatgcagctcaccgcgcgccgcgaaaactatctgcgcccgatgcaggcggactacctgaagaacctgccgcagggcgtgaaacaggtgccaatggtcgtgctcgtcaacagcggctcggcgtcggcctcggagatcgtggccggcgcgctgcaggaccacaagcgcgccgtggtcatgggcacgcgcaccttcggcaagggctcggtgcagaccatcctgccgctcggcaacggcaccgcgatcaagctcacgaccgcccgctatttcacgccgaacgggcgctcgatccaggccaaaggcatcgaacccgacatcgtcgtcgaggatccgagcatgccgtcggaagacgacggcctcggcatccgcgaggccgacctcgccaagcacctggccaatccttccgacaaggagggtacgtccatcgtcgtgccggccgacgacgaggccgggcccgcggagcagccctcgcgggaaagaaagccgctcgcaccgctcgaacccggtgaaatcgtgtccaagaacgatttccaggtcaatcaggcgctgaacctgctgaaaggcctgcagattctccaggcgcactga

SEQ ID NO: 41055 - protein, 468 aa, Thiobacillus denitrificans ATCC 25259
MTQKSKFVLVGVAGVLAGAALTLNLSAIADKEAGAPLPIEELRAFTDVFARVKNDYVEPVEDKKLITEAINGMLTGLDPHSAYLDVEGFKDLQVGTQGEFGGLGIEVGMEEGFIKVVSPIEDTPAFKAGVKPGDLIVKLDDTPVKGMALNDAVKRMRGKPGSKIRLTVARKGVDKPIVLTLTRAIIKIRSVKSKLMESGYGYVRVTQFQEHTGELLAEALNALYKNNKAPLKGLILDLRNDPGGLLNGAVAVTAAFVKPDALVVYTEGRTPDAKMQLTARRENYLRPMQADYLKNLPQGVKQVPMVVLVNSGSASASEIVAGALQDHKRAVVMGTRTFGKGSVQTILPLGNGTAIKLTTARYFTPNGRSIQAKGIEPDIVVEDPSMPSEDDGLGIREADLAKHLANPSDKEGTSIVVPADDEAGPAEQPSRERKPLAPLEPGEIVSKNDFQVNQALNLLKGLQILQAH

SEQ ID NO: 41056 - DNA, 1338 bp, Silicibacter sp. TM1040
  CDS (1)..(1338)
atgaagaaatttgcgatggcggctctgggcgggacgcttgcgggctttgtggcaacaacctacgtggcagcgccgttgctggcacaggagagcaataacacaaccgtctatgagcaactcgatctgtttggtgacatcttcgagcgcattcgggcgcaatacgtcgaagaggtcgacgaaaaagagctgatcgaggcggcgattggcggcatgctgcagtccctggatccgcactctagctatctgtcccctgatgatgcgagcaagatgcgggtgcagacccgtggggagttcggtggccttggcatcgaagtcacgcaggaagacggctttgtcaaagtggtgtcgccgatggatggcacacccgcagacgaagccggagtcgaggcgggcgattttatcacccatgtggatggcgagagcctgttggggcttggacttgatgaagcggtcgaactgatgcgcggcccggtggggtctgaaatcatcatcaccatcgtgcgcgaaggcgaagacgagccttttgatgtttccattattcgcgacaccatcaagctgacggctgtacgcggtcggaccgaaggggactcggtggtgctgcgggtcacgacgttcaatgaacagaccacgcccaacctcgaggccaagctcgaagagcaagtcgaggcgctgggcggcatggacaacgtgaacggcatcgtgcttgacctgcgcaacaacccgggcgggttgctgacccaggcgatcagcgtagccgacagcttccttgaaagcggtgaaatcgtctctacccgtggtcgcaatcccgaggatggcgagcggttcaatgcaacgccgggggacctggttggtggcaagccgattgtggtgctgatcaacggtggctccgcctccgcgtccgagattgtcgccggcgcgctgcaagaccaccgccgcgcgatcgttgtgggcaccaaatcctttggcaaagggtcggttcagaccgtgatgcccctccgcagcgacggagccatgcgcctcaccaccgcgcggtattacacgccctctggccgctccattcaggcactgggtgtcagcccggacatcgttgtagcgcagccgcgtcgccgccccgaggctgaggaagatgaacccgccagcagcgcctttggtccccgttcagaggcggacctgcgtggtcgtctgaacaatgacagcctctccgaggatgaggtgcgccagatcgaagcggatcgcgagaaggctgaaaaagccgcagaactgcgtgaacaggattatcagctggcctacgccatcgatattctgaaaggcctctcggctctgggtcctaaagactaa

SEQ ID NO: 41057 - protein, 445 aa, Silicibacter sp. TM1040
MKKFAMAALGGTLAGFVATTYVAAPLLAQESNNTTVYEQLDLFGDIFERIRAQYVEEVDEKELIEAAIGGMLQSLDPHSSYLSPDDASKMRVQTRGEFGGLGIEVTQEDGFVKVVSPMDGTPADEAGVEAGDFITHVDGESLLGLGLDEAVELMRGPVGSEIIITIVREGEDEPFDVSIIRDTIKLTAVRGRTEGDSVVLRVTTFNEQTTPNLEAKLEEQVEALGGMDNVNGIVLDLRNNPGGLLTQAISVADSFLESGEIVSTRGRNPEDGERFNATPGDLVGGKPIVVLINGGSASASEIVAGALQDHRRAIVVGTKSFGKGSVQTVMPLRSDGAMRLTTARYYTPSGRSIQALGVSPDIVVAQPRRRPEAEEDEPASSAFGPRSEADLRGRLNNDSLSEDEVRQIEADREKAEKAAELREQDYQLAYAIDILKGLSALGPKD

SEQ ID NO: 41058 - DNA, 1443 bp, Dechloromonas aromatica RCB
  CDS (1)..(1443)
atgggccagcttgaaatgagcaaaacgaaaaccattagcttgaccgtaggcgcattcgtcgccggcgcactgatcagcctgaacttcccggcactcgccgacaaggaggcgaagcccggactgccgatcgaggagctgcgcacctttgccgaggtctatagcgccatcaagcaaggctatgtcgagccggtcgaagacaagaagatgattaccaatgccatctccggcatgctgtccaacctcgacccgcactccgcctacctagatgccgatgccttcaaggatctgcaggtcggcacccagggggaatttggcggcctcggtatcgaagtgggcatggaagatggcttggtcaaggtcgtttcgccgatcgaggacaccccggcctatcgcgctggcgtcaagtccggcgacctgatcttcaagctggatgacaccatggtcaaaggcctgacgctgtccgaagcggtcaagaagatgcgcggcaagccgaagaccccgatcaagctgtcgatcatccgcaagggtgaaaccaagcccatcgaattgaccttgatccgcgaagtgatcaaggtgcagagcgtcaagtccaagctgatcgaaccgggctacggctgggtccgtatcacccagttccaggaaaacaccattgccgaactggccaagcacgtcgctggcctctacaaggacggcaacaagctgcaaggactggtgcttgacctgcgtaacgacccgggtggcctgttgcatggcgcgatcggcgtctccgcggccttcctgccgccggacgtcaaggtggtttccaccgatggccgcactgaagatgccaagcaggaattcagagcccggacgcaggactatcagcgcggcaccaaggaagattcgctgaagggcatgccgatcgaagccaagaatgtgccgatggtcgtcctggtcaatggcggctcagcctcggcttccgaaatcgttgccggcgcattgcaggatcacaagcgcgccgtcatcgtcggcacccagaccttcggcaagggctccgtgcaatccgtgctgccactccccggcaacaccgcgatcaagctgaccacggcccgctactacacgccgtcggggcgttccatccaggccaagggcatcacaccggacatcgtcgtcgaggaaagcctgaatggcaacgccgccgcatcaatgcgtctgcgcgaggccgatctggaccgccacctgagcaacgaccgcgacaaggaagccggcaaggaacttccgaaggccgacaccaagccgcaggccaagacctcgccgaaatccggcaaggacaaaaacggcaaggaagacgccgaagacgaactgccgcaacgactggaatatgcgagcaagagcgattaccaattccagcaggcgataaacctactcaagggtctgcagatcatgcagaataaagcccaatag

SEQ ID NO: 41059 - protein, 480 aa, Dechloromonas aromatica RCB
MGQLEMSKTKTISLTVGAFVAGALISLNFPALADKEAKPGLPIEELRTFAEVYSAIKQGYVEPVEDKKMITNAISGMLSNLDPHSAYLDADAFKDLQVGTQGEFGGLGIEVGMEDGLVKVVSPIEDTPAYRAGVKSGDLIFKLDDTMVKGLTLSEAVKKMRGKPKTPIKLSIIRKGETKPIELTLIREVIKVQSVKSKLIEPGYGWVRITQFQENTIAELAKHVAGLYKDGNKLQGLVLDLRNDPGGLLHGAIGVSAAFLPPDVKVVSTDGRTEDAKQEFRARTQDYQRGTKEDSLKGMPIEAKNVPMVVLVNGGSASASEIVAGALQDHKRAVIVGTQTFGKGSVQSVLPLPGNTAIKLTTARYYTPSGRSIQAKGITPDIVVEESLNGNAAASMRLREADLDRHLSNDRDKEAGKELPKADTKPQAKTSPKSGKDKNGKEDAEDELPQRLEYASKSDYQFQQAINLLKGLQIMQNKAQ

SEQ ID NO: 41060 - DNA, 1440 bp, Polaromonas sp. JS666
  CDS (1)..(1440)
atgggtcagaagctcaagatagcaggctggatttcgatcggtgccgtggcaggtgccctcaccacagtgcaactccaggccgtcgcgcgcggcggcctgacccccttgccgctcgaagagttgcagcaactggccgccgtttttggcatggtcaagaccgactacgtcgaaccggttgacgaaaagaaactcattacggacgccatttcgggcatggtggcaagcctggatccgcattccgtctatttcgacaaaaaatcgtacaaggagtttcgcgagggtacctccggacggtttgtgggtgtcggcatcgagatcagccaggaagacggcctggtcaaggtggtttccccgatagaaggctcacccgccgatcgcgcgggcctcaaacccaatgacctgatcacccggatcgacgacacggccgtcaagggcctgtccctcaacgacgcggtgaagaaaatgcgtggcgagcccaaaaccaaggtgctgctgacgatcttccgcaaggacgaaaaccgcacatttcccgtcaccatcacgcgcgaggaaattcgtacccagtctgtgcgcagcaaggtcgtcgagcccggttacgcctggatccggctgagccagttccaggagcgcacggtggaagattttgtcaccaagctggaacagatctacaagcaggagcccaacctcaagggcctggtgctggacctgcgcaacgaccccggcggcttgctggatgcggccgttgcggtgtcagccgccttcctgccggagaacgtcacggtggtctccaccaacggccagctggcagaaagcaaattcacctacaaggcgtccccggagttttaccagcgccgcaacggagctgatcccctgaagcgcctgcccgcggccatcaagaaggtgccgctggtggtgctcgtcaatgaaggctcagcctccgccagcgagatcgtggcaggtgcccttcaggactacaaacgcgccaccatcatgggcaaccagactttcggcaaaggctcggtccagaccgtgcgcccgctgggccctgataccggcatcaagctcaccacggcccgttactacacccccagcggcaaatccatccaggcgcgcggcatcgttcccgacgtgatggtggacgacaccgccgaaggcagcccgtttgccgcattgcgcacgcgcgaagccgatctggaaaagcatctcaacagcggccagggctctgaagtcaaggatgccagccgggaaaaagcccgcgaggaagccttgaagcgcctggaagaagaggccaaaaagacgccggagcagcgccgcccgcccgaactgggcagcgacaaggacttccagctggcgcaggccatcaaccagctcaagggccggccggtgctggtcagcaagacggcggtggtcgagcccaaaaacgagaaaaaagaaaactag

SEQ ID NO: 41061 - protein, 479 aa, Polaromonas sp. JS666
MGQKLKIAGWISIGAVAGALTTVQLQAVARGGLTPLPLEELQQLAAVFGMVKTDYVEPVDEKKLITDAISGMVASLDPHSVYFDKKSYKEFREGTSGRFVGVGIEISQEDGLVKVVSPIEGSPADRAGLKPNDLITRIDDTAVKGLSLNDAVKKMRGEPKTKVLLTIFRKDENRTFPVTITREEIRTQSVRSKVVEPGYAWIRLSQFQERTVEDFVTKLEQIYKQEPNLKGLVLDLRNDPGGLLDAAVAVSAAFLPENVTVVSTNGQLAESKFTYKASPEFYQRRNGADPLKRLPAAIKKVPLVVLVNEGSASASEIVAGALQDYKRATIMGNQTFGKGSVQTVRPLGPDTGIKLTTARYYTPSGKSIQARGIVPDVMVDDTAEGSPFAALRTREADLEKHLNSGQGSEVKDASREKAREEALKRLEEEAKKTPEQRRPPELGSDKDFQLAQAINQLKGRPVLVSKTAVVEPKNEKKEN

SEQ ID NO: 41062 - DNA, 1395 bp, Scenedesmus obliquus
  CDS (1)..(1395)
atgcactcccggacaaactgcttgcaaaccagcgtccgagcaccgcaaccacacttcaggccatttactgcagtcaaaacatgtagacagcggtgcagcacaactgcagcagcagccaagcgtgatcaggcgcaagaacagcagccatggattcaggttgggctgggcctggcagctgctgccactgcagtggcagtgggcctgggggcagctgcgctgccggcgcaagcagtgacaagcgagcagctgctgttcctggaagcatggcgagcagtggacagggcttatgtggacaaatcgttcaacgggcagagctggttcaagctacgggagacgtaccttaagaaggagcccatggacaggcgggcgcagacatatgatgccatccgcaagctgctggcggtgctggacgaccccttcacgcgcttcttggagccctcacgcctggctgcgctgcggcgaggcacagcaggctctgttacaggtgtaggcttggagataacgtatgacggcggcagcggcaaagacgttgtagtgctgacgcctgcgcctggcgggccggcagagaaggctggtgcacgggctggtgatgtcattgtgacagtggatggcacggctgtgaaggggctgtcgctgtatgacgtgtctgatttgctgcaaggagaggctgactcacaggtggaggtggtgctgcatgcgcctggagcacccagcaacacgcgcacgctgcagctgacgcgccagaaagtgaccatcaacccagtcacgttcaccacctgcagcaacgtggcagcagcagcactgcctccaggtgccgcgaagcagcagctgggctatgtgcggctggccaccttcaacagcaacaccacagcagcagcacagcaggcgttcacagagctgagcaagcagggcgtggctggcttggtgctggacatacgcaacaacggcggcggcctgttcccagcaggtgtgaacgtggcgcgcatgctggtggaccggggtgatttggtgctcatcgcggacagccagggcatccgtgacatctactcggctgacggcaacagcatcgacagtgccacgccgctggtggtgctggtcaacaggggcacagcctccgcctcagaggtgcttgctggcgcgctgaaggacagcaagcggggcctcatagctggcgagcgcacctttggcaagggcctcattcagactgtggtggacttgtcggatggctctggcgtggctgtgacggttgcgcggtaccagacgccagctggcgttgacatcaacaagataggtgtcagtccagatgtgcagcttgacccagaggtgctgccgacagatctggagggggtgtgccgcgtgctggggtctgatgctgcgccgcggctgtttgggtga

SEQ ID NO: 41063 - protein, 464 aa, Scenedesmus obliquus
MHSRTNCLQTSVRAPQPHFRPFTAVKTCRQRCSTTAAAAKRDQAQEQQPWIQVGLGLAAAATAVAVGLGAAALPAQAVTSEQLLFLEAWRAVDRAYVDKSFNGQSWFKLRETYLKKEPMDRRAQTYDAIRKLLAVLDDPFTRFLEPSRLAALRRGTAGSVTGVGLEITYDGGSGKDVVVLTPAPGGPAEKAGARAGDVIVTVDGTAVKGLSLYDVSDLLQGEADSQVEVVLHAPGAPSNTRTLQLTRQKVTINPVTFTTCSNVAAAALPPGAAKQQLGYVRLATFNSNTTAAAQQAFTELSKQGVAGLVLDIRNNGGGLFPAGVNVARMLVDRGDLVLIADSQGIRDIYSADGNSIDSATPLVVLVNRGTASASEVLAGALKDSKRGLIAGERTFGKGLIQTVVDLSDGSGVAVTVARYQTPAGVDINKIGVSPDVQLDPEVLPTDLEGVCRVLGSDAAPRLFG

SEQ ID NO: 41064 - DNA, 1275 bp, Nostoc punctiforme
  CDS (1)..(1275)
atgttcaagcaaaaatcgatcgtcaggatagaactcgccgttattgccgcaatcctggcaggaactagtctctacacttctgaagttctaggtaaaactcaagctagccctcaaaaactagtggatgaggtgtggcaaatcctagataaaaattatgttgatagcaattttaaccatcaagattggaaagcaattcgacagcagtatcttagccgatcttatagttctaagaaagaggcttatggcgcaattcaagaaatggtgtctaaattaggcgatcgctacaccgagttttacgacccccaggaatttaaagccctaaatagcgatatttctggcaacctcagtggtgtagggctggaactggcagaaaatgaaaagactaaagctttaactgttgttgctccaattgaaggaacgcctgcttttaaagcgggtattttgccgggtgatttaattgtccagattaacggtcaaatcactcaaggaatgaaaatagaggatgccgttaagcggattgtgggcccagtgggaaccgaagtagtactcacgattaaacggggtagccaatcccaaactttcaagcttacccgtgcaaatattgctatccaccctgtaacttacaacacccaaacgacggcagcgggtaagattggttatattcgtttaccagagtttacgcagactgcacccgcccagatgcatcgggcaattgaagcactagaaaaacaacaggtgcaaggttacgttttggatctgcgttccgatccaggtggactgctggatgcgagtttgcaaattgccagtatgtggttaaaacaaggagcaatcgtgtctttggtaaatcgagatcgagttaaagatagttacaatgcgtcgggacatcctctcaccaacaaacccttagtgatactggtcgataaaggatctgccagcgccagcgaaattctgtcaggagcgctgcaagatgataatcgcgccacgttagtagggactcgcactttcgggaaaggtttagttcaagctgtagagccactggacgatggttcggggttgaaactaacgatcgccaaatactacacaccaaaaggtcgagatatcaatcatgttggcattgcaccagatattaccgtggagttaagcgaggcacaacagaaagcattagtagaaaaccgaaccttggggacattagccgatcctcagtatgctagcgccgttgctgacttgggcaaattgattcagtctggggccaatgcgtgtgagtttgcagggtga

SEQ ID NO: 41065 - protein, 424 aa, Nostoc punctiforme
MFKQKSIVRIELAVIAAILAGTSLYTSEVLGKTQASPQKLVDEVWQILDKNYVDSNFNHQDWKAIRQQYLSRSYSSKKEAYGAIQEMVSKLGDRYTEFYDPQEFKALNSDISGNLSGVGLELAENEKTKALTVVAPIEGTPAFKAGILPGDLIVQINGQITQGMKIEDAVKRIVGPVGTEVVLTIKRGSQSQTFKLTRANIAIHPVTYNTQTTAAGKIGYIRLPEFTQTAPAQMHRAIEALEKQQVQGYVLDLRSDPGGLLDASLQIASMWLKQGAIVSLVNRDRVKDSYNASGHPLTNKPLVILVDKGSASASEILSGALQDDNRATLVGTRTFGKGLVQAVEPLDDGSGLKLTIAKYYTPKGRDINHVGIAPDITVELSEAQQKALVENRTLGTLADPQYASAVADLGKLIQSGANACEFAG

SEQ ID NO: 41066 - DNA, 1620 bp, Spinacia oleracea
  CDS (1)..(1620)
atggaggttatctcgcgcctcacctttgcttccgtttcttatcccttcatttcttccaaccttaatccaacacccatgctcaattctttcaatttcagggtgctttcctggaacagtgcccccacaaatgttgcagaagctcatctccaccgccttttactgaggaaattgaatcctgctaatgatcgggttgttgggatctctaactttggttgttcatgccggttagatctttggccaagttggagacgtcataagaggttatttttccagaatggtgtatctacaataaggtgggaggtcaagaagtgcagtcccaaattttataagatagtcagcaactatgaaaaatgcaaacgtcatatctatgtcccctctgttcgtttggttgttggagttgtattgcttatgtctgtttccgtagctttaaaccaggacccatcttggtccctttctgaggagaatcgaattttcctagaagcgtggagaacaatagatcgtgcttatgttgacaaaacttttaatggacaaagttggtttcgctatagggagaatgcactgcgcaatgagccgatgaacagcagagaagagacatataccgcaataagaaagatggttgctacactgaatgatccattcactcgttttctggaacccgaaaaattaaagagtttgcggtctggaactcagagttcgcttacgggtgtagggatatctattggccccaccgccgttgaccaatcatccactggattagttgtaatctcagctactcctggggctcctgccagtagggccggcatcttgcctggtgatgtaatattggcaattgatgatgcaagtactgacaaaatgggcatatatgaggcagcaaatatcttacagggacctgatggaagttctgttgatttgactatttgcagcagggatgagataaaacatgtggtgctgaagcgtgagagaataactctaagcccagtaaaatccagattatgtgagatgcctggttcagcaaaggatgctcctccaaaagttggatatatcaagttaacaacgttcactgagaatgcttctgatgcagtaaaggaagctatagagacacttagaagtaacaatgttaatgcttttgtgctggaccttcgggataatagcggtggtctctttccagagggaatcgagatagccaaaatttggttgaacaaaggagttattgtatatatatgtgatagtcgtggtgttcgtgatatatatgatgttgaagggagcagtgctgtagctggttcagaacctcttgttgttctggtgaacaagggaactgcaagtgctagtgaaatattagctggggcattaaaggacaagaaacgagcagtggtatttggagagcccacatatggaaagggcaagatacagtcagttttcgagctatctgatggatctggcttagcagtcacagttgctcgctatgagactcctgctcacacagatattggcaaggtgggaatcaaaccagatcatcctctcccagcatcttttccaaaggatgaaaatgatttctgcacctgcgtccaagatccatcgtctacttgttatctcaacggcgtacaactcttttcaagatga

SEQ ID NO: 41067 - protein, 539 aa, Spinacia oleracea
MEVISRLTFASVSYPFISSNLNPTPMLNSFNFRVLSWNSAPTNVAEAHLHRLLLRKLNPANDRVVGISNFGCSCRLDLWPSWRRHKRLFFQNGVSTIRWEVKKCSPKFYKIVSNYEKCKRHIYVPSVRLVVGVVLLMSVSVALNQDPSWSLSEENRIFLEAWRTIDRAYVDKTFNGQSWFRYRENALRNEPMNSREETYTAIRKMVATLNDPFTRFLEPEKLKSLRSGTQSSLTGVGISIGPTAVDQSSTGLVVISATPGAPASRAGILPGDVILAIDDASTDKMGIYEAANILQGPDGSSVDLTICSRDEIKHVVLKRERITLSPVKSRLCEMPGSAKDAPPKVGYIKLTTFTENASDAVKEAIETLRSNNVNAFVLDLRDNSGGLFPEGIEIAKIWLNKGVIVYICDSRGVRDIYDVEGSSAVAGSEPLVVLVNKGTASASEILAGALKDKKRAVVFGEPTYGKGKIQSVFELSDGSGLAVTVARYETPAHTDIGKVGIKPDHPLPASFPKDENDFCTCVQDPSSTCYLNGVQLFSR

SEQ ID NO: 41068 - DNA, 1620 bp, Spinacia oleracea
  CDS (1)..(1620)
atggaggttatctcgcgcctcacctttgcttccgtttcttatcccttcatttcttccaaccttaatccaacacccatgctcaattctttcaatttcagggtgctttcctggaacagtgcccccacaaatgttgcagaagctcatctccaccgccttttactgaggaaattgaatcctgctaatgatcgggttgttgggatctctaactttggttgttcatgccggttagatctttggccaagttggagacgtcataagaggttatttttccagaatggtgtatctacaataaggtgggaggtcaagaagtgcagtcccaaattttataagatagtcagcaactatgaaaaatgcaaacgtcatatctatgtcccctttgttcgtttggttgttggagttgtattgcttatgtctgtttccgtagctttaaaccagggcccatcttggtccctttctgaggagaatcgaattttcctagaagcgtggagaacaatagatcgtgcttatgttgacaaaacttttaatggacaaagttggtttcgctatagggagaatgcactgcgcaatgagccgatgaacagcagagaagagacatataccgcaataagaaagatggttgctacactgaatgatccattcactcgttttctggaacccgaaaaattaaagagtttgcggtctggaactcagagttcgcttacgggtgtagggatatctattggccccaccgccgttgaccaatcatccactggattagttgtaatctcagctactcctggggctcctgccagtagggccggcatcttgcctggtgatgtaatattggcaattgatgatgcaagtactgacaaaatgggcatatatgaggcagcaaatatcttacagggacctgatggaagttctgttgatttgactatttgcagcagggatgagataaaacatgtggtgctgaagcgtgagagaataactctaagcccagtaaaatccagattatgtgagatgcctggttcagcaaaggatgctcctccaaaagttggatatatcaagttaacatcgttcactgagaatgcttctgatgcagtaaaggaagctatagagacacttagaagtaacaatgttaatgcttttgtgctggaccttcgagataatagcggtggtctctttccagagggaatcgagatagccaaaatttggttgaacaaaggagttattgtatatatatgtgatagtcgtggtgttcgtgatatatatgatgttgaagggagcagtgctgtagctggttcagaacctcttgttgttctggtgaacaagggaactgcaagtgctagtgaaatattagctggggcattaaaggacaacaaacgagcagtggtatttggagagcccacatatggaaagggcaagatacagtcagttttcgagctatctgatggatctggcttagcagtcacagttgctcgctatgagactcctgctcacacagatattgacaaggtgggaatcaaaccagatcatcctctcccagcatcttttccaaaggatgaaaatgatttctgcacctgcgtccaagatccatcgtctacttgttatctcaacggcgtacaactcttttcaagatga

SEQ ID NO: 41069 - protein, 539 aa, Spinacia oleracea
MEVISRLTFASVSYPFISSNLNPTPMLNSFNFRVLSWNSAPTNVAEAHLHRLLLRKLNPANDRVVGISNFGCSCRLDLWPSWRRHKRLFFQNGVSTIRWEVKKCSPKFYKIVSNYEKCKRHIYVPFVRLVVGVVLLMSVSVALNQGPSWSLSEENRIFLEAWRTIDRAYVDKTFNGQSWFRYRENALRNEPMNSREETYTAIRKMVATLNDPFTRFLEPEKLKSLRSGTQSSLTGVGISIGPTAVDQSSTGLVVISATPGAPASRAGILPGDVILAIDDASTDKMGIYEAANILQGPDGSSVDLTICSRDEIKHVVLKRERITLSPVKSRLCEMPGSAKDAPPKVGYIKLTSFTENASDAVKEAIETLRSNNVNAFVLDLRDNSGGLFPEGIEIAKIWLNKGVIVYICDSRGVRDIYDVEGSSAVAGSEPLVVLVNKGTASASEILAGALKDNKRAVVFGEPTYGKGKIQSVFELSDGSGLAVTVARYETPAHTDIDKVGIKPDHPLPASFPKDENDFCTCVQDPSSTCYLNGVQLFSR

SEQ ID NO: 41070 - DNA, 1401 bp, Bacillus subtilis
  CDS (1)..(1401)
ttgaaacggcaattaaaactgttttttattgtgctgatcactgcagttgtcgcttcggcgcttactttatttattacgggcaattccagtatcctgggccaaaaatcagcaagcacaggagacagcaagttcgacaaattaaataaagcgtatgagcaaatcaaaagtgattattaccaaaaaacagatgatgacaaattagtagacggagcaattaaaggaatgattcaatcactggatgatccgtattctacatatatggatcaagagcaagcgaaatcattcgacgagacgatttcagcatcttttgaaggaatcggagcccaagtagaggagaaagacggagaaatccttattgtatccccaattaaaggttcacctgctgaaaaagccggtatcaaaccgagggaccaaatcattaaggtaaatggaaaaagcgtaaaaggcatgaatgtaaatgaagccgtcgctttaatccgaggcaaaaagggcacaaaggtgaagcttgaactgaacagagcgggagtggggaatatcgatctttccattaagcgcgataccattcctgtagagactgtctattcagagatgaaagacaacaacatcggagaaattcaaatcacttctttctctgaaacaacagctaaagagctgacagatgcgattgacagtttagagaaaaaaggcgccaaaggctatattttagacttgagaggcaacccgggcggcttaatggaacaggcgattacgatgagcaacctgttcattgataaagggaaaaacatcatgcaggttgaatacaaaaacggttcaaaagaagtcatgaaggccgaaaaagaacggaaagtgaccaagccgaccgtcgttttagtaaatgacggtacagcaagtcgcagccgaaattatggccgctgccttcatgaatcgtcaaacgtaccgttaatcggcgagacgacattcggcaaaggtacagtacaaacggcaaaagaatatgatgatggctctaccgtcaaactgacagttgccaaatggctgactgctgatggcgaatggattcacaaaaaaggcatcaagcctcaagtgaaagcagagctgcctgattacgcgaagctgccgtatttggacgcagataaaacgtacaaatcaggtgatacaggcacaaacgtcaaagtggctcagaaaatgctcaaagcacttggttacaaggtaaaggttaacagtatgtatgaccaggattttgtatctgtcgtcaaacagttccagaaaaaagagaagctgaatgaaacaggcatactgactggcgatacaacaacgaaattaatgatagaacttcaaaagaagctgtctgataatgatacgcaaatggaaaaggcaattgaaacactgaaaaaagaaatgtaa

SEQ ID NO: 41071 - protein, 466 aa, Bacillus subtilis
MKRQLKLFFIVLITAVVASALTLFITGNSSILGQKSASTGDSKFDKLNKAYEQIKSDYYQKTDDDKLVDGAIKGMIQSLDDPYSTYMDQEQAKSFDETISASFEGIGAQVEEKDGEILIVSPIKGSPAEKAGIKPRDQIIKVNGKSVKGMNVNEAVALIRGKKGTKVKLELNRAGVGNIDLSIKRDTIPVETVYSEMKDNNIGEIQITSFSETTAKELTDAIDSLEKKGAKGYILDLRGNPGGLMEQAITMSNLFIDKGKNIMQVEYKNGSKEVMKAEKERKVTKPTVVLVNDGTASRSRNYGRCLHESSNVPLIGETTFGKGTVQTAKEYDDGSTVKLTVAKWLTADGEWIHKKGIKPQVKAELPDYAKLPYLDADKTYKSGDTGTNVKVAQKMLKALGYKVKVNSMYDQDFVSVVKQFQKKEKLNETGILTGDTTTKLMIELQKKLSDNDTQMEKAIETLKKEM

SEQ ID NO: 41072 - DNA, 1560 bp, Arabidopsis thaliana
  CDS (1)..(1560)
atggaaaaagttgtaaccctaaatcatgatctacctctgttacacttcccgaattctcggaaacccttttcgattccatctccgattcttcggatttcgagcttcaagcgtcataagaaacgttcttgtcttgcatcgtcttcgcgtctagggttctatacagagaccaagaccgtttcagagagccatggtgtgatagttgacaacagtaccatcggaagaagattgcttggtttagccgcagccgtttcagtagcggtttctttgtcgatcttttgtgattccccggcactagctgagtctctaacgatcgctttccctgtttcacgtgctcgtgaggtgatcgagacgatggtggaaatgtttcctctaagatcagcagatgctgcttatggaaagctcaaagctatgctctctacgcttggtgatccctttactcgactcattaccccaaaggagtaccaaagtttcagaattggcagcgatggaaatctccaaggtgttggccttttcataaactcagaaccaagaacaggtcacctggttagtgatcaaacacatcttgaaacccaaataagcttggtctttggtctttttgttcattttctgagcatgaacccggcagatcgtgctggtatacatgaaggcgaggagttagtcgagataaatggtgagaaattagatgatgttgatagtgaagcagcagcacagaagctgagaggccgagttggaacatttgttaccataaaacttaaaaatgtactattcgggacagattctggtattagagaggtaacagttaccgctgtttctgttagatgtgtcaagttacctcgagattacattaagctatctccaatatccagtgctataatcccacatacaacacctgatggacgtttagcgaagacaggttatgtcaaactcacagcgttttcacagactgcagcgtccgatatggaaaatgcggtgcacgagatggagaatcaggatgttcagtcatacattctagacctaaggaacaatccgcttttggctattccatatcagggaggtctggttagagctggtcttgatgttgcacaattatggcttgacggagatgagactcttgtgtatacaatcgatcgagaaggggttacatcaccgatcaacatgatcaatggacacgctgtgacacatgatccacttgttgtgcttgtgaatgaaggaagtgctagtgcaagtgaaattttggcaggtgctttacacgataatggtcgagctatacttgtcggtaaccggacatttgggaaagggaaaattcaaagcataacagagctaaacgatgggtcggctttgtttgtgacggtggctaagtatttgtctccgtctttacacgaaattgatcaagtagggattgcacctgatgtacagtgtaccacaggtatgatcgattctttgaccgctgagatagttgagaagatgaacagttcggttccattgcttgaagcagactcatgtgttatggtcgctgagcacgaacttgaggctcgacgatctaatggaacagcttcttga

SEQ ID NO: 41073 - protein, 519 aa, Arabidopsis thaliana
MEKVVTLNHDLPLLHFPNSRKPFSIPSPILRISSFKRHKKRSCLASSSRLGFYTETKTVSESHGVIVDNSTIGRRLLGLAAAVSVAVSLSIFCDSPALAESLTIAFPVSRAREVIETMVEMFPLRSADAAYGKLKAMLSTLGDPFTRLITPKEYQSFRIGSDGNLQGVGLFINSEPRTGHLVSDQTHLETQISLVFGLFVHFLSMNPADRAGIHEGEELVEINGEKLDDVDSEAAAQKLRGRVGTFVTIKLKNVLFGTDSGIREVTVTAVSVRCVKLPRDYIKLSPISSAIIPHTTPDGRLAKTGYVKLTAFSQTAASDMENAVHEMENQDVQSYILDLRNNPLLAIPYQGGLVRAGLDVAQLWLDGDETLVYTIDREGVTSPINMINGHAVTHDPLVVLVNEGSASASEILAGALHDNGRAILVGNRTFGKGKIQSITELNDGSALFVTVAKYLSPSLHEIDQVGIAPDVQCTTGMIDSLTAEIVEKMNSSVPLLEADSCVMVAEHELEARRSNGTAS

SEQ ID NO: 41074 - DNA, 1305 bp, Bartonella bacilliformis
  CDS (1)..(1305)
atgattcgtaaagttattttttttgtcgctggggtttttctcagcgccagtttgatagtcatggcgcagtctattactacgaataatgaacaaaatacttataaacaattggctagatttggtgatatttttgagcgggtgcgcacgcaatatgtaacaattccggatgatcaaaaacttattgaaaatgctattaatggtatgctgttgtctctcgatccacattcatcttatatggatgctgaaaaagcgaaagatatgcgggattctacaaaaggagaatttggaggtcttgggattgaagtaactatggagaataatttaattaaagttgtttctccgatagatgacacccctgctgcaaaagcaggtgttttagcaggagatttcatttcaaaaattgatgggaaacagatcagtggtcaaactttgaatgaggctgtcgaccaaatgcgggggcctgctggaacaccgattacgctgacaattaatcgctttggtgttgataagccactcgatatcaagattgttcgtgatatcataaaagtaaaagcagttaagtatcgtgttgaaggtgatattggttatttaagacttatccagtttacggaaaagactttttctgaccttcaagctgcgattaaagatattcagtctaaaatccccacagataaattaaaaggatatgttcttgatttgcggcttaatcctggtggtcttttagatcaggctattagtgttacagatgcttttcttaataaaggtgaaattgtttcaactcgtggccgcaagcaaaatgatgtgatgagatttgatgctaagctaggggatttgactgatgaaaagcctattattgtgcttattaatggtggttcagcgagtgcttctgaaattgttgcaggtgccttacaagatcaccgtcgtgctacaattataggaacgcaatcttttggtaaggggtctgttcagacgattatccctttaggtgaaaatggtgccttacgcttgactacagcactttattacacgccatctggtacatcaattcaagggattgggatcacgccggatattgttgtagagcaaccgttgcctgaaaaatataaagggtatgatgtaacgcttggtgaatctgaattaaggggtcatatcaaggggaagcaggagagcgataaaggatccggttcagctgcttttgttccaagagatcccaaggatgatgttcaattgaatgaggcttataagcttttgcgaggtgaaatcactcatgcagcatttccacctgaccccaataaggtgttttaa

SEQ ID NO: 41075 - protein, 434 aa, Bartonella bacilliformis
MIRKVIFFVAGVFLSASLIVMAQSITTNNEQNTYKQLARFGDIFERVRTQYVTIPDDQKLIENAINGMLLSLDPHSSYMDAEKAKDMRDSTKGEFGGLGIEVTMENNLIKVVSPIDDTPAAKAGVLAGDFISKIDGKQISGQTLNEAVDQMRGPAGTPITLTINRFGVDKPLDIKIVRDIIKVKAVKYRVEGDIGYLRLIQFTEKTFSDLQAAIKDIQSKIPTDKLKGYVLDLRLNPGGLLDQAISVTDAFLNKGEIVSTRGRKQNDVMRFDAKLGDLTDEKPIIVLINGGSASASEIVAGALQDHRRATIIGTQSFGKGSVQTIIPLGENGALRLTTALYYTPSGTSIQGIGITPDIVVEQPLPEKYKGYDVTLGESELRGHIKGKQESDKGSGSAAFVPRDPKDDVQLNEAYKLLRGEITHAAFPPDPNKVF

SEQ ID NO: 41076 - DNA, 1284 bp, Synechocystis sp
  CDS (1)..(1284)
atgggtaaacggacaaggcggttttgggctttagctttttctttgctgatgggggccctgatttatctgggcaatacaccgtcggccttggctttcaccgaggaacaaaagctactgttgcaatcctggcgtttggtcaaccaatcctatctcgatgaaacctttaaccatcaaaattggtggctgttgcgggagaagtacgttaaacgtcccctccggaaccgggaagaaacctacacggcgatcgaagaaatgctcgctaccctggatgaaccctttacccgcttactgcgtccggaacagtacggcaatctccaggtgaccaccactggtgagctatcgggggtaggtctgcaaatcaacatcaaccctgaaaccaaccagttagaaattatggcccccctggccggttcccctgcggaggaggccgggctgcaaccccatgaccaaattttggcgatcgacggtgtagatacccaaaccctgagcttagacgaagcagcggccagaatgcggggcccaaaaaacaccaaagtttccctggaaattctgtcagcgggcaccgaagtaccccaagaatttaccctgactcggcagttaatttccctcagtccggtggcggcccaattggacgattcccgcccaggtcaatcggtgggttacattcgcctcagtcaatttagtgccaatgcctataaagaagtagcccacgctctgcatcaacttgaggaacagggggccgacggttatatcttggatttgcgtaacaaccccggtggcttactccaggctggtattgacattgctcggttgtggttaccggaaagcaccattgtctacaccgttaatcgccaaggcacccaggaaagtttcactgccaatggagaagcggcgaccgatcgcccgttggtggtgttggtcaaccagggtactgccagtgccagcgaaattttagccggagctttgcaggataatcagcgggccactctagtgggggaaaaaacctttggtaagggtttgattcaatccttgtttgaactatccgatggggccggcattgccgtcacggtggccaaatacgaaaccccccaacatcacgacatccataaactgggcattatgcccgatgaagtggtggagcaacccctgattagctttgcggaaattacttcccccgccgatgtgcaataccaagccgccttagatttgctcaccggaggagtggcaatcgcccataaatcttcttcaattcccgccatggcaacggctcacaagcccaactaa

SEQ ID NO: 41077 - protein, 427 aa, Synechocystis sp
MGKRTRRFWALAFSLLMGALIYLGNTPSALAFTEEQKLLLQSWRLVNQSYLDETFNHQNWWLLREKYVKRPLRNREETYTAIEEMLATLDEPFTRLLRPEQYGNLQVTTTGELSGVGLQININPETNQLEIMAPLAGSPAEEAGLQPHDQILAIDGVDTQTLSLDEAAARMRGPKNTKVSLEILSAGTEVPQEFTLTRQLISLSPVAAQLDDSRPGQSVGYIRLSQFSANAYKEVAHALHQLEEQGADGYILDLRNNPGGLLQAGIDIARLWLPESTIVYTVNRQGTQESFTANGEAATDRPLVVLVNQGTASASEILAGALQDNQRATLVGEKTFGKGLIQSLFELSDGAGIAVTVAKYETPQHHDIHKLGIMPDEVVEQPLISFAEITSPADVQYQAALDLLTGGVAIAHKSSSIPAMATAHKPN

SEQ ID NO: 41078 - DNA, 2049 bp, Salmonella typhimurium
  CDS (1)..(2049)
atgaacactttttttaggcttaccgcgttagctggcctgcttgcattagcaggccagtccttcgccgtggaagatattacgcgtgccgatcaaattcccgtactaaaggaagagacgcaacatgcgacggtgagcgagcgcgtaacgtcgcgttttacccgctcccattatcgccagttcgatctggatgaggcattttcggcaaagatttttgatcgctatctgaatcttctcgactatagccacaacgttttgttggcgagcgatgtcgagcagtttgcgaaaaagaaaaccgtgttgggcgatgagctgcgcacgggtaagctggatgttttttacgatctttataacctggcgcaaaagcgccggtttgaacgttaccagtacgcgctaaaagtgctggaacggccaatggatttcaccggaaacgatacgtttaacctggaccgcagtaaagcgccctggccgaaagatgaggctgagctaaatgcgctgtgggatggtaaagtgaaattcgatgagctcagcctgaaactcaccggcaagagcgacaaagaaattcgcgaaacgctgacgcgtcgctacaaattcgctattcgtcgcctggcgcagaccaacagtgaagatgtgttctcgctggcgatgaccgcttttgcgcgtgaaatcgacccgcatacgaattatctttctccccgcaataccgagcagtttaataccgaaatgagcctgtctctggaaggtatcggcgcggtgctgcaaatggatgacgattatactgtcattaactcattggttgccggcggcccggcagcgaagagcaagtcgattagcgtcggcgatcgtatcgtcggcgtagggcaggccggaaaaccgatggtcgacgttattggctggcgtcttgacgatgtggtggcgctgatcaaagggccgaaaggcagcaaggttcgactggaaatactgccggctggcaaagggacgaaaacgcgtattatcacgctgacgcgtgaacggattcgtcttgaagatcgcgcggttaaaatgtcggtgaaaaccgtcggcaaggaaaaagttggtgtactggatattccaggcttctatgttggcttgaccgatgatgtcaaagttcagcttcagaagctggaaaaacagaacgttaacagcatcgttatcgatctgcgttcaaacggcggtggggcgctgacggaagccgtttcgctttccggtctgtttatcccttctggtccgatagttcaggtgcgcgacaataacggtaaagtgcgtgaggatagcgacaccgacggcgtggtctactacaaaggcccgctggtggtgctggtcgatcgtttcagtgcctcggcatcggaaatcttcgctgccgcgatgcaggattatggccgcgcgctgattgtcggtgagccgaccttcggtaaaggtacggtacagcaatatcgttcgctaaaccgaatttacgatcagatgcttcgcccggaatggcctgcgctgggttcggtgcagtacaccattcagaagttttaccgtgtcaacggcggtagtacgcagcgtaaaggggtcacgccggatatcatcatgccgactggcaatgaagagacggaaaccggagaaaaatttgaagataacgccttgccgtgggatagcattgatgcggcgaaatacgtgaaatcggacgatttggccccgtttggcccggaattattgaaagaacacaacgcgcgtatcgccaaagatcctgagttccagtacatcatgaaggatatcgcacgtttcaatgccatgaaggataagcgcaacatcgtctctctgaattatgcgcagcgtgagaaagagaacaatgaagaagacgctctgcgtctggcgcgtattaacgatcggtttaaacgcgagggtaaaccgttgctgaagaaactggacgatctgccaaaggattaccaggagccggacccataccttgatgaaacggtgaagattgctctggacctggcgcatcttgaaaaagaaaaaccagcggagcaggcggcagccaataagtaa

SEQ ID NO: 41079 - protein, 682 aa, Salmonella typhimurium
MNTFFRLTALAGLLALAGQSFAVEDITRADQIPVLKEETQHATVSERVTSRFTRSHYRQFDLDEAFSAKIFDRYLNLLDYSHNVLLASDVEQFAKKKTVLGDELRTGKLDVFYDLYNLAQKRRFERYQYALKVLERPMDFTGNDTFNLDRSKAPWPKDEAELNALWDGKVKFDELSLKLTGKSDKEIRETLTRRYKFAIRRLAQTNSEDVFSLAMTAFAREIDPHTNYLSPRNTEQFNTEMSLSLEGIGAVLQMDDDYTVINSLVAGGPAAKSKSISVGDRIVGVGQAGKPMVDVIGWRLDDVVALIKGPKGSKVRLEILPAGKGTKTRIITLTRERIRLEDRAVKMSVKTVGKEKVGVLDIPGFYVGLTDDVKVQLQKLEKQNVNSIVIDLRSNGGGALTEAVSLSGLFIPSGPIVQVRDNNGKVREDSDTDGVVYYKGPLVVLVDRFSASASEIFAAAMQDYGRALIVGEPTFGKGTVQQYRSLNRIYDQMLRPEWPALGSVQYTIQKFYRVNGGSTQRKGVTPDIIMPTGNEETETGEKFEDNALPWDSIDAAKYVKSDDLAPFGPELLKEHNARIAKDPEFQYIMKDIARFNAMKDKRNIVSLNYAQREKENNEEDALRLARINDRFKREGKPLLKKLDDLPKDYQEPDPYLDETVKIALDLAHLEKEKPAEQAAANK

SEQ ID NO: 41080 - DNA, 24 bp, Primer
atgaacatgttttttaggcttacc

SEQ ID NO: 41081 - DNA, 22 bp, Primer
ttacttgacgggagcgggttgt

SEQ ID NO: 41082 - protein, 466 aa, consensus
  MISC_FEATURE (1)..(466): consensus for the disclosure of xaa see table XV
DPXXXXXXXXXXXXXXXXXXXXXXXGXGXXXXXXXXXXXXXXXXXXXXXXXXXXXXXXXXXXXXXPAXXXGXXXXXDXXXXXXXXXXXXXXXXXXXXXXXXXXXXXXXXXGXXGXXXXLXXXXXXXXXXXXXXXXXXXXXXXXXXXXXRXXIXXXXXXXXXXXXXXXXXXXXXXXXXXXXXXXXXXFXXXXXXXXXXXXXXXXXXXXXXXXXXXXXXXXXXXXXXDLRXNXGGXLXXXXXXXXXXXXXXXXXXXXXXXXXXXXXXXXXXXXXXXXXXXXXXXXXXXXXXXXXXXPXXVLXXXXSASASEIXXXAXXDXXRXXXXGXXXXFGKGXVQXXXXXXXXXXXXXXXXXXXXXXXXXXXXXXXXXXXXXXXXXXXXXXXTXXXXXXPXGXXXXXXXXXXXXXXXXXXXXXXXXXXXXXXXXXXXXXXXXXXXXXXXXXXXXXXXXXXXXXXXXXXXXGXXPD

SEQ ID NO: 41083 - protein, 31 aa, consensus
  MISC_FEATURE (1)..(31): consensus for the disclosure of xaa see table XV
XXXXXXXXXXXXXXXXXXXXXXXXXGXGXXX

SEQ ID NO: 41084 - protein, 119 aa, consensus
  MISC_FEATURE (1)..(119): consensus for the disclosure of xaa see table XV
XXXXXXXXXXXXXXXXXXXXXXXXXXXXXXXXXXXXXXXXXXXXXXXXXXXXXGXXXXXXXXXXXXXXXXXXXXXXXXXXXXRXXXXXXXXXXXXXXXXXXXXXXXXXXXXXXXXXXXF

SEQ ID NO: 41085 - protein, 27 aa, consensus
  MISC_FEATURE (1)..(27): consensus for the disclosure of xaa see table XV
XXXXXXDXXXXXGGXXXXXXXXXXXXX

SEQ ID NO: 41086 - protein, 42 aa, consensus
  MISC_FEATURE (1)..(42): consensus for the disclosure of xaa see table XV
XXXXXXXXXXASXXEXXXXXXXXXXXXXXXGXXXXXGKXXXQ

SEQ ID NO: 41087 - DNA, 2200 bp, Escherichia coli K12; identical to SEQ ID NO: 17198
  CDS (776)..(2200)

SEQ ID NO: 41088 - protein, 474 aa, Escherichia coli K12; identical to SEQ ID NO: 17199

SEQ ID NO: 41089 - DNA, 3053 bp, Arabidopsis thaliana (mouse-ear cress); identical to SEQ ID NO: 17200
  CDS (1)..(2556)

SEQ ID NO: 41090 - protein, 851 aa, Arabidopsis thaliana (mouse-ear cress); identical to SEQ ID NO: 17201

SEQ ID NO: 41091 - DNA, 1422 bp, Salmonella enterica subsp. enterica serovar Typhi; identical to SEQ ID NO: 17202
  CDS (1)..(1422)

SEQ ID NO: 41092 - protein, 473 aa, Salmonella enterica subsp. enterica serovar Typhi; identical to SEQ ID NO: 17203

SEQ ID NO: 41093 - DNA, 1497 bp, Mycobacterium leprae; identical to SEQ ID NO: 17204
  CDS (1)..(1497)

SEQ ID NO: 41094 - protein, 498 aa, Mycobacterium leprae; identical to SEQ ID NO: 17205

SEQ ID NO: 41095 - DNA, 2829 bp, Arabidopsis thaliana (mouse-ear cress); identical to SEQ ID NO: 17206
  CDS (1)..(2829)

SEQ ID NO: 41096 - protein, 942 aa, Arabidopsis thaliana (mouse-ear cress); identical to SEQ ID NO: 17207

SEQ ID NO: 41097 - DNA, 1491 bp, Methanobacterium thermoautotrophicum; identical to SEQ ID NO: 17208
  CDS (1)..(1491)

SEQ ID NO: 41098 - protein, 496 aa, Methanobacterium thermoautotrophicum; identical to SEQ ID NO: 17209

SEQ ID NO: 41099 - DNA, 1392 bp, Sinorhizobium meliloti; identical to SEQ ID NO: 17210
  CDS (1)..(1392)

SEQ ID NO: 41100 - protein, 463 aa, Sinorhizobium meliloti; identical to SEQ ID NO: 17211

SEQ ID NO: 41101 - DNA, 1503 bp, Mycobacterium tuberculosis; identical to SEQ ID NO: 17212
  CDS (1)..(1503)

SEQ ID NO: 41102 - protein, 500 aa, Mycobacterium tuberculosis; identical to SEQ ID NO: 17213

SEQ ID NO: 41103 - DNA, 2091 bp, Saccharomyces cerevisiae; identical to SEQ ID NO: 17214
  CDS (233)..(1720)

SEQ ID NO: 41104 - protein, 495 aa, Saccharomyces cerevisiae; identical to SEQ ID NO: 17215

SEQ ID NO: 41105 - DNA, 5981 bp, Saccharomyces cerevisiae; identical to SEQ ID NO: 17216
  CDS (2282)..(5578)

SEQ ID NO: 41106 - protein, 1098 aa, Saccharomyces cerevisiae; identical to SEQ ID NO: 17217

SEQ ID NO: 41107 - DNA, 2358 bp, Kluyveromyces marxianus var. lactis, Candida sphaerica; identical to SEQ ID NO: 17218
  CDS (722)..(2188)

SEQ ID NO: 41108 - protein, 488 aa, Kluyveromyces marxianus var. lactis, Candida sphaerica; identical to SEQ ID NO: 17219

SEQ ID NO: 41109 - DNA, 3170 bp, Saccharomyces cerevisiae; identical to SEQ ID NO: 17220
  CDS (147)..(2837)

SEQ ID NO: 41110 - protein, 896 aa, Saccharomyces cerevisiae; identical to SEQ ID NO: 17221

SEQ ID NO: 41111 - DNA, 1500 bp, Synechocystis sp; identical to SEQ ID NO: 17222
  CDS (1)..(1500)

SEQ ID NO: 41112 - protein, 499 aa, Synechocystis sp; identical to SEQ ID NO: 17223

SEQ ID NO: 41113 - DNA, 2586 bp, Arabidopsis thaliana (mouse-ear cress); identical to SEQ ID NO: 17224
  CDS (1)..(2586)

SEQ ID NO: 41114 - protein, 861 aa, Arabidopsis thaliana (mouse-ear cress); identical to SEQ ID NO: 17225

SEQ ID NO: 41115 - DNA, 2388 bp, Arabidopsis thaliana (mouse-ear cress); identical to SEQ ID NO: 17226
  CDS (1)..(2388)

SEQ ID NO: 41116 - protein, 795 aa, Arabidopsis thaliana (mouse-ear cress); identical to SEQ ID NO: 17227

SEQ ID NO: 41117 - DNA, 2676 bp, Schizosaccharomyces pombe; identical to SEQ ID NO: 17228
  CDS (1)..(2676)

SEQ ID NO: 41118 - protein, 891 aa, Schizosaccharomyces pombe; identical to SEQ ID NO: 17229

SEQ ID NO: 41119 - DNA, 2550 bp, Schizosaccharomyces pombe; identical to SEQ ID NO: 17230
  CDS (1)..(2550)

SEQ ID NO: 41120 - protein, 849 aa, Schizosaccharomyces pombe; identical to SEQ ID NO: 17231

SEQ ID NO: 41121 - DNA, 2835 bp, Schizosaccharomyces pombe; identical to SEQ ID NO: 17232
  CDS (1)..(2835)

SEQ ID NO: 41122 - protein, 944 aa, Schizosaccharomyces pombe; identical to SEQ ID NO: 17233

SEQ ID NO: 41123 - DNA, 2580 bp, Schizosaccharomyces pombe; identical to SEQ ID NO: 17234
  CDS (52)..(2505)

SEQ ID NO: 41124 - protein, 817 aa, Schizosaccharomyces pombe; identical to SEQ ID NO: 17235

SEQ ID NO: 41125 - DNA, 1993 bp, Schizosaccharomyces pombe; identical to SEQ ID NO: 17236
  CDS (266)..(1705)

SEQ ID NO: 41126 - protein, 479 aa, Schizosaccharomyces pombe; identical to SEQ ID NO: 17237

SEQ ID NO: 41127 - DNA, 2621 bp, unidentified; identical to SEQ ID NO: 17238
  CDS (25)..(2487)

SEQ ID NO: 41128 - protein, 820 aa, unidentified; identical to SEQ ID NO: 17239

SEQ ID NO: 41129 - DNA, 2640 bp, Helianthus annuus; identical to SEQ ID NO: 17240
  CDS (171)..(2510)

SEQ ID NO: 41130 - protein, 779 aa, Helianthus annuus; identical to SEQ ID NO: 17241

SEQ ID NO: 41131 - DNA, 1913 bp, Selaginella lepidophylla; identical to SEQ ID NO: 17242
  CDS (111)..(1913)

SEQ ID NO: 41132 - protein, 600 aa, Selaginella lepidophylla; identical to SEQ ID NO: 17243

SEQ ID NO: 41133 - DNA, 4351 bp, Caenorhabditis elegans; identical to SEQ ID NO: 17244
  CDS (112)..(3996)

SEQ ID NO: 41134 - protein, 1294 aa, Caenorhabditis elegans; identical to SEQ ID NO: 17245

SEQ ID NO: 41135 - DNA, 2637 bp, Debaryomyces hansenii; identical to SEQ ID NO: 17246
  CDS (1)..(2637)

SEQ ID NO: 41136 - protein, 878 aa, Debaryomyces hansenii; identical to SEQ ID NO: 17247

SEQ ID NO: 41137 - DNA, 1443 bp, Debaryomyces hansenii; identical to SEQ ID NO: 17248
  CDS (1)..(1443)

SEQ ID NO: 41138 - protein, 480 aa, Debaryomyces hansenii; identical to SEQ ID NO: 17249

SEQ ID NO: 41139 - DNA, 2403 bp, Yarrowia lipolytica; identical to SEQ ID NO: 17250
  CDS (1)..(2403)

SEQ ID NO: 41140 - protein, 800 aa, Yarrowia lipolytica; identical to SEQ ID NO: 17251

SEQ ID NO: 41141 - DNA, 3447 bp, Kluyveromyces lactis; identical to SEQ ID NO: 17252
  CDS (1)..(3447)

SEQ ID NO: 41142 - protein, 1148 aa, Kluyveromyces lactis; identical to SEQ ID NO: 17253

SEQ ID NO: 41143 - DNA, 2631 bp, Kluyveromyces lactis; identical to SEQ ID NO: 17254
  CDS (1)..(2631)

SEQ ID NO: 41144 - protein, 876 aa, Kluyveromyces lactis; identical to SEQ ID NO: 17255

SEQ ID NO: 41145 - DNA, 1437 bp, Acinetobacter sp; identical to SEQ ID NO: 17256
  CDS (1)..(1437)

SEQ ID NO: 41146 - protein, 478 aa, Acinetobacter sp; identical to SEQ ID NO: 17257

SEQ ID NO: 41147 - DNA, 1476 bp, Candida glabrata; identical to SEQ ID NO: 17258
  CDS (1)..(1476)

SEQ ID NO: 41148 - protein, 491 aa, Candida glabrata; identical to SEQ ID NO: 17259

SEQ ID NO: 41149 - DNA, 3198 bp, Candida glabrata; identical to SEQ ID NO: 17260
  CDS (1)..(3198)

SEQ ID NO: 41150 - protein, 1065 aa, Candida glabrata; identical to SEQ ID NO: 17261

SEQ ID NO: 41151 - DNA, 3345 bp, Candida glabrata; identical to SEQ ID NO: 17262
  CDS (1)..(3345)

SEQ ID NO: 41152 - protein, 1114 aa, Candida glabrata; identical to SEQ ID NO: 17263

SEQ ID NO: 41153 - DNA, 2673 bp, Candida glabrata; identical to SEQ ID NO: 17264
  CDS (1)..(2673)

SEQ ID NO: 41154 - protein, 890 aa, Candida glabrata; identical to SEQ ID NO: 17265

SEQ ID NO: 41155 - DNA, 2013 bp, Cryptococcus neoformans var; identical to SEQ ID NO: 17266
  CDS (1)..(2013)

SEQ ID NO: 41156 - protein, 670 aa, Cryptococcus neoformans var; identical to SEQ ID NO: 17267

SEQ ID NO: 41157 - DNA, 1302 bp, Picrophilus torridus; identical to SEQ ID NO: 17268
  CDS (1)..(1302)

SEQ ID NO: 41158 - protein, 433 aa, Picrophilus torridus; identical to SEQ ID NO: 17269

SEQ ID NO: 41159 - DNA, 1482 bp, Rhodopseudomonas palustris; identical to SEQ ID NO: 17270
  CDS (1)..(1482)

SEQ ID NO: 41160 - protein, 493 aa, Rhodopseudomonas palustris; identical to SEQ ID NO: 17271

SEQ ID NO: 41161 - DNA, 1440 bp, Corynebacterium diphtheriae; identical to SEQ ID NO: 17272
  CDS (1)..(1440)

SEQ ID NO: 41162 - protein, 479 aa, Corynebacterium diphtheriae; identical to SEQ ID NO: 17273

SEQ ID NO: 41163 - DNA, 2589 bp, Oryza sativa; identical to SEQ ID NO: 17274
  CDS (1)..(2589)

SEQ ID NO: 41164 - protein, 862 aa, Oryza sativa; identical to SEQ ID NO: 17275

SEQ ID NO: 41165 - DNA, 2812 bp, Oryza sativa; identical to SEQ ID NO: 17276
  CDS (53)..(2527)

SEQ ID NO: 41166 - protein, 824 aa, Oryza sativa; identical to SEQ ID NO: 17277

SEQ ID NO: 41167 - DNA, 2208 bp, Thermoproteus tenax; identical to SEQ ID NO: 17278
  CDS (1)..(2208)

SEQ ID NO: 41168 - protein, 735 aa, Thermoproteus tenax; identical to SEQ ID NO: 17279

SEQ ID NO: 41169 - DNA, 1479 bp, Mycobacterium paratuberculosis; identical to SEQ ID NO: 17280
  CDS (1)..(1479)

SEQ ID NO: 41170 - protein, 492 aa, Mycobacterium paratuberculosis; identical to SEQ ID NO: 17281

SEQ ID NO: 41171 - DNA, 1461 bp, Geobacter sulfurreducens; identical to SEQ ID NO: 17282
  CDS (1)..(1461)

SEQ ID NO: 41172 - protein, 486 aa, Geobacter sulfurreducens; identical to SEQ ID NO: 17283

SEQ ID NO: 41173 - DNA, 3333 bp, Ashbya gossypii; identical to SEQ ID NO: 17284
  CDS (1)..(3333)

SEQ ID NO: 41174 - protein, 1110 aa, Ashbya gossypii; identical to SEQ ID NO: 17285

SEQ ID NO: 41175 - DNA, 1485 bp, Ashbya gossypii; identical to SEQ ID NO: 17286
  CDS (1)..(1485)

SEQ ID NO: 41176 - protein, 494 aa, Ashbya gossypii; identical to SEQ ID NO: 17287

SEQ ID NO: 41177 - DNA, 3498 bp, Oryza sativa; identical to SEQ ID NO: 17288
  CDS (176)..(2875)

SEQ ID NO: 41178 - protein, 899 aa, Oryza sativa; identical to SEQ ID NO: 17289

SEQ ID NO: 41179 - DNA, 3048 bp, Neurospora crassa; identical to SEQ ID NO: 17290
  CDS (1)..(3048)

SEQ ID NO: 41180 - protein, 1015 aa, Neurospora crassa; identical to SEQ ID NO: 17291

SEQ ID NO: 41181 - DNA, 1572 bp, Neurospora crassa; identical to SEQ ID NO: 17292
  CDS (1)..(1572)

SEQ ID NO: 41182 - protein, 523 aa, Neurospora crassa; identical to SEQ ID NO: 17293

SEQ ID NO: 41183 - DNA, 2730 bp, Neurospora crassa; identical to SEQ ID NO: 17294
  CDS (1)..(2730)

SEQ ID NO: 41184 - protein, 909 aa, Neurospora crassa; identical to SEQ ID NO: 17295

SEQ ID NO: 41185 - DNA, 1488 bp, Synechococcus sp; identical to SEQ ID NO: 17296
  CDS (1)..(1488)

SEQ ID NO: 41186 - protein, 495 aa, Synechococcus sp; identical to SEQ ID NO: 17297

SEQ ID NO: 41187 - DNA, 1350 bp, Thermus thermophilus; identical to SEQ ID NO: 17298
  CDS (1)..(1350)

SEQ ID NO: 41188 - protein, 449 aa, Thermus thermophilus; identical to SEQ ID NO: 17299

SEQ ID NO: 41189 - DNA, 3862 bp, Caenorhabditis elegans; identical to SEQ ID NO: 17300
  CDS (30)..(3722)

SEQ ID NO: 41190 - protein, 1230 aa, Caenorhabditis elegans; identical to SEQ ID NO: 17301

SEQ ID NO: 41191 - DNA, 1590 bp, Magnaporthe grisea; identical to SEQ ID NO: 17302
  CDS (1)..(1590)

SEQ ID NO: 41192 - protein, 529 aa, Magnaporthe grisea; identical to SEQ ID NO: 17303

SEQ ID NO: 41193 - DNA, 1485 bp, Bradyrhizobium japonicum; identical to SEQ ID NO: 17304
  CDS (1)..(1485)

SEQ ID NO: 41194 - protein, 494 aa, Bradyrhizobium japonicum; identical to SEQ ID NO: 17305

SEQ ID NO: 41195 - DNA, 1449 bp, Corynebacterium efficiens; identical to SEQ ID NO: 17306
  CDS (1)..(1449)

SEQ ID NO: 41196 - protein, 482 aa, Corynebacterium efficiens; identical to SEQ ID NO: 17307

SEQ ID NO: 41197 - DNA, 2774 bp, Arabidopsis thaliana; identical to SEQ ID NO: 17308
  CDS (102)..(2690)

SEQ ID NO: 41198 - protein, 862 aa, Arabidopsis thaliana; identical to SEQ ID NO: 17309

SEQ ID NO: 41199 - DNA, 2583 bp, Oryza sativa; identical to SEQ ID NO: 17310
  CDS (1)..(2583)

SEQ ID NO: 41200 - protein, 860 aa, Oryza sativa; identical to SEQ ID NO: 17311

SEQ ID NO: 41201 - DNA, 1458 bp, Corynebacterium glutamicum; identical to SEQ ID NO: 17312
  CDS (1)..(1458)

SEQ ID NO: 41202 - protein, 485 aa, Corynebacterium glutamicum; identical to SEQ ID NO: 17313

SEQ ID NO: 41203 - DNA, 2358 bp, Xanthomonas campestris; identical to SEQ ID NO: 17314
  CDS (1)..(2358)

SEQ ID NO: 41204 - protein, 785 aa, Xanthomonas campestris; identical to SEQ ID NO: 17315

SEQ ID NO: 41205 - DNA, 1368 bp, Xanthomonas axonopodis; identical to SEQ ID NO: 17316
  CDS (1)..(1368)

SEQ ID NO: 41206 - protein, 455 aa, Xanthomonas axonopodis; identical to SEQ ID NO: 17317

SEQ ID NO: 41207 - DNA, 2574 bp, Solanum tuberosum; identical to SEQ ID NO: 17318
  CDS (1)..(2574)

SEQ ID NO: 41208 - protein, 857 aa, Solanum tuberosum; identical to SEQ ID NO: 17319

SEQ ID NO: 41209 - DNA, 1380 bp, Encephalitozoon cuniculi; identical to SEQ ID NO: 17320
  CDS (1)..(1380)

SEQ ID NO: 41210 - protein, 459 aa, Encephalitozoon cuniculi; identical to SEQ ID NO: 17321

SEQ ID NO: 41211 - DNA, 1398 bp, Ralstonia solanacearum; identical to SEQ ID NO: 17322
  CDS (1)..(1398)

SEQ ID NO: 41212 - protein, 465 aa, Ralstonia solanacearum; identical to SEQ ID NO: 17323

SEQ ID NO: 41213 - DNA, 1674 bp, Ralstonia solanacearum; identical to SEQ ID NO: 17324
  CDS (1)..(1674)

SEQ ID NO: 41214 - protein, 557 aa, Ralstonia solanacearum; identical to SEQ ID NO: 17325

SEQ ID NO: 41215 - DNA, 2214 bp, Pyrobaculum aerophilum; identical to SEQ ID NO: 17326
  CDS (1)..(2214)

SEQ ID NO: 41216 - protein, 737 aa, Pyrobaculum aerophilum; identical to SEQ ID NO: 17327

SEQ ID NO: 41217 - DNA, 3001 bp, Arabidopsis thaliana; identical to SEQ ID NO: 17328
  CDS (204)..(2306)

SEQ ID NO: 41218 - protein, 700 aa, Arabidopsis thaliana; identical to SEQ ID NO: 17329

SEQ ID NO: 41219 - DNA, 3272 bp, Oryza sativa; identical to SEQ ID NO: 17330
  CDS (247)..(2985)

SEQ ID NO: 41220 - protein, 912 aa, Oryza sativa; identical to SEQ ID NO: 17331

SEQ ID NO: 41221 - DNA, 1681 bp, Amanita muscaria; identical to SEQ ID NO: 17332
  CDS (101)..(1552)

SEQ ID NO: 41222 - protein, 483 aa, Amanita muscaria; identical to SEQ ID NO: 17333

SEQ ID NO: 41223 - DNA, 1344 bp, Thermoplasma volcanium; identical to SEQ ID NO: 17334
  CDS (1)..(1344)

SEQ ID NO: 41224 - protein, 447 aa, Thermoplasma volcanium; identical to SEQ ID NO: 17335

SEQ ID NO: 41225 - DNA, 1563 bp, Rhizobium loti; identical to SEQ ID NO: 17336
  CDS (1)..(1563)

SEQ ID NO: 41226 - protein, 520 aa, Rhizobium loti; identical to SEQ ID NO: 17337

SEQ ID NO: 41227 - DNA, 2637 bp, Oryza sativa; identical to SEQ ID NO: 17338
  CDS (1)..(2637)

SEQ ID NO: 41228 - protein, 878 aa, Oryza sativa; identical to SEQ ID NO: 17339

SEQ ID NO: 41229 - DNA, 1326 bp, Thermoplasma acidophilum; identical to SEQ ID NO: 17340
  CDS (1)..(1326)

SEQ ID NO: 41230 - protein, 441 aa, Thermoplasma acidophilum; identical to SEQ ID NO: 17341

SEQ ID NO: 41231 - DNA, 1389 bp, Streptomyces coelicolor; identical to SEQ ID NO: 17342
  CDS (1)..(1389)

SEQ ID NO: 41232 - protein, 462 aa, Streptomyces coelicolor; identical to SEQ ID NO: 17343

SEQ ID NO: 41233 - DNA, 2635 bp, Arabidopsis thaliana; identical to SEQ ID NO: 17344
  CDS (1)..(2604)

SEQ ID NO: 41234 - protein, 867 aa, Arabidopsis thaliana; identical to SEQ ID NO: 17345

SEQ ID NO: 41235 - DNA, 2843 bp, Zygosaccharomyces rouxii; identical to SEQ ID NO: 17346
  CDS (24)..(2726)

SEQ ID NO: 41236 - protein, 900 aa, Zygosaccharomyces rouxii; identical to SEQ ID NO: 17347

SEQ ID NO: 41237 - DNA, 3197 bp, Drosophila melanogaster; identical to SEQ ID NO: 17348
  CDS (662)..(3091)

SEQ ID NO: 41238 - protein, 809 aa, Drosophila melanogaster; identical to SEQ ID NO: 17349

SEQ ID NO: 41239 - DNA, 1503 bp, Pseudomonas anguilliseptica; identical to SEQ ID NO: 17350
  CDS (1)..(1503)

SEQ ID NO: 41240 - protein, 500 aa, Pseudomonas anguilliseptica; identical to SEQ ID NO: 17351

SEQ ID NO: 41241 - DNA, 1503 bp, Synechococcus sp; identical to SEQ ID NO: 17352
  CDS (1)..(1503)

SEQ ID NO: 41242 - protein, 500 aa, Synechococcus sp; identical to SEQ ID NO: 17353

SEQ ID NO: 41243 - DNA, 1395 bp, Rhizobium sp; identical to SEQ ID NO: 17354
  CDS (1)..(1395)

SEQ ID NO: 41244 - protein, 464 aa, Rhizobium sp; identical to SEQ ID NO: 17355

SEQ ID NO: 41245 - DNA, 1437 bp, Candida albicans; identical to SEQ ID NO: 17356
  CDS (1)..(1437)

SEQ ID NO: 41246 - protein, 478 aa, Candida albicans; identical to SEQ ID NO: 17357

SEQ ID NO: 41247 - DNA, 1515 bp, Emericella nidulans; identical to SEQ ID NO: 17358
  CDS (1)..(1515)

SEQ ID NO: 41248 - protein, 504 aa, Emericella nidulans; identical to SEQ ID NO: 17359

SEQ ID NO: 41249 - DNA, 2695 bp, Pichia angusta; identical to SEQ ID NO: 17360
  CDS (793)..(2220)

SEQ ID NO: 41250 - protein, 475 aa, Pichia angusta; identical to SEQ ID NO: 17361

SEQ ID NO: 41251 - DNA, 1542 bp, Schizosaccharomyces pombe; identical to SEQ ID NO: 17362
  CDS (1)..(1542)

SEQ ID NO: 41252 - protein, 513 aa, Schizosaccharomyces pombe; identical to SEQ ID NO: 17363

SEQ ID NO: 41253 - DNA, 1520 bp, Yarrowia lipolytica; identical to SEQ ID NO: 17364
  CDS (27)..(1436)

SEQ ID NO: 41254 - protein, 469 aa, Yarrowia lipolytica; identical to SEQ ID NO: 17365

SEQ ID NO: 41255 - DNA, 1645 bp, Zygosaccharomyces rouxii; identical to SEQ ID NO: 17366
  CDS (77)..(1534)

SEQ ID NO: 41256 - protein, 485 aa, Zygosaccharomyces rouxii; identical to SEQ ID NO: 17367

SEQ ID NO: 41257 - DNA, 3069 bp, Saccharomyces cerevisiae; identical to SEQ ID NO: 17368
  CDS (1)..(3069)

SEQ ID NO: 41258 - protein, 1022 aa, Saccharomyces cerevisiae; identical to SEQ ID NO: 17369

SEQ ID NO: 41259 - DNA, 1554 bp, Aspergillus niger; identical to SEQ ID NO: 17370
  CDS (1)..(1554)

SEQ ID NO: 41260 - protein, 517 aa, Aspergillus niger; identical to SEQ ID NO: 17371

SEQ ID NO: 41261 - DNA, 25 bp, Primer
atgagtcgtttagtcgtagtatcta

SEQ ID NO: 41262 - DNA, 24 bp, Primer
ttacgcaagctttggaaaggtagc

SEQ ID NO: 41263 - protein, 98 aa, consensus; identical to SEQ ID NO: 18676
  MISC_FEATURE (1)..(98): consensus for the disclosure of xaa see table XV

SEQ ID NO: 41264 - protein, 47 aa, consensus; identical to SEQ ID NO: 18677
  MISC_FEATURE (1)..(47): consensus for the disclosure of xaa see table XV

SEQ ID NO: 41265 - protein, 117 aa, consensus; identical to SEQ ID NO: 18678
  MISC_FEATURE (1)..(117): consensus for the disclosure of xaa see table XV

SEQ ID NO: 41266 - protein, 75 aa, consensus; identical to SEQ ID NO: 18679
  MISC_FEATURE (1)..(75): consensus for the disclosure of xaa see table XV

SEQ ID NO: 41267 - DNA, 1728 bp, Escherichia coli; identical to SEQ ID NO: 37383
  CDS (1)..(1728)

SEQ ID NO: 41268 - protein, 575 aa, Escherichia coli; identical to SEQ ID NO: 37384

SEQ ID NO: 41269 - DNA, 1917 bp, Mesorhizobium loti MAFF303099; identical to SEQ ID NO: 37385
  CDS (1)..(1917)

SEQ ID NO: 41270 - protein, 638 aa, Mesorhizobium loti MAFF303099; identical to SEQ ID NO: 37386

SEQ ID NO: 41271 - DNA, 1782 bp, Salmonella typhimurium LT2; identical to SEQ ID NO: 37387
  CDS (1)..(1782)

SEQ ID NO: 41272 - protein, 593 aa, Salmonella typhimurium LT2; identical to SEQ ID NO: 37388

SEQ ID NO: 41273 - DNA, 1599 bp, Streptomyces coelicolor A3(2); identical to SEQ ID NO: 37389
  CDS (1)..(1599)

SEQ ID NO: 41274 - protein, 532 aa, Streptomyces coelicolor A3(2); identical to SEQ ID NO: 37390

SEQ ID NO: 41275 - DNA, 1857 bp, Xanthomonas campestris pv. campestris str. ATCC 33913; identical to SEQ ID NO: 37391
  CDS (1)..(1857)

SEQ ID NO: 41276 - protein, 618 aa, Xanthomonas campestris pv. campestris str. ATCC 33913; identical to SEQ ID NO: 37392

SEQ ID NO: 41277 - DNA, 1866 bp, Shewanella oneidensis MR-1; identical to SEQ ID NO: 37393
  CDS (1)..(1866)

SEQ ID NO: 41278 - protein, 621 aa, Shewanella oneidensis MR-1; identical to SEQ ID NO: 37394

SEQ ID NO: 41279 - DNA, 1743 bp, Escherichia coli CFT073; identical to SEQ ID NO: 37395
  CDS (1)..(1743)

SEQ ID NO: 41280 - protein, 580 aa, Escherichia coli CFT073; identical to SEQ ID NO: 37396

SEQ ID NO: 41281 - DNA, 1866 bp, Bacteroides thetaiotaomicron VPI-5482; identical to SEQ ID NO: 37397
  CDS (1)..(1866)

SEQ ID NO: 41282 - protein, 621 aa, Bacteroides thetaiotaomicron VPI-5482; identical to SEQ ID NO: 37398

SEQ ID NO: 41283 - DNA, 2658 bp, Rhodopirellula baltica SH 1; identical to SEQ ID NO: 37399
  CDS (1)..(2658)

SEQ ID NO: 41284 - protein, 885 aa, Rhodopirellula baltica SH 1; identical to SEQ ID NO: 37400

SEQ ID NO: 41285 - DNA, 1716 bp, Bordetella bronchiseptica RB50; identical to SEQ ID NO: 37401
  CDS (1)..(1716)

SEQ ID NO: 41286 - protein, 571 aa, Bordetella bronchiseptica RB50; identical to SEQ ID NO: 37402

SEQ ID NO: 41287 - DNA, 1833 bp, Bacteroides fragilis YCH46; identical to SEQ ID NO: 37403
  CDS (1)..(1833)

SEQ ID NO: 41288 - protein, 610 aa, Bacteroides fragilis YCH46; identical to SEQ ID NO: 37404

SEQ ID NO: 41289 - DNA, 1956 bp, Rhodobacter sphaeroides 2.4.1; identical to SEQ ID NO: 37405
  CDS (1)..(1956)

SEQ ID NO: 41290 - protein, 651 aa, Rhodobacter sphaeroides 2.4.1; identical to SEQ ID NO: 37406

SEQ ID NO: 41291 - DNA, 1650 bp, Pseudomonas fluorescens PfO-1; identical to SEQ ID NO: 37407
  CDS (1)..(1650)

SEQ ID NO: 41292 - protein, 549 aa, Pseudomonas fluorescens PfO-1; identical to SEQ ID NO: 37408

SEQ ID NO: 41293 - DNA, 1617 bp, Clostridium thermocellum ATCC 27405; identical to SEQ ID NO: 37409
  CDS (1)..(1617)

SEQ ID NO: 41294 - protein, 538 aa, Clostridium thermocellum ATCC 27405; identical to SEQ ID NO: 37410

SEQ ID NO: 41295 - DNA, 2127 bp, Microbulbifer degradans 2-40; identical to SEQ ID NO: 37411
  CDS (1)..(2127)

SEQ ID NO: 41296 - protein, 708 aa, Microbulbifer degradans 2-40; identical to SEQ ID NO: 37412

SEQ ID NO: 41297 - DNA, 28 bp, Primer
atgcgaaataaaaatataatcatgttgc

SEQ ID NO: 41298 - DNA, 25 bp, Primer
ttactgactgatgtcagtcacacca

SEQ ID NO: 41299 - protein, 487 aa, consensus; identical to SEQ ID NO: 37415
  MISC_FEATURE (1)..(487): consensus for the disclosure of xaa see table XV

SEQ ID NO: 41300 - protein, 50 aa, consensus; identical to SEQ ID NO: 37416
  MISC_FEATURE (1)..(50): consensus for the disclosure of xaa see table XV

SEQ ID NO: 41301 - protein, 51 aa, consensus; identical to SEQ ID NO: 37417
  MISC_FEATURE (1)..(51): consensus for the disclosure of xaa see table XV

SEQ ID NO: 41302 - protein, 110 aa, consensus; identical to SEQ ID NO: 37418
  MISC_FEATURE (1)..(110): consensus for the disclosure of xaa see table XV

SEQ ID NO: 41303 - protein, 55 aa, consensus; identical to SEQ ID NO: 37419
  MISC_FEATURE (1)..(55): consensus for the disclosure of xaa see table XV

SEQ ID NO: 41304 - protein, 96 aa, consensus; identical to SEQ ID NO: 37420
  MISC_FEATURE (1)..(96): consensus for the disclosure of xaa see table XV

SEQ ID NO: 41305 - DNA, 1923 bp, Escherichia coli K12; identical to SEQ ID NO: 24353
  CDS (777)..(1748)

SEQ ID NO: 41306 - protein, 323 aa, Escherichia coli K12; identical to SEQ ID NO: 24354

SEQ ID NO: 41307 - DNA, 1313 bp, Capsicum annuum (pepper); identical to SEQ ID NO: 24355
  CDS (2)..(1126)

SEQ ID NO: 41308 - protein, 374 aa, Capsicum annuum (pepper); identical to SEQ ID NO: 24356

SEQ ID NO: 41309 - DNA, 1468 bp, Spinacia oleracea (spinach); identical to SEQ ID NO: 24357
  CDS (167)..(1273)

SEQ ID NO: 41310 - protein, 368 aa, Spinacia oleracea (spinach); identical to SEQ ID NO: 24358

SEQ ID NO: 41311 - DNA, 1656 bp, Homo sapiens (man); identical to SEQ ID NO: 24359
  CDS (1)..(1656)

SEQ ID NO: 41312 - protein, 551 aa, Homo sapiens (man); identical to SEQ ID NO: 24360

SEQ ID NO: 41313 - DNA, 984 bp, Aquifex aeolicus; identical to SEQ ID NO: 24361
  CDS (1)..(984)

SEQ ID NO: 41314 - protein, 327 aa, Aquifex aeolicus; identical to SEQ ID NO: 24362

SEQ ID NO: 41315 - DNA, 954 bp, Deinococcus radiodurans; identical to SEQ ID NO: 24363
  CDS (1)..(954)

SEQ ID NO: 41316 - protein, 317 aa, Deinococcus radiodurans; identical to SEQ ID NO: 24364

SEQ ID NO: 41317 - DNA, 1149 bp, Pseudomonas aeruginosa; identical to SEQ ID NO: 24365
  CDS (250)..(1149)

SEQ ID NO: 41318 - protein, 299 aa, Pseudomonas aeruginosa; identical to SEQ ID NO: 24366

SEQ ID NO: 41319 - DNA, 1210 bp, Arabidopsis thaliana (mouse-ear cress); identical to SEQ ID NO: 24367
  CDS (1)..(1179)

SEQ ID NO: 41320 - protein, 392 aa, Arabidopsis thaliana (mouse-ear cress); identical to SEQ ID NO: 24368

SEQ ID NO: 41321 - DNA, 960 bp, Nostoc sp. PCC 7120; identical to SEQ ID NO: 24369
  CDS (1)..(960)

SEQ ID NO: 41322 - protein, 319 aa, Nostoc sp. PCC 7120; identical to SEQ ID NO: 24370

SEQ ID NO: 41323 - DNA, 972 bp, Salmonella enterica subsp. enterica serovar Typhi; identical to SEQ ID NO: 24371
  CDS (1)..(972)

SEQ ID NO: 41324 - protein, 323 aa, Salmonella enterica subsp. enterica serovar Typhi; identical to SEQ ID NO: 24372

SEQ ID NO: 41325 - DNA, 1029 bp, Brucella melitensis; identical to SEQ ID NO: 24373
  CDS (1)..(1029)

SEQ ID NO: 41326 - protein, 342 aa, Brucella melitensis; identical to SEQ ID NO: 24374

SEQ ID NO: 41327 - DNA, 927 bp, Listeria innocua; identical to SEQ ID NO: 24375
  CDS (1)..(927)

SEQ ID NO: 41328 - protein, 308 aa, Listeria innocua; identical to SEQ ID NO: 24376

SEQ ID NO: 41329 - DNA, 975 bp, Nostoc sp. PCC 7120; identical to SEQ ID NO: 24377
  CDS (1)..(975)

SEQ ID NO: 41330 - protein, 324 aa, Nostoc sp. PCC 7120; identical to SEQ ID NO: 24378

SEQ ID NO: 41331 - DNA, 963 bp, Nostoc sp. PCC 7120; identical to SEQ ID NO: 24379
  CDS (1)..(963)

SEQ ID NO: 41332 - protein, 320 aa, Nostoc sp. PCC 7120; identical to SEQ ID NO: 24380

SEQ ID NO: 41333 - DNA, 1011 bp, Brucella melitensis; identical to SEQ ID NO: 24381
  CDS (1)..(1011)

SEQ ID NO: 41334 - protein, 336 aa, Brucella melitensis; identical to SEQ ID NO: 24382

SEQ ID NO: 41335 - DNA, 969 bp, Yersinia pestis; identical to SEQ ID NO: 24383
  CDS (1)..(969)

SEQ ID NO: 41336 - protein, 322 aa, Yersinia pestis; identical to SEQ ID NO: 24384

SEQ ID NO: 41337 - DNA, 942 bp, Staphylococcus aureus; identical to SEQ ID NO: 24385
  CDS (10)..(942)

SEQ ID NO: 41338 - protein, 310 aa, Staphylococcus aureus; identical to SEQ ID NO: 24386

SEQ ID NO: 41339 - DNA, 1038 bp, Agrobacterium tumefaciens; identical to SEQ ID NO: 24387
  CDS (1)..(1038)

SEQ ID NO: 41340 - protein, 345 aa, Agrobacterium tumefaciens; identical to SEQ ID NO: 24388

SEQ ID NO: 41341 - DNA, 921 bp, Helicobacter pylori; identical to SEQ ID NO: 24389
  CDS (1)..(921)

SEQ ID NO: 41342 - protein, 306 aa, Helicobacter pylori; identical to SEQ ID NO: 24390

SEQ ID NO: 41343 - DNA, 1395 bp, Mycobacterium tuberculosis; identical to SEQ ID NO: 24391
  CDS (1)..(1395)

SEQ ID NO: 41344 - protein, 464 aa, Mycobacterium tuberculosis; identical to SEQ ID NO: 24392

SEQ ID NO: 41345 - DNA, 969 bp, Vibrio cholerae; identical to SEQ ID NO: 24393
  CDS (1)..(969)

SEQ ID NO: 41346 - protein, 322 aa, Vibrio cholerae; identical to SEQ ID NO: 24394

SEQ ID NO: 41347 - DNA, 984 bp, Halobacterium sp. NRC-1; identical to SEQ ID NO: 24395
  CDS (1)..(984)

SEQ ID NO: 41348 - protein, 327 aa, Halobacterium sp. NRC-1; identical to SEQ ID NO: 24396

SEQ ID NO: 41349 - DNA, 999 bp, Caulobacter crescentus; identical to SEQ ID NO: 24397
  CDS (1)..(999)

SEQ ID NO: 41350 - protein, 332 aa, Caulobacter crescentus; identical to SEQ ID NO: 24398

SEQ ID NO: 41351 - DNA, 1014 bp, Caenorhabditis elegans; identical to SEQ ID NO: 24399
  CDS (1)..(1014)

SEQ ID NO: 41352 - protein, 337 aa, Caenorhabditis elegans; identical to SEQ ID NO: 24400

SEQ ID NO: 41353 - DNA, 972 bp, Mycobacterium tuberculosis; identical to SEQ ID NO: 24401
  CDS (1)..(972)

SEQ ID NO: 41354 - protein, 323 aa, Mycobacterium tuberculosis; identical to SEQ ID NO: 24402

SEQ ID NO: 41355 - DNA, 888 bp, Vibrio cholerae; identical to SEQ ID NO: 24403
  CDS (1)..(888)

SEQ ID NO: 41356 - protein, 295 aa, Vibrio cholerae; identical to SEQ ID NO: 24404

SEQ ID NO: 41357 - DNA, 999 bp, Xylella fastidiosa; identical to SEQ ID NO: 24405
  CDS (1)..(999)

SEQ ID NO: 41358 - protein, 332 aa, Xylella fastidiosa; identical to SEQ ID NO: 24406

SEQ ID NO: 41359 - DNA, 933 bp, Lactococcus lactis subsp. lactis; identical to SEQ ID NO: 24407
  CDS (1)..(933)

SEQ ID NO: 41360 - protein, 310 aa, Lactococcus lactis subsp. lactis; identical to SEQ ID NO: 24408

SEQ ID NO: 41361 - DNA, 921 bp, Streptococcus pneumoniae; identical to SEQ ID NO: 24409
  CDS (1)..(921)

SEQ ID NO: 41362 - protein, 306 aa, Streptococcus pneumoniae; identical to SEQ ID NO: 24410

SEQ ID NO: 41363 - DNA, 975 bp, Pseudomonas aeruginosa; identical to SEQ ID NO: 24411
  CDS (1)..(975)

SEQ ID NO: 41364 - protein, 324 aa, Pseudomonas aeruginosa; identical to SEQ ID NO: 24412

SEQ ID NO: 41365 - DNA, 1374 bp, Pseudomonas aeruginosa; identical to SEQ ID NO: 24413
  CDS (1)..(1374)

SEQ ID NO: 41366 - protein, 457 aa, Pseudomonas aeruginosa; identical to SEQ ID NO: 24414

SEQ ID NO: 41367 - DNA, 948 bp, Buchnera sp; identical to SEQ ID NO: 24415
  CDS (1)..(948)

SEQ ID NO: 41368 - protein, 315 aa, Buchnera sp; identical to SEQ ID NO: 24416

SEQ ID NO: 41369 - DNA, 906 bp, Staphylococcus aureus; identical to SEQ ID NO: 24417
  CDS (1)..(906)

SEQ ID NO: 41370 - protein, 301 aa, Staphylococcus aureus; identical to SEQ ID NO: 24418

SEQ ID NO: 41371 - DNA, 930 bp, Clostridium acetobutylicum; identical to SEQ ID NO: 24419
  CDS (1)..(930)

SEQ ID NO: 41372 - protein, 309 aa, Clostridium acetobutylicum; identical to SEQ ID NO: 24420

SEQ ID NO: 41373 - DNA, 951 bp, Haemophilus influenzae; identical to SEQ ID NO: 24421
  CDS (1)..(951)

SEQ ID NO: 41374 - protein, 316 aa, Haemophilus influenzae; identical to SEQ ID NO: 24422

SEQ ID NO: 41375 - DNA, 876 bp, Thermotoga maritima; identical to SEQ ID NO: 24423
  CDS (1)..(876)

SEQ ID NO: 41376 - protein, 291 aa, Thermotoga maritima; identical to SEQ ID NO: 24424

SEQ ID NO: 41377 - DNA, 1182 bp, Aeropyrum pernix; identical to SEQ ID NO: 24425
  CDS (1)..(1182)

SEQ ID NO: 41378 - protein, 393 aa, Aeropyrum pernix; identical to SEQ ID NO: 24426

SEQ ID NO: 41379 - DNA, 921 bp, Lactococcus lactis subsp. lactis; identical to SEQ ID NO: 24427
  CDS (1)..(921)

SEQ ID NO: 41380 - protein, 306 aa, Lactococcus lactis subsp. lactis; identical to SEQ ID NO: 24428

SEQ ID NO: 41381 - DNA, 933 bp, Mycobacterium tuberculosis; identical to SEQ ID NO: 24429
  CDS (1)..(933)

SEQ ID NO: 41382 - protein, 310 aa, Mycobacterium tuberculosis; identical to SEQ ID NO: 24430

SEQ ID NO: 41383 - DNA, 900 bp, Campylobacter jejuni; identical to SEQ ID NO: 24431
  CDS (1)..(900)

SEQ ID NO: 41384 - protein, 299 aa, Campylobacter jejuni; identical to SEQ ID NO: 24432

SEQ ID NO: 41385 - DNA, 1371 bp, Xylella fastidiosa; identical to SEQ ID NO: 24433
  CDS (1)..(1371)

SEQ ID NO: 41386 - protein, 456 aa, Xylella fastidiosa; identical to SEQ ID NO: 24434

SEQ ID NO: 41387 - DNA, 918 bp, Pseudomonas aeruginosa; identical to SEQ ID NO: 24435
  CDS (1)..(918)

SEQ ID NO: 41388 - protein, 305 aa, Pseudomonas aeruginosa; identical to SEQ ID NO: 24436

SEQ ID NO: 41389 - DNA, 939 bp, Bacillus halodurans; identical to SEQ ID NO: 24437
  CDS (1)..(939)

SEQ ID NO: 41390 - protein, 312 aa, Bacillus halodurans; identical to SEQ ID NO: 24438

SEQ ID NO: 41391 - DNA, 825 bp, Halobacterium sp. NRC-1; identical to SEQ ID NO: 24439
  CDS (1)..(825)

SEQ ID NO: 41392 - protein, 274 aa, Halobacterium sp. NRC-1; identical to SEQ ID NO: 24440

SEQ ID NO: 41393 - DNA, 987 bp, Caulobacter crescentus; identical to SEQ ID NO: 24441
  CDS (1)..(987)

SEQ ID NO: 41394 - protein, 328 aa, Caulobacter crescentus; identical to SEQ ID NO: 24442

SEQ ID NO: 41395 - DNA, 969 bp, Agrobacterium tumefaciens; identical to SEQ ID NO: 24443
  CDS (1)..(969)

SEQ ID NO: 41396 - protein, 322 aa, Agrobacterium tumefaciens; identical to SEQ ID NO: 24444

SEQ ID NO: 41397 - DNA, 924 bp, Bacillus subtilis; identical to SEQ ID NO: 24445
  CDS (1)..(924)

SEQ ID NO: 41398 - protein, 307 aa, Bacillus subtilis; identical to SEQ ID NO: 24446

SEQ ID NO: 41399 - DNA, 936 bp, Bacillus subtilis; identical to SEQ ID NO: 24447
  CDS (1)..(936)

SEQ ID NO: 41400 - protein, 311 aa, Bacillus subtilis; identical to SEQ ID NO: 24448

SEQ ID NO: 41401 - DNA, 933 bp, Neisseria meningitidis; identical to SEQ ID NO: 24449
  CDS (1)..(933)

SEQ ID NO: 41402 - protein, 310 aa, Neisseria meningitidis; identical to SEQ ID NO: 24450

SEQ ID NO: 41403 - DNA, 924 bp, Bacillus halodurans; identical to SEQ ID NO: 24451
  CDS (1)..(924)

SEQ ID NO: 41404 - protein, 307 aa, Bacillus halodurans; identical to SEQ ID NO: 24452

SEQ ID NO: 41405 - DNA, 1014 bp, Caenorhabditis elegans; identical to SEQ ID NO: 24453
  CDS (1)..(1014)

SEQ ID NO: 41406 - protein, 337 aa, Caenorhabditis elegans; identical to SEQ ID NO: 24454

SEQ ID NO: 41407 - DNA, 912 bp, Clostridium acetobutylicum; identical to SEQ ID NO: 24455
  CDS (1)..(912)

SEQ ID NO: 41408 - protein, 303 aa, Clostridium acetobutylicum; identical to SEQ ID NO: 24456

SEQ ID NO: 41409 - DNA, 1128 bp, Campylobacter jejuni; identical to SEQ ID NO: 24457
  CDS (105)..(1004)

SEQ ID NO: 41410 - protein, 299 aa, Campylobacter jejuni; identical to SEQ ID NO: 24458

SEQ ID NO: 41411 - DNA, 1371 bp, Triticum aestivum (common wheat); identical to SEQ ID NO: 24459
  CDS (72)..(1049)

SEQ ID NO: 41412 - protein, 325 aa, Triticum aestivum (common wheat); identical to SEQ ID NO: 24460

SEQ ID NO: 41413 - DNA, 1351 bp, Salmonella typhimurium; identical to SEQ ID NO: 24461
  CDS (423)..(1334)

SEQ ID NO: 41414 - protein, 303 aa, Salmonella typhimurium; identical to SEQ ID NO: 24462

SEQ ID NO: 41415 - DNA, 1432 bp, Spinacia oleracea (spinach); identical to SEQ ID NO: 24463
  CDS (54)..(1205)

SEQ ID NO: 41416 - protein, 383 aa, Spinacia oleracea (spinach); identical to SEQ ID NO: 24464

SEQ ID NO: 41417 - DNA, 1281 bp, Spinacia oleracea (spinach); identical to SEQ ID NO: 24465
  CDS (52)..(1029)

SEQ ID NO: 41418 - protein, 325 aa, Spinacia oleracea (spinach) [sequence omitted]

SEQ ID NO: 41419 - DNA, 1855 bp, Citrullus lanatus (watermelon); identical to SEQ ID NO: 24467
  CDS (564)..(1541)

SEQ ID NO: 41420 - protein, 325 aa, Citrullus lanatus (watermelon); identical to SEQ ID NO: 24468

SEQ ID NO: 41421 - DNA, 1278 bp, Arabidopsis thaliana (mouse-ear cress); identical to SEQ ID NO: 24469
  CDS (87)..(1061)

SEQ ID NO: 41422 - protein, 324 aa, Arabidopsis thaliana (mouse-ear cress); identical to SEQ ID NO: 24470

SEQ ID NO: 41423 - DNA, 1319 bp, Zea mays (maize); identical to SEQ ID NO: 24471
  CDS (73)..(1050)

SEQ ID NO: 41424 - protein, 325 aa, Zea mays (maize); identical to SEQ ID NO: 24472

SEQ ID NO: 41425 - DNA, 990 bp, Synechococcus sp; identical to SEQ ID NO: 24473
  CDS (1)..(990)

SEQ ID NO: 41426 - protein, 329 aa, Synechococcus sp; identical to SEQ ID NO: 24474

SEQ ID NO: 41427 - DNA, 1775 bp, Flavobacterium sp; identical to SEQ ID NO: 24475
  CDS (509)..(1432)

SEQ ID NO: 41428 - protein, 307 aa, Flavobacterium sp; identical to SEQ ID NO: 24476

SEQ ID NO: 41429 - DNA, 927 bp, Bacillus subtilis; identical to SEQ ID NO: 24477
  CDS (1)..(927)

SEQ ID NO: 41430 - protein, 308 aa, Bacillus subtilis; identical to SEQ ID NO: 24478

SEQ ID NO: 41431 - DNA, 978 bp, Synechocystis sp; identical to SEQ ID NO: 24479
  CDS (1)..(978)

SEQ ID NO: 41432 - protein, 325 aa, Synechocystis sp; identical to SEQ ID NO: 24480

SEQ ID NO: 41433 - DNA, 996 bp, Synechocystis sp; identical to SEQ ID NO: 24481
  CDS (1)..(996)

SEQ ID NO: 41434 - protein, 331 aa, Synechocystis sp; identical to SEQ ID NO: 24482

SEQ ID NO: 41435 - DNA, 912 bp, Escherichia coli; identical to SEQ ID NO: 24483
  CDS (1)..(912)

SEQ ID NO: 41436 - protein, 303 aa, Escherichia coli; identical to SEQ ID NO: 24484

SEQ ID NO: 41437 - DNA, 1308 bp, Solanum tuberosum (potato); identical to SEQ ID NO: 24485
  CDS (35)..(1012)

SEQ ID NO: 41438 - protein, 325 aa, Solanum tuberosum (potato); identical to SEQ ID NO: 24486

SEQ ID NO: 41439 - DNA, 1404 bp, Solanum tuberosum (potato); identical to SEQ ID NO: 24487
  CDS (21)..(1181)

SEQ ID NO: 41440 - protein, 386 aa, Solanum tuberosum (potato); identical to SEQ ID NO: 24488

SEQ ID NO: 41441 - DNA, 1492 bp, Chlamydomonas reinhardtii; identical to SEQ ID NO: 24489
  CDS (73)..(1131)

SEQ ID NO: 41442 - protein, 352 aa, Chlamydomonas reinhardtii; identical to SEQ ID NO: 24490

SEQ ID NO: 41443 - DNA, 1446 bp, chloroplast Spinacia oleracea (spinach); identical to SEQ ID NO: 24491
  CDS (43)..(1215)

SEQ ID NO: 41444 - protein, 390 aa, chloroplast Spinacia oleracea (spinach); identical to SEQ ID NO: 24492

SEQ ID NO: 41445 - DNA, 1035 bp, Caenorhabditis elegans; identical to SEQ ID NO: 24493
  CDS (1)..(1035)

SEQ ID NO: 41446 - protein, 344 aa, Caenorhabditis elegans; identical to SEQ ID NO: 24494

SEQ ID NO: 41447 - DNA, 1014 bp, Caenorhabditis elegans; identical to SEQ ID NO: 24495
  CDS (1)..(1014)

SEQ ID NO: 41448 - protein, 337 aa, Caenorhabditis elegans; identical to SEQ ID NO: 24496

SEQ ID NO: 41449 - DNA, 951 bp, Streptomyces coelicolor; identical to SEQ ID NO: 24497
  CDS (1)..(951)

SEQ ID NO: 41450 - protein, 316 aa, Streptomyces coelicolor; identical to SEQ ID NO: 24498

SEQ ID NO: 41451 - DNA, 1056 bp, Schizosaccharomyces pombe; identical to SEQ ID NO: 24499
  CDS (1)..(1056)

SEQ ID NO: 41452 - protein, 351 aa, Schizosaccharomyces pombe; identical to SEQ ID NO: 24500

SEQ ID NO: 41453 - DNA, 909 bp, Clostridium perfringens; identical to SEQ ID NO: 24501
  CDS (1)..(909)

SEQ ID NO: 41454 - protein, 302 aa, Clostridium perfringens; identical to SEQ ID NO: 24502

SEQ ID NO: 41455 - DNA, 927 bp, Methanosarcina barkeri; identical to SEQ ID NO: 24503
  CDS (1)..(927)

SEQ ID NO: 41456 - protein, 308 aa, Methanosarcina barkeri; identical to SEQ ID NO: 24504

SEQ ID NO: 41457 - DNA, 933 bp, Mycobacterium leprae; identical to SEQ ID NO: 24505
  CDS (1)..(933)

SEQ ID NO: 41458 - protein, 310 aa, Mycobacterium leprae; identical to SEQ ID NO: 24506

SEQ ID NO: 41459 - DNA, 1329 bp, Arabidopsis thaliana (mouse-ear cress); identical to SEQ ID NO: 24507
  CDS (1)..(1329)

SEQ ID NO: 41460 - protein, 442 aa, Arabidopsis thaliana (mouse-ear cress); identical to SEQ ID NO: 24508

SEQ ID NO: 41461 - DNA, 1142 bp, Arabidopsis thaliana (mouse-ear cress); identical to SEQ ID NO: 24509
  CDS (1)..(1107)

SEQ ID NO: 41462 - protein, 368 aa, Arabidopsis thaliana (mouse-ear cress); identical to SEQ ID NO: 24510

SEQ ID NO: 41463 - DNA, 1056 bp, Corynebacterium glutamicum; identical to SEQ ID NO: 24511
  CDS (101)..(1036)

SEQ ID NO: 41464 - protein, 311 aa, Corynebacterium glutamicum; identical to SEQ ID NO: 24512

SEQ ID NO: 41465 - DNA, 1035 bp, Rhodobacter sphaeroides; identical to SEQ ID NO: 24513
  CDS (1)..(1035)

SEQ ID NO: 41466 - protein, 344 aa, Rhodobacter sphaeroides; identical to SEQ ID NO: 24514

SEQ ID NO: 41467 - DNA, 1200 bp, Entamoeba histolytica; identical to SEQ ID NO: 24515
  CDS (83)..(1096)

SEQ ID NO: 41468 - protein, 337 aa, Entamoeba histolytica; identical to SEQ ID NO: 24516

SEQ ID NO: 41469 - DNA, 1524 bp, Saccharomyces cerevisiae; identical to SEQ ID NO: 24517
  CDS (1)..(1524)

SEQ ID NO: 41470 - protein, 507 aa, Saccharomyces cerevisiae; identical to SEQ ID NO: 24518

SEQ ID NO: 41471 - DNA, 894 bp, Yersinia pseudotuberculosis IP 32953; identical to SEQ ID NO: 24519
  CDS (1)..(894)

SEQ ID NO: 41472 - protein, 297 aa, Yersinia pseudotuberculosis IP 32953; identical to SEQ ID NO: 24520

SEQ ID NO: 41473 - DNA, 936 bp, Symbiobacterium thermophilum; identical to SEQ ID NO: 24521
  CDS (1)..(936)

SEQ ID NO: 41474 - protein, 311 aa, Symbiobacterium thermophilum; identical to SEQ ID NO: 24522

SEQ ID NO: 41475 - DNA, 936 bp, Propionibacterium acnes; identical to SEQ ID NO: 24523
  CDS (1)..(936)

SEQ ID NO: 41476 - protein, 311 aa, Propionibacterium acnes; identical to SEQ ID NO: 24524

SEQ ID NO: 41477 - DNA, 921 bp, Desulfotalea psychrophila; identical to SEQ ID NO: 24525
  CDS (1)..(921)

SEQ ID NO: 41478 - protein, 306 aa, Desulfotalea psychrophila; identical to SEQ ID NO: 24526

SEQ ID NO: 41479 - DNA, 1095 bp, Debaryomyces hansenii CBS767; identical to SEQ ID NO: 24527
  CDS (1)..(1095)

SEQ ID NO: 41480 - protein, 364 aa, Debaryomyces hansenii CBS767; identical to SEQ ID NO: 24528

SEQ ID NO: 41481 - DNA, 1476 bp, Debaryomyces hansenii CBS767; identical to SEQ ID NO: 24529
  CDS (1)..(1476)

SEQ ID NO: 41482 - protein, 491 aa, Debaryomyces hansenii CBS767; identical to SEQ ID NO: 24530

SEQ ID NO: 41483 - DNA, 1134 bp, Yarrowia lipolytica CLIB99; identical to SEQ ID NO: 24531
  CDS (1)..(1134)

SEQ ID NO: 41484 - protein, 377 aa, Yarrowia lipolytica CLIB99; identical to SEQ ID NO: 24532

SEQ ID NO: 41485 - DNA, 1617 bp, Yarrowia lipolytica CLIB99; identical to SEQ ID NO: 24533
  CDS (1)..(1617)

SEQ ID NO: 41486 - protein, 538 aa, Yarrowia lipolytica CLIB99; identical to SEQ ID NO: 24534

SEQ ID NO: 41487 - DNA, 1482 bp, Kluyveromyces lactis NRRL Y; identical to SEQ ID NO: 24535
  CDS (1)..(1482)

SEQ ID NO: 41488 - protein, 493 aa, Kluyveromyces lactis NRRL Y; identical to SEQ ID NO: 24536

SEQ ID NO: 41489 - DNA, 969 bp, Erwinia carotovora; identical to SEQ ID NO: 24537
  CDS (1)..(969)

SEQ ID NO: 41490 - protein, 322 aa, Erwinia carotovora; identical to SEQ ID NO: 24538

SEQ ID NO: 41491 - DNA, 2098 bp, Xenopus laevis; identical to SEQ ID NO: 24539
  CDS (30)..(1718)

SEQ ID NO: 41492 - protein, 562 aa, Xenopus laevis; identical to SEQ ID NO: 24540

SEQ ID NO: 41493 - DNA, 924 bp, Acinetobacter sp; identical to SEQ ID NO: 24541
  CDS (1)..(924)

SEQ ID NO: 41494 - protein, 307 aa, Acinetobacter sp; identical to SEQ ID NO: 24542

SEQ ID NO: 41495 - DNA, 999 bp, Acinetobacter sp; identical to SEQ ID NO: 24543
  CDS (1)..(999)

SEQ ID NO: 41496 - protein, 332 aa, Acinetobacter sp; identical to SEQ ID NO: 24544

SEQ ID NO: 41497 - DNA, 1506 bp, Candida glabrata CBS138; identical to SEQ ID NO: 24545
  CDS (1)..(1506)

SEQ ID NO: 41498 - protein, 501 aa, Candida glabrata CBS138; identical to SEQ ID NO: 24546

SEQ ID NO: 41499 - DNA, 918 bp, Bacillus thuringiensis; identical to SEQ ID NO: 24547
  CDS (1)..(918)

SEQ ID NO: 41500 - protein, 305 aa, Bacillus thuringiensis; identical to SEQ ID NO: 24548

SEQ ID NO: 41501 - DNA, 924 bp, Bacillus thuringiensis; identical to SEQ ID NO: 24549
  CDS (1)..(924)

SEQ ID NO: 41502 - protein, 307 aa, Bacillus thuringiensis; identical to SEQ ID NO: 24550

SEQ ID NO: 41503 - DNA, 951 bp, Picrophilus torridus; identical to SEQ ID NO: 24551
  CDS (1)..(951)

SEQ ID NO: 41504 - protein, 316 aa, Picrophilus torridus; identical to SEQ ID NO: 24552

SEQ ID NO: 41505 - DNA, 969 bp, Photobacterium profundum; identical to SEQ ID NO: 24553
  CDS (1)..(969)

SEQ ID NO: 41506 - protein, 322 aa, Photobacterium profundum; identical to SEQ ID NO: 24554

SEQ ID NO: 41507 - DNA, 936 bp, Corynebacterium glutamicum; identical to SEQ ID NO: 24555
  CDS (1)..(936)

SEQ ID NO: 41508 - protein, 311 aa, Corynebacterium glutamicum; identical to SEQ ID NO: 24556

SEQ ID NO: 41509 - DNA, 1047 bp, Bdellovibrio bacteriovorus; identical to SEQ ID NO: 24557
  CDS (1)..(1047)

SEQ ID NO: 41510 - protein, 348 aa, Bdellovibrio bacteriovorus; identical to SEQ ID NO: 24558

SEQ ID NO: 41511 - DNA, 990 bp, Bdellovibrio bacteriovorus; identical to SEQ ID NO: 24559
  CDS (1)..(990)

SEQ ID NO: 41512 - protein, 329 aa, Bdellovibrio bacteriovorus; identical to SEQ ID NO: 24560

SEQ ID NO: 41513 - DNA, 990 bp, Bdellovibrio bacteriovorus; identical to SEQ ID NO: 24561
  CDS (1)..(990)

SEQ ID NO: 41514 - protein, 329 aa, Bdellovibrio bacteriovorus; identical to SEQ ID NO: 24562

SEQ ID NO: 41515 - DNA, 1038 bp, Rhodopseudomonas palustris; identical to SEQ ID NO: 24563
  CDS (1)..(1038)

SEQ ID NO: 41516 - protein, 345 aa, Rhodopseudomonas palustris; identical to SEQ ID NO: 24564

SEQ ID NO: 41517 - DNA, 1398 bp, Rhodopseudomonas palustris; identical to SEQ ID NO: 24565
  CDS (1)..(1398)

SEQ ID NO: 41518 - protein, 465 aa, Rhodopseudomonas palustris; identical to SEQ ID NO: 24566

SEQ ID NO: 41519 - DNA, 999 bp, Rhodopseudomonas palustris; identical to SEQ ID NO: 24567
  CDS (1)..(999)

SEQ ID NO: 41520 - protein, 332 aa, Rhodopseudomonas palustris; identical to SEQ ID NO: 24568

SEQ ID NO: 41521 - DNA, 936 bp, Corynebacterium diphtheriae; identical to SEQ ID NO: 24569
  CDS (1)..(936)

SEQ ID NO: 41522 - protein, 311 aa, Corynebacterium diphtheriae; identical to SEQ ID NO: 24570

SEQ ID NO: 41523 - DNA, 906 bp, uncultured bacterium 561; identical to SEQ ID NO: 24571
  CDS (1)..(906)

SEQ ID NO: 41524 - protein, 301 aa, uncultured bacterium 561; identical to SEQ ID NO: 24572

SEQ ID NO: 41525 - DNA, 927 bp, Desulfovibrio vulgaris; identical to SEQ ID NO: 24573
  CDS (1)..(927)

SEQ ID NO: 41526 - protein, 308 aa, Desulfovibrio vulgaris; identical to SEQ ID NO: 24574

SEQ ID NO: 41527 - DNA, 915 bp, Thermus thermophilus; identical to SEQ ID NO: 24575
  CDS (1)..(915)

SEQ ID NO: 41528 - protein, 304 aa, Thermus thermophilus; identical to SEQ ID NO: 24576

SEQ ID NO: 41529 - DNA, 924 bp, Bacillus cereus; identical to SEQ ID NO: 24577
  CDS (1)..(924)

SEQ ID NO: 41530 - protein, 307 aa, Bacillus cereus; identical to SEQ ID NO: 24578

SEQ ID NO: 41531 - DNA, 933 bp, Mycobacterium paratuberculosis; identical to SEQ ID NO: 24579
  CDS (1)..(933)

SEQ ID NO: 41532 - protein, 310 aa, Mycobacterium paratuberculosis; identical to SEQ ID NO: 24580

SEQ ID NO: 41533 - DNA, 1407 bp, Mycobacterium paratuberculosis; identical to SEQ ID NO: 24581
  CDS (1)..(1407)

SEQ ID NO: 41534 - protein, 468 aa, Mycobacterium paratuberculosis; identical to SEQ ID NO: 24582

SEQ ID NO: 41535 - DNA, 927 bp, Geobacter sulfurreducens; identical to SEQ ID NO: 24583
  CDS (1)..(927)

SEQ ID NO: 41536 - protein, 308 aa, Geobacter sulfurreducens; identical to SEQ ID NO: 24584

SEQ ID NO: 41537 - DNA, 924 bp, Geobacter sulfurreducens; identical to SEQ ID NO: 24585
  CDS (1)..(924)

SEQ ID NO: 41538 - protein, 307 aa, Geobacter sulfurreducens; identical to SEQ ID NO: 24586

SEQ ID NO: 41539 - DNA, 1479 bp, Ashbya gossypii; identical to SEQ ID NO: 24587
  CDS (1)..(1479)

SEQ ID NO: 41540 - protein, 492 aa, Ashbya gossypii; identical to SEQ ID NO: 24588

SEQ ID NO: 41541 - DNA, 1098 bp, Spinacia oleracea; identical to SEQ ID NO: 24589
  CDS (78)..(1076)

SEQ ID NO: 41542 - protein, 332 aa, Spinacia oleracea; identical to SEQ ID NO: 24590

SEQ ID NO: 41543 - DNA, 1221 bp, Penicillium chrysogenum; identical to SEQ ID NO: 24591
  CDS (45)..(1160)

SEQ ID NO: 41544 - protein, 371 aa, Penicillium chrysogenum; identical to SEQ ID NO: 24592

SEQ ID NO: 41545 - DNA, 1206 bp, Solanum tuberosum; identical to SEQ ID NO: 24593
  CDS (35)..(1090)

SEQ ID NO: 41546 - protein, 351 aa, Solanum tuberosum; identical to SEQ ID NO: 24594

SEQ ID NO: 41547 - DNA, 999 bp, Wolinella succinogenes; identical to SEQ ID NO: 24595
  CDS (1)..(999)

SEQ ID NO: 41548 - protein, 332 aa, Wolinella succinogenes; identical to SEQ ID NO: 24596

SEQ ID NO: 41549 - DNA, 969 bp, Vibrio vulnificus; identical to SEQ ID NO: 24597
  CDS (1)..(969)

SEQ ID NO: 41550 - protein, 322 aa, Vibrio vulnificus; identical to SEQ ID NO: 24598

SEQ ID NO: 41551 - DNA, 1029 bp, Photorhabdus luminescens; identical to SEQ ID NO: 24599
  CDS (1)..(1029)

SEQ ID NO: 41552 - protein, 342 aa, Photorhabdus luminescens; identical to SEQ ID NO: 24600

SEQ ID NO: 41553 - DNA, 954 bp, Photorhabdus luminescens; identical to SEQ ID NO: 24601
  CDS (1)..(954)

SEQ ID NO: 41554 - protein, 317 aa, Photorhabdus luminescens; identical to SEQ ID NO: 24602

SEQ ID NO: 41555 - DNA, 882 bp, Photorhabdus luminescens; identical to SEQ ID NO: 24603
  CDS (1)..(882)

SEQ ID NO: 41556 - protein, 293 aa, Photorhabdus luminescens; identical to SEQ ID NO: 24604

SEQ ID NO: 41557 - DNA, 1368 bp, Photorhabdus luminescens; identical to SEQ ID NO: 24605
  CDS (1)..(1368)

SEQ ID NO: 41558 - protein, 455 aa, Photorhabdus luminescens; identical to SEQ ID NO: 24606

SEQ ID NO: 41559 - DNA, 963 bp, Gloeobacter violaceus; identical to SEQ ID NO: 24607
  CDS (1)..(963)

SEQ ID NO: 41560 - protein, 320 aa, Gloeobacter violaceus; identical to SEQ ID NO: 24608

SEQ ID NO: 41561 - DNA, 963 bp, Gloeobacter violaceus; identical to SEQ ID NO: 24609
  CDS (1)..(963)

SEQ ID NO: 41562 - protein, 320 aa, Gloeobacter violaceus; identical to SEQ ID NO: 24610

SEQ ID NO: 41563 - DNA, 933 bp, Chromobacterium violaceum; identical to SEQ ID NO: 24611
  CDS (1)..(933)

SEQ ID NO: 41564 - protein, 310 aa, Chromobacterium violaceum; identical to SEQ ID NO: 24612

SEQ ID NO: 41565 - DNA, 1371 bp, Chromobacterium violaceum; identical to SEQ ID NO: 24613
  CDS (1)..(1371)

SEQ ID NO: 41566 - protein, 456 aa, Chromobacterium violaceum; identical to SEQ ID NO: 24614

SEQ ID NO: 41567 - DNA, 891 bp, Chromobacterium violaceum; identical to SEQ ID NO: 24615
  CDS (1)..(891)

SEQ ID NO: 41568 - protein, 296 aa, Chromobacterium violaceum; identical to SEQ ID NO: 24616

SEQ ID NO: 41569 - DNA, 1131 bp, Neurospora crassa; identical to SEQ ID NO: 24617
  CDS (1)..(1131)

SEQ ID NO: 41570 - protein, 376 aa, Neurospora crassa; identical to SEQ ID NO: 24618

SEQ ID NO: 41571 - DNA, 1587 bp, Neurospora crassa; identical to SEQ ID NO: 24619
  CDS (1)..(1587)

SEQ ID NO: 41572 - protein, 528 aa, Neurospora crassa; identical to SEQ ID NO: 24620

SEQ ID NO: 41573 - DNA, 1371 bp, Neurospora crassa; identical to SEQ ID NO: 24621
  CDS (1)..(1371)

SEQ ID NO: 41574 - protein, 456 aa, Neurospora crassa; identical to SEQ ID NO: 24622

SEQ ID NO: 41575 - DNA, 969 bp, Synechococcus sp; identical to SEQ ID NO: 24623
  CDS (1)..(969)

SEQ ID NO: 41576 - protein, 322 aa, Synechococcus sp; identical to SEQ ID NO: 24624

SEQ ID NO: 41577 - DNA, 987 bp, Synechococcus sp; identical to SEQ ID NO: 24625
  CDS (1)..(987)

SEQ ID NO: 41578 - protein, 328 aa, Synechococcus sp; identical to SEQ ID NO: 24626

SEQ ID NO: 41579 - DNA, 960 bp, Rhodopirellula baltica; identical to SEQ ID NO: 24627
  CDS (1)..(960)

SEQ ID NO: 41580 - protein, 319 aa, Rhodopirellula baltica; identical to SEQ ID NO: 24628

SEQ ID NO: 41581 - DNA, 987 bp, Prochlorococcus marinus subsp; identical to SEQ ID NO: 24629
  CDS (1)..(987)

SEQ ID NO: 41582 - protein, 328 aa, Prochlorococcus marinus subsp; identical to SEQ ID NO: 24630

SEQ ID NO: 41583 - DNA, 969 bp, Prochlorococcus marinus subsp; identical to SEQ ID NO: 24631
  CDS (1)..(969)

SEQ ID NO: 41584 - protein, 322 aa, Prochlorococcus marinus subsp; identical to SEQ ID NO: 24632

SEQ ID NO: 41585 - DNA, 969 bp, Prochlorococcus marinus; identical to SEQ ID NO: 24633
  CDS (1)..(969)

SEQ ID NO: 41586 - protein, 322 aa, Prochlorococcus marinus; identical to SEQ ID NO: 24634

SEQ ID NO: 41587 - DNA, 987 bp, Prochlorococcus marinus; identical to SEQ ID NO: 24635
  CDS (1)..(987)

SEQ ID NO: 41588 - protein, 328 aa, Prochlorococcus marinus; identical to SEQ ID NO: 24636

SEQ ID NO: 41589 - DNA, 987 bp, Prochlorococcus marinus; identical to SEQ ID NO: 24637
  CDS (1)..(987)

SEQ ID NO: 41590 - protein, 328 aa, Prochlorococcus marinus; identical to SEQ ID NO: 24638

SEQ ID NO: 41591 - DNA, 969 bp, Prochlorococcus marinus; identical to SEQ ID NO: 24639
  CDS (1)..(969)

SEQ ID NO: 41592 - protein, 322 aa, Prochlorococcus marinus; identical to SEQ ID NO: 24640

SEQ ID NO: 41593 - DNA, 903 bp, Helicobacter hepaticus; identical to SEQ ID NO: 24641
  CDS (1)..(903)

SEQ ID NO: 41594 - protein, 300 aa, Helicobacter hepaticus; identical to SEQ ID NO: 24642

SEQ ID NO: 41595 - DNA, 942 bp, Helicobacter hepaticus; identical to SEQ ID NO: 24643
  CDS (1)..(942)

SEQ ID NO: 41596 - protein, 313 aa, Helicobacter hepaticus; identical to SEQ ID NO: 24644

SEQ ID NO: 41597 - DNA, 951 bp, Haemophilus ducreyi; identical to SEQ ID NO: 24645
  CDS (1)..(951)

SEQ ID NO: 41598 - protein, 316 aa, Haemophilus ducreyi; identical to SEQ ID NO: 24646

SEQ ID NO: 41599 - DNA, 945 bp, Candidatus Blochmannia floridanus; identical to SEQ ID NO: 24647
  CDS (1)..(945)

SEQ ID NO: 41600 - protein, 314 aa, Candidatus Blochmannia floridanus; identical to SEQ ID NO: 24648

SEQ ID NO: 41601 - DNA, 912 bp, Bordetella parapertussis; identical to SEQ ID NO: 24649
  CDS (1)..(912)

SEQ ID NO: 41602 - protein, 303 aa, Bordetella parapertussis; identical to SEQ ID NO: 24650

SEQ ID NO: 41603 - DNA, 969 bp, Propionibacterium freudenreichii shermanii; identical to SEQ ID NO: 24651
  CDS (1)..(969)

SEQ ID NO: 41604 - protein, 322 aa, Propionibacterium freudenreichii shermanii; identical to SEQ ID NO: 24652

SEQ ID NO: 41605 - DNA, 927 bp, Propionibacterium freudenreichii shermanii; identical to SEQ ID NO: 24653
  CDS (1)..(927)

SEQ ID NO: 41606 - protein, 308 aa, Propionibacterium freudenreichii shermanii; identical to SEQ ID NO: 24654

SEQ ID NO: 41607 - DNA, 1466 bp, Porphyra purpurea; identical to SEQ ID NO: 24655
  CDS (149)..(1282)

SEQ ID NO: 41608 - protein, 377 aa, Porphyra purpurea; identical to SEQ ID NO: 24656

SEQ ID NO: 41609 - DNA, 1436 bp, Oryza sativa; identical to SEQ ID NO: 24657
  CDS (57)..(1190)

SEQ ID NO: 41610 - protein, 377 aa, Oryza sativa; identical to SEQ ID NO: 24658

SEQ ID NO: 41611 - DNA, 1059 bp, Betula verrucosa; identical to SEQ ID NO: 24659
  CDS (1)..(1059)

SEQ ID NO: 41612 - protein, 352 aa, Betula verrucosa; identical to SEQ ID NO: 24660

SEQ ID NO: 41613 - DNA, 1990 bp, Xenopus laevis; identical to SEQ ID NO: 24661
  CDS (68)..(1765)

SEQ ID NO: 41614 - protein, 565 aa, Xenopus laevis; identical to SEQ ID NO: 24662

SEQ ID NO: 41615 - DNA, 924 bp, Bacillus cereus; identical to SEQ ID NO: 24663
  CDS (1)..(924)

SEQ ID NO: 41616 - protein, 307 aa, Bacillus cereus; identical to SEQ ID NO: 24664

SEQ ID NO: 41617 - DNA, 924 bp, Bacillus cereus; identical to SEQ ID NO: 24665
  CDS (1)..(924)

SEQ ID NO: 41618 - protein, 307 aa, Bacillus cereus; identical to SEQ ID NO: 24666

SEQ ID NO: 41619 - DNA, 951 bp, Streptomyces avermitilis; identical to SEQ ID NO: 24667
  CDS (1)..(951)

SEQ ID NO: 41620 - protein, 316 aa, Streptomyces avermitilis; identical to SEQ ID NO: 24668

SEQ ID NO: 41621 - DNA, 1395 bp, Streptomyces avermitilis; identical to SEQ ID NO: 24669
  CDS (1)..(1395)

SEQ ID NO: 41622 - protein, 464 aa, Streptomyces avermitilis; identical to SEQ ID NO: 24670

SEQ ID NO: 41623 - DNA, 888 bp, Nitrosomonas europaea; identical to SEQ ID NO: 24671
  CDS (1)..(888)

SEQ ID NO: 41624 - protein, 295 aa, Nitrosomonas europaea; identical to SEQ ID NO: 24672

SEQ ID NO: 41625 - DNA, 933 bp, Enterococcus faecalis; identical to SEQ ID NO: 24673
  CDS (1)..(933)

SEQ ID NO: 41626 - protein, 310 aa, Enterococcus faecalis; identical to SEQ ID NO: 24674

SEQ ID NO: 41627 - DNA, 918 bp, Enterococcus faecalis; identical to SEQ ID NO: 24675
  CDS (1)..(918)

SEQ ID NO: 41628 - protein, 305 aa, Enterococcus faecalis; identical to SEQ ID NO: 24676

SEQ ID NO: 41629 - DNA, 951 bp, Coxiella burnetii; identical to SEQ ID NO: 24677
  CDS (1)..(951)

SEQ ID NO: 41630 - protein, 316 aa, Coxiella burnetii; identical to SEQ ID NO: 24678

SEQ ID NO: 41631 - DNA, 990 bp, Shigella flexneri; identical to SEQ ID NO: 24679
  CDS (1)..(990)

SEQ ID NO: 41632 - protein, 329 aa, Shigella flexneri; identical to SEQ ID NO: 24680

SEQ ID NO: 41633 - DNA, 927 bp, Bacillus stearothermophilus; identical to SEQ ID NO: 24681
  CDS (1)..(927)

SEQ ID NO: 41634 - protein, 308 aa, Bacillus stearothermophilus [sequence omitted]

SEQ ID NO: 41635 - DNA, 1230 bp, Oryza sativa; identical to SEQ ID NO: 24683
  CDS (1)..(1230)

SEQ ID NO: 41636 - protein, 409 aa, Oryza sativa; identical to SEQ ID NO: 24684

SEQ ID NO: 41637 - DNA, 1371 bp, Xylella fastidiosa; identical to SEQ ID NO: 24685
  CDS (1)..(1371)

SEQ ID NO: 41638 - protein, 456 aa, Xylella fastidiosa; identical to SEQ ID NO: 24686

SEQ ID NO: 41639 - DNA, 969 bp, Vibrio parahaemolyticus; identical to SEQ ID NO: 24687
  CDS (1)..(969)

SEQ ID NO: 41640 - protein, 322 aa, Vibrio parahaemolyticus; identical to SEQ ID NO: 24688

SEQ ID NO: 41641 - DNA, 975 bp, Pseudomonas syringae; identical to SEQ ID NO: 24689
  CDS (1)..(975)

SEQ ID NO: 41642 - protein, 324 aa, Pseudomonas syringae; identical to SEQ ID NO: 24690

SEQ ID NO: 41643 - DNA, 984 bp, Pseudomonas syringae; identical to SEQ ID NO: 24691
  CDS (1)..(984)

SEQ ID NO: 41644 - protein, 327 aa, Pseudomonas syringae; identical to SEQ ID NO: 24692

SEQ ID NO: 41645 - DNA, 903 bp, Pseudomonas syringae; identical to SEQ ID NO: 24693
  CDS (1)..(903)

SEQ ID NO: 41646 - protein, 300 aa, Pseudomonas syringae; identical to SEQ ID NO: 24694

SEQ ID NO: 41647 - DNA, 975 bp, Pseudomonas putida; identical to SEQ ID NO: 24695
  CDS (1)..(975)

SEQ ID NO: 41648 - protein, 324 aa, Pseudomonas putida; identical to SEQ ID NO: 24696

SEQ ID NO: 41649 - DNA, 900 bp, Pseudomonas putida; identical to SEQ ID NO: 24697
  CDS (1)..(900)

SEQ ID NO: 41650 - protein, 299 aa, Pseudomonas putida; identical to SEQ ID NO: 24698

SEQ ID NO: 41651 - DNA, 912 bp, Lactobacillus plantarum; identical to SEQ ID NO: 24699
  CDS (1)..(912)

SEQ ID NO: 41652 - protein, 303 aa, Lactobacillus plantarum; identical to SEQ ID NO: 24700

SEQ ID NO: 41653 - DNA, 918 bp, Clostridium tetani; identical to SEQ ID NO: 24701
  CDS (1)..(918)

SEQ ID NO: 41654 - protein, 305 aa, Clostridium tetani; identical to SEQ ID NO: 24702

SEQ ID NO: 41655 - DNA, 978 bp, Bradyrhizobium japonicum; identical to SEQ ID NO: 24703
  CDS (1)..(978)

SEQ ID NO: 41656 - protein, 325 aa, Bradyrhizobium japonicum; identical to SEQ ID NO: 24704

SEQ ID NO: 41657 - DNA, 1035 bp, Bradyrhizobium japonicum; identical to SEQ ID NO: 24705
  CDS (1)..(1035)

SEQ ID NO: 41658 - protein, 344 aa, Bradyrhizobium japonicum; identical to SEQ ID NO: 24706

SEQ ID NO: 41659 - DNA, 948 bp, Bacteroides thetaiotaomicron; identical to SEQ ID NO: 24707
  CDS (1)..(948)

SEQ ID NO: 41660 - protein, 315 aa, Bacteroides thetaiotaomicron; identical to SEQ ID NO: 24708

SEQ ID NO: 41661 - DNA, 954 bp, Bacteroides thetaiotaomicron; identical to SEQ ID NO: 24709
  CDS (1)..(954)

SEQ ID NO: 41662 - protein, 317 aa, Bacteroides thetaiotaomicron; identical to SEQ ID NO: 24710

SEQ ID NO: 41663 - DNA, 909 bp, Staphylococcus epidermidis; identical to SEQ ID NO: 24711
  CDS (1)..(909)

SEQ ID NO: 41664 - protein, 302 aa, Staphylococcus epidermidis; identical to SEQ ID NO: 24712

SEQ ID NO: 41665 - DNA, 930 bp, Oceanobacillus iheyensis; identical to SEQ ID NO: 24713
  CDS (1)..(930)

SEQ ID NO: 41666 - protein, 309 aa, Oceanobacillus iheyensis; identical to SEQ ID NO: 24714

SEQ ID NO: 41667 - DNA, 1089 bp, Synechococcus elongatus; identical to SEQ ID NO: 24715
  CDS (1)..(1089)

SEQ ID NO: 41668 - protein, 362 aa, Synechococcus elongatus; identical to SEQ ID NO: 24716

SEQ ID NO: 41669 - DNA, 966 bp, Synechococcus elongatus; identical to SEQ ID NO: 24717
  CDS (1)..(966)

SEQ ID NO: 41670 - protein, 321 aa, Synechococcus elongatus; identical to SEQ ID NO: 24718

SEQ ID NO: 41671 - DNA, 927 bp, Streptococcus mutans; identical to SEQ ID NO: 24719
  CDS (1)..(927)

SEQ ID NO: 41672 - protein, 308 aa, Streptococcus mutans; identical to SEQ ID NO: 24720

SEQ ID NO: 41673 - DNA, 927 bp, Streptococcus agalactiae; identical to SEQ ID NO: 24721
  CDS (1)..(927)

SEQ ID NO: 41674 - protein, 308 aa, Streptococcus agalactiae; identical to SEQ ID NO: 24722

SEQ ID NO: 41675 - DNA, 969 bp, Shewanella oneidensis; identical to SEQ ID NO: 24723
  CDS (1)..(969)

SEQ ID NO: 41676 - protein, 322 aa, Shewanella oneidensis; identical to SEQ ID NO: 24724

SEQ ID NO: 41677 - DNA, 924 bp, Oceanobacillus iheyensis; identical to SEQ ID NO: 24725
  CDS (1)..(924)

SEQ ID NO: 41678 - protein, 307 aa, Oceanobacillus iheyensis; identical to SEQ ID NO: 24726

SEQ ID NO: 41679 - DNA, 927 bp, Oceanobacillus iheyensis; identical to SEQ ID NO: 24727
  CDS (1)..(927)

SEQ ID NO: 41680 - protein, 308 aa, Oceanobacillus iheyensis; identical to SEQ ID NO: 24728

SEQ ID NO: 41681 - DNA, 930 bp, Leptospira interrogans; identical to SEQ ID NO: 24729
  CDS (1)..(930)

SEQ ID NO: 41682 - protein, 309 aa, Leptospira interrogans; identical to SEQ ID NO: 24730

SEQ ID NO: 41683 - DNA, 936 bp, Corynebacterium efficiens; identical to SEQ ID NO: 24731
  CDS (1)..(936)

SEQ ID NO: 41684 - protein, 311 aa, Corynebacterium efficiens; identical to SEQ ID NO: 24732

SEQ ID NO: 41685 - DNA, 1227 bp, Bifidobacterium longum; identical to SEQ ID NO: 24733
  CDS (1)..(1227)

SEQ ID NO: 41686 - protein, 408 aa, Bifidobacterium longum; identical to SEQ ID NO: 24734

SEQ ID NO: 41687 - DNA, 1572 bp, Phytophthora infestans; identical to SEQ ID NO: 24735
  CDS (5)..(1474)

SEQ ID NO: 41688 - protein, 489 aa, Phytophthora infestans; identical to SEQ ID NO: 24736

SEQ ID NO: 41689 - DNA, 942 bp, Streptococcus pyogenes; identical to SEQ ID NO: 24737
  CDS (1)..(942)

SEQ ID NO: 41690 - protein, 313 aa, Streptococcus pyogenes; identical to SEQ ID NO: 24738

SEQ ID NO: 41691 - DNA, 1371 bp, Chlorobium tepidum; identical to SEQ ID NO: 24739
  CDS (1)..(1371)

SEQ ID NO: 41692 - protein, 456 aa, Chlorobium tepidum; identical to SEQ ID NO: 24740

SEQ ID NO: 41693 - DNA, 933 bp, Chlorobium tepidum; identical to SEQ ID NO: 24741
  CDS (1)..(933)

SEQ ID NO: 41694 - protein, 310 aa, Chlorobium tepidum; identical to SEQ ID NO: 24742

SEQ ID NO: 41695 - DNA, 1075 bp, Fusobacterium nucleatum; identical to SEQ ID NO: 24743
  CDS (135)..(1055)

SEQ ID NO: 41696 - protein, 306 aa, Fusobacterium nucleatum; identical to SEQ ID NO: 24744

SEQ ID NO: 41697 - DNA, 1386 bp, Rhodococcus erythropolis; identical to SEQ ID NO: 24745
  CDS (1)..(1386)

SEQ ID NO: 41698 - protein, 461 aa, Rhodococcus erythropolis; identical to SEQ ID NO: 24746

SEQ ID NO: 41699 - DNA, 1303 bp, Arabidopsis thaliana; identical to SEQ ID NO: 24747
  CDS (93)..(1067)

SEQ ID NO: 41700 - protein, 324 aa, Arabidopsis thaliana; identical to SEQ ID NO: 24748

SEQ ID NO: 41701 - DNA, 1422 bp, Arabidopsis thaliana; identical to SEQ ID NO: 24749
  CDS (239)..(1210)

SEQ ID NO: 41702 - protein, 323 aa, Arabidopsis thaliana; identical to SEQ ID NO: 24750

SEQ ID NO: 41703 - DNA, 1602 bp, Magnaporthe grisea; identical to SEQ ID NO: 24751
  CDS (1)..(1602)

SEQ ID NO: 41704 - protein, 533 aa, Magnaporthe grisea; identical to SEQ ID NO: 24752

SEQ ID NO: 41705 - DNA, 960 bp, Xanthomonas campestris; identical to SEQ ID NO: 24753
  CDS (1)..(960)

SEQ ID NO: 41706 - protein, 319 aa, Xanthomonas campestris; identical to SEQ ID NO: 24754

SEQ ID NO: 41707 - DNA, 1371 bp, Xanthomonas campestris; identical to SEQ ID NO: 24755
  CDS (1)..(1371)

SEQ ID NO: 41708 - protein, 456 aa, Xanthomonas campestris; identical to SEQ ID NO: 24756

SEQ ID NO: 41709 - DNA, 1371 bp, Xanthomonas axonopodis; identical to SEQ ID NO: 24757
  CDS (1)..(1371)

SEQ ID NO: 41710 - protein, 456 aa, Xanthomonas axonopodis; identical to SEQ ID NO: 24758

SEQ ID NO: 41711 - DNA, 960 bp, Xanthomonas axonopodis; identical to SEQ ID NO: 24759
  CDS (1)..(960)

SEQ ID NO: 41712 - protein, 319 aa, Xanthomonas axonopodis; identical to SEQ ID NO: 24760

SEQ ID NO: 41713 - DNA, 939 bp, Thermoanaerobacter tengcongensis; identical to SEQ ID NO: 24761
  CDS (1)..(939)

SEQ ID NO: 41714 - protein, 312 aa, Thermoanaerobacter tengcongensis; identical to SEQ ID NO: 24762

SEQ ID NO: 41715 - DNA, 921 bp, Thermoanaerobacter tengcongensis; identical to SEQ ID NO: 24763
  CDS (1)..(921)

SEQ ID NO: 41716 - protein, 306 aa, Thermoanaerobacter tengcongensis; identical to SEQ ID NO: 24764

SEQ ID NO: 41717 - DNA, 951 bp, Fusobacterium nucleatum; identical to SEQ ID NO: 24765
  CDS (1)..(951)

SEQ ID NO: 41718 - protein, 316 aa, Fusobacterium nucleatum; identical to SEQ ID NO: 24766

SEQ ID NO: 41719 - DNA, 927 bp, Methanosarcina acetivorans; identical to SEQ ID NO: 24767
  CDS (1)..(927)

SEQ ID NO: 41720 - protein, 308 aa, Methanosarcina acetivorans; identical to SEQ ID NO: 24768

SEQ ID NO: 41721 - DNA, 1267 bp, Glycine max; identical to SEQ ID NO: 24769
  CDS (82)..(1059)

SEQ ID NO: 41722 - protein, 325 aa, Glycine max; identical to SEQ ID NO: 24770

SEQ ID NO: 41723 - DNA, 903 bp, Clostridium perfringens; identical to SEQ ID NO: 24771
  CDS (1)..(903)

SEQ ID NO: 41724 - protein, 300 aa, Clostridium perfringens; identical to SEQ ID NO: 24772

SEQ ID NO: 41725 - DNA, 975 bp, Ralstonia solanacearum; identical to SEQ ID NO: 24773
  CDS (1)..(975)

SEQ ID NO: 41726 - protein, 324 aa, Ralstonia solanacearum; identical to SEQ ID NO: 24774

SEQ ID NO: 41727 - DNA, 903 bp, Ralstonia solanacearum; identical to SEQ ID NO: 24775
  CDS (1)..(903)

SEQ ID NO: 41728 - protein, 300 aa, Ralstonia solanacearum; identical to SEQ ID NO: 24776

SEQ ID NO: 41729 - DNA, 2433 bp, Mus musculus; identical to SEQ ID NO: 24777
  CDS (187)..(1872)

SEQ ID NO: 41730 - protein, 561 aa, Mus musculus; identical to SEQ ID NO: 24778

SEQ ID NO: 41731 - DNA, 969 bp, Rhizobium meliloti; identical to SEQ ID NO: 24779
  CDS (1)..(969)

SEQ ID NO: 41732 - protein, 322 aa, Rhizobium meliloti; identical to SEQ ID NO: 24780

SEQ ID NO: 41733 - DNA, 1601 bp, Pichia pastoris; identical to SEQ ID NO: 24781
  CDS (14)..(1519)

SEQ ID NO: 41734 - protein, 501 aa, Pichia pastoris; identical to SEQ ID NO: 24782

SEQ ID NO: 41735 - DNA, 1089 bp, Rhizobium loti; identical to SEQ ID NO: 24783
  CDS (1)..(1089)

SEQ ID NO: 41736 - protein, 362 aa, Rhizobium loti; identical to SEQ ID NO: 24784

SEQ ID NO: 41737 - DNA, 1440 bp, Rhizobium loti; identical to SEQ ID NO: 24785
  CDS (1)..(1440)

SEQ ID NO: 41738 - protein, 479 aa, Rhizobium loti; identical to SEQ ID NO: 24786

SEQ ID NO: 41739 - DNA, 1035 bp, Rhizobium loti; identical to SEQ ID NO: 24787
  CDS (1)..(1035)

SEQ ID NO: 41740 - protein, 344 aa, Rhizobium loti; identical to SEQ ID NO: 24788

SEQ ID NO: 41741 - DNA, 1370 bp, Trypanosoma cruzi; identical to SEQ ID NO: 24789
  CDS (15)..(1169)

SEQ ID NO: 41742 - protein, 384 aa, Trypanosoma cruzi; identical to SEQ ID NO: 24790

SEQ ID NO: 41743 - DNA, 1200 bp, Arabidopsis thaliana; identical to SEQ ID NO: 24791
  CDS (1)..(1200)

SEQ ID NO: 41744 - protein, 399 aa, Arabidopsis thaliana; identical to SEQ ID NO: 24792

SEQ ID NO: 41745 - DNA, 948 bp, Pasteurella multocida; identical to SEQ ID NO: 24793
  CDS (1)..(948)

SEQ ID NO: 41746 - protein, 315 aa, Pasteurella multocida; identical to SEQ ID NO: 24794

SEQ ID NO: 41747 - DNA, 1392 bp, Streptomyces venezuelae; identical to SEQ ID NO: 24795
  CDS (1)..(1392)

SEQ ID NO: 41748 - protein, 463 aa, Streptomyces venezuelae; identical to SEQ ID NO: 24796

SEQ ID NO: 41749 - DNA, 927 bp, Bacillus stearothermophilus; identical to SEQ ID NO: 24797
  CDS (1)..(927)

SEQ ID NO: 41750 - protein, 308 aa, Bacillus stearothermophilus; identical to SEQ ID NO: 24798

SEQ ID NO: 41751 - DNA, 951 bp, Selenomonas ruminantium; identical to SEQ ID NO: 24799
  CDS (19)..(951)

SEQ ID NO: 41752 - protein, 310 aa, Selenomonas ruminantium; identical to SEQ ID NO: 24800

SEQ ID NO: 41753 - DNA, 1378 bp, Solanum tuberosum; identical to SEQ ID NO: 24801
  CDS (55)..(1215)

SEQ ID NO: 41754 - protein, 386 aa, Solanum tuberosum; identical to SEQ ID NO: 24802

SEQ ID NO: 41755 - DNA, 1354 bp, Solanum tuberosum; identical to SEQ ID NO: 24803
  CDS (85)..(1062)

SEQ ID NO: 41756 - protein, 325 aa, Solanum tuberosum; identical to SEQ ID NO: 24804

SEQ ID NO: 41757 - DNA, 1250 bp, Solanum tuberosum; identical to SEQ ID NO: 24805
  CDS (96)..(1139)

SEQ ID NO: 41758 - protein, 347 aa, Solanum tuberosum; identical to SEQ ID NO: 24806

SEQ ID NO: 41759 - DNA, 1493 bp, Nicotiana tabacum; identical to SEQ ID NO: 24807
  CDS (88)..(1062)

SEQ ID NO: 41760 - protein, 324 aa, Nicotiana tabacum; identical to SEQ ID NO: 24808

SEQ ID NO: 41761 - DNA, 927 bp, Methanosarcina thermophila; identical to SEQ ID NO: 24809
  CDS (1)..(927)

SEQ ID NO: 41762 - protein, 308 aa, Methanosarcina thermophila; identical to SEQ ID NO: 24810

SEQ ID NO: 41763 - DNA, 1269 bp, Salmonella enterica subsp; identical to SEQ ID NO: 24811
  CDS (205)..(1176)

SEQ ID NO: 41764 - protein, 323 aa, Salmonella enterica subsp; identical to SEQ ID NO: 24812

SEQ ID NO: 41765 - DNA, 1386 bp, Streptomyces coelicolor; identical to SEQ ID NO: 24813
  CDS (1)..(1386)

SEQ ID NO: 41766 - protein, 461 aa, Streptomyces coelicolor; identical to SEQ ID NO: 24814

SEQ ID NO: 41767 - DNA, 915 bp, Clostridium sticklandii; identical to SEQ ID NO: 24815
  CDS (1)..(915)

SEQ ID NO: 41768 - protein, 304 aa, Clostridium sticklandii; identical to SEQ ID NO: 24816

SEQ ID NO: 41769 - DNA, 1671 bp, Allium tuberosum; identical to SEQ ID NO: 24817
  CDS (417)..(1394)

SEQ ID NO: 41770 - protein, 325 aa, Allium tuberosum; identical to SEQ ID NO: 24818

SEQ ID NO: 41771 - DNA, 1868 bp, Oryctolagus cuniculus; identical to SEQ ID NO: 24819
  CDS (71)..(1726)

SEQ ID NO: 41772 - protein, 551 aa, Oryctolagus cuniculus; identical to SEQ ID NO: 24820

SEQ ID NO: 41773 - DNA, 1077 bp, Leishmania tarentolae; identical to SEQ ID NO: 24821
  CDS (1)..(1077)

SEQ ID NO: 41774 - protein, 358 aa, Leishmania tarentolae; identical to SEQ ID NO: 24822

SEQ ID NO: 41775 - DNA, 990 bp, Synechococcus sp; identical to SEQ ID NO: 24823
  CDS (1)..(990)

SEQ ID NO: 41776 - protein, 329 aa, Synechococcus sp; identical to SEQ ID NO: 24824

SEQ ID NO: 41777 - DNA, 921 bp, Lactococcus lactis; identical to SEQ ID NO: 24825
  CDS (1)..(921)

SEQ ID NO: 41778 - protein, 306 aa, Lactococcus lactis; identical to SEQ ID NO: 24826

SEQ ID NO: 41779 - DNA, 1014 bp, Zymomonas mobilis; identical to SEQ ID NO: 24827
  CDS (1)..(1014)

SEQ ID NO: 41780 - protein, 337 aa, Zymomonas mobilis; identical to SEQ ID NO: 24828

SEQ ID NO: 41781 - DNA, 927 bp, Streptococcus suis; identical to SEQ ID NO: 24829
  CDS (1)..(927)

SEQ ID NO: 41782 - protein, 308 aa, Streptococcus suis; identical to SEQ ID NO: 24830

SEQ ID NO: 41783 - DNA, 1173 bp, Cyanidioschyzon merolae; identical to SEQ ID NO: 24831
  CDS (1)..(1173)

SEQ ID NO: 41784 - protein, 390 aa, Cyanidioschyzon merolae; identical to SEQ ID NO: 24832

SEQ ID NO: 41785 - DNA, 1170 bp, Cyanidioschyzon merolae; identical to SEQ ID NO: 24833
  CDS (1)..(1170)

SEQ ID NO: 41786 - protein, 389 aa, Cyanidioschyzon merolae; identical to SEQ ID NO: 24834

SEQ ID NO: 41787 - DNA, 972 bp, Arabidopsis thaliana; identical to SEQ ID NO: 24835
  CDS (1)..(972)

SEQ ID NO: 41788 - protein, 323 aa, Arabidopsis thaliana; identical to SEQ ID NO: 24836

SEQ ID NO: 41789 - DNA, 1068 bp, Entamoeba dispar; identical to SEQ ID NO: 24837
  CDS (26)..(1036)

SEQ ID NO: 41790 - protein, 336 aa, Entamoeba dispar; identical to SEQ ID NO: 24838

SEQ ID NO: 41791 - DNA, 1151 bp, Entamoeba dispar; identical to SEQ ID NO: 24839
  CDS (100)..(1110)

SEQ ID NO: 41792 - protein, 336 aa, Entamoeba dispar; identical to SEQ ID NO: 24840

SEQ ID NO: 41793 - DNA, 1780 bp, Drosophila melanogaster; identical to SEQ ID NO: 24841
  CDS (66)..(1634)

SEQ ID NO: 41794 - protein, 522 aa, Drosophila melanogaster; identical to SEQ ID NO: 24842

SEQ ID NO: 41795 - DNA, 1020 bp, Oryza sativa; identical to SEQ ID NO: 24843
  CDS (1)..(1020)

SEQ ID NO: 41796 - protein, 339 aa, Oryza sativa; identical to SEQ ID NO: 24844

SEQ ID NO: 41797 - DNA, 1758 bp, Fugu rubripes; identical to SEQ ID NO: 24845
  CDS (1)..(1758)

SEQ ID NO: 41798 - protein, 585 aa, Fugu rubripes; identical to SEQ ID NO: 24846

SEQ ID NO: 41799 - DNA, 1511 bp, Dictyostelium discoideum; identical to SEQ ID NO: 24847
  CDS (1)..(1494)

SEQ ID NO: 41800 - protein, 497 aa, Dictyostelium discoideum; identical to SEQ ID NO: 24848

SEQ ID NO: 41801 - DNA, 1280 bp, Brassica juncea; identical to SEQ ID NO: 24849
  CDS (74)..(1042)

SEQ ID NO: 41802 - protein, 322 aa, Brassica juncea; identical to SEQ ID NO: 24850

SEQ ID NO: 41803 - DNA, 1290 bp, Oryza sativa; identical to SEQ ID NO: 24851
  CDS (74)..(1039)

SEQ ID NO: 41804 - protein, 321 aa, Oryza sativa; identical to SEQ ID NO: 24852

SEQ ID NO: 41805 - DNA, 1238 bp, Brassica juncea; identical to SEQ ID NO: 24853
  CDS (18)..(992)

SEQ ID NO: 41806 - protein, 324 aa, Brassica juncea; identical to SEQ ID NO: 24854

SEQ ID NO: 41807 - DNA, 1363 bp, Oryza sativa; identical to SEQ ID NO: 24855
  CDS (139)..(1116)

SEQ ID NO: 41808 - protein, 325 aa, Oryza sativa; identical to SEQ ID NO: 24856

SEQ ID NO: 41809 - DNA, 969 bp, Buchnera aphidicola; identical to SEQ ID NO: 24857
  CDS (1)..(969)

SEQ ID NO: 41810 - protein, 322 aa, Buchnera aphidicola; identical to SEQ ID NO: 24858

SEQ ID NO: 41811 - DNA, 942 bp, Staphylococcus epidermidis; identical to SEQ ID NO: 24859
  CDS (10)..(942)

SEQ ID NO: 41812 - protein, 310 aa, Staphylococcus epidermidis; identical to SEQ ID NO: 24860

SEQ ID NO: 41813 - DNA, 1459 bp, Arabidopsis thaliana; identical to SEQ ID NO: 24861
  CDS (1)..(1215)

SEQ ID NO: 41814 - protein, 404 aa, Arabidopsis thaliana; identical to SEQ ID NO: 24862

SEQ ID NO: 41815 - DNA, 24 bp, Primer
atgagtaagatttttgaagataac

SEQ ID NO: 41816 - DNA, 25 bp, Primer
ttactgttgcaattctttctcagtg

SEQ ID NO: 41817 - protein, 420 aa, consensus; identical to SEQ ID NO: 25512
  MISC_FEATURE (1)..(420): consensus for the disclosure of xaa see table XV

SEQ ID NO: 41818 - protein, 56 aa, consensus; identical to SEQ ID NO: 25508
  MISC_FEATURE (1)..(56): consensus for the disclosure of xaa see table XV

SEQ ID NO: 41819 - protein, 53 aa, consensus; identical to SEQ ID NO: 25509
  MISC_FEATURE (1)..(53): consensus for the disclosure of xaa see table XV

SEQ ID NO: 41820 - protein, 74 aa, consensus; identical to SEQ ID NO: 25510
  MISC_FEATURE (1)..(74): consensus for the disclosure of xaa see table XV

SEQ ID NO: 41821 - protein, 32 aa, consensus; identical to SEQ ID NO: 25511
  MISC_FEATURE (1)..(32): consensus for the disclosure of xaa see table XV

SEQ ID NO: 41822 - DNA, 2054 bp, Escherichia coli K12
  CDS (293)..(1483)
ggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaggaagaccatatgcttgacgctcaaaccatcgctacagtaaaagccaccatccctttactggtggaaacggggccaaagttaaccgcccatttctacgaccgtatgtttactcataacccagaactcaaagaaatttttaacatgagtaaccagcgtaatggcgatcaacgtgaagccctgtttaacgctattgccgcctacgccagtaatattgaaaacctgcctgcgctgctgccagcggtagaaaaaatcgcgcagaagcacaccagcttccagatcaaaccggaacagtacaacatcgtcggtgaacacctgttggcaacgctggacgaaatgttcagcccggggcaggaagtgctggacgcgtggggtaaagcctatggtgtactggctaatgtatttatcaatcgcgaggcggaaatctataacgaaaacgccagcaaagccggtggttgggaaggtactcgcgatttccgcattgtggctaaaacaccgcgcagcgcgcttatcaccagcttcgaactggagccggtcgacggtggcgcagtggcagaataccgtccggggcaatatctcggcgtctggctgaagccggaaggtttcccacatcaggaaattcgtcagtactctttgactcgcaaaccggatggcaaaggctatcgtattgcggtgaaacgcgaagagggtgggcaggtatccaactggttgcacaatcacgccaatgttggcgatgtcgtgaaactggtcgctccggcaggtgatttctttatggctgtcgcagatgacacaccagtgacgttaatctctgccggtgttggtcaaacgccaatgctggcaatgctcgacacgctggcaaaagcaggccacacagcacaagtgaactggttccatgcggcagaaaatggcgatgttcacgcctttgccgatgaagttaaggaactggggcagtcactgccgcgctttaccgcgcacacctggtatcgtcagccgagcgaagccgatcgcgctaaaggtcagtttgatagcgaaggtctgatggatttgagcaaactggaaggtgcgttcagcgatccgacaatgcagttctatctctgcggcccggttggcttcatgcagtttaccgcgaaacagttagtggatctgggcgtgaagcaggaaaacattcattacgaatgctttggcccgcataaggtgctgtaatttgatgttgccggatggaaacatccggcaacccttgacgcggtttaaattgccgcgtcgtcctcttcaccggtacggatgcgaatgacccgtgccacgtcaaagacgaagattttaccgtcaccgattttgccggtttgcgccgtgcgaataatggtatcgacacaggtatcgacaatgtcgtccggtacgacaatctcaattttcactttcggcagaaaatccaccatatactccgcgccgcggtacagctcggtatggcctttctggcgaccaaagcctttcacttcggtcaccgtcatgccggtaataccgacttcggccagtgcttcgcggacatcgtccagcttgaagggttttataatcgcatcaatctttttcatgctattccttgaaaaggtcgcctgtcttttgatctgctaaacgtaacacataacgccaattcattccttgaaatcgtttgcatccagctcgtgtcgggaaagcagtttataaaattctgtccggttgcgccccgccattctcgccgcgtgggtgacgttgcctttggtgatttgcagcagcttacgca

SEQ ID NO: 41823 - protein, 396 aa, Escherichia coli K12 [sequence omitted]

SEQ ID NO: 41824 - DNA, 1490 bp, Alcaligenes eutrophus
  CDS (165)..(1376)
caatttctgccatgagtgtcatcgttcaagccttgcggcacggcttcgggttactccgtcacgaccgtctcacctagacttgaccttgatcaacgcggcgaggcaggccaccgtctaccctcgccgatttggcgacccctacgcccgcgccatggagaccgactatgctgacccagaaaacaaaagacatcgtaaaggccaccgcaccggtgctggccgaacacggctacgacatcatcaagtgcttctatcagcgcatgttcgaagcgcatcccgaactgaagaatgtgttcaacatggcccaccaggaacagggccagcagcagcaggcgctggcacgggcggtctatgcctatgcggagaatatcgaggacccaaacagtctgatggccgtcctgaagaacatcgccaacaagcatgcaagtctcggcgtcaaaccggaacagtaccccattgttggagaacacctactggccgccatcaaggaagtgttgggcaatgccgcaaccgacgacatcatttccgcttgggcgcaagcctacgggaatctggccgatgtcctgatgggcatggagagcgagttgtatgagcgctctgcggaacaacccggtggctggaaggggtggcgcacctttgtgattcgtgagaagcgccccgagagcgatgtgatcacgtcattcatccttgagcctgccgatggtggtcccgtggtgaacttcgaacccggacaatacaccagcgtcgcaatcgatgtgcccgcgctcgggttgcagcagattcgccaatacagcctgtcggatatgccgaacgggcgcacgtatcgcatctcggtgaagcgcgagggcggcgggccgcagcctccgggctatgtttcgaacctgttgcatgatcacgtgaatgttggggatcaggtcaagctggctgcgccctatggaagcttccatatcgacgttgacgccaagacacccattgtcctgatcagcggtggcgttgggctgacaccgatggtcagcatgctcaaagtggcattgcaggccccaccgaggcaagttgtattcgtgcatggcgcacgtaacagcgcagtacacgcgatgcgcgacaggctgcgcgaagcggcgaagacctatgaaaaccttgacctctttgttttctatgaccaaccgctaccggaagatgtccagggacgggactatgattatccgggcttagtcgatgtgaagcagatcgagaaatcgatcctgctgccagacgccgactactacatctgcggtccgattccgttcatgcgaatgcagcatgatgccctgaagaatctcggcattcatgaggcacgcattcattacgaagtgtttggtcccgacctgtttgctgagtagcagggaccggtcgttccggtcgccgccgacttggtgaagatcggttgtccgggctttcagtagagcggaaggacatcgattcgcagatgtcctttccttcctcatcgaccaatc

SEQ ID NO: 41825 - protein, 403 aa, Alcaligenes eutrophus [sequence omitted]

SEQ ID NO: 41826 - DNA, 1212 bp, Sinorhizobium meliloti
  CDS (1)..(1212)
atgctcactcagaagaccaaggatatcgtcaaagcaacggcccccgtcctcgcgcagcacgggtacgccatcatccagcatttctataagcggatgtttcaggctcatcccgagctcaagaacatcttcaatatggcgcaccaggaacggggcgaacaacagcaagcgctcgcgcgcgcggtctacgcctatgcggccaacatcgaaaatccggagagcctttcggcggtgctgaaggatatcgcccataagcacgccagccttggcgtcagaccggaacaatacccgatcgtcggagaacatctgcttgcgtctatcaaggaggtgctgggagatgccgcgacagatgaaatcatctcagcgtgggcacaggcctatggcaatctggcggatatactggccggcatggagagcgagctctatgagcgctcggaggaacgtgccggtggctgggccggctggcgtcgcttcatcgtccgtgagaagaacccggagagcgacgtcatcacctcattcgtgctggagccggcggacggcggacccgttgcggatttcgaacccggacaatatacgagtgtcgccgtgcaggtgcctaagctcgggtaccagcagatacgccagtacagcctgtcggactctccgaacggacgcagctatcggatctctgtgaagcgagaagatggcggcttggggacgcccggctatgtctcgtccttgctgcacgacgagatcaatgtcggcgacgaactcaagctcgcggctccctatggcaatttctacatcgatgtaagcgcgactacgccaatcgttctgatcagcggcggggtcgggctgacgccgatggtcagcatgctgaagaaggcgctccagacgccgccgcggaaggtcgtgttcgtacatggcgcgcgaaacagcgcggtacatgcgatgcgcgatcggctgaaggaagcctcccgtacctatccggatttcaagctgttcatcttctacgacgagcccctgccgacggatatcgaggggcgtgactacgactttgcgggcctcgtcgacgtcgaaaaggtcaaggacagcatcctgctcgacgacgccgactattacatctgcggaccggttccgttcatgcgcatgcagcacgacaagctcctcggtcttggaattaccgaagcgcgcatccactacgaagtattcggtcccgatctgtttgccgagtga

SEQ ID NO: 41827 - protein, 403 aa, Sinorhizobium meliloti
MLTQKTKDIVKATAPVLAQHGYAIIQHFYKRMFQAHPELKNIFNMAHQERGEQQQALARAVYAYAANIENPESLSAVLKDIAHKHASLGVRPEQYPIVGEHLLASIKEVLGDAATDEIISAWAQAYGNLADILAGMESELYERSEERAGGWAGWRRFIVREKNPESDVITSFVLEPADGGPVADFEPGQYTSVAVQVPKLGYQQIRQYSLSDSPNGRSYRISVKREDGGLGTPGYVSSLLHDEINVGDELKLAAPYGNFYIDVSATTPIVLISGGVGLTPMVSMLKKALQTPPRKVVFVHGARNSAVHAMRDRLKEASRTYPDFKLFIFYDEPLPTDIEGRDYDFAGLVDVEKVKDSILLDDADYYICGPVPFMRMQHDKLLGLGITEARIHYEVFGPDLFAE

SEQ ID NO: 41828 - DNA, 1191 bp, Salmonella enterica subsp. enterica serovar Typhi
  CDS (1)..(1191)
atgcttgacgcacaaaccatcgctacagtaaaggccaccattcccctgctggttgaaacaggaccgaaactgaccgcccacttctacgaccgtatgtttacgcataacccggagctcaaagaaatcttcaatatgagcaaccagcgtaacggtgatcagcgcgaagccctgtttaatgctatcgcggcctacgccagcaatatcgaaaatttaccggcgttgctgccggcggtagaaaaaatcgcgcagaagcacaccagcttccagattaagccggagcagtacaacatcgtcgggacgcatctgctggcgacgctggatgaaatgttcaacccgggccaggaagtgctggacgcatggggtaaagcctatggcgtactggctaacgtctttattcatcgggaagccgagatttatcacgagaacgccagcaaagacggcggctgggaaggcacgcgccccttccgcatcgttgcgaaaaccccgcgtagcgcactgatcaccagctttgagtttgaaccggtcgacggcggtacggtggcggaataccgtcccgggcagtatctgggcgtctggctgaagccggaaggttttgcgcatcaggagatccgccaatattcactgacccgtaaacccgatggcaaagggtaccgtattgccgtgaagcgtgaagacggcggccaggtatcaaactggttacaccatcacgccaacgtaggcgatgtggtgcatctggctgcgccggcaggtgacttctttatgaatgtcgccgctgatacccccgtttcgctgatttccgctggcgtcggccagacgccgatgttggcgatgctcgatacgctggcgaaagaacagcataccgcgcaggtgaactggttccacgcggcggagaacggcgacgtccatgcgtttgccgacgaagtgagcgagctgggccgtacactgccgcgtttcactgcccatacctggtaccgcgagccaaccgaggccgatcgcgcccaacgcgtctttgacagcgaagggctgatggatttaagcaaactggaagccgcgatcagcgatccggcaatgcagttctatctttgcggcccggtaggctttatgcagtttgccgcaaaacaactggtttcacttggcgtgaataacgaaaacattcattacgaatgcttcggcccgcataaagtgctgtaa

SEQ ID NO: 41829 - protein, 396 aa, Salmonella enterica subsp. enterica serovar Typhi
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGTHLLATLDEMFNPGQEVLDAWGKAYGVLANVFIHREAEIYHENASKDGGWEGTRPFRIVAKTPRSALITSFEFEPVDGGTVAEYRPGQYLGVWLKPEGFAHQEIRQYSLTRKPDGKGYRIAVKREDGGQVSNWLHHHANVGDVVHLAAPAGDFFMNVAADTPVSLISAGVGQTPMLAMLDTLAKEQHTAQVNWFHAAENGDVHAFADEVSELGRTLPRFTAHTWYREPTEADRAQRVFDSEGLMDLSKLEAAISDPAMQFYLCGPVGFMQFAAKQLVSLGVNNENIHYECFGPHKVL

SEQ ID NO: 41830 - DNA, 1191 bp, Yersinia pestis
  CDS (1)..(1191)
atgctggatacccaaaccatcgctatcgttaaatctaccatccccttgctggctgccaccggccccaaactgacagcccatttctatgagcgcatgtttaagcatcaccctgaactcaaaaacatttttaatatgagtaaccaatcgagtggtgatcaacgcgaagccttatttaatgctatttgtgcttatgcgaccaatatcgaaaatcttgcggcactactccccacggttgaacgtattgcccaaaaacataccagtttaaatattcagccagagcattaccctattgttggtgagcatttaatcgctacccttgatgaactattttcacccggtcaggccgttttagatgcctgggctaaagcctatggtgtcttggctgatgtgtttattcagcgtgaaagccagatttatcagcaaagtgagacggaaaccggtggttggagaaccttacgccgcttccgcattataaaaaaagagcaacaaagcgaggtaatttgcagttttgtcttggcaccggaagacggcggccaagtgcttcactataaaccggggcaatatttaggcatttatatcgagcatgaaagccttgaattccaagagattcgtcaatattcgctgaccaccgcgcccaatggcaaaacttaccgtattgcagtaaaacgtgaagaacaaggcacggtttcaaacttactgcatcgggagttaaatgaaggggatatcgtgcgcatcgcaccaccccgtggcgatttctttttggatgtatcaccagataccccagtagcactgatttctgctggggtgggccaaaccccgatgctcagtatgctcaataccctctatagccaacaacatgctgcccccgtacattggttacacgcagctgaaaatggtcgtgtacacgcattcgctgatgaagttagcgctatcgcagccaagatgcctaatctaagccgccatgtgtggtaccgcgagccagacctacaggataaacacggcgaggattaccatagccaagggttgatggatctgagttcgtaccagtggctagctgatgatcctaaacgacattattacttctgtggcccgctgccatttatgcaatttataggtcgtcaattactggcccaagggatagcacctgagcagattcactacgaatgcttcggtccacataaagtcatttaa

SEQ ID NO: 41831 - protein, 396 aa, Yersinia pestis
MLDTQTIAIVKSTIPLLAATGPKLTAHFYERMFKHHPELKNIFNMSNQSSGDQREALFNAICAYATNIENLAALLPTVERIAQKHTSLNIQPEHYPIVGEHLIATLDELFSPGQAVLDAWAKAYGVLADVFIQRESQIYQQSETETGGWRTLRRFRIIKKEQQSEVICSFVLAPEDGGQVLHYKPGQYLGIYIEHESLEFQEIRQYSLTTAPNGKTYRIAVKREEQGTVSNLLHRELNEGDIVRIAPPRGDFFLDVSPDTPVALISAGVGQTPMLSMLNTLYSQQHAAPVHWLHAAENGRVHAFADEVSAIAAKMPNLSRHVWYREPDLQDKHGEDYHSQGLMDLSSYQWLADDPKRHYYFCGPLPFMQFIGRQLLAQGIAPEQIHYECFGPHKVI

SEQ ID NO: 41832 - DNA, 1200 bp, Bacillus subtilis
  CDS (1)..(1200)
atgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgccgttattgcagctgcggcaaacattgaccaattaggaaacatcattccggttgtcaaacaaatcggccacaagcaccgcagtatcggaattaagcctgagcactacccaatcgtcggtaaatatttgctgattgcgattaaagatgtattgggagacgctgcaactcctgacattatgcaggcatgggaaaaagcgtacggagtcattgctgacgcgttcatcggaattgaaaaagacatgtatgaacaggctgaagagcaagccggcggctggaaggagtataagccattcgttatcgcaaaaaaagagcgggaaagcaaagaaattacatccttctatttgaaaccggaagacagcaagccgttacctgaattccaagcagggcaatatatcagcatcaaagtgcggattcctgattctgaatatacgcatatccgccagtacagcctgtctgatatgccgggaaaagactattatcgaatttcagtgaagaaagatggtgtcgtgtcttcctacttacacgatgggctgcaggagggagattcaatagagatcagcgcaccggcaggggactttgttttagatcatgcatcacaaaaagatctcgttttgatcagtgccggagttggcattacaccaatgatcagcatgctgaaaacatctgtttccaaacagcctgaacggcaaattctgttcattcatgcggcgaaaaacagtgaatatcatgcattgcgccatgaagtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacacagatgcggattactatatttgcggttcaccgtcgtttattacggcaatgcataagcttgtatcagagctcggatcagcgccggagtctatccattacgagctattcggcccgcaattaagtttggcgcagtccgtttga

SEQ ID NO: 41833 - protein, 399 aa, Bacillus subtilis
MLDNKTIEIIKSTVPVLQQHGETITGRFYDRMFQDHPELLNIFNQTNQKKKTQRTALANAVIAAAANIDQLGNIIPVVKQIGHKHRSIGIKPEHYPIVGKYLLIAIKDVLGDAATPDIMQAWEKAYGVIADAFIGIEKDMYEQAEEQAGGWKEYKPFVIAKKERESKEITSFYLKPEDSKPLPEFQAGQYISIKVRIPDSEYTHIRQYSLSDMPGKDYYRISVKKDGVVSSYLHDGLQEGDSIEISAPAGDFVLDHASQKDLVLISAGVGITPMISMLKTSVSKQPERQILFIHAAKNSEYHALRHEVEEAAKHSAVKTAFVYREPTEEDRAGDLHFHEGQIDQQFLKELIANTDADYYICGSPSFITAMHKLVSELGSAPESIHYELFGPQLSLAQSV

SEQ ID NO: 41834 - DNA, 1236 bp, Bacillus halodurans
  CDS (1)..(1236)
atgagtactgcgacgttaagccaagaaacgaaacaaatcgttaaagccaccgtaccgattttagccgaacacggggaagcgataacgaagcacttttacaaacgaatgtttagtcatcatccggaattgttaaacatctttaatcagacgcatcaaaaacaaggaagacaaccgcaagcactagcaaattccatctatgcggccgctgagcatatcgacaatttggaagcaattttacctgttgtcagtcgtatcgcccacaagcatcgcagcttaaacattaaaccagaacagtatccgatcgtcggggagaatttgcttgctgcgatgagagaagtactaggagatgctgcatctgatgacgtattggaggcgtggcgggaagcgtatgaactgatcgcagacgtgttcattcaagttgagaaaaaaatgtacgaagaggctagtcaggctccgggtggttggcgcgagttccgttcctttgttgttgaaaaaaagcaaagggaaagtgcgacaattacatcattttatttaaagcctgaagacgggaaagcacttgcctcctacaaaccagggcaatatattaccgtaaaagtaacgattccaggacatgagcatactcatatgcggcaatatagtttatcagatgccccagaaaaaggctattaccggatcactgttaagcgtgaggagggggatggcgatttgcccccagggatcgtctcgaattatttgcatcaacatatccatgagggggatgtgctagagatcacagcaccagcaggagattttacgttacaggaggaaggggagcgtccaattgtgttcataagcggtggcgtagggataacgcctcttatgagtatgtttaacactttaatgcaaagaggagtaaaacgtgaagtgatatttattcatgcagcaatcaatggtttttatcatgccatgcatgaccatttagctcaaaccgctagccagcaagaaaatgtccactatgctgtatgctacgaacggccaacaccaggggatcggatgaatccttttatgaaaaaggaaggatttatcgatgaatccttccttcgttccatcctccacgatcgagaggcagacttttatttttgcgggccagtcccatttatgaaaacgatcgctcagattttaaaagactgggacgttcccgaacagcaggttcattatgagttttttggacctgcaggaacgctagcgtcttcttag

SEQ ID NO: 41835 - protein, 411 aa, Bacillus halodurans
MSTATLSQETKQIVKATVPILAEHGEAITKHFYKRMFSHHPELLNIFNQTHQKQGRQPQALANSIYAAAEHIDNLEAILPVVSRIAHKHRSLNIKPEQYPIVGENLLAAMREVLGDAASDDVLEAWREAYELIADVFIQVEKKMYEEASQAPGGWREFRSFVVEKKQRESATITSFYLKPEDGKALASYKPGQYITVKVTIPGHEHTHMRQYSLSDAPEKGYYRITVKREEGDGDLPPGIVSNYLHQHIHEGDVLEITAPAGDFTLQEEGERPIVFISGGVGITPLMSMFNTLMQRGVKREVIFIHAAINGFYHAMHDHLAQTASQQENVHYAVCYERPTPGDRMNPFMKKEGFIDESFLRSILHDREADFYFCGPVPFMKTIAQILKDWDVPEQQVHYEFFGPAGTLASS

SEQ ID NO: 41836 - DNA, 1146 bp, Staphylococcus aureus
  CDS (1)..(1146)
atgcttacagaacaagagaaagacattatcaaacaaacggtgcctttacttaaagagaaagggacagaaattacgtcaatcttttatccaaaaatgtttaaagcgcatcctgaacttttaaacatgtttaatcaaacgaaccaaaaacgaggcatgcaatcttcagcattagcacaagctgtaatggccgctgcggttaatatcgataacttaagtgttattaaaccagtcattatgccagtcgcatataaacactgtgcattacaagtttatgctgaacattatccaattgtgggggaaaatttattaaaagcaatccaagacgtgacaggtttagaagaacatgaccctgtgattcaagcttgggcaaaagcatatggtgttattgcggatgtgttcatccaaattgaaaaagaaatttatgatcaaatgatgtggattggttttaaaccattcaaaattaccaatattaaacaagaatctgaagacattaaatcatttacagttgaaactgaagaatatgactttagtgaatttacaccaggccaatacatcacagttgatgtttctagtgataaacttccatatagagctaaacgtcactattctatcgtatcaggtgaaaaaaaccatttaacttttggcgttaaacgtgatgtcacaacagaacatgaaggcgaagtttcaacaattttacacgatgagattaaagaaggcgatatgattaatttagctgcgcctgtaggtggattcgtattagagaatacgactgaaccacaacttttcttaggttcaggtattggcgtcacacctttagtagcaatgtatgaagctgcctctgccaaaggtttagatacacagatggttcaagttgctgaaaatgaacaacatttacctttcaaagacaacttcaacagtatcgcaagccattatgacaacgctaaattatatacacacttaaaagataaacaaggctatattggcactgaagaattacaagcatttttagcaaataaacctgaaatttatatctgtggtggtacaaaattcttacaatctatgatcgaagcacttaaatctttaaattacgatatggatcgcgtacactacgaaacatttattccaagactaagcgttgcagtataa

SEQ ID NO: 41837 - protein, 381 aa, Staphylococcus aureus
MLTEQEKDIIKQTVPLLKEKGTEITSIFYPKMFKAHPELLNMFNQTNQKRGMQSSALAQAVMAAAVNIDNLSVIKPVIMPVAYKHCALQVYAEHYPIVGENLLKAIQDVTGLEEHDPVIQAWAKAYGVIADVFIQIEKEIYDQMMWIGFKPFKITNIKQESEDIKSFTVETEEYDFSEFTPGQYITVDVSSDKLPYRAKRHYSIVSGEKNHLTFGVKRDVTTEHEGEVSTILHDEIKEGDMINLAAPVGGFVLENTTEPQLFLGSGIGVTPLVAMYEAASAKGLDTQMVQVAENEQHLPFKDNFNSIASHYDNAKLYTHLKDKQGYIGTEELQAFLANKPEIYICGGTKFLQSMIEALKSLNYDMDRVHYETFIPRLSVAV

SEQ ID NO: 41838 - DNA, 1212 bp, Deinococcus radiodurans
  CDS (1)..(1212)
atgctgacccccgaacagaaagccatcgtcaaggccaccgttcccgcgctggaagcgcacggcgagacgatcacccgcaccttctacgcctcgatgttcgccgcgcaccccgaactgctcaacatcttcaaccccgccaaccagcagaccggcaagcaggcccgcagcctggcggcgtcggtgctggcctacgcggcacatatcgaccatccggaggcgctgggcggcatggtggggcggattgcccacaagcacgtcagcctggaagtcctgcccgagcattaccccatcgtgggccagtacctgctcggcgcgattgccggggtgctgggcgacgccgccaagccggagattctggacgcctgggccgccgcctacggggagctggccgacctgatgatcgggatcgagaagggcatgtacgacgccggagccgggcagcccggcggctggcgcgacttccggcccttccgggtcgcccgcaaggtggccgagagccgcgtgatcacctccttcgtgctcgagcccgtgggcggcggggcgttgcccgcctatcagccggggcagtaccttagcctgaaggtgaaggtgccggggcaggagcggtggcaaatccggcagtacagcctctcggacgcgccgagcccggaccactaccgcatctcggtcaagcgcgagggcggcgggctggtgtcggagtacctgcacggcgcggtgcaggagggcgacgaactgctcgttcacgttccggcgggcgacttcgtgctgcaacagagtgagcgcccggtggtcctgatcagcgcaggcgtgggcatcaccccgatgctggcgatggtgcagacgctggcccaggcggggtcgcagcggcccgtcaccttcatccacgcggcgcagaacggctccgttcacgccttccgcgacgacgtggcgcggctgacgcacgagtacccgcactttcgcaaggtggtcttctacgacgaggccggccccgacgaccagctcggcacccaccacgacgtggccgggcgcctgagcctggacgccgtgcggggcgcgctcccggcgggtgaggccgagttctactactgcggtccggcgggcttcgccggggcggtggaagccatactcgacgacttgcaggtgcccgccgagcgacgctttaccgaaaccttcgggccgagccagagcttcgcgccggtgattctgggctga

SEQ ID NO: 41839 - protein, 403 aa, Deinococcus radiodurans
MLTPEQKAIVKATVPALEAHGETITRTFYASMFAAHPELLNIFNPANQQTGKQARSLAASVLAYAAHIDHPEALGGMVGRIAHKHVSLEVLPEHYPIVGQYLLGAIAGVLGDAAKPEILDAWAAAYGELADLMIGIEKGMYDAGAGQPGGWRDFRPFRVARKVAESRVITSFVLEPVGGGALPAYQPGQYLSLKVKVPGQERWQIRQYSLSDAPSPDHYRISVKREGGGLVSEYLHGAVQEGDELLVHVPAGDFVLQQSERPVVLISAGVGITPMLAMVQTLAQAGSQRPVTFIHAAQNGSVHAFRDDVARLTHEYPHFRKVVFYDEAGPDDQLGTHHDVAGRLSLDAVRGALPAGEAEFYYCGPAGFAGAVEAILDDLQVPAERRFTETFGPSQSFAPVILG

SEQ ID NO: 41840 - DNA, 1185 bp, Vibrio cholerae
  CDS (1)..(1185)
atgctcacccaagaacacatcaatatcattaaaagcaccattcctttgctggagtctgcaggtcctgcgctgacgcaacatttttaccaacgtatgttcagccataatccagagctgaagcatatttttaatatgacccaccagaaaaccggacgtcaaagtgttgcgctgtttgaagcgattgcggcttatgccaagcatatcgataatttagccgcattaaccagtgccgttgagcgtatcgcccataaacacaccagttttaatattcagccagagcattatcagattgtcgggcatcatctgctggagactttgcgtgaattagccccagatgcctttacccaaccggttgaagaggcttggaccgccgcgtatttctttttggctcaagtttttatcgaccgcgaaggcgcactctacttagagcgcaaacaagctttaggtggatggcgtgatggccgaacctttgttgtacgcgagaaacaggtagagtctgcttacgtgaccagttttgtgctcgtacccgctgatggtggtgcggtactggattatcaaccgggacaatacattgggattgaagtgacgccagagggaagtgattatcgagaaattcgtcaatactccttgtcgcatgcatcgaatggtcgtgagtatcgcatttcggttaagcgcgaaggggtgggcagtgataatccagggctggtttctcactatctgcacaacaacgtcaaagttggggatagcgttaaactctatgctcccgccggagattttttctatgttgagcgtgagcggcctgtggttctgatttcggctggtgttggcgcgacgcccatgcaggctatcctgcacaccttagccaagcaaaataagtctggagtgacttatctttatgcgtgtaattctgctaaggaacatacttttgctcaggaaaccgcgcagctcattgcgcaacagggatggatgcagcaagtgtggtaccgtgatgaaagtgcagatgatgtcttacaaggtgaaatgcagttagccgagcttattctgccgattgaggatggagatttctatttgtgtggtccgatcggttttatgcagtatgtggtcaagcagttactggcgcttggtgtggataaggcgcgaattcattatgaagtgtttggtccacatgcacagcttgcggcgtaa

SEQ ID NO: 41841 - protein, 394 aa, Vibrio cholerae
MLTQEHINIIKSTIPLLESAGPALTQHFYQRMFSHNPELKHIFNMTHQKTGRQSVALFEAIAAYAKHIDNLAALTSAVERIAHKHTSFNIQPEHYQIVGHHLLETLRELAPDAFTQPVEEAWTAAYFFLAQVFIDREGALYLERKQALGGWRDGRTFVVREKQVESAYVTSFVLVPADGGAVLDYQPGQYIGIEVTPEGSDYREIRQYSLSHASNGREYRISVKREGVGSDNPGLVSHYLHNNVKVGDSVKLYAPAGDFFYVERERPVVLISAGVGATPMQAILHTLAKQNKSGVTYLYACNSAKEHTFAQETAQLIAQQGWMQQVWYRDESADDVLQGEMQLAELILPIEDGDFYLCGPIGFMQYVVKQLLALGVDKARIHYEVFGPHAQLAA

SEQ ID NO: 41842 - DNA, 1182 bp, Pseudomonas aeruginosa
  CDS (1)..(1182)
atgttgtccaatgcccaacgtgccctcatcaaagccaccgtaccgctgctggagaccggcggtgaagcgctgatcacccatttctaccgcaccatgctcggcgagtaccccgaggttcgcccgctgttcaaccaggcccaccaggccagcggcgaccagccgcgggcgctggccaatggcgtgctgatgtacgccaggcacatcgaccagttgcaggaactcggcccgctggtggccaaggtggtgaacaagcatgtctccctgcaggtgctgcccgaacactatccgatcgtcggcacttgcctgttgcgggcgatccgcgaggtcctcggcgaacagatcgccaccgacgaagtcctcgaagcctggggcgcggcctaccagcaactggccgacctgctgatcgaggccgaggagtcggtgtatgccgccagcgcccaggccgatggcggctggcgcggcgtgcggcgcttccgcgtggcacgcaagcaggcggagagcgaggaaatcacctcgttctacctggagccggtggacggccagccgctgctggcgttccagccgggacagtacatcggcctgcggctggacatcgacggcgaggaagtgcgccgcaactattcgctttccgctgccagcaacggccgcgaataccgcatcagcgtcaagcgcgaggcgggtggacgggtctccaattacctgcatgaccgggtcgccgagggcgacgagctggatctgtttccgccggctggcgatttcgtcctgcgtgacagcgacaagccgctggtgctgatcaccgccggcgtcggcatcaccccggccctggccatgttgcaggaagcgctgccgcaggcgcggccgatccgcttcatccattgcgcccggcatggcggcgtgcatgccttccgcgactggatcgaagacgtgtcggcgcagcacgagcaggtcgagcacttcttctgctacagcgaaccgcgcgccggcgacagtgccgacgccgagggattgctgagccgcgagaaactggccgactggttgccgcaggagcgcgacctggacgcctacttcctcggaccccggcctttcatggcgcaggtcaagcgccacctggccgacctcggcgtaccctcgcagcaatgccactacgagttcttcggtccggccgccgcgctggacgcctga

SEQ ID NO: 41843 - protein, 393 aa, Pseudomonas aeruginosa
MLSNAQRALIKATVPLLETGGEALITHFYRTMLGEYPEVRPLFNQAHQASGDQPRALANGVLMYARHIDQLQELGPLVAKVVNKHVSLQVLPEHYPIVGTCLLRAIREVLGEQIATDEVLEAWGAAYQQLADLLIEAEESVYAASAQADGGWRGVRRFRVARKQAESEEITSFYLEPVDGQPLLAFQPGQYIGLRLDIDGEEVRRNYSLSAASNGREYRISVKREAGGRVSNYLHDRVAEGDELDLFPPAGDFVLRDSDKPLVLITAGVGITPALAMLQEALPQARPIRFIHCARHGGVHAFRDWIEDVSAQHEQVEHFFCYSEPRAGDSADAEGLLSREKLADWLPQERDLDAYFLGPRPFMAQVKRHLADLGVPSQQCHYEFFGPAAALDA

SEQ ID NO: 41844 - DNA, 1259 bp, Pichia norvegensis, Candida norvegensis
  CDS (11)..(1177)
acaagccaaaatgtcagcagcaaagcaattattcaagattgtcccacttacaccaaccgagattaactttttacaatctttagcaccagttgttaaagaacatggtgttacagttacatcaactatgtacaagtatatgtttcaaacgtaccccgaagtgagaagttactttaacatgactaatcagaagactggtagacaaccaaaagttcttgcattttcactttatcagtatattcttcatcttaatgatttaacaccaatttctggatttgttaatcaaattgttctcaaacattgtggtttaggaattaaacctgatcaatatccagttgttggtgaatcacttgttcaagcatttaagatggttctcggtgaagcagctgatgaacattttgttgaagttttcaagaaagcgtatggtaatcttgcacaaacattgattgatgctgaagcatcagtttataagacacttgcatgggaagaatttaaagatttccgtgtaactaaattagttaaagaagctgaagatgttacatcagtttatttaacaccagttgatggatttaaattaaagccaattattccaggtgaatatatttcatttagatgggatattcataatcctgatattacagatattcaaccaagagaatattcaatttcacaagatgttaaagagaatgaatatagaatttctgttcgtgatattggtattgtttccgattatatcaataagaaattacaagttggagatattgtaccagttcatgcaccagttggtactatgaaatatgattcgatttcaaagaagggtaaagttgcagttttagctggaggtattggaattacgccaatgattccaattattgaacatgcattgaaggatggtaaagatgttgaactttattattcaaatagaagttatcaaagtgaaccattccgtgaatttttctctaatttagagaaggaaaacaatggtaaatttaaattaaacaattatatcagtgcagagaatcaaaaattacaagttaaagatttagaacatattaatcctgatgaatacgatgtttatttacttggtcctgttgcatacatgcatgaattcaagacataccttgtcggtaagggagtttctgatttgaagatggaattctttggaccaacagatccttgattgttaaagtggtactaagattgttaaatacatagtatagaattgttatatatatatatatagtttaaaatagattaaaagc

SEQ ID NO: 41845 - protein, 388 aa, Pichia norvegensis, Candida norvegensis
MSAAKQLFKIVPLTPTEINFLQSLAPVVKEHGVTVTSTMYKYMFQTYPEVRSYFNMTNQKTGRQPKVLAFSLYQYILHLNDLTPISGFVNQIVLKHCGLGIKPDQYPVVGESLVQAFKMVLGEAADEHFVEVFKKAYGNLAQTLIDAEASVYKTLAWEEFKDFRVTKLVKEAEDVTSVYLTPVDGFKLKPIIPGEYISFRWDIHNPDITDIQPREYSISQDVKENEYRISVRDIGIVSDYINKKLQVGDIVPVHAPVGTMKYDSISKKGKVAVLAGGIGITPMIPIIEHALKDGKDVELYYSNRSYQSEPFREFFSNLEKENNGKFKLNNYISAENQKLQVKDLEHINPDEYDVYLLGPVAYMHEFKTYLVGKGVSDLKMEFFGPTDP

SEQ ID NO: 41846 - DNA, 1694 bp, Erwinia chrysanthemi
  CDS (241)..(1428)
gggctgacagaggtttttacgcaaacgattagctacaggctacgcaaggctttacgtctttccgggattagccattccggctgattttttctcatcctcaacctgcatttttttcatacgcctttccccctgattcgttgccccgcccctaccccagaccatcaccggggatttacaggcaacatcctttttaataagatgcatttaaaatgcaacttatagacaacaatgaggttcaccatgctggatcaacaaaccatcgccaccatcaaatccaccattcctctgctggccgaaaccggtccggcgttgaccgctcacttttatcagcggatgttccaccataacccggaactgaaagatatcttcaatatgagtaatcagcgtaatggcgaccagcgcgaagcgctgttcaatgccatttgcgcctacgcgacgcatatcgaaaacctgccggcgttgctgcccgcggtagaacgtatcgcgcaaaagcatgccagcttcaatattcagccggaacagtatcagatagtgggtactcacctgctggcaacgctggaagaaatgttccagcccggtcaggcggtgctggatgcctggggcaaacgctacggcgtgctggcgaatgtgtttatccagcgggaaagcgacatttatcagcaaagcgccggacaaaacggcggctggcatggcatccggccgtttcgcattgtggcgaaacagccccagagcagcctgatcaccagcttcacgctggaaccggtggatggcggcccgatcgccgcattccgtcccggccagtatctggcggtctacatccgcgataagcgctttgaatatcaggagattcgtcagtactcactaacgaacgaacccaacgggcgctattaccgtatcgcggtcaaacgggaaacgatgggcagcgtatcgggctatttgcacgatgtcgcccgcgaaggcgatgtgattgaactggccgccccgcacggcgatttctaccttgaggtcacgccagagacgccggtagcgctgatttccgccggtgttggtcaaacaccgatgctcagcatgctgcacagcctgaaaaatcagcagcatcaggcggatatcttctggttacacgcggctgaaaacacagaagtacatgccttcgccgacgaaatcgccgatgttgccgctacgctgccgcagttgcaatcctatgtctggtatcgggaagcctcatcggaagcggcacgttcggcgcatgcttttcacggattgatggcgttgaaggacctcccgacgccgctgccgatgacaaacctgcactgttatttatgcggcccggtcgcctttatgcaattcgccgcccgacaattgttggagttggggattaccgaatcgcagattcattacgaatgctttggtccgcacaaggttatataaccgataaaaggttatatttattcacaccagcaggccgggaatccggcctgttttattttccatttatttcccaaaaataaacaccagtacagaaataacctgacgaggtaaccgttactgtttcgtaatagtttcatttaccaccgcgtcatgctgaccagtaaaaacaacgctccctcccccttctcattttttattcccgaattgaaaaatagttaagtaaaccttcataaataagaaataaaaaacacaatgttacatttaaa

SEQ ID NO: 41847 - protein, 395 aa, Erwinia chrysanthemi
MLDQQTIATIKSTIPLLAETGPALTAHFYQRMFHHNPELKDIFNMSNQRNGDQREALFNAICAYATHIENLPALLPAVERIAQKHASFNIQPEQYQIVGTHLLATLEEMFQPGQAVLDAWGKRYGVLANVFIQRESDIYQQSAGQNGGWHGIRPFRIVAKQPQSSLITSFTLEPVDGGPIAAFRPGQYLAVYIRDKRFEYQEIRQYSLTNEPNGRYYRIAVKRETMGSVSGYLHDVAREGDVIELAAPHGDFYLEVTPETPVALISAGVGQTPMLSMLHSLKNQQHQADIFWLHAAENTEVHAFADEIADVAATLPQLQSYVWYREASSEAARSAHAFHGLMALKDLPTPLPMTNLHCYLCGPVAFMQFAARQLLELGITESQIHYECFGPHKVI

SEQ ID NO: 41848 - DNA, 1200 bp, Saccharomyces cerevisiae
  CDS (1)..(1200)
atgctagccgaaaaaacccgttccataatcaaagcaaccgttcctgttttggaacagcagggcactgtcatcacgcgtacattctacaaaaatatgcttactgaacacaccgaattacttaatatttttaacagaactaatcaaaaggttggcgcacaaccaaatgccttggccactactgttttggcagcggctaagaacattgacgatttgtctgtgcttatggaccatgtcaagcaaattggccacaagcatcgtgccttgcaaattaaacctgagcattatccaatcgttggtgagtacttgttaaaagcaatcaaggaagttttaggcgatgctgcgactccagagataattaatgcatggggcgaggcttaccaagcaattgctgacatcttcatcactgttgaaaaaaaaatgtacgaagaagctttatggccaggttggaaaccatttgacattactgccaaagagtacgttgcttcagatattgttgaatttactgttaagccaaagttcggttctggtattgaattggaaagcttgccaatcactccaggtcagtatattacggtaaacactcacccaattagacaggaaaaccaatacgacgctttaagacactactctctttgttctgcttcaactaaaaatggtttacgatttgcagtaaagatggaagctgccagagaaaattttcctgcaggattagtctctgaatatttacacaaggacgctaaagttggtgatgaaattaagcttagtgctccggctggtgatttcgcaataaataaagagttgatacaccaaaacgaagttccattggtgttactatcgtctggtgttggtgttacaccacttttagctatgttagaagaacaagtcaaatgcaacccaaataggccaatttactggattcaatcttcctatgatgaaaagactcaagcattcaaaaaacatgtagatgaactattagctgaatgtgcgaatgtcgacaaaataattgttcatactgatactgaaccactgattaatgctgcattcttgaaggaaaagtcacctgcgcatgccgatgtctacacttgcggctctttagcttttatgcaagctatgattggtcatctaaaagaactagagcatcgtgatgatatgattcactatgaaccatttggtccaaagatgtcaaccgtgcaagtttag

SEQ ID NO: 41849 - protein, 399 aa, Saccharomyces cerevisiae [sequence omitted]

SEQ ID NO: 41850 - DNA, 1308 bp, Streptomyces coelicolor
  CDS (1)..(1308)
atgacgggcaggttcgagttcatgcaccagagctcccaccccgacagaccgaccaccccggcagacgattggagcggggccaacgcggcccacctcgctgcacccgctcgcatcgcagccgccccggcctctgtgactgacgaggacgtcgcgctggtacgggccagcctgacagttgtcactccccatgtgtccgagctggcagcgcacttctacagcatcctgttctcgcgttacccacaggtcagggacttgtttccggcggagctcgatgtccagcgggaacgtctggtgcgcgcactgctgcgcattgtggagctggtcgacgaccccgacaacctcgtggcgttctgctcccgcctgggacgcggccatcgcaagttcggcacgcagagcggccattatcctgctgtcggcgaatgcctgctgcaggccctttcccacttcgcgggcccggcatggcatccggcactggcgacggcatggcagcgcgcctacacggcagccgcggacgtgatggtccgggccgcggaagaggacgcccgtagccgcccagccgtatgggacgcgcacatcgtcgggcatgtccaccgggggcacggaatagccgagatcacggtccggccccaccagccgtacccgttcgtggcgggccagtacgtgagcatcgaaacgccgtgggcaccgaggcagtggcgtcagtactcccccgcgaacgccccgcgtcccaattccgaactgaccttccacgtgcgagccgtgcgcgagggaaaggtcagcaacgcgctcgtccaccacgctcgtccgggagaccctgtccgactcggcccgccggagggcgacatggtcttgcgtccaacccgccagcgggacctgctcttcgtggccggcggcaccggcctcgccccgattcgcgccctgatcgaagaggtggcccagggcagtatcagcgacgcacgtgaagtcagtctgttcatcggcgccagaacggcgaacgaactgtacggactcgatgacatgctgcgcatgtcccagcgctaccactggctgcgcgtccgggcggcggtctccgatgagcgcatcccgggcctggaaggcaccctgcccgaggtattggcggaattcggcccctggtaccggcacgaggcgtatctgtgcggcccaccgcaaatgctgagcggggccgtgcacgccctgcggcgccacggtgtcccgcctcgccacattcactacgacccctgggacacccctgtgctgaccgcacctttgggaccgcctccgcccgacgaggaggacgaccagctgtga

SEQ ID NO: 41851 - protein, 435 aa, Streptomyces coelicolor
MTGRFEFMHQSSHPDRPTTPADDWSGANAAHLAAPARIAAAPASVTDEDVALVRASLTVVTPHVSELAAHFYSILFSRYPQVRDLFPAELDVQRERLVRALLRIVELVDDPDNLVAFCSRLGRGHRKFGTQSGHYPAVGECLLQALSHFAGPAWHPALATAWQRAYTAAADVMVRAAEEDARSRPAVWDAHIVGHVHRGHGIAEITVRPHQPYPFVAGQYVSIETPWAPRQWRQYSPANAPRPNSELTFHVRAVREGKVSNALVHHARPGDPVRLGPPEGDMVLRPTRQRDLLFVAGGTGLAPIRALIEEVAQGSISDAREVSLFIGARTANELYGLDDMLRMSQRYHWLRVRAAVSDERIPGLEGTLPEVLAEFGPWYRHEAYLCGPPQMLSGAVHALRRHGVPPRHIHYDPWDTPVLTAPLGPPPPDEEDDQL

SEQ ID NO: 41852 - DNA, 1284 bp, Schizosaccharomyces pombe
  CDS (1)..(1284)
atgtccagtgttgaggttaatcgtgaaaacgctgatgttgctaatacaaatcgacaggcaaatctagcagaaggctatgaaataaaagaacttaatgaatcgcaaaagcagtatatacgttcttcaatcccaatccttgaatcatctggggtaaacttgacaaaagcattctaccaaaaaatgctaggtaactacccggaagtgctcccgtactttaataaagcgcatcaaatttctttatctcaaccaaggattttagcgtttgctttgttgaattatgctaaaaacattgatgatctcacttcgctctcggcttttatggatcaaattgtggtcaaacatgttggtttacagatcaaagcagaacattatcccatagtgggacattgtctgttgagcaccatgcaagaactactacctagtgatgttgctaccccggcatttttagaggcatggactactgcatatggtaacttggcaaaaattttgattgactctgaaaaaaaagtttatcagagtcagccatggaacgggttcgtggaattcaaagttacagaacttattaatgaatcttccgacgtaaaatcagtttacttgggtccgaaagatccagctttcagaatttctcatgcccacccagggcaatatgtcagtgtgctctgggaaatacctggtttatcacataaaacattaagagagtattcattgtctaatcgtgttgatacttgtagaaatcagtttcgcatttctgtacgccgagtcgctgggggagtagtttccaactttgtacacgataacttgaaagttggtgatatcgttggtgtcagtcctccggccggtaattttgtttacaaacgttcagaggaaaatgtaaatcgcccgcttctttgctttgctggtggtattggtataacaccgcttattccaatcattgagacagctttattagatggaagaaaggtaaacttttgttattctagcagaaattatgttagccgtcctttcaaacagtggcttgagcaactcaaacttaaatataaagagaacttgaaattgaaagagttcttttcggaggagtcctcagttactaaagagcagattgtggatgaggtaatgactcgtattataaatgaagaagacctagaaaagctagacttaagtgaatgcgacatatacatgcttggaccaaataactatatgcgttttgttaagcaagaactagtcaaactaggagttgaaccaaataaagtacagagtgaattttttggaccgtatattccttaa

SEQ ID NO: 41853 - protein, 427 aa, Schizosaccharomyces pombe
MSSVEVNRENADVANTNRQANLAEGYEIKELNESQKQYIRSSIPILESSGVNLTKAFYQKMLGNYPEVLPYFNKAHQISLSQPRILAFALLNYAKNIDDLTSLSAFMDQIVVKHVGLQIKAEHYPIVGHCLLSTMQELLPSDVATPAFLEAWTTAYGNLAKILIDSEKKVYQSQPWNGFVEFKVTELINESSDVKSVYLGPKDPAFRISHAHPGQYVSVLWEIPGLSHKTLREYSLSNRVDTCRNQFRISVRRVAGGVVSNFVHDNLKVGDIVGVSPPAGNFVYKRSEENVNRPLLCFAGGIGITPLIPIIETALLDGRKVNFCYSSRNYVSRPFKQWLEQLKLKYKENLKLKEFFSEESSVTKEQIVDEVMTRIINEEDLEKLDLSECDIYMLGPNNYMRFVKQELVKLGVEPNKVQSEFFGPYIP

SEQ ID NO: 41854 - DNA, 1281 bp, Corynebacterium glutamicum
  CDS (101)..(1261)
tgccatcatattaaggccaaattgcttggatcctgggatttatttaattagattaaatccgtagaaattagcccatgaagcatggaaaggcgaaaaccccatgatcgtttccacccagcccattactgatcgcagcgcactctcggcagaacacgcagaggtgatcaaagcaacgcttcctctcgtgggcggcaagattaatgagatcacgccggttttctacaacaagatgtttgcggctcacccagaattgatcgctaacaccttcaacggtggcaatcagaagcaaggcgatcagcagaaggcgctggcggcttcgattgcaacgtttgccaccatgctcgttactcctgatgctcctgacccagttcagctgctgtcccgcattggccacaagcacgtgtccctcggcattactgctgatcagtacgacattgttcacgagcacctgttcgccgcaatcgttgaggttttgggagcggaaactgtcaccgcacctgtcgctgaagcctgggatgctgtctactggatcatggcaaatgtgctgatcggttttgagaacaacctttatgcttccaacgatctggagcctggcgacgtcttccgcgaagtcaccgtgaccgcgaagaagcagctcagcgcaaccgtctgggaatacaccctggcaggtgagctggttgccccagagccaggtcagtacacctccatcggagtagtgcttgacgacggcgcccgccagctgcgccagtacagcttgctcggcggctccgacaccgagtaccgcattgcggttgaggataacggcgaggtttctggattcctgcgtgatcgcgtatccgttggtgacaagattgaagccaccatcgcggccggcgacctggttcttaacaaggacaccaatccagttgtgctgatttcccagggcatcggctccaccccaatggtgggcatgctcgcaggtatgaaccctgaacgtgacgttgtggttttgcatgctgaccaggccgagtccacctacgcgcaggtggaggaagtgcaggggctcgtcgaaaagctccctaaggctgcgtttgaaatcttctaccgcgacaacgaccagtggctcgaggtcgctggccgcattccatcaggtgcgtccgtgtacctgtgcggtggcgtggaattcttgaagaacgtgcgtgagcagatcgaggcgctcgatgagcagcctcgcgacgtaaacttcgagctcttcgcaccaaacgactggctgatttcctaagcccacaccccagaacttcc

SEQ ID NO: 41855 - protein, 386 aa, Corynebacterium glutamicum
MIVSTQPITDRSALSAEHAEVIKATLPLVGGKINEITPVFYNKMFAAHPELIANTFNGGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 41856 - DNA, 1506 bp, Fusarium oxysporum
  CDS (72)..(1319)
gtatatcaacaccacaacaacctctcaactcctcctcacatctcttcaacaccaaagaaaaacagtacacaatggctctcaccgcagcacaagtagcaattgtgaagtcaactgctcccatcctgaaggagcatggcaagactatcaccaccactttctaccgcaacatgctcggtgctcatcctgagctcaagaactacttctctctacgaaaccagcagaccggagctcaacaagctgctctcgccaactctgtcctcgcctacgccacatatatcgacgaccttggcaagctttcccacgccgttgagcgcattgctcacaagcacgtttctctcttcatcaagccagagcactaccccatcgttggcacacatctcatcggtgccattggcgaggttctcggttctgctttgacgactgagatcaaggacgcttgggttgctgcttatggccagctcgctgatatcttcatccagcgcgagggtcagatgtacgaggctgctggcgaatggaactcgtggcgcaagttcaagattgtcaagaaggaggctgagaacgactctgttactagcttctaccttgagcctactgatggcaagcctctgcccaagttcctccccggacaatacgtcagcgtacagattcccatccctgagcttgatggtcttcttcagagccgtcagttcagtctgagcgaggcccctggcaccaatcactaccgcatcagtgtcaagcttcagggtcctactgaggagcctgctgttgaggatctcgctgctggtaagattgctggtcttctctccaccagacttcacaaccgttacaacgtcggtgacgaggttgagctgagccctcctgctggagagttctcacttgaccctgccgacacttccgctgccaagaagcctcttgttctcctctccgctggtgttggcgccactcctctcgtctccatcctcgactcagttctccagtccccgaccgcctcacgacccatcacctggatccatggtgctcgctactcgggctctacctgcttcgtcccccatgttctcgactctgctaagaagcacgagaacatcactgccaagatcttcctcgaggatgttaaggagggtgaccagtacgacttcaagggcgagatcgaccttgccaagctccagaaggaacagcttctccagctcgacaacgctgatgctgagtactacatctgcggacctgaggactggatggtcaatgtcagggcattcctcgaggagaacggtgttccccgcgagcgccagcacctcgaactcttcaagactggtgatatttaaaaagtgatgcgctgcatatgatgggtttccttgtatttaatcggtttattgtctggcatgtcgagggcgttgaggatctgctgtgcttttttttgcagcggtatgttttgtttgctcagatcgaagaaagagtgcatatactagatactagataccaccctcaaaaacaaaaagaattattcaaccc

SEQ ID NO: 41857 - protein, 415 aa, Fusarium oxysporum
MALTAAQVAIVKSTAPILKEHGKTITTTFYRNMLGAHPELKNYFSLRNQQTGAQQAALANSVLAYATYIDDLGKLSHAVERIAHKHVSLFIKPEHYPIVGTHLIGAIGEVLGSALTTEIKDAWVAAYGQLADIFIQREGQMYEAAGEWNSWRKFKIVKKEAENDSVTSFYLEPTDGKPLPKFLPGQYVSVQIPIPELDGLLQSRQFSLSEAPGTNHYRISVKLQGPTEEPAVEDLAAGKIAGLLSTRLHNRYNVGDEVELSPPAGEFSLDPADTSAAKKPLVLLSAGVGATPLVSILDSVLQSPTASRPITWIHGARYSGSTCFVPHVLDSAKKHENITAKIFLEDVKEGDQYDFKGEIDLAKLQKEQLLQLDNADAEYYICGPEDWMVNVRAFLEENGVPRERQHLELFKTGDI

SEQ ID NO: 41858 - DNA, 1242 bp, Aspergillus fumigatus
  CDS (1)..(1242)
atgcctctaacaccagaacaagttcaaatcatcaaggccactgtgcctgtgctggcagagcatggcacaaccatcaccactgtgttctacaagaacatgctcactgcccatcccgagctcaacaatgtcttcaataccacgcaccaggttaccggccaccaagctcgtgctctcgccggggcgctcttcgcctatgcctccaacatcgacaacctgggtgctcttggacccgccgtcgagctcatgtgccacaaacacgcctcgctgtacatcaagccggacgactacaagattgtcggcaaattcctgctcgaagcaatgggccaggtcctcggggacgccctcaccccggagattctcgacgcctgggccaccgcctactggcaactggccgacatcatgatcgggcgcgaggcccagctttacgagcaagccgagggctggaccgacttccgtgactttgtcgtcgcgctgaaggtccctgaatcttcggaaatcacctccttctatctgaagccggcggacggcaagcctctgccggccttccagccgggacagtacatctccgtgcaggtccacgtccccgagctcaactacctgcaggcgcgccagtactctctcagcgacatgccccggtcagactactaccgcatcagcgtgaagaaggaatcgggactgaaccccgccgagcccggggccaaggcgcaccccggccacgtgtcgaacatcctgcacgcgtcggtcaacgagggcgataccatcaaggtctctcatccgttcggcgactttttcctgtctgacgcgaaagccgcgcaccccgtggtgctcctctcggccggtgtcggtctgacccccatgacgtcgattctcaacacgctgacctcgcaggctccggagcgcaaggtcagcttcatccacggcgcccgaaacgctcgggcgcgtgcgttcaagaaccacatcacctctctggaacagaagctgccaaacctcaagtccacctttttcaccagccatcccacggaggaggacaaggagggcgatgattaccagttccgcggccgtgtggatctgagccagttggacagcaaccgggatctgttcctggatgatgccacaacggagtactacgtgtgcggacccgacacgttcatgacggacatgctgaatgttctcaagtccaagggcgtgagcgaggaccgcgtgaagctggagctgttcggaactggcggtgttcctcattga

SEQ ID NO: 41859 - protein, 413 aa, Aspergillus fumigatus
MPLTPEQVQIIKATVPVLAEHGTTITTVFYKNMLTAHPELNNVFNTTHQVTGHQARALAGALFAYASNIDNLGALGPAVELMCHKHASLYIKPDDYKIVGKFLLEAMGQVLGDALTPEILDAWATAYWQLADIMIGREAQLYEQAEGWTDFRDFVVALKVPESSEITSFYLKPADGKPLPAFQPGQYISVQVHVPELNYLQARQYSLSDMPRSDYYRISVKKESGLNPAEPGAKAHPGHVSNILHASVNEGDTIKVSHPFGDFFLSDAKAAHPVVLLSAGVGLTPMTSILNTLTSQAPERKVSFIHGARNARARAFKNHITSLEQKLPNLKSTFFTSHPTEEDKEGDDYQFRGRVDLSQLDSNRDLFLDDATTEYYVCGPDTFMTDMLNVLKSKGVSEDRVKLELFGTGGVPH

SEQ ID NO: 41860 - DNA, 1206 bp, Debaryomyces hansenii CBS767
  CDS (1)..(1206)
atggcaatcaatactccagtaatttacaagattagagaattaactccgcgcgaaaagaaattgatcaaagcatcgattccaatactcgacgaggatgtattaacttccaagttttacaatcatatgctcactgattttccagaagtgagaccttttttcaatgaaacccatcaaaagacgatgaaacaacccagaattttggcgtttggtttattgcattacgttaagaatattgatgacctagctccacttacaacatttgtaaatcaaatagttgttaagcatgtaggtttacaagttaaaccggaccattatcctattgttggacaatgtattttggatacgatgaagactttattaggtgacagaattgcgacagaagaatttttaactgcttgggcaactgcgtatggcaacttagctcaaaccttgatcaacgcggaagctgataaatataagtcaaatgaatgggatggtttccgtgatttcaatatttcacgtattgtgaacgaatctaaaaacgttaagtccgtttatttcaaacctgttgatggcggaaaaattgctattccaaagagaggacaatatgtttgtataagattcaaattaccagactcagaaacggagaagggtagggaatattctctttcgcaatatccaagttctgatgaatatcgtatttctgttcgtttagtcgaagatggtcagatttctccatttatacataacggattacaagttggttctactatccgtgttactcccccagcaggtcaatttgtatatcgcgaagctaactctgataaatcggttgttttatttgtaggaggtattggaattactggattagtttcaatcactgaaaaggctttagaaagtggtcgtcaggtgtacatgctcaattctaatagacaagttgaaaccagaccttttgctaagtggttgcaaggcttaaaggaaaaatatggagataaattcaagctaattgagtttacctcgaatgaatctgattcgggtcttcatgctatcgacaagttggaatctcgtagattagctgctcaagattttgactttgttaaaccaaacttcgattattacatgttaggtcctaacccatatatgaaatttgttaaaggagagttgttgaatagaggcattgaagaatcggcaatcacttctgagttttatggtcctatggaagtataa

SEQ ID NO: 41861 - protein, 401 aa, Debaryomyces hansenii CBS767
MAINTPVIYKIRELTPREKKLIKASIPILDEDVLTSKFYNHMLTDFPEVRPFFNETHQKTMKQPRILAFGLLHYVKNIDDLAPLTTFVNQIVVKHVGLQVKPDHYPIVGQCILDTMKTLLGDRIATEEFLTAWATAYGNLAQTLINAEADKYKSNEWDGFRDFNISRIVNESKNVKSVYFKPVDGGKIAIPKRGQYVCIRFKLPDSETEKGREYSLSQYPSSDEYRISVRLVEDGQISPFIHNGLQVGSTIRVTPPAGQFVYREANSDKSVVLFVGGIGITGLVSITEKALESGRQVYMLNSNRQVETRPFAKWLQGLKEKYGDKFKLIEFTSNESDSGLHAIDKLESRRLAAQDFDFVKPNFDYYMLGPNPYMKFVKGELLNRGIEESAITSEFYGPMEV

SEQ ID NO: 41862 - DNA, 1212 bp, Debaryomyces hansenii CBS767
  CDS (1)..(1212)
atgacaattgtcactccagtaatttaccagattagagaattaactccccgtgaaaaggaattgattaaagcatcggttccaatactcgaagagtcaggggatgtgttaacttctaagttttacaatcatatgctcaccgattttccagaagtaaagcctttcttcaacgaatccaaccaaaagaccatgaaacaacctaaaattttggcatttgctttattgcattacgccaagaatattgatgacatagctccacttacagcatttgtaaatcaaatagttgttaagcatgtaggtttacaagttaaaccggaacattatcctattgttggtcaatgtcttttagatacaatggagactttattaggtccagaaattgcaacagaagaatttttgactgcatgggcaactgcttatggtaatttggcccaaattttaatcaacgctgaagctgagaaatataaaacaatggaatgggatggattccgtggattcaaaattacacgtatcgagaatgaatctagaaacgtcaagtctgtttacttcaaacctgctgatggcggaaaaattgctatgcctaagagaggacaatacgtctgtattagatttaagttaccagactctgatacagagaaaagtagggaatattctctctctcaatatcctagctctgatgaatatcgtatctctgttcgtttactcgaaggtggacagatttccccatttatacataacggattgcaagttggttctactatccgtgttagccccccagcaggtcaattcatatatcgtgaatctgacgttgctaagccagttgttttattcgtagggggtatcggtattactcctttagtttcgatcactgaaaaggctttagaaagtggccgtcaggtgtacatgctcaattctaatagacaagttgaaaccagaccttttgctaagtggttgcaaggcttaaaggaaaaatatggagataaattcaagctaattgagtttatctcgaatgaatctgattcgggtcttcatgctatcgacaagttggaatctcgtagattagctgctcaagattttgactttgttaaaccaaacttcgattattacatgttaggtcctaacccttacatgaattttgttaaaggagagttgttgaataggggtgttgaggaatcggaaattgcttctgaattttttggccctatggaagtataa

SEQ ID NO: 41863 - protein, 403 aa, Debaryomyces hansenii CBS767
MTIVTPVIYQIRELTPREKELIKASVPILEESGDVLTSKFYNHMLTDFPEVKPFFNESNQKTMKQPKILAFALLHYAKNIDDIAPLTAFVNQIVVKHVGLQVKPEHYPIVGQCLLDTMETLLGPEIATEEFLTAWATAYGNLAQILINAEAEKYKTMEWDGFRGFKITRIENESRNVKSVYFKPADGGKIAMPKRGQYVCIRFKLPDSDTEKSREYSLSQYPSSDEYRISVRLLEGGQISPFIHNGLQVGSTIRVSPPAGQFIYRESDVAKPVVLFVGGIGITPLVSITEKALESGRQVYMLNSNRQVETRPFAKWLQGLKEKYGDKFKLIEFISNESDSGLHAIDKLESRRLAAQDFDFVKPNFDYYMLGPNPYMNFVKGELLNRGVEESEIASEFFGPMEV

SEQ ID NO: 41864 - DNA, 1125 bp, Yarrowia lipolytica CLIB99
  CDS (1)..(1125)
atgctcaccgacgcccagatcaaaatcatcaaggactctgcccccttcctggcagaaaatggcactgactttgctgccaagatgtacaagtacatgttcgccacctaccccgaggtgatccgattcttcaaccagagcgaccagaagaacctggcccagcccaagattctggcccacgctctggttgcctacgcctccaacattgacaaccttggcgtgctgtccgactttgtcgagcagattgtcgtcaagcacgttggcctgcagatccagcccgagcagtaccccattgtggccgcttccatcatccacaccctcaaggagatgctcggcgaggctgccacccccgagttcatcgaggcctggaccgtggcttacacccagctggccaacattctcatcgacgccgagaagaagctgtacgagaagcaggcttctctggccggcggctgggagggcttccgagactttgtcgtgaccaaggtcgaggacgagtcttccaacgtcaagtccgtctacttcaagtctgccgacggcaagcccgtttccactcccatccccggccagtacgtgactttcctcttcaccttcaacggccaggagaccatgcgatcctataccgtttcccagaaggtgactggagacgagtaccgaatctccgtgcgaaaggtcaagggcggcctcgtttccacttacatccacaccgaggtcaagcccggcactcagctcaaggttgctcctcctaccggccgattcacctacaccgacgatggcaagaagattctctttgtggccggcggcattggcatcactcctctcatctccatcattgaggagaccaagggtaaggagggcaacgcgctcatctactgtgaccgatcgcccgagacccagcctttcggcaagtggctgcaggacgctggcgtcaagaccaccaacgtttactccgagaccgccgacaagcgacacatcagcaaggacgactttgccggtgttgatctcagcaacgtcaacgtctaccttctgggccctccccccttcatgaccactgtgcgaaagctgctgagcgagcttggtttctccggcgagatcaagaccgagtttttcggccctgtcgaggtttaa

SEQ ID NO: 41865 - protein, 374 aa, Yarrowia lipolytica CLIB99
MLTDAQIKIIKDSAPFLAENGTDFAAKMYKYMFATYPEVIRFFNQSDQKNLAQPKILAHALVAYASNIDNLGVLSDFVEQIVVKHVGLQIQPEQYPIVAASIIHTLKEMLGEAATPEFIEAWTVAYTQLANILIDAEKKLYEKQASLAGGWEGFRDFVVTKVEDESSNVKSVYFKSADGKPVSTPIPGQYVTFLFTFNGQETMRSYTVSQKVTGDEYRISVRKVKGGLVSTYIHTEVKPGTQLKVAPPTGRFTYTDDGKKILFVAGGIGITPLISIIEETKGKEGNALIYCDRSPETQPFGKWLQDAGVKTTNVYSETADKRHISKDDFAGVDLSNVNVYLLGPPPFMTTVRKLLSELGFSGEIKTEFFGPVEV

SEQ ID NO: 41866 - DNA, 1188 bp, Kluyveromyces lactis NRRL Y
  CDS (1)..(1188)
atgctgtccgttaatacgaaaaatatcgtgaaggccaccgtgccagtactagaacaacatggtgttaccatcaccaaaatcttctacaacaacatgctttctgaaaaccctgtccttttgaacactttcaacagagtgaatcaaaagaagggtagacaacccaccgcattggcaatgaccgttttggctgctgctaagaacattgatgacttgtccgtcttattgcctgccgtgaatgaaatcggccaaaagcaccgtgctttacaagttgaaccagcacaatatgatatcgtcggaaaatacttgttgttggctatcaaagaagttttgggcagtgctgctacaccagaaattatccaagcttggggcgaagcttacaaagtcattgctgacattttcatcagtgttgaaaaggaaatgtataagaaggcagcatggccatcttggaaacctttcgttgtcactgaaaagacacatgtcgcagacgaaatcatcgaatttgtcgtcaagaccgctccaggttgtgacgtcgatttgtcaaagttgaaaatcgtcccaggccaatatttgaccgttaagacccatccaaccacccatgacaacgaatatgacgccttgagacattactccatttgttctgagtctactgaagacggattgaaattcgccgttaagtacgaacacggtgaagaacaagacggtttggtctctgaatacatgcataaattcatcaacgttggtgaccaaatcgaactaagtgctccagccggtgacttcgaaatgaacaaagaattgattaaacaagaagaagtcccattggtactaatcagcgctggtgtaggtgccactccattggtcgccatgcttgaattccaacagaaacataacccaaagagacctgttttgtggatccaatcttctaacgatgaaatgtctcaaccgttcaaggatcacgtgaccgacttgctatcgaaattcgacaacgccagatccgaaatcgtacacacagcatccatgccaagaatagacggtaccttcttggaaaagcatatcccaggccactctgacgtctacatctgtggttctatcgagttcatggaaactttaatgggcgttctaaaggatttgggccaccatgatcaaatgattcattacgaaccttttggtccaaagatgtccttagtgtag

SEQ ID NO: 41867 - protein, 395 aa, Kluyveromyces lactis NRRL Y
MLSVNTKNIVKATVPVLEQHGVTITKIFYNNMLSENPVLLNTFNRVNQKKGRQPTALAMTVLAAAKNIDDLSVLLPAVNEIGQKHRALQVEPAQYDIVGKYLLLAIKEVLGSAATPEIIQAWGEAYKVIADIFISVEKEMYKKAAWPSWKPFVVTEKTHVADEIIEFVVKTAPGCDVDLSKLKIVPGQYLTVKTHPTTHDNEYDALRHYSICSESTEDGLKFAVKYEHGEEQDGLVSEYMHKFINVGDQIELSAPAGDFEMNKELIKQEEVPLVLISAGVGATPLVAMLEFQQKHNPKRPVLWIQSSNDEMSQPFKDHVTDLLSKFDNARSEIVHTASMPRIDGTFLEKHIPGHSDVYICGSIEFMETLMGVLKDLGHHDQMIHYEPFGPKMSLV

SEQ ID NO: 41868 - DNA, 1191 bp, Erwinia carotovora
  CDS (1)..(1191)
atgctggataaccacactatcgccatcgttaaatcgaccatccctctgctggcggaaaccggcccgaaactaaccgcacatttttacgatcgcatgtttacacataaccctgagctcaaagatatctttaacatgagcaaccagcgcaatggcgatcagcgggaagcactgttcaatgccatttgtgcttatgcgacgaatattgaaaacctggctgcgctgctgcctgcggttgagcgcatcgcccagaaacataccagttttaacattcaggcagatcagtatcagatcgtgggtaatcacttattggccacgctggacgaaatgtttagcccagggcaagaagtgctggatgcctggggtaaagcctatggcgtgctggcgaacgttttcatccagcgtgaggacgatatctatcgcagcaccgaaacgaaaaccggcggctggagtggcgtgcggcctttccgtattgtgaacaaacagttgcaaagttccgtgattaccagcttcacactggaacccaccgacggccagcctattgctgattttcagccgggccagtatctggcgatttatatcaagcatgacagttttgccaatcaggaaattcgccaatactcgctgactcatgcgccgaatgggaaatcctaccggattgcggttaaacgtgaagcacaaggcactgtttccggctatctgcatgataccgctcgcgaaggcgatattgttcatctggcggctccgcacggcgacttcttccttgatattccaaccgacacaccggttgccttgatttcaggcggcgtggggcagacccccatgctgggcatgctgcatacgttaaaacaacaggatcatcaggcgaaggtgctatggctgcacgcggcagaaaacggcacagcacacgcgtttactgatgaaattgaacaaacgggacaggcgctgccgcatttcgatcaccacatctggtatcgggaaccgcaacaaaccgatcgtccgggtgaagattatcatcacagcggactgatgcagttggcctcgctaaaaggcgaattgaccacgcccgatatgcactattacctgtgtggccccgtggttttcatgcagtttgtcgcgcagcaactgctggcaatgggcattcccgctgagcagctgcattacgaatgttttggtccacataaagtcgtctaa

SEQ ID NO: 41869 - protein, 396 aa, Erwinia carotovora
MLDNHTIAIVKSTIPLLAETGPKLTAHFYDRMFTHNPELKDIFNMSNQRNGDQREALFNAICAYATNIENLAALLPAVERIAQKHTSFNIQADQYQIVGNHLLATLDEMFSPGQEVLDAWGKAYGVLANVFIQREDDIYRSTETKTGGWSGVRPFRIVNKQLQSSVITSFTLEPTDGQPIADFQPGQYLAIYIKHDSFANQEIRQYSLTHAPNGKSYRIAVKREAQGTVSGYLHDTAREGDIVHLAAPHGDFFLDIPTDTPVALISGGVGQTPMLGMLHTLKQQDHQAKVLWLHAAENGTAHAFTDEIEQTGQALPHFDHHIWYREPQQTDRPGEDYHHSGLMQLASLKGELTTPDMHYYLCGPVVFMQFVAQQLLAMGIPAEQLHYECFGPHKVV

SEQ ID NO: 41870 - DNA, 1146 bp, Staphylococcus aureus
  CDS (1)..(1146)
atgcttacagaacaagagaaagacattatcaaacaaacggtgccattgcttaaagaaaaaggaacagaaattacgtcaatcttttatccaaaaatgtttaaggcacatcctgaacttttaaatatgtttaatcaaacgaaccaaaaaagaggcatgcaatcttcagcattagcacaagctgtaatggccgcagcggttaatatcgataatttaagtgttattaaaccagttattatgccagttgcatataaacactgcgcactacaagtttatgctgaacattatccaattgtgggggaaaatttattaaaagccattcaagacgtgacaggattagaagaaaatgaccctgtcattcaagcttgggcgaaagcatatggcgttattgcggatgtgttcatccaaattgaaaaagaaatttatgatcaaatgatgtggattggttttaaaccattcaaaattaccaatattaaacaagaatctgaagacattaaatcatttacagttgaaactgatgcatatgactttagtcaatatgtaccaggccaatacatcacagttgatgtttctagtgataaacttccatatagagctaaacgtcactattctatcgtatcaggtgataaaaatcatttaacctttggcgttaaacgtgatgtcacaacagaacatgaaggcgaagtttcaacaattttacacgatgagattaaagaaggcgatatgattaatttagctgcacctgtaggtggattcgtattagagaatacgactgaaccacaacttttcttaggttcaggtattggcgtcacacctttagtagcaatgtatgaagctgcctctgccaaaggtttagatactcagatggttcaagttgctgaaaatgaacaacatttacctttcaaagacaacttcaacagtattgcaaatcattatgacaacgctaaattatatacccacttaaaaggcgaacaaggttatatcggtgctgaagaattaaaagcatttttagcaaataaacctgaaatttatatctgtggtggtacaaaattcttacaatctatgatcgaagcacttaaatctttaaattacgatatggatcgcgtacactacgaaacatttattccaagactaagcgttgtagtataa

SEQ ID NO: 41871 - protein, 381 aa, Staphylococcus aureus
MLTEQEKDIIKQTVPLLKEKGTEITSIFYPKMFKAHPELLNMFNQTNQKRGMQSSALAQAVMAAAVNIDNLSVIKPVIMPVAYKHCALQVYAEHYPIVGENLLKAIQDVTGLEENDPVIQAWAKAYGVIADVFIQIEKEIYDQMMWIGFKPFKITNIKQESEDIKSFTVETDAYDFSQYVPGQYITVDVSSDKLPYRAKRHYSIVSGDKNHLTFGVKRDVTTEHEGEVSTILHDEIKEGDMINLAAPVGGFVLENTTEPQLFLGSGIGVTPLVAMYEAASAKGLDTQMVQVAENEQHLPFKDNFNSIANHYDNAKLYTHLKGEQGYIGAEELKAFLANKPEIYICGGTKFLQSMIEALKSLNYDMDRVHYETFIPRLSVVV

SEQ ID NO: 41872 - DNA, 1588 bp, Giardia lamblia ATCC 50803
  CDS (101)..(1477)
cactcgcttcggcacatcttttgcatttaatttcaaccacgattatgttcgccaccacaagcgatcattcttctgttcaacagatctactaaaatatcaaatgacgctttccgaagacaccctgagggccgtggaggcgaccgccggcctcatcgccgctcaaggcatcgagtttactcgcgccttctacgagcgcatgttgaccaagaacgaagagctgaagaacatcttcaatctagcccaccagcgcaccctgcgccagcccaaggccctgctcgactccctcgtcgcctacgcgctgaatatccgtaggatcaatgagctgtacgagctgaaggggaagggcctgccggtgccgccagagcactgggccgagctgcagggcttcttctctgccgccgagcgtgtcgcgaacaagcacaccagctttggcatccaacctgcgcagtatcagattgtcggcgcacacctgctcgctaccatcgaggatcgcataaccaaagacaaggacattctcgcagagtgggccaaggcctaccaattcctcgccgacctcttcatcaaacgcgaggaggagatctatgccgcgacagagggctgcaagggcgggtggcgccagactcgcacgttccgcgtcgaggaaaagaccagggtcaacgaaatcatctgcaagttcaggctcgtcccggctgaggagggcgccggcgtggtagagcacaggcccgggcagtaccttgctatcttcgtccgcagccccgagcacttccagcaccagcagattcgccagtactcaattatttcggcgccgaatagcgcgtactacgagatcgcggtgcacagggacgaaaaggggactgtttcccgctatctccatgattacgtgagcactggcgatctgctcgaggtcgcgccgccttacggggacttcttcctcaggtatctcgaggccgatgagcaggcccctgcggacacacaggcctcgcaagagttccaaatgctgcagagcggggccatcaactttgcggcagagaagacgatgccgattgtgctcatctccggcggcatcggccagaccccgctgctgtcgatgctcaggttcctcgcgcagaaggagggcaaggagacggcccgccccatcttctggatccatgccgcgcacaacagccgcgtccgcgccttcaaggaagaggttgacgcgatcagagagacggctctgccaagcctgcgcgtcgtgacctttctgagcgaggtcagggcgacggacagagagggcgaggattacgacttcgccgggcgcatcaaccttgaccgtatctcggaactcaccaagctggaggcagacaacgccaatccgcactacttcttcgtcggcccgaccggcttcatgaccgccgtggaggagcagctcaagaccaagtccgtgcccaatagccgcatccacttcgagatgttcggccccttcaaggcctcccattagctgcccgcacacggccctccgccggtgtgtgtagacgattacatcgccatcccaggctccatgagcccggtccgtgcctggccctgcttcgctgcatctctgctgaagaag

SEQ ID NO: 41873 - protein, 458 aa, Giardia lamblia ATCC 50803
MTLSEDTLRAVEATAGLIAAQGIEFTRAFYERMLTKNEELKNIFNLAHQRTLRQPKALLDSLVAYALNIRRINELYELKGKGLPVPPEHWAELQGFFSAAERVANKHTSFGIQPAQYQIVGAHLLATIEDRITKDKDILAEWAKAYQFLADLFIKREEEIYAATEGCKGGWRQTRTFRVEEKTRVNEIICKFRLVPAEEGAGVVEHRPGQYLAIFVRSPEHFQHQQIRQYSIISAPNSAYYEIAVHRDEKGTVSRYLHDYVSTGDLLEVAPPYGDFFLRYLEADEQAPADTQASQEFQMLQSGAINFAAEKTMPIVLISGGIGQTPLLSMLRFLAQKEGKETARPIFWIHAAHNSRVRAFKEEVDAIRETALPSLRVVTFLSEVRATDREGEDYDFAGRINLDRISELTKLEADNANPHYFFVGPTGFMTAVEEQLKTKSVPNSRIHFEMFGPFKASH

SEQ ID NO: 41874 - DNA, 1257 bp, Neurospora crassa
  CDS (1)..(1257)
atgaccctcaccgacgcccaaatatccatcgtcaaatccaccgcccctgtcctcaagcaacacggcgaagccatcaccaccgtcttctacaacgacctcatcacggagaacccctccctcaaaaacatcttcagccttacctcgcaagccaccggcgcccaaccgcgcgccctcgcccacgccgtcctcgcctatgccacctacatcgacaacctttccgcgctctcggaggcggtcgcgcgcattgcgcacaagcacgtgtctctccaagtcgagccggcgcagtacgctattgtcggccaatacctgatccaagccatcggcaaggttctgggcgatgcggcgactcccgagattgtagacgcttggacggcggcatatggagttttggcgaacgtttttattggcgtcgagggaggcatgtacgaggagaatgaaaagaaagaccactggaaggggtggaggaagttcaggattgcgaggaaggtggaggagagcagttccatttcgagcttttacctgaggcccgtggatggggccactctgcccaagtatctgcctggccagtatgtgtctgtgcaggtgctggtctcgcagttggggtatttgcagagtaggcagtacagcttgagcgaggcgccgaaggagggcgggatggaggaatatcgtattagtgtcaagagggaggaaggggaaaccggtgcgccgggactggtttccaacttgctccatggtatgcaagagggcgcggaggtggaggttagtcatccccagggcgagttcttccttgaccccgcggatgcaagcaaggagggggtgccggctgtgttgatctcggtgggcgtgggcgctactccgatgatggctatcctcaagagcttgcttcaggagaatgtcaagaggagaccggtgtcgtggatccatgcgagcaagtcgagctcgacgcagccgtttggcgaggaggtgaggcgcatcgtcaaggagaaccctgagcaggtgtcggcacatgtgtttctgaagacggtggctggtacggatcaggccggtgtgcattacgattttgcggatacgaggatggacttgaccaagttggatggggagcgggatctgcatttggcggataagaggaccgagtactacatctgcggaccggagacgtttatggtggaaaccaggaaagtgttggttggtcttggagtagataagagcaaggtgcacttggagctttttgctacgggtttcgttgctgatgagtag

SEQ ID NO: 41875 - protein, 418 aa, Neurospora crassa
MTLTDAQISIVKSTAPVLKQHGEAITTVFYNDLITENPSLKNIFSLTSQATGAQPRALAHAVLAYATYIDNLSALSEAVARIAHKHVSLQVEPAQYAIVGQYLIQAIGKVLGDAATPEIVDAWTAAYGVLANVFIGVEGGMYEENEKKDHWKGWRKFRIARKVEESSSISSFYLRPVDGATLPKYLPGQYVSVQVLVSQLGYLQSRQYSLSEAPKEGGMEEYRISVKREEGETGAPGLVSNLLHGMQEGAEVEVSHPQGEFFLDPADASKEGVPAVLISVGVGATPMMAILKSLLQENVKRRPVSWIHASKSSSTQPFGEEVRRIVKENPEQVSAHVFLKTVAGTDQAGVHYDFADTRMDLTKLDGERDLHLADKRTEYYICGPETFMVETRKVLVGLGVDKSKVHLELFATGFVADE

SEQ ID NO: 41876 - DNA, 1614 bp, Neurospora crassa
  CDS (1)..(1614)
atggctctcacttaccaacaaagtaagctcgtcagagatactatacccgctctcaaggagcacggtgagaggataacgagcatcttctacaagactatgctcaccgaccaccccgaactcaacaactacttcaactcggtaaaccagaagaatggcaggcaacctcgggccctgacggccgtcatcttgggcttcgcctcaaacattaaccatcttagcgagctcgtccccaagtttgagcgcatgtgcaacaagcactgctcgttgggtatccagccagaacactacgaggttgtcggcaagtatctcatccaggctttcggcgaggttttgggccccgcgatgacgcccgaggtgcagacggcatggacaaaggcatattggatgctagccaagatgttgattgggcgcgaggcacagttgtacagggactttgagagctggccctcatggcgccctttcaagatcgacaggattgtcaacgagtgcgatgacctctacaccttctatcttgttcctcaggatggaaagaggttaccgaaattcctacccggccagtacgtctccgtccagatccaggtccctggtggcaacctccagtccagacagtattccctcagtgaggcgtggagggaggattactaccgtatcaccatccgccgagacgagggcaccgtctactccaactcagtttccaagtccttcttcaaccccggcatcgtctccaactaccttatcgatcaaactaccgtcggttctatccttcaggtctctcacccggctggcgagtttttcttggacgtccacaacacgagcacggtgcctctggttctgatttctgctggtgtcggcgtcactcccatggtttccatcgccaacaccgttatggagagtcaacccagtcgccaaattgcctggatccatggctgccgcaagcatatcccctttgaggaccacatcaagactttgcgcaagaagaatagcaacttccaaaccaagatcttcaagaccgtcatcaacagcactgatcgtcctggcgagacatatgactacaacgagcgcatggacctggccaagctcaagcccgaggagctccatcttcagcatggcggcactgagtacttcatctgcggcccggagcagttcatggtcaaccaaaaactctacctcatgcagcaaggtgtctcggcctcgcgcatcaaatgcgagatcttcaccacgggcgatttgaagctgggtctcataatagagaccatcgatcaggaggaggaggctggggacgaaaagagggtgacacatataagcagagaaggagggggtggatgggaaaatgtggcgcctgatccccgcaaggcgagaaggtctccatcgctttccacaaagctgcccaaacggagaaaccacgccgccgtgtccgggctcagcacaggcagcggcactcagaaacttgccccgactctgctcaacccctcgtcaacaaggacccgacgagacatgacaatacctccaccaacaacaactacggcgatgcccggtatggaggaggaggaggaggaggagagaagagaagaagagcgtcgatatcggtggcgggaagcatcagcactgggataa

SEQ ID NO: 41877 - protein, 537 aa, Neurospora crassa
MALTYQQSKLVRDTIPALKEHGERITSIFYKTMLTDHPELNNYFNSVNQKNGRQPRALTAVILGFASNINHLSELVPKFERMCNKHCSLGIQPEHYEVVGKYLIQAFGEVLGPAMTPEVQTAWTKAYWMLAKMLIGREAQLYRDFESWPSWRPFKIDRIVNECDDLYTFYLVPQDGKRLPKFLPGQYVSVQIQVPGGNLQSRQYSLSEAWREDYYRITIRRDEGTVYSNSVSKSFFNPGIVSNYLIDQTTVGSILQVSHPAGEFFLDVHNTSTVPLVLISAGVGVTPMVSIANTVMESQPSRQIAWIHGCRKHIPFEDHIKTLRKKNSNFQTKIFKTVINSTDRPGETYDYNERMDLAKLKPEELHLQHGGTEYFICGPEQFMVNQKLYLMQQGVSASRIKCEIFTTGDLKLGLIIETIDQEEEAGDEKRVTHISREGGGGWENVAPDPRKARRSPSLSTKLPKRRNHAAVSGLSTGSGTQKLAPTLLNPSSTRTRRDMTIPPPTTTTAMPGMEEEEEEERREEERRYRWREASALG

SEQ ID NO: 41878 - DNA, 1203 bp, Streptomyces avermitilis
  CDS (1)..(1203)
atgctgtccgagcagtccgccgccaccgtgcgcgccaccctccccgccgtcggcgcggccgtcggcgagatcaccgcgcgcttctacgaccggctgttcgccgcccgccccgagctgctgcgcgacctcttcaaccgcggcaaccaggcggcggggacgcagcggcaggcgctggcgggctcgatcgccgcgttcgccacgtacctcgtggaacacccggacgagcgccccgacgcgatgctggaccgcatcgcccacaagcacgcctccctgggcatcgcacccgggcagtacgcggtcgtccacgagcacctcttcgcggccatcgccgaggtcctcggcgacgcggtcacccccgaggtcgcggccgcctgggacgaggtctactggctgatggcgaacgcgctcatcgccatcgagcggcggctgtacgcgcagcacgagaacaccggtgacaccggcggccggcggccctggcgggtcgtggagcgcgtggacgagaccgccgacgtcgccgccttccggctgcgcccggccgacggccggcccctcccggacttccgccccggccagtacgtgtccgtccgcgtcgaactcccggacggcgcccgccagacccgccagtacagcctcgtcggcgcgcccggctcaccggagctgcggatcgccgtgaagcgcgtccacggcggtacgacaccggacggcgaggtctcgaaccatctccacgcgcgcgtgcgcgagggcagcgtcctggagctctccgccccgtacggcgatctcgccctggaggccacggacgtgcccctgctgctcgcctccgccggcatcggcgtgaccccgatgatcgcgatgctggagcacctcgccctgaccggccaccgcgccccggtcaccgtcgtgcacgccgaccgctcgccggccgagcacgccctgcgcgcggaccacgaggcgtacgcggccaagctcgcggacgcggccgtccacttctggtacgagcacccggagccggggcacccggccgaccgcacggggctcgtcgacctgaccggcgtgccggtctccgccggcacgcgcgcgtacctgtgcggtccgctgcccttcatgcgcgccgtccgtacccagctcatcgagaagggcgtggcacccgccgacatccactacgaggtgttcggacccgacctctggctcgcccgggagagctga

SEQ ID NO: 41879 - protein, 400 aa, Streptomyces avermitilis
MLSEQSAATVRATLPAVGAAVGEITARFYDRLFAARPELLRDLFNRGNQAAGTQRQALAGSIAAFATYLVEHPDERPDAMLDRIAHKHASLGIAPGQYAVVHEHLFAAIAEVLGDAVTPEVAAAWDEVYWLMANALIAIERRLYAQHENTGDTGGRRPWRVVERVDETADVAAFRLRPADGRPLPDFRPGQYVSVRVELPDGARQTRQYSLVGAPGSPELRIAVKRVHGGTTPDGEVSNHLHARVREGSVLELSAPYGDLALEATDVPLLLASAGIGVTPMIAMLEHLALTGHRAPVTVVHADRSPAEHALRADHEAYAAKLADAAVHFWYEHPEPGHPADRTGLVDLTGVPVSAGTRAYLCGPLPFMRAVRTQLIEKGVAPADIHYEVFGPDLWLARES

SEQ ID NO: 41880 - DNA, 1146 bp, Staphylococcus epidermidis
  CDS (1)..(1146)
atgctaactgaaaaagagcaagatattatcaaacaaactgtaccattattacaagataaaggaactgagattacttcaattttttatcctaagatgtttgaggctaacccagaattattaaacatgtttaaccaaacaaaccaaaagaaaggtatgcaatctgctgcattagcacaagcagtactagctgcagcaatgaatattaataatttaggtgcaattaagccagcaattatgcctgtggcacataagcactgtgctttacaagtttatcccgaacattatccaattgtaggtgaaaatttacttgctgcaattcaagatgtgacagggttagaaagtgacgacccagtaattcaaacatgggcaaaagcgtatggagaaattgcagatgtatttatcaaattagagcaagaaatttacaaccatatgttatggaaaggttttaaaccatttaaaatcacaaacattacacaagaaacaagtgacatcaaatctttcacagttgaatctgaagaatatgatttaagtcaattcgaaccaggtcaatacattaccgtagatgtttctagtgaaaagttaccatatagagctaaacgtcattattcaatcatagatggagatgaaaatcacttagtatttggtgtcaaacgtgatgtgactactgaacatgaaggtgaagtttcaacaattttacatgatgaaatatcagaaggtgacatgattaatttatctgctcctgtaggtggcttttcaatagaaaatactgaaagaccgcaattgtttattggttctggcgtaggtatgacaccattagtttcaatgtttaaaaaagctgcatcattaaacgttccaactcaaatgattcaagcggttgtgacagaagatgaacgaccatttgctcaaaaacttgatagcattacagataattatgagcaagcacagctacatttacacgtgaaagataaagaaggttatttagaagctaaagaattagaacaatatttaagtgaacagcctgaaatttatatttgtggtggtacgaaattcttacattcaattataaattctcttaaagaattaaattatgatatgaatcatgttcattttgaaacatttattcctcgtttaagtgttcaagtatag

SEQ ID NO: 41881 - protein, 381 aa, Staphylococcus epidermidis
MLTEKEQDIIKQTVPLLQDKGTEITSIFYPKMFEANPELLNMFNQTNQKKGMQSAALAQAVLAAAMNINNLGAIKPAIMPVAHKHCALQVYPEHYPIVGENLLAAIQDVTGLESDDPVIQTWAKAYGEIADVFIKLEQEIYNHMLWKGFKPFKITNITQETSDIKSFTVESEEYDLSQFEPGQYITVDVSSEKLPYRAKRHYSIIDGDENHLVFGVKRDVTTEHEGEVSTILHDEISEGDMINLSAPVGGFSIENTERPQLFIGSGVGMTPLVSMFKKAASLNVPTQMIQAVVTEDERPFAQKLDSITDNYEQAQLHLHVKDKEGYLEAKELEQYLSEQPEIYICGGTKFLHSIINSLKELNYDMNHVHFETFIPRLSVQV

SEQ ID NO: 41882 - DNA, 1215 bp, Corynebacterium efficiens
  CDS (1)..(1215)
atgatcggggtttcccgccccactccccagaattcctaccccggaggttccaccgtgatcgtctcgaccaagcccttgaccgaccgcagcaggctgtccgaagcccacgccgagatgatcaaggcgaccctgcccctggtcggcagcaagatcaacgacatcacccccgtcttctacaaccggatgttcaccgcgcacccggaactgctccgcagcaccttcaaccgcgccaaccagaagcagggtgatcagcagaaggcactggccgcctccatcgcaaccttcgccaccatgcttgttgatccagaggcaccggaccccgtggacatgctcgcccgcatcggccacaagcacgtctccctcggcatcaccgccgaccagtacaacatcgtccatgagcacctgttcggcgccatcgtcgaggtgctcggcgcagacgtggtcaccccaccggtcgccgaggcctgggatgccgtctactggctcatggccaacgtcctcatcgacctggagagcgacctctatgcctccaacgacctcgccccgggtgatgtgttccgccacgtcaccgtcactggtaagaagcagctcagcgacaaggtctgggagtacaccttcgaaggcgacctcgtcaccccggcgccgggccagtacacctccatcggcgtaaagcttcccgacggcgcacgccaactccgccagtactcactgctcagcggcaccgacagccagtaccgcatcgccgtggaggacaacggtgaggtctccaccttcctgcgggacaacgtggaggtcggcgacaccatcgaggccagcgtcgccgccggtgacctggtcatgaacgatgatgtcaacccggtggtcctcatctcccagggcatcggctccaccccgatggtgggcatgctcaaccaggtcgccgccgaccgccacgtcaccgtcctgcacgccgaccagtccgagaaggatcacgcccagcgtgaggagatggtcgcgctggtcgggggcctggccaacggtgccctctacaccttctaccgcgatgccgaccagtggctcaacgttgccggccacatcccctccgatgcctccgtctacctctgcggtggcaacgaattcctgcagaatgtccgcggccagctggaaaacctggaggagcagccccgagagatccgcttcgagctcttctccccgaatgactggctgatctcgtag

SEQ ID NO: 41883 - protein, 404 aa, Corynebacterium efficiens
MIGVSRPTPQNSYPGGSTVIVSTKPLTDRSRLSEAHAEMIKATLPLVGSKINDITPVFYNRMFTAHPELLRSTFNRANQKQGDQQKALAASIATFATMLVDPEAPDPVDMLARIGHKHVSLGITADQYNIVHEHLFGAIVEVLGADVVTPPVAEAWDAVYWLMANVLIDLESDLYASNDLAPGDVFRHVTVTGKKQLSDKVWEYTFEGDLVTPAPGQYTSIGVKLPDGARQLRQYSLLSGTDSQYRIAVEDNGEVSTFLRDNVEVGDTIEASVAAGDLVMNDDVNPVVLISQGIGSTPMVGMLNQVAADRHVTVLHADQSEKDHAQREEMVALVGGLANGALYTFYRDADQWLNVAGHIPSDASVYLCGGNEFLQNVRGQLENLEEQPREIRFELFSPNDWLIS

SEQ ID NO: 41884 - DNA, 1206 bp, Ralstonia solanacearum
  CDS (1)..(1206)
atgctgtcggaacagtccaagcccctgatcgatgcgagcgtgccggtgttgcgcgaacacggtctgaccatcacccagaccttctaccgcaacatgttcgccagccacccggagctgaccaacctgttcaacatgggcaaccaggccaacggttcgcagcagcagtcgctggcttcggcggtgttcgcctatgccgccaaccacggcaacaacgccgcgctggcgccggtggtcggccgcatcgtccacaagcatgcggcggtcggcatccggccgagccactacccgatcgtcgggcggcatctgctgggcgcgatcgccgaggtgctgggcgatgctgccacgcctgagctgctggcggcgtgggacgaggcgtactggctgctggccgccgagctgatcgccgccgaagcccgcctgtacgcgcacacgcagagcggcccggaccaccgccagcccgtgcgcatcatcgagcgccacgcgcaggccgaagacgtggtgtcgttcacgctggaagccgtcggcggggccaagctggccgatttcctaccgggtcagtacatctcggtgcaggtggaactggcgccgggcgtgctgcagcaacgccagtacagcctgtcggacgcgcccaacggccgcacctggcgcatctccgtcaagcgtgatgccggcggcagcggccgcccggccggcaccgtgtcgaactggctgcacgacaacgcgcgcccgggcgaggtcctgctggtcagccagccctacggcgatttcgttccgcagctcgccaccgatagccccatcgtgctgatgtcggccggcgtcggcatcacgccgatgatcgccacgctcaacgcgctggcccggcggaacaccgcgcgcaaggtggtgttcagccatgccggccaagccgcttcgcacgtcgcgcatgccgacgacctggagcgtgccgcgcaggtcctgccggatttcgcggcgcatgtgttcctggaatcgggcgaggccgcggacttcgctgcgcgtccggcgcgtccggggcgcatgacggtcgagaccttcctcgacgacggggtcgccgatgccgacttctacctgtgcggtccgctgccgttcatgcaggcgcagcgcgcggcgctgctcgccggcggcgtgccggcggggcgcatccaccgcgaggtgttcggccccgatctgctggacgacatcctctga

SEQ ID NO: 41885 - protein, 401 aa, Ralstonia solanacearum
MLSEQSKPLIDASVPVLREHGLTITQTFYRNMFASHPELTNLFNMGNQANGSQQQSLASAVFAYAANHGNNAALAPVVGRIVHKHAAVGIRPSHYPIVGRHLLGAIAEVLGDAATPELLAAWDEAYWLLAAELIAAEARLYAHTQSGPDHRQPVRIIERHAQAEDVVSFTLEAVGGAKLADFLPGQYISVQVELAPGVLQQRQYSLSDAPNGRTWRISVKRDAGGSGRPAGTVSNWLHDNARPGEVLLVSQPYGDFVPQLATDSPIVLMSAGVGITPMIATLNALARRNTARKVVFSHAGQAASHVAHADDLERAAQVLPDFAAHVFLESGEAADFAARPARPGRMTVETFLDDGVADADFYLCGPLPFMQAQRAALLAGGVPAGRIHREVFGPDLLDDIL

SEQ ID NO: 41886 - DNA, 1212 bp, Streptomyces coelicolor
  CDS (1)..(1212)
atgctctccagtcagtcggcccagatcgtccgcgacacgctccccaccgtcggagcctcgctcggcacgatcaccgacctgttctaccgccgcatgttcgaggagcgtcccgagctcctgcgcgacctgttcaaccgcgcgaaccaggccagcggcgtccagcgcgaggcactggccggtgccgtcgccgccttcgcgaccgcgctcgtgaagcacccggacgagcgccccgacgccgtactcggccgcatcgcgaacaagcacgcgtcactgggcatcacgtccgaccagtacaccctcgtcggccgccacctcctcgcggccgtcgcggaggtcctcggcgacgccgtgaccccggcggtggcggccgcctgggacgaggtgtactggctcatggcgaacgccctcatcgccatggaggcgcgtctgtacgcccggtccgacgtcgaggacggctccgtgtggcagagcatggagatcgtcgaacgccacgaggagaccccggacacggcctccttcgtcctgcgtcccgccgacggctcacccacccgccccttcgtccccggccagtacgtcagcgtgcgggccgaactgccggacggagcacaccagatacggcagtacagcctctccagcgctcccggcggcgggacctggcgcttcaccgtgaagcgcgagcgctccctggacgggcaggtgccggacggggaggtctccacgtggctgcacacccacgcccgccccggtgacgtcctgcgggtgtccctgcccttcggtgacctcctgctgcccgagggcgacggtccgctcctgctggcctccgcgggcatcggtgtcacccccatgctcgccatgctggagcatctggccaccgcggcgcccgaccgtccggtgaccgtcgtccacgccgaccgctcccccgctctccacgcgcaccggctcgaactcaccgcgctcgtcgagcggctgccccacgcctcgctgcacctgtggtacgaggacaccgcggaccacccggacgcctcggcggaccacgtcaacgagggctgggccgacctcacgggcctgtccccggtccccggcaccaccgcgttcctgtgcgggccgctgtccttcatgaaggccgtccgcaccgacctgctcgcccacgggctgagccccagggccatccactacgaggtgttcggccccgatctgtggctcagcaagtag

SEQ ID NO: 41887 - protein, 403 aa, Streptomyces coelicolor
MLSSQSAQIVRDTLPTVGASLGTITDLFYRRMFEERPELLRDLFNRANQASGVQREALAGAVAAFATALVKHPDERPDAVLGRIANKHASLGITSDQYTLVGRHLLAAVAEVLGDAVTPAVAAAWDEVYWLMANALIAMEARLYARSDVEDGSVWQSMEIVERHEETPDTASFVLRPADGSPTRPFVPGQYVSVRAELPDGAHQIRQYSLSSAPGGGTWRFTVKRERSLDGQVPDGEVSTWLHTHARPGDVLRVSLPFGDLLLPEGDGPLLLASAGIGVTPMLAMLEHLATAAPDRPVTVVHADRSPALHAHRLELTALVERLPHASLHLWYEDTADHPDASADHVNEGWADLTGLSPVPGTTAFLCGPLSFMKAVRTDLLAHGLSPRAIHYEVFGPDLWLSK

SEQ ID NO: 41888 - DNA, 1197 bp, Streptomyces coelicolor
  CDS (1)..(1197)
atgctctccgaacagtccgttcccgtggtccgagccaccctccccgccgtcggagcggccatcggtgacatcgccgccctgttctaccgcaagctcttcgacgcccacccggagctgctgcgggacctgttcaaccgggggaaccaggccaacggcgagcagcagcgggccctggcgggctcggtcgccgcgttcgccggcctgctgctggagaacccggacgagcgcgccgacgtgctgctctcccgtatctcgcacaagcacgcctcgctcggcatcacccccgaccagtacacgatcgtccaccgccacctgatggccgccgtcgtcgacgtgctcggcgacgccgtcactcccgaggtggcccgggcctgggacgaggtctactggctgatggccaacgcgctcatcgccctggaggcccgcctctacaccgagaagggcgtcgcggagggagacgtctggcgcaccatggagatcgtcgaccgggtcgaggagagcgccgacgcggtctccctcgtcctggggtcggccgacggccgtcccgtcgtgccgttccggccgggtcagtacgtcagcgtccaggtcgaactggccgacggcgcccggcagatccgccagtacagcctgtccgccgcgcccggccggtccgactggcgcatcaccgtcaagcgcgtccggggcgacgggcagccggacggcgaggtctcctcctggctgtacgcgaacgcccgcaagggcgacgcgctcaacgtgtcgctgccggccggggacctggccctggccgagcacgacggcccgctgctgctggtctccgccggtatcggcgtcacaccgatgctctcgatgctcgaccacctggccgccgccggcgccacccgcccggtgaccgtggtgcacgccgaccgcacccccgaccaccacgcccaccggcaggagcagctcgacctgatacgcacgctgccgggcgcccggctccacctgtggtacgaggagcccggcgaccgggcgccggaggcgtccaccggccgcgccgacctgaccggcctcgacctgcccgcggacctcacggtctacctctgcggtccggtgcccttcatgcgcgcggtccgcggcgacctgctgcgccgcggggtgcccgccgaggccatccactacgaggtcttcggccccgacctctggctcggacagcagtag

SEQ ID NO: 41889 - protein, 398 aa, Streptomyces coelicolor
MLSEQSVPVVRATLPAVGAAIGDIAALFYRKLFDAHPELLRDLFNRGNQANGEQQRALAGSVAAFAGLLLENPDERADVLLSRISHKHASLGITPDQYTIVHRHLMAAVVDVLGDAVTPEVARAWDEVYWLMANALIALEARLYTEKGVAEGDVWRTMEIVDRVEESADAVSLVLGSADGRPVVPFRPGQYVSVQVELADGARQIRQYSLSAAPGRSDWRITVKRVRGDGQPDGEVSSWLYANARKGDALNVSLPAGDLALAEHDGPLLLVSAGIGVTPMLSMLDHLAAAGATRPVTVVHADRTPDHHAHRQEQLDLIRTLPGARLHLWYEEPGDRAPEASTGRADLTGLDLPADLTVYLCGPVPFMRAVRGDLLRRGVPAEAIHYEVFGPDLWLGQQ

SEQ ID NO: 41890 - DNA, 1665 bp, Dictyostelium discoideum
  CDS (129)..(1400)
tttttttttctttttcttttaaaaactttatattcaaaaagaatcttaaaatcaaaaaaaaaaaaaaaaaaacatatataaaatttataatcaaataaaaaataaatatataagtaaatataaatataatgttaagtcaaaaatcaattcaaataattaaatcaactgtaccacttttggagaaatatggagttgagatcactagcctcttctataagaatatgtttgaagcacaaccacaatttttaaatatattcaatcattcaaatcaaagaaatcagaaacaaccggtggctttggccaatacaattttacaatctgcaattcatattgaaaaattaaatgaaatcaatttaatgccaatcgttcataaacacgttgcattaggtattacacctgaaatgtatccaattgttggtgctcatttattgggtgctatgaaaactgtaatgcaagatgaagcaactcctgaaattatggctgcatggactgaggcatatagagcagttgcacaagcatttatggatgcagaagaagatttatactttgagactgaggaacaaattggtggttggaaagatacgagagagtttgtagttgatagaattgaagaagagacaccattaattaaatcattttactttaaagcatatgatggtaaagagatagctacttatattcctggacaatatattactgtaaagattacattaccgggtgatggtgttgatgtaccaactgataagatgagaacttatgtcagacattacagtttatcagataaaccaaatgatgaatactatcgtatttcaataaagaaagaactcggtaagaatacaccaaatggtatagtatcaaatcattttcataataatattaaagtgggtgatgtagtaccaatgtcggtcccagcaggcgatttcgtggtaaataacgattctgagactccaatccttttaatttgtggtggtgttggtattaacccgttatttagtatgcttaaagagacattggtccaacaaccagatagaaaaataaatttcattttctcaactcattgcgaatcaagtcaaccatttaaagaggaacttaaacaattggaagacgattataaagaaactggtaatcttaaaatcaatttagtatactctgaaaatcaaggtcatatcaataaagaaatcattgaaaaatattcaactcaacatgttgatcaagctgaaatcgatgaaaccgacgtttacatttgtggtcctgtaccttttatgatgcaagttaacaaagatttattacaattaggtttccataaagaaaatgtacattatgaattatttggtccattaactccagtcctcgaagaaaatcaaatgttaagaggtgtaaaaaatattattgaaaattaatttaaataaataaataaaaaaaaaaaaaaaaaaatttaaaaaataaaaataaaaataaaataatttaaaagatatttttaattttttggtataaggaaaaaaaaaaaaaaaaaaaaattggaaataataatttaattattaataatcgatatttatgtctaattattttttttttttttaatttattttttaaaaaaaaaaaaaaaaaaaaaaaaaaaaaaaaaaaaaaaaaaaaaaaaaaaaaaaaaaaaaaaaaaaaaaaaaa

SEQ ID NO: 41891 - protein, 423 aa, Dictyostelium discoideum
MLSQKSIQIIKSTVPLLEKYGVEITSLFYKNMFEAQPQFLNIFNHSNQRNQKQPVALANTILQSAIHIEKLNEINLMPIVHKHVALGITPEMYPIVGAHLLGAMKTVMQDEATPEIMAAWTEAYRAVAQAFMDAEEDLYFETEEQIGGWKDTREFVVDRIEEETPLIKSFYFKAYDGKEIATYIPGQYITVKITLPGDGVDVPTDKMRTYVRHYSLSDKPNDEYYRISIKKELGKNTPNGIVSNHFHNNIKVGDVVPMSVPAGDFVVNNDSETPILLICGGVGINPLFSMLKETLVQQPDRKINFIFSTHCESSQPFKEELKQLEDDYKETGNLKINLVYSENQGHINKEIIEKYSTQHVDQAEIDETDVYICGPVPFMMQVNKDLLQLGFHKENVHYELFGPLTPVLEENQMLRGVKNIIEN

SEQ ID NO: 41892 - DNA, 1313 bp, Dictyostelium discoideum
  CDS (68)..(1261)
attattatttatttatttatttattaaaaaaaaaaaaaaaacaaacaaataaaaaaaaaaaaaaaaaatgtctttaagtcaacaatcaatttcaattattaaagcaacagtacctgttttacaagtccatggagttaatatcactacaaccttctatagaaatatgtttaaagctaatccacaacttttaaatattttcaatcattcaaatcaaagagaaggaaaacaacaaaatgctttagcaaatacagttttacaagctgccattcatattgataaattgaatgaattaaatttagctccaatcgttcataaacatgttgcattgggtgtattaccagaacattatccaattgttggtacaaatttattgggtgcaattaaagaagttcttcaagatgctgccactgatgagattttaggtgcatggggtgaagcttatggtgtaattgctcaagctttcattgatgctgaagccgctttatataaagttacagaggagcaaattggaggttggagagatactcgtgaattcattgtcgatagaaaggttgaagagtcgtccaatatcatttcattctactttaaaccagccgatggtaaaccaattgcaacctatattccaggccaatacattaccattaaggtaccattaactttagagaatggtgaacaaagaactcacatcagacattacagtttatcagacacaccatccgaacaatactatcgtattagtgtaaagaaagaagacgccctcaaaaagtctgatccaaatggtgtagtttcaaatcatttgcatgcaaatgttaaggttggcgataaagttttactctcccctccagctggtgactatgtagtcgaccaattatcaagcaatccaatccttttggttagtggtggtgttggtatcactccattattaagtatggcaaaggcaactttagctaaacaaccagaaagagaagtcacctttgttcactcttcaaagaacaaacaatatcaaccatttgcaaatgaattatcccaattggaaaaatcaaataaagtaaaggtatcaactgttcattctgaaactgatggtcaaatcaccaaagataaattagaaaaattcatcaatccttctcaaattaaagatactaaagttttcatctgtggtccagtatcttttatgtctgcaattaataaacaattaattgaattaggttatccaaaagaaaatatttcttatgaaatttttggtccattaacaaatgtataaaaaaaaataaaaaataaaaaataaaaaaaataacatatttaaaataaataaa

SEQ ID NO: 41893 - protein, 397 aa, Dictyostelium discoideum
MSLSQQSISIIKATVPVLQVHGVNITTTFYRNMFKANPQLLNIFNHSNQREGKQQNALANTVLQAAIHIDKLNELNLAPIVHKHVALGVLPEHYPIVGTNLLGAIKEVLQDAATDEILGAWGEAYGVIAQAFIDAEAALYKVTEEQIGGWRDTREFIVDRKVEESSNIISFYFKPADGKPIATYIPGQYITIKVPLTLENGEQRTHIRHYSLSDTPSEQYYRISVKKEDALKKSDPNGVVSNHLHANVKVGDKVLLSPPAGDYVVDQLSSNPILLVSGGVGITPLLSMAKATLAKQPEREVTFVHSSKNKQYQPFANELSQLEKSNKVKVSTVHSETDGQITKDKLEKFINPSQIKDTKVFICGPVSFMSAINKQLIELGYPKENISYEIFGPLTNV

SEQ ID NO: 41894 - DNA, 1209 bp, Bacillus thuringiensis
  CDS (1)..(1209)
atgttaagtgaaaaaacaattgaaatcgtaaagtcaacagtaccattattacaggaaaaaggcgttgaaattacaacgagattttatgaaattttattttcggaacatccggagttattgaatattttcaaccatacaaatcagaaaaagggaagacaacaacaagcgttagcgaatgctgtttatgcagctgcaacgtacattgataatttagaagctattattccagttgtaaaacaaattggtcataagcatagaagtttaggtattaaagcagagcattatccgattgtaggtacatgtttattacgtgcaattaaagaggtcgcaggtgcaccggatgaagtattaaacgcatggggagaagcgtatggtgtcattgctgatgcattcattagcattgaagcagagatgtatgaagaagcggcacataaagaaggtggatggaaagatttccgtaactttgtggttgttaaaaaagtgaaggaaagcgatgttatcacgtcattttatttaaaacctgaagatggagggaaagtttcttcattcattccaggacaatatgtaacggttcaaataaatatcgaaggtgaaacatatacacataatcgtcaatatagcttatcagatgctcctggaaaagaatattatcgtattagtgtcaagaaagaaaaaggtgtagatacgccggatggtaaagtatctaattacttacatgatcatgtaaaagaaggtgatatgttaccagtaagtgcaccagcaggagatttcgtattaaatatggattcaactttaccagttgtcttaattagtggtggagtaggtattacaccaatgatgagtatgctaaatacgttaattgaacaagattcaaaacgtaatgtatgttttgttcatgcagcgataaatagtaatacacatgcaatgaaagaacacgttgaggcagtagataatgaatacgaacaagttaaagcatatacttgttattctgcaccaactgaaaaagatttagaaatgaagaactttgataaagaaggttttgtggaaagagaatggttacaaactattattccgacaactgaagcagagttttatttctgtggtccagtaccatttatgaaacatataaatgctgtactaactgatttaggtgtgaaacaagaacatattcattatgaatttttcggcccagcagcgagcttacaataa

SEQ ID NO: 41895 - protein, 402 aa, Bacillus thuringiensis
MLSEKTIEIVKSTVPLLQEKGVEITTRFYEILFSEHPELLNIFNHTNQKKGRQQQALANAVYAAATYIDNLEAIIPVVKQIGHKHRSLGIKAEHYPIVGTCLLRAIKEVAGAPDEVLNAWGEAYGVIADAFISIEAEMYEEAAHKEGGWKDFRNFVVVKKVKESDVITSFYLKPEDGGKVSSFIPGQYVTVQINIEGETYTHNRQYSLSDAPGKEYYRISVKKEKGVDTPDGKVSNYLHDHVKEGDMLPVSAPAGDFVLNMDSTLPVVLISGGVGITPMMSMLNTLIEQDSKRNVCFVHAAINSNTHAMKEHVEAVDNEYEQVKAYTCYSAPTEKDLEMKNFDKEGFVEREWLQTIIPTTEAEFYFCGPVPFMKHINAVLTDLGVKQEHIHYEFFGPAASLQ

SEQ ID NO: 41896 - DNA, 1209 bp, Bordetella pertussis
  CDS (1)..(1209)
atgttgagccccgaagtccgcgcgctggtcaaggccaccgcgcccgtcctgaaagaacacggcgaggcgctgacgcgccatttctatacgcgcatgctgggcggcaacccagagttgcgccagctgttcaaccaaggccaccagcaaagcggccagcagcagcaggcgctggccgccgcggtggcggcctatgccgagcatatcgacgatccctcggtgctgctgcaggtggtcgagcgcatcgcccacaagcacgtcagcctgggcgtgcgcgcggaacactatgccatcgtcggcaagcatttgctggcctcgatccgcgaggtgctgggcgaagcggccaccgacgaactgatcgacgcctgggcggccgcctatggccagctggccgatctgctgatcggacgcgagcgcgcgctgtacgccgccgctgcttcccgcgacggcggctggaccggctggcgcgccttcaaggtggtgcgcaagacgccggaaagcgccgagatcacctcgttctacctggcgccggccgacggcggcgccactcccgactacctgccgggccaatacgtatcggtgcgggtctacgtgcccgagctgggcctgatgcagccgcgccagtacagcctgtccgaggcgccgggcatgccggggcaactgcgcatttcggtcaagcgcgaggccggctcgcccgccggcatggtgtcgggcacgctgcacaatcgcatcaacgagggcgatgtgctggacgtgtcgccgccgcagggcgatttcacgctggacgccgaggacggccggccggtggtgctgctcagcggcggggtggggctgacgccgatggtgtccatgctcaaccacctgacggcgcgcgacgacggccggcagatccgcttcgtgcatgcctgccgcgaggccggcgtgcatgcgatgaaggaacatatcaacgcgctggccgccaagcggccgaatgtgcgcaaggcggtgttctacgagcgcgtgggcgcggacgaccggcgcggcgtcgactacgactacgaaggccgggtcgatctgcatgcgatccgcgacgaggtgatcctgcccgacgcggactactacctgtgcggtccgttgcccttcatgcaggcgcaacggcgcgccctggccgacctgggcgtggccgagcaccgcatccatgccgaagtgttcggcaccggcggcgtggcatag

SEQ ID NO: 41897 - protein, 402 aa, Bordetella pertussis
MLSPEVRALVKATAPVLKEHGEALTRHFYTRMLGGNPELRQLFNQGHQQSGQQQQALAAAVAAYAEHIDDPSVLLQVVERIAHKHVSLGVRAEHYAIVGKHLLASIREVLGEAATDELIDAWAAAYGQLADLLIGRERALYAAAASRDGGWTGWRAFKVVRKTPESAEITSFYLAPADGGATPDYLPGQYVSVRVYVPELGLMQPRQYSLSEAPGMPGQLRISVKREAGSPAGMVSGTLHNRINEGDVLDVSPPQGDFTLDAEDGRPVVLLSGGVGLTPMVSMLNHLTARDDGRQIRFVHACREAGVHAMKEHINALAAKRPNVRKAVFYERVGADDRRGVDYDYEGRVDLHAIRDEVILPDADYYLCGPLPFMQAQRRALADLGVAEHRIHAEVFGTGGVA

SEQ ID NO: 41898 - DNA, 1182 bp, Burkholderia sp
  CDS (1)..(1182)
atgctgtcagccgaacatcgcgcaatcgtcaaggcaactgttccgctgctcgaaagcggcggcgaagcgctcaccacgcacttctacaagaccatgctggcggagtacccgagtgtgcgcccgctgttcaaccaggcgcaccagcaatcgggcgatcagccgcgcgcgctcgcgaatgcggtgctgatgtacgcgcgtcatatcgatcaactcgaacaactcggcggactggtttcgcagatcgtcaacaagcacgtcgccctcaacatcctgcccgagcattatccgatcgtcggcgcatgtctgctgcgcgcgatccgcgaagtgctcggagcggaaatcgccacggatgccgtgattgaagcgtggggcgccgcgtatcagcaactggccgacctgctgatcggcctcgaagagaacgtctacgtcgagaaggaaaccgcgacgggcggctggcgcggcacgcgtgcgttcgtggtggcgcgcaaggtcaaggaaagcgacgagatcacgtcgttctatctgcgtcccgccgacggcggcgagctgctcgaattccacccgggccagtacattggcctgaagctgatcgtcgacggtgaagaaattcgccgcaactattcattgtcggctgcggcaaacggccgcgaatatcggatcagcgtgaagcgcgagccgaacggcaaggcctcgaactatctgcacgactcggtgaatgaaggcgcgacgttggacctgctcacaccgtcgggcgacttcacgctggagcacaacgacaagccgctggtgctgatcagcggtggcgttggtatcacgccgacgctcgcaatgctgaatgccgcgctgcaaacgtcgcgtcccatccacttcattcatgccacgcgtcacggcggcgtgcatgcgttccgcgaccatatcgacgaactggcggcacgtcatccgcaactcaagcgcttctatgtgtatgagaagccgcgtcacgacgacgaggcgcatcacgcggaaggctatatcgacgaagcgcgtctgatcgaatggctgccggccacgcgtgatgtggatgtgtacttcctcggacccaagtcgttcatgcaggcggtgaagcgccatctgaagacgattggcgtgccggaaaagcagagccgttacgagttcttcggtcccgcttccgcgctcgattga

SEQ ID NO: 41899 - protein, 393 aa, Burkholderia sp
MLSAEHRAIVKATVPLLESGGEALTTHFYKTMLAEYPSVRPLFNQAHQQSGDQPRALANAVLMYARHIDQLEQLGGLVSQIVNKHVALNILPEHYPIVGACLLRAIREVLGAEIATDAVIEAWGAAYQQLADLLIGLEENVYVEKETATGGWRGTRAFVVARKVKESDEITSFYLRPADGGELLEFHPGQYIGLKLIVDGEEIRRNYSLSAAANGREYRISVKREPNGKASNYLHDSVNEGATLDLLTPSGDFTLEHNDKPLVLISGGVGITPTLAMLNAALQTSRPIHFIHATRHGGVHAFRDHIDELAARHPQLKRFYVYEKPRHDDEAHHAEGYIDEARLIEWLPATRDVDVYFLGPKSFMQAVKRHLKTIGVPEKQSRYEFFGPASALD

SEQ ID NO: 41900 - DNA, 1215 bp, Chromobacterium violaceum
  CDS (1)..(1215)
atgctgagcgaacaaacccgatccctggtcaaggccaccgtcccggtgctgcagcagcacggcgtggcgctgaccagccatttctaccgccgcatgttcgagcacaatccggaactgaaaaacgtgttcaaccaggggcaccagcattccggccagcagcagcaggcgctggcgatggcggtgctggcctatgcccggcacatcgacgacccgtcgccgctgctgccggtgctgacccgcgtcgcgcacaagcacgtcagcctgggcatacgcgccgagcactacccgattgtcggcaagcacttgctggcgtcgatccgcgagttgctgggcgaggcggccggcgacgatctgatccaggcctgggccgaggcctacggtttgctggcggatacgctgatcggcatcgaaaacggcatgtacggcgacgccaccagcgccgacggcggctggagcggctggcggccgttccgcgtggcgaagaaggaaatcgagagcgaggagatcgcgtcgttttacctggagcccagcgacggcggcgcgctgccggcgttcaagcccggccagtacgtgtcggtgaagcgcttcgtcgccgagtgggggctgagccagccgcgccagtacagcctgtccgacgcgcccaacggcgaatacctgcgcatctcggtcaagcgcgaagacgcggcgcagggcaagccggcggggcgagtatccaatctgttgcaccgcgaggtgcaggtcggcgatgtgctggagctgagcgcgccgcagggcgatttcttcctgcatgaggaacgcgacggtccggcggtgctgatcagcgccggcgtcggccagacgccgatgcaggcgatgctgggccagttgctcaagcgcggcggccgcgaagtgcgcttcctgcacgcggcccgtcacggcggcgcgcatgcgatgggcgccaaagtgcgccagctggccgatcgccatccgcaactgaaggtccacgtttgctacgagacgccgcgcgcgcaggatgcgatcggcgtcgactaccaggctgcggggcggctgaacctggcggatgtgaagggcatcgcgctgttgccggacgccgactactatctgtgcggcccgctgggcttcatgcgcgcgcagcgcgacagcctgcgcggcctgggcgtggccgccgaccgcatccattacgaagtgttcggctcccatcccggcgacgattga

SEQ ID NO: 41901 - protein, 404 aa, Chromobacterium violaceum
MLSEQTRSLVKATVPVLQQHGVALTSHFYRRMFEHNPELKNVFNQGHQHSGQQQQALAMAVLAYARHIDDPSPLLPVLTRVAHKHVSLGIRAEHYPIVGKHLLASIRELLGEAAGDDLIQAWAEAYGLLADTLIGIENGMYGDATSADGGWSGWRPFRVAKKEIESEEIASFYLEPSDGGALPAFKPGQYVSVKRFVAEWGLSQPRQYSLSDAPNGEYLRISVKREDAAQGKPAGRVSNLLHREVQVGDVLELSAPQGDFFLHEERDGPAVLISAGVGQTPMQAMLGQLLKRGGREVRFLHAARHGGAHAMGAKVRQLADRHPQLKVHVCYETPRAQDAIGVDYQAAGRLNLADVKGIALLPDADYYLCGPLGFMRAQRDSLRGLGVAADRIHYEVFGSHPGDD

SEQ ID NO: 41902 - DNA, 1221 bp, Oceanobacillus iheyensis
  CDS (1)..(1221)
atgtcaaacacaaccgtacttttagacaaaaaaacgacagaaattattaaagctaccgtaccagtattaaaggagcacggagaagccataactaagcatttttacaagatacttttagaaaacaatccagaactaaaaaatgtctttaatcaaacaaatcaacggaaaggagcccaatcgaaagcactagcaaatacggtatacgctgctgcagcaaacattgagaaattagaagaaatcttaccacatgttaaacaaattgcacataaacatgtcagtttaaatattaaaccagaacaatatcctattgttggtaaatacctgttaatagcgatcaaggaagtattaggagatgcagctactgacgaaattatagaggcatgggaaaaagcatactttgttatcgcggacatctttatatccgtagaaaaagagatgtacaacgagaaaaagaaccagatcggtggatggaccggttttcgtgattttaaagttattaaaaaagtaaaagaaagtaaggagattacttctttttatctcaagccggatgataatttaccaatcaccactttcatacctgggcaatatattacgataaaagcacagatagaaagtgaagcttatgttcatttacgacaatatagcttatcaacggcaccagggaaagattattatcgtattagtgtaaaacgagaagcttcaaatcaaccgattggagttgtatctaattatcttcacacttctgtggaagtgggatctgttttaccaatcagtgcacctgctggtgattttattttagacgaacgtgaccaccgtcctctagttttaattagtggtggagttggattaactcccatcatgagtatgttagaatccgttgtagaacatcagccaaatcggaatgtagtattcattcatgctgccaaatctatcgaccatcaagcgatgagaaaaagagtttctgaaatagcaaaatctaaagaacaagtgaagcagtatgttgtatatagtaacccaacgaatcgtacagatggagataaacaaggctatatcgattatgaatggttaaaagaagttatccctacaaaagatgctgccttttacttgtgcgggccgaagccttttatgagtgcaataaacaatgatctacaaaatatgaacattgctcaaaacgatattcatatggaattatttggacctctcgaacctattgcgaagtaa

SEQ ID NO: 41903 - protein, 406 aa, Oceanobacillus iheyensis
MSNTTVLLDKKTTEIIKATVPVLKEHGEAITKHFYKILLENNPELKNVFNQTNQRKGAQSKALANTVYAAAANIEKLEEILPHVKQIAHKHVSLNIKPEQYPIVGKYLLIAIKEVLGDAATDEIIEAWEKAYFVIADIFISVEKEMYNEKKNQIGGWTGFRDFKVIKKVKESKEITSFYLKPDDNLPITTFIPGQYITIKAQIESEAYVHLRQYSLSTAPGKDYYRISVKREASNQPIGVVSNYLHTSVEVGSVLPISAPAGDFILDERDHRPLVLISGGVGLTPIMSMLESVVEHQPNRNVVFIHAAKSIDHQAMRKRVSEIAKSKEQVKQYVVYSNPTNRTDGDKQGYIDYEWLKEVIPTKDAAFYLCGPKPFMSAINNDLQNMNIAQNDIHMELFGPLEPIAK

SEQ ID NO: 41904 - DNA, 1191 bp, Photorhabdus luminescens
  CDS (1)..(1191)
atgctggataaccaaactattgcaactgtcaaatcaactattcccctactttccgcgactggcccaaaactgacagcacatttctatgagcggatgtttaaacataatcctgagttgaaaaacatctttaatatgagccatcagcttaacggcgatcaacgtgaagccttgttcaatgcgatctgcgcctatgcagccaatattgataacttaaaggtactactacccgcagtggaaaagatcgctcataaacacgcgagtttgaatattcaaccagagcattatcagattgtcggtactcacctgctggcaacgttgaatgaaatgttccagccgggaaatgaaattctggacgcctggggaaaagcttacggtgtgctcgctgatatttttatcaatcgtgaagagcaaatctatcatagtggtgaattaacagatggtggctggcgtggtttacgcccattccgtatcaaccggaaagaagtaaaaagtgaggtcatttgcagctttgaatttgcaccacaagatggtgggaaagtaatggactataagcctggccaatatctaagtatttatctgcaagatgatagttttgctaaccgagaaattcgccagtattcactaacggcagcaccaaacggctccagctaccggattgcgattaaacgtgagccacaaggaatcgtttccaaccatatgcacgataagatgcaagaaggcgataccgtctggctgaccgccccacgcggtgattttttccttgatattaaaccagaaacgccggttactttaatttctgcgggggttggcctgactcccatgatgagcatgttgtatcacctccaccagcaaaatcacaatagcccgattaattggttacatgcggcggaacacggcggtcatcacgcgtttagccatgaagtcgcagcgatcgcgcaagcaatgccgaattttgctggcacaatttggtatcgcgaaccaagggatgaagatcaacaaggtattcattatcaacacaaaggttttatggatctgacggttctgaatgaggcgttgaaaacagaaggaatgcatttctatttctgtggcccagtcgcctttatgcaatatgtcgcgaagcagttattagatatggggatagataaacaatttattcactatgaatgttttggtccacataaagtgatttaa

SEQ ID NO: 41905 - protein, 396 aa, Photorhabdus luminescens
MLDNQTIATVKSTIPLLSATGPKLTAHFYERMFKHNPELKNIFNMSHQLNGDQREALFNAICAYAANIDNLKVLLPAVEKIAHKHASLNIQPEHYQIVGTHLLATLNEMFQPGNEILDAWGKAYGVLADIFINREEQIYHSGELTDGGWRGLRPFRINRKEVKSEVICSFEFAPQDGGKVMDYKPGQYLSIYLQDDSFANREIRQYSLTAAPNGSSYRIAIKREPQGIVSNHMHDKMQEGDTVWLTAPRGDFFLDIKPETPVTLISAGVGLTPMMSMLYHLHQQNHNSPINWLHAAEHGGHHAFSHEVAAIAQAMPNFAGTIWYREPRDEDQQGIHYQHKGFMDLTVLNEALKTEGMHFYFCGPVAFMQYVAKQLLDMGIDKQFIHYECFGPHKVI

SEQ ID NO: 41906 - DNA, 1179 bp, Pseudomonas putida
  CDS (1)..(1179)
atgctcaatgccgaacaacgtgcaatcatcaaggccactgtacctctgctggaaagcggcggcgaagcgctgaccacccacttctacaagatgatgctcagcgaataccccgaggtacggccgctgttcaaccaggcccaccaggccagtggcgatcagccgcgtgcgctggctaacggcgtgttgatgtatgcccgccatatcgaccagctggagcaactgggcggcctggtcgggcagatcatcaacaagcatgttgccctgcagattctgccggagcactacccgattgtcggaagctgcctgctgcgcgccatcgaggaagtgctgggcaaggacattgccacccctgcggtgatcgacgcctggggcgcggcctatggccagctggccgacattctgatcggcgctgaagaaaacctctataaagagaaggaagaggccgagggtggctggcgcggtacccgtgaattccgcctggtacgccgcgagcaggaaagcagcgagatcgtttcgttctacttcgccccggtggatggcatgccggtgctcaaggcagaacctggccagtacatcggtctgaaactggacattgacggtgccgagcagcgccgcaactattccctgtcggcgctgtgcgacggcaaggaataccgcatcagcgtcaagcgcgaggcgggcggcaaggtctccaactacctgcacgatgagctgaaggtgggcgataccctgcaactgttcccgcctgcgggtgacttcaccctggcagccagcgacaagccgctggtgctgatcagcggaggggtgggcattaccccgaccctggcgatgctgcaggcagcactgcaaacccggcgcgaggtgcatttcatccactgtgcgcgtaacggcgcggtgcatgccttccgggactggatcgatggcctggcggcgcgccatccacagctcaagcgcttctactgctatgccgagccggaaggtggcgctgcggccgacgccgtgggtttgctcagtgaagacctgctcgccgagtggctgccgcaggagcgtgacgtggatgcctacttcctcgggcccaagggcttcatggcggcggtcaagcgccagctgaagggcctgggggtgccggagcagcagagccgctacgagttcttcgggccggcggcagcgctggagtga

SEQ ID NO: 41907 - protein, 392 aa, Pseudomonas putida
MLNAEQRAIIKATVPLLESGGEALTTHFYKMMLSEYPEVRPLFNQAHQASGDQPRALANGVLMYARHIDQLEQLGGLVGQIINKHVALQILPEHYPIVGSCLLRAIEEVLGKDIATPAVIDAWGAAYGQLADILIGAEENLYKEKEEAEGGWRGTREFRLVRREQESSEIVSFYFAPVDGMPVLKAEPGQYIGLKLDIDGAEQRRNYSLSALCDGKEYRISVKREAGGKVSNYLHDELKVGDTLQLFPPAGDFTLAASDKPLVLISGGVGITPTLAMLQAALQTRREVHFIHCARNGAVHAFRDWIDGLAARHPQLKRFYCYAEPEGGAAADAVGLLSEDLLAEWLPQERDVDAYFLGPKGFMAAVKRQLKGLGVPEQQSRYEFFGPAAALE

SEQ ID NO: 41908 - DNA, 1227 bp, Rhodopirellula baltica
  CDS (1)..(1227)
atgctgagcgaaaaaacgattcgaatcgtcaaggaaatcacacctttggtcgctgcgaacgcggaaacgatcactcgcagattttacgaacggatgttcgaagccaatcccgaggtgaaggcgtttttcaatcaagctcaccagcattccggcggtcaacagaaagctctcgccggtgcgatctgtgcctacttcacccacatcgacaatcccgccgtgttgatgccggctgttgaattgatcgcacaaaagcatgtttcattgggcatcaagccagaacactacccgatcgtcggcagcaacttgctggccgcgattggtgacgtcatgggggatgccgcgacaccggaaatcgtcgaagccgtttcggaagcctacgggtttttggcggatatcttcatcggccgcgaaggtgcgatctatgaggaacaagcttccatgccgggcggatggaatgggacgcgaacatttgttgtgacgaagaaagttcgtgaaagcgagatcgtcacatcgttctatctcaaacccgaagacgaaggcccgctgccaccgttcaaaccggggcaatacatcacggtccacatggatcacccgcacacgccaacttccccacgcaactacagcctttcggattgtgccagccaaccgcactatcgaatcagcgtcaaacgtgaagagcgactcgtcccggatgcgcccgacggtttgatttccaatcatttgcatgatggcatcgaagagggacaccgcatcgaacttggcccaccgtgtggtgagttcacggtcgatccagcaacgattgcaaaaccgatcgtgctgatcgcgggcggcattggtgtgacgccactattgtcgatggcgaaatcaatcgttcatgccaatcccaacgcggagctgcacttcattcaagcggctcggaacagcaaggtgcacgcattcgccgatgaacttcgccgtctggcacaagccggacccaatgttcacaccaaggtcatctatgactcgccgcttccaggagacgtggaagaaggcaagtgcgatgaggccggatttgtcacggaaaatcaaatacgagagtcgacgccttttaccgacgcggacttttacttttgcggtcccaagccgttcatgaaaaatgtccattcctgcttgcgggagcttggtgtcgacgagcaccgcgttcggtacgagttctttggacccaaagaagaattggtcgcggtgtga

SEQ ID NO: 41909 - protein, 408 aa, Rhodopirellula baltica
MLSEKTIRIVKEITPLVAANAETITRRFYERMFEANPEVKAFFNQAHQHSGGQQKALAGAICAYFTHIDNPAVLMPAVELIAQKHVSLGIKPEHYPIVGSNLLAAIGDVMGDAATPEIVEAVSEAYGFLADIFIGREGAIYEEQASMPGGWNGTRTFVVTKKVRESEIVTSFYLKPEDEGPLPPFKPGQYITVHMDHPHTPTSPRNYSLSDCASQPHYRISVKREERLVPDAPDGLISNHLHDGIEEGHRIELGPPCGEFTVDPATIAKPIVLIAGGIGVTPLLSMAKSIVHANPNAELHFIQAARNSKVHAFADELRRLAQAGPNVHTKVIYDSPLPGDVEEGKCDEAGFVTENQIRESTPFTDADFYFCGPKPFMKNVHSCLRELGVDEHRVRYEFFGPKEELVAV

SEQ ID NO: 41910 - DNA, 1185 bp, Vibrio parahaemolyticus
  CDS (1)..(1185)
atgctcagcaatcaaaccattgagatcgtgaaagcgaccgcgccactaatcgcagaaacaggaccaaaactgaccgctcacttctatgaccgcatgtttactcacaaccctgagttaaaagacattttcaacatgagcaaccagcgtaatggcgatcaacgtgaagcgctattcaatgccatctgtgcatacgctgctaacattgaaaacttgcctgctctgcttggcgcagtggagaaaattgcgcataaacacaccagctttttgatcacgaaagatcagtatcaaatcgtaggtaaacacttgatcgctacaattgatgagttattcaatccgggccaagaagttttagacgcgtgggctgaagcttatggcgtattggctaatgtatttatccagcgcgaagagcaaatctatcaagcgaatgcatcgcaagaaggtggctggcgagggctacgtgagtttgagttggtcggtaaacaattggaaagtgaacacatttgcagttttgttttcaaaccgacggatggcagtaaagtgacgaagtacaagcctgggcagtacctcggcatctacatcaacagcgataagtttgaaaaccaagagatccgtcaatacagcctatcttcttcggttcaagagaacacttaccgcatctccgtaaaacgtgaacaaggcggtaaagtatccaactacctgcacgatgagctaaacatcggcgataaagtaaaactcgcagcgccagcgggtgatttctttatggatgtagacaccaatacaccagtggtgctgatttctgcaggtgtcggccttacgccaacactgtcaatgctagaaagcttgacggagcatcacgcgccagtgacttgggtacatgcaacagaaaacagcaaacaccacgcctttaaagagcacgtaaaccagctagtcacggcgaaagaaaacatgaacgcgctcatttggtataaccaaccaacggcagaagacaagataggtgaagacttccactttaccggctttgtaaacctgcatgaaatcgaagccgcactcaaacaagacaacgtacaagtgtacttctgtggtccggtgggctttatgcagcacgtcgcgaaacagctacaagaacttggcgtccctcaggaacaattccattacgaatgctttggcccacataaggtggtttaa

SEQ ID NO: 41911 - protein, 394 aa, Vibrio parahaemolyticus
MLSNQTIEIVKATAPLIAETGPKLTAHFYDRMFTHNPELKDIFNMSNQRNGDQREALFNAICAYAANIENLPALLGAVEKIAHKHTSFLITKDQYQIVGKHLIATIDELFNPGQEVLDAWAEAYGVLANVFIQREEQIYQANASQEGGWRGLREFELVGKQLESEHICSFVFKPTDGSKVTKYKPGQYLGIYINSDKFENQEIRQYSLSSSVQENTYRISVKREQGGKVSNYLHDELNIGDKVKLAAPAGDFFMDVDTNTPVVLISAGVGLTPTLSMLESLTEHHAPVTWVHATENSKHHAFKEHVNQLVTAKENMNALIWYNQPTAEDKIGEDFHFTGFVNLHEIEAALKQDNVQVYFCGPVGFMQHVAKQLQELGVPQEQFHYECFGPHKVV

SEQ ID NO: 41912 - DNA, 1194 bp, Xylella fastidiosa
  CDS (1)..(1194)
atgtctgcatcattttcgccacatacaattacacttataaaatctacagtgccattattggccgaacatggcacaactatcatcgaagccatgtaccatcgattgttcgaagatccgcagattgaggcgctgttcaatcaggcaaaccagaagaacggcactcaaatccatgcacttgctggagcgatactggcgtacgctcgcaatattgataacccgggtgtgcttgcatcagcgattgaaagaatttcacaaaagcatgttggttatgcaatccatccagaacattatcctcatgtcgcaaccgctttactgggtgcgattaagcaagtcttgggtgacgttgccacatcagaagtgttggaagcctggggagaagcgtattggtttattgcaaatcttttaaaagatcgggaagcagtgattcgtgaggggatcatgaccaagaacggtgggtggatccactggcggcgttttgtcatttccaagcgtattcctgaaagtgaaacgattacttcgtttatgctgcatcctgaggatggtgggccggttgtcccccatcaggccggacaatatcttacgtttcgtttcgatgcagccggcatgccgggtatgaaacgcaattactctatttcctgtggtcctaatagcgaccattatcggattaccgttaaacgtgaacacggcacaggggcatcggcttttctacacgatcaagcgaaagttggaacgattatcgaatgtacgccgcctgtgggtgattttttccttcccagtgtgattgaaaggccaatcgttcttttatctggtggtgtcggattaacaccaatggtgagcatgatggagcagatcgctgaagcgtatcctgatgcgcaggtatggtatgtccatggtactcagaatcgagaaacacatgcgatggatgctcatattcgtgctttagtgagtcgacacaagcatatgaaagccacgacgttctatacacaacgtagtgaagccgatgatgcggaagccgggtttatcaccattgattggttgcgagccaatacaccgtttcaaaaggccgatttttacctttgtggcccgcgtcccttcttgcgcacttttgttcgtgatctgatcggtgctggtgtgccagcagcacaggttcattatgaatttttcggtccgatggatgaagaaatggccgcataa

SEQ ID NO: 41913 - protein, 397 aa, Xylella fastidiosa
MSASFSPHTITLIKSTVPLLAEHGTTIIEAMYHRLFEDPQIEALFNQANQKNGTQIHALAGAILAYARNIDNPGVLASAIERISQKHVGYAIHPEHYPHVATALLGAIKQVLGDVATSEVLEAWGEAYWFIANLLKDREAVIREGIMTKNGGWIHWRRFVISKRIPESETITSFMLHPEDGGPVVPHQAGQYLTFRFDAAGMPGMKRNYSISCGPNSDHYRITVKREHGTGASAFLHDQAKVGTIIECTPPVGDFFLPSVIERPIVLLSGGVGLTPMVSMMEQIAEAYPDAQVWYVHGTQNRETHAMDAHIRALVSRHKHMKATTFYTQRSEADDAEAGFITIDWLRANTPFQKADFYLCGPRPFLRTFVRDLIGAGVPAAQVHYEFFGPMDEEMAA

SEQ ID NO: 41914 - DNA, 23 bp, Primer
atgcttgacgctcaaaccatcgc

SEQ ID NO: 41915 - DNA, 22 bp, Primer
ttacagcaccttatgcgggcca

SEQ ID NO: 41916 - protein, 449 aa, consensus
  MISC_FEATURE (1)..(449): consensus for the disclosure of xaa see table XV
LXXXXXXXXKXTXPXLXXXGXXXTXXFYXXMXXXXPEXXXXXFNXXXQXXGXQXXALXXXXXXXAXXIXXXXXXXXXXXXXXXIXXKHXXXXXXXXXYXIVGXXLXXXXXXXXXXXXXXXXXXXAWXXAYXXXAXXXIXXEXXXYXXXXXXXXXXXXXXXFXXXXXXXXXXXXXSFXXXXXXXXXXXXXXXXXXPGQYXXXXXXXXXXXXXXXXXXXXXXXRXYSLXXXXXXXXXXXXXRIXVKXXXXXXXXXXXXXXXXXXXGXVSXXLHXXXXXGXXXXXXXPXGXFXXXXXXXXXXXXXXXXXPXXLXXXGXGXTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXCGPXXFMXXXXXXLXXXGXXXXXXXXEXFGP

SEQ ID NO: 41917 - protein, 68 aa, consensus
  MISC_FEATURE (1)..(68): consensus for the disclosure of xaa see table XV
XXXXXXXXXXXXXXXXXXXXXXXXXXXYXXXXXXXXXXXXXXFXXXXXXXXXQXXXLXXXXXXXXXXX

SEQ ID NO: 41918 - protein, 65 aa, consensus
  MISC_FEATURE (1)..(65): consensus for the disclosure of xaa see table XV
XXXXXXXHXXXXXXXXXYXXVXXXXXXXXXXXXXXXXXXXXXXXXXXXXYXXXAXXXXXXXXXXX

SEQ ID NO: 41919 - protein, 122 aa, consensus
  MISC_FEATURE (1)..(122): consensus for the disclosure of xaa see table XV
GXYXXXXXXXXXXXXXXXXXXXXXXXRXXXXXXXXXXXXXXXXXXXXXXXXXXXXXXXXXXXXXXXXGXXSXXXXXXXXXGXXXXXXXXXGXXXXXXXXXXXXXXXXXXXXXGXGXXXXXXX

SEQ ID NO: 41920 - protein, 31 aa, consensus
  MISC_FEATURE (1)..(31): consensus for the disclosure of xaa see table XV
XXXGXXXXXXXXXXXXXXXXXXXXXXXXXXX

SEQ ID NO: 41921 - DNA, 681 bp, Escherichia coli K12; identical to SEQ ID NO: 30948
  CDS (1)..(681)

SEQ ID NO: 41922 - protein, 226 aa, Escherichia coli K12; identical to SEQ ID NO: 30949

SEQ ID NO: 41923 - DNA, 738 bp, Pseudomonas sp; identical to SEQ ID NO: 30950
  CDS (1)..(738)

SEQ ID NO: 41924 - protein, 245 aa, Pseudomonas sp; identical to SEQ ID NO: 30951

SEQ ID NO: 41925 - DNA, 678 bp, Salmonella enterica subsp. enterica serovar Typhi; identical to SEQ ID NO: 30952
  CDS (1)..(678)

SEQ ID NO: 41926 - protein, 225 aa, Salmonella enterica subsp. enterica serovar Typhi; identical to SEQ ID NO: 30953

SEQ ID NO: 41927 - DNA, 675 bp, Sinorhizobium meliloti; identical to SEQ ID NO: 30954
  CDS (1)..(675)

SEQ ID NO: 41928 - protein, 224 aa, Sinorhizobium meliloti; identical to SEQ ID NO: 30955

SEQ ID NO: 41929 - DNA, 923 bp, Pseudomonas pseudoalcaligenes; identical to SEQ ID NO: 30956
  CDS (95)..(832)

SEQ ID NO: 41930 - protein, 245 aa, Pseudomonas pseudoalcaligenes; identical to SEQ ID NO: 30957

SEQ ID NO: 41931 - DNA, 681 bp, Bacillus licheniformis DSM 13; identical to SEQ ID NO: 30958
  CDS (1)..(681)

SEQ ID NO: 41932 - protein, 226 aa, Bacillus licheniformis DSM 13; identical to SEQ ID NO: 30959

SEQ ID NO: 41933 - DNA, 654 bp, Photobacterium profundum; identical to SEQ ID NO: 30960
  CDS (1)..(654)

SEQ ID NO: 41934 - protein, 217 aa, Photobacterium profundum; identical to SEQ ID NO: 30961

SEQ ID NO: 41935 - DNA, 732 bp, Rhodopseudomonas palustris; identical to SEQ ID NO: 30962
  CDS (1)..(732)

SEQ ID NO: 41936 - protein, 243 aa, Rhodopseudomonas palustris; identical to SEQ ID NO: 30963

SEQ ID NO: 41937 - DNA, 711 bp, Rhodopseudomonas palustris; identical to SEQ ID NO: 30964
  CDS (1)..(711)

SEQ ID NO: 41938 - protein, 236 aa, Rhodopseudomonas palustris; identical to SEQ ID NO: 30965

SEQ ID NO: 41939 - DNA, 666 bp, Rhodopseudomonas palustris; identical to SEQ ID NO: 30966
  CDS (1)..(666)

SEQ ID NO: 41940 - protein, 221 aa, Rhodopseudomonas palustris; identical to SEQ ID NO: 30967

SEQ ID NO: 41941 - DNA, 738 bp, Rhizobium sp; identical to SEQ ID NO: 30968
  CDS (1)..(738)

SEQ ID NO: 41942 - protein, 245 aa, Rhizobium sp; identical to SEQ ID NO: 30969

SEQ ID NO: 41943 - DNA, 720 bp, Rhizobium sp; identical to SEQ ID NO: 30970
  CDS (1)..(720)

SEQ ID NO: 41944 - protein, 239 aa, Rhizobium sp; identical to SEQ ID NO: 30971

SEQ ID NO: 41945 - DNA, 675 bp, Chromobacterium violaceum; identical to SEQ ID NO: 30972
  CDS (1)..(675)

SEQ ID NO: 41946 - protein, 224 aa, Chromobacterium violaceum; identical to SEQ ID NO: 30973

SEQ ID NO: 41947 - DNA, 663 bp, Bordetella parapertussis; identical to SEQ ID NO: 30974
  CDS (1)..(663)

SEQ ID NO: 41948 - protein, 220 aa, Bordetella parapertussis; identical to SEQ ID NO: 30975

SEQ ID NO: 41949 - DNA, 711 bp, Bordetella parapertussis; identical to SEQ ID NO: 30976
  CDS (1)..(711)

SEQ ID NO: 41950 - protein, 236 aa, Bordetella parapertussis; identical to SEQ ID NO: 30977

SEQ ID NO: 41951 - DNA, 741 bp, Bordetella parapertussis; identical to SEQ ID NO: 30978
  CDS (1)..(741)

SEQ ID NO: 41952 - protein, 246 aa, Bordetella parapertussis; identical to SEQ ID NO: 30979

SEQ ID NO: 41953 - DNA, 657 bp, Bordetella bronchiseptica; identical to SEQ ID NO: 30980
  CDS (1)..(657)

SEQ ID NO: 41954 - protein, 218 aa, Bordetella bronchiseptica; identical to SEQ ID NO: 30981

SEQ ID NO: 41955 - DNA, 945 bp, Wautersia oxalatica; identical to SEQ ID NO: 30982
  CDS (1)..(945)

SEQ ID NO: 41956 - protein, 314 aa, Wautersia oxalatica; identical to SEQ ID NO: 30983

SEQ ID NO: 41957 - DNA, 699 bp, Ralstonia sp; identical to SEQ ID NO: 30984
  CDS (1)..(699)

SEQ ID NO: 41958 - protein, 232 aa, Ralstonia sp; identical to SEQ ID NO: 30985

SEQ ID NO: 41959 - DNA, 675 bp, Vibrio parahaemolyticus; identical to SEQ ID NO: 30986
  CDS (1)..(675)

SEQ ID NO: 41960 - protein, 224 aa, Vibrio parahaemolyticus; identical to SEQ ID NO: 30987

SEQ ID NO: 41961 - DNA, 669 bp, Vibrio parahaemolyticus; identical to SEQ ID NO: 30988
  CDS (1)..(669)

SEQ ID NO: 41962 - protein, 222 aa, Vibrio parahaemolyticus; identical to SEQ ID NO: 30989

SEQ ID NO: 41963 - DNA, 729 bp, Pseudomonas syringae; identical to SEQ ID NO: 30990
  CDS (31)..(729)

SEQ ID NO: 41964 - protein, 232 aa, Pseudomonas syringae; identical to SEQ ID NO: 30991

SEQ ID NO: 41965 - DNA, 696 bp, Pseudomonas putida; identical to SEQ ID NO: 30992
  CDS (1)..(696)

SEQ ID NO: 41966 - protein, 231 aa, Pseudomonas putida; identical to SEQ ID NO: 30993

SEQ ID NO: 41967 - DNA, 717 bp, Pseudomonas putida; identical to SEQ ID NO: 30994
  CDS (1)..(717)

SEQ ID NO: 41968 - protein, 238 aa, Pseudomonas putida; identical to SEQ ID NO: 30995

SEQ ID NO: 41969 - DNA, 774 bp, Bradyrhizobium japonicum; identical to SEQ ID NO: 30996
  CDS (1)..(774)

SEQ ID NO: 41970 - protein, 257 aa, Bradyrhizobium japonicum; identical to SEQ ID NO: 30997

SEQ ID NO: 41971 - DNA, 693 bp, Bradyrhizobium japonicum; identical to SEQ ID NO: 30998
  CDS (1)..(693)

SEQ ID NO: 41972 - protein, 230 aa, Bradyrhizobium japonicum; identical to SEQ ID NO: 30999

SEQ ID NO: 41973 - DNA, 924 bp, Bradyrhizobium japonicum; identical to SEQ ID NO: 31000
  CDS (1)..(924)

SEQ ID NO: 41974 - protein, 307 aa, Bradyrhizobium japonicum; identical to SEQ ID NO: 31001

SEQ ID NO: 41975 - DNA, 720 bp, Bradyrhizobium japonicum; identical to SEQ ID NO: 31002
  CDS (1)..(720)

SEQ ID NO: 41976 - protein, 239 aa, Bradyrhizobium japonicum; identical to SEQ ID NO: 31003

SEQ ID NO: 41977 - DNA, 627 bp, Vibrio vulnificus; identical to SEQ ID NO: 31004
  CDS (1)..(627)

SEQ ID NO: 41978 - protein, 208 aa, Vibrio vulnificus; identical to SEQ ID NO: 31005

SEQ ID NO: 41979 - DNA, 672 bp, Shewanella oneidensis; identical to SEQ ID NO: 31006
  CDS (1)..(672)

SEQ ID NO: 41980 - protein, 223 aa, Shewanella oneidensis; identical to SEQ ID NO: 31007

SEQ ID NO: 41981 - DNA, 675 bp, Xanthomonas campestris; identical to SEQ ID NO: 31008
  CDS (1)..(675)

SEQ ID NO: 41982 - protein, 224 aa, Xanthomonas campestris; identical to SEQ ID NO: 31009

SEQ ID NO: 41983 - DNA, 675 bp, Xanthomonas axonopodis; identical to SEQ ID NO: 31010
  CDS (1)..(675)

SEQ ID NO: 41984 - protein, 224 aa, Xanthomonas axonopodis; identical to SEQ ID NO: 31011

SEQ ID NO: 41985 - DNA, 765 bp, Pseudomonas sp; identical to SEQ ID NO: 31012
  CDS (1)..(765)

SEQ ID NO: 41986 - protein, 254 aa, Pseudomonas sp; identical to SEQ ID NO: 31013

SEQ ID NO: 41987 - DNA, 762 bp, Rhizobium loti; identical to SEQ ID NO: 31014
  CDS (1)..(762)

SEQ ID NO: 41988 - protein, 253 aa, Rhizobium loti; identical to SEQ ID NO: 31015

SEQ ID NO: 41989 - DNA, 663 bp, Rhizobium loti; identical to SEQ ID NO: 31016
  CDS (1)..(663)

SEQ ID NO: 41990 - protein, 220 aa, Rhizobium loti; identical to SEQ ID NO: 31017

SEQ ID NO: 41991 - DNA, 744 bp, Rhizobium loti; identical to SEQ ID NO: 31018
  CDS (1)..(744)

SEQ ID NO: 41992 - protein, 247 aa, Rhizobium loti; identical to SEQ ID NO: 31019

SEQ ID NO: 41993 - DNA, 780 bp, Rhizobium loti; identical to SEQ ID NO: 31020
  CDS (1)..(780)

SEQ ID NO: 41994 - protein, 259 aa, Rhizobium loti; identical to SEQ ID NO: 31021

SEQ ID NO: 41995 - DNA, 693 bp, Streptomyces coelicolor; identical to SEQ ID NO: 31022
  CDS (1)..(693)

SEQ ID NO: 41996 - protein, 230 aa, Streptomyces coelicolor; identical to SEQ ID NO: 31023

SEQ ID NO: 41997 - DNA, 732 bp, Alcaligenes eutrophus; identical to SEQ ID NO: 31024
  CDS (1)..(732)

SEQ ID NO: 41998 - protein, 243 aa, Alcaligenes eutrophus; identical to SEQ ID NO: 31025

SEQ ID NO: 41999 - DNA, 741 bp, Rhodococcus sp; identical to SEQ ID NO: 31026
  CDS (1)..(741)

SEQ ID NO: 42000 - protein, 246 aa, Rhodococcus sp; identical to SEQ ID NO: 31027

SEQ ID NO: 42001 - DNA, 780 bp, Comamonas testosteroni; identical to SEQ ID NO: 31028
  CDS (25)..(744)

SEQ ID NO: 42002 - protein, 239 aa, Comamonas testosteroni; identical to SEQ ID NO: 31029

SEQ ID NO: 42003 - DNA, 666 bp, Photobacterium leiognathi; identical to SEQ ID NO: 31030
  CDS (1)..(666)

SEQ ID NO: 42004 - protein, 221 aa, Photobacterium leiognathi; identical to SEQ ID NO: 31031

SEQ ID NO: 42005 - DNA, 22 bp, Primer
atgatcaggagtcacaccatga

SEQ ID NO: 42006 - DNA, 21 bp, Primer
ttaattgccagccatcgcctg

SEQ ID NO: 42007 - protein, 178 aa, consensus; identical to SEQ ID NO: 31034
  MISC_FEATURE (1)..(178): consensus for the disclosure of xaa see table XV

SEQ ID NO: 42008 - protein, 81 aa, consensus; identical to SEQ ID NO: 31035
  MISC_FEATURE (1)..(81): consensus for the disclosure of xaa see table XV

SEQ ID NO: 42009 - protein, 12 aa, consensus
  MISC_FEATURE (1)..(12): consensus for the disclosure of xaa see table XV
XXXXXXXXXXXX

SEQ ID NO: 42010 - DNA, 333 bp, Escherichia coli K12; identical to SEQ ID NO: 24865
  CDS (1)..(333)

SEQ ID NO: 42011 - protein, 110 aa, Escherichia coli K12; identical to SEQ ID NO: 24866

SEQ ID NO: 42012 - DNA, 1068 bp, Mus musculus (house mouse); identical to SEQ ID NO: 24867
  CDS (64)..(996)

SEQ ID NO: 42013 - protein, 310 aa, Mus musculus (house mouse); identical to SEQ ID NO: 24868

SEQ ID NO: 42014 - DNA, 1953 bp, Helicobacter pylori; identical to SEQ ID NO: 24869
  CDS (1)..(1953)

SEQ ID NO: 42015 - protein, 650 aa, Helicobacter pylori; identical to SEQ ID NO: 24870

SEQ ID NO: 42016 - DNA, 336 bp, Pseudomonas aeruginosa; identical to SEQ ID NO: 24871
  CDS (1)..(336)

SEQ ID NO: 42017 - protein, 111 aa, Pseudomonas aeruginosa; identical to SEQ ID NO: 24872

SEQ ID NO: 42018 - DNA, 489 bp, Sulfolobus solfataricus; identical to SEQ ID NO: 24873
  CDS (1)..(489)

SEQ ID NO: 42019 - protein, 162 aa, Sulfolobus solfataricus; identical to SEQ ID NO: 24874

SEQ ID NO: 42020 - DNA, 1935 bp, Clostridium acetobutylicum; identical to SEQ ID NO: 24875
  CDS (1)..(1935)

SEQ ID NO: 42021 - protein, 644 aa, Clostridium acetobutylicum; identical to SEQ ID NO: 24876

SEQ ID NO: 42022 - DNA, 2028 bp, Yersinia pestis; identical to SEQ ID NO: 24877
  CDS (1)..(2028)

SEQ ID NO: 42023 - protein, 675 aa, Yersinia pestis; identical to SEQ ID NO: 24878

SEQ ID NO: 42024 - DNA, 1995 bp, Listeria innocua; identical to SEQ ID NO: 24879
  CDS (1)..(1995)

SEQ ID NO: 42025 - protein, 664 aa, Listeria innocua; identical to SEQ ID NO: 24880

SEQ ID NO: 42026 - DNA, 2205 bp, Borrelia burgdorferi (Lyme disease spirochete); identical to SEQ ID NO: 24881
  CDS (1)..(2205)

SEQ ID NO: 42027 - protein, 734 aa, Borrelia burgdorferi (Lyme disease spirochete); identical to SEQ ID NO: 24882

SEQ ID NO: 42028 - DNA, 2169 bp, Pyrococcus abyssi; identical to SEQ ID NO: 24883
  CDS (1)..(2169)

SEQ ID NO: 42029 - protein, 722 aa, Pyrococcus abyssi; identical to SEQ ID NO: 24884

SEQ ID NO: 42030 - DNA, 2046 bp, Deinococcus radiodurans; identical to SEQ ID NO: 24885
  CDS (1)..(2046)

SEQ ID NO: 42031 - protein, 681 aa, Deinococcus radiodurans; identical to SEQ ID NO: 24886

SEQ ID NO: 42032 - DNA, 2109 bp, Xylella fastidiosa; identical to SEQ ID NO: 24887
  CDS (1)..(2109)

SEQ ID NO: 42033 - protein, 702 aa, Xylella fastidiosa; identical to SEQ ID NO: 24888

SEQ ID NO: 42034 - DNA, 2070 bp, Halobacterium sp. NRC-1; identical to SEQ ID NO: 24889
  CDS (1)..(2070)

SEQ ID NO: 42035 - protein, 689 aa, Halobacterium sp. NRC-1; identical to SEQ ID NO: 24890

SEQ ID NO: 42036 - DNA, 1323 bp, Arabidopsis thaliana (mouse-ear cress); identical to SEQ ID NO: 24891
  CDS (1)..(1323)

SEQ ID NO: 42037 - protein, 440 aa, Arabidopsis thaliana (mouse-ear cress); identical to SEQ ID NO: 24892

SEQ ID NO: 42038 - DNA, 1974 bp, Staphylococcus aureus; identical to SEQ ID NO: 24893
  CDS (1)..(1974)

SEQ ID NO: 42039 - protein, 657 aa, Staphylococcus aureus; identical to SEQ ID NO: 24894

SEQ ID NO: 42040 - DNA, 1977 bp, Archaeoglobus fulgidus; identical to SEQ ID NO: 24895
  CDS (1)..(1977)

SEQ ID NO: 42041 - protein, 658 aa, Archaeoglobus fulgidus; identical to SEQ ID NO: 24896

SEQ ID NO: 42042 - DNA, 2172 bp, Pyrococcus horikoshii; identical to SEQ ID NO: 24897
  CDS (1)..(2172)

SEQ ID NO: 42043 - protein, 723 aa, Pyrococcus horikoshii; identical to SEQ ID NO: 24898

SEQ ID NO: 42044 - DNA, 1998 bp, Streptococcus pneumoniae; identical to SEQ ID NO: 24899
  CDS (1)..(1998)

SEQ ID NO: 42045 - protein, 665 aa, Streptococcus pneumoniae; identical to SEQ ID NO: 24900

SEQ ID NO: 42046 - DNA, 2436 bp, Treponema pallidum subsp. pallidum (syphilis spirochete); identical to SEQ ID NO: 24901
  CDS (1)..(2436)

SEQ ID NO: 42047 - protein, 811 aa, Treponema pallidum subsp. pallidum (syphilis spirochete); identical to SEQ ID NO: 24902

SEQ ID NO: 42048 - DNA, 1890 bp, Thermotoga maritima; identical to SEQ ID NO: 24903
  CDS (1)..(1890)

SEQ ID NO: 42049 - protein, 629 aa, Thermotoga maritima; identical to SEQ ID NO: 24904

SEQ ID NO: 42050 - DNA, 1983 bp, Bacillus halodurans; identical to SEQ ID NO: 24905
  CDS (1)..(1983)

SEQ ID NO: 42051 - protein, 660 aa, Bacillus halodurans; identical to SEQ ID NO: 24906

SEQ ID NO: 42052 - DNA, 1956 bp, Methanococcus jannaschii; identical to SEQ ID NO: 24907
  CDS (1)..(1956)

SEQ ID NO: 42053 - protein, 651 aa, Methanococcus jannaschii; identical to SEQ ID NO: 24908

SEQ ID NO: 42054 - DNA, 336 bp, Aquifex aeolicus; identical to SEQ ID NO: 24909
  CDS (1)..(336)

SEQ ID NO: 42055 - protein, 111 aa, Aquifex aeolicus; identical to SEQ ID NO: 24910

SEQ ID NO: 42056 - DNA, 339 bp, Pyrococcus horikoshii; identical to SEQ ID NO: 24911
  CDS (1)..(339)

SEQ ID NO: 42057 - protein, 112 aa, Pyrococcus horikoshii; identical to SEQ ID NO: 24912

SEQ ID NO: 42058 - DNA, 1887 bp, Campylobacter jejuni; identical to SEQ ID NO: 24913
  CDS (1)..(1887)

SEQ ID NO: 42059 - protein, 628 aa, Campylobacter jejuni; identical to SEQ ID NO: 24914

SEQ ID NO: 42060 - DNA, 345 bp, Vibrio cholerae; identical to SEQ ID NO: 24915
  CDS (1)..(345)

SEQ ID NO: 42061 - protein, 114 aa, Vibrio cholerae; identical to SEQ ID NO: 24916

SEQ ID NO: 42062 - DNA, 1956 bp, Methanobacterium thermoautotrophicum; identical to SEQ ID NO: 24917
  CDS (1)..(1956)

SEQ ID NO: 42063 - protein, 651 aa, Methanobacterium thermoautotrophicum; identical to SEQ ID NO: 24918

SEQ ID NO: 42064 - DNA, 1971 bp, Helicobacter pylori; identical to SEQ ID NO: 24919
  CDS (1)..(1971)

SEQ ID NO: 42065 - protein, 656 aa, Helicobacter pylori; identical to SEQ ID NO: 24920

SEQ ID NO: 42066 - DNA, 354 bp, Aeropyrum pernix; identical to SEQ ID NO: 24921
  CDS (1)..(354)

SEQ ID NO: 42067 - protein, 117 aa, Aeropyrum pernix; identical to SEQ ID NO: 24922

SEQ ID NO: 42068 - DNA, 330 bp, Pyrococcus abyssi; identical to SEQ ID NO: 24923
  CDS (1)..(330)

SEQ ID NO: 42069 - protein, 109 aa, Pyrococcus abyssi; identical to SEQ ID NO: 24924

SEQ ID NO: 42070 - DNA, 1989 bp, Lactococcus lactis subsp. lactis; identical to SEQ ID NO: 24925
  CDS (1)..(1989)

SEQ ID NO: 42071 - protein, 662 aa, Lactococcus lactis subsp. lactis; identical to SEQ ID NO: 24926

SEQ ID NO: 42072 - DNA, 2049 bp, Haemophilus influenzae; identical to SEQ ID NO: 24927
  CDS (1)..(2049)

SEQ ID NO: 42073 - protein, 682 aa, Haemophilus influenzae; identical to SEQ ID NO: 24928

SEQ ID NO: 42074 - DNA, 2879 bp, Bacillus stearothermophilus; identical to SEQ ID NO: 24929
  CDS (646)..(2595)

SEQ ID NO: 42075 - protein, 649 aa, Bacillus stearothermophilus; identical to SEQ ID NO: 24930

SEQ ID NO: 42076 - DNA, 1131 bp, Saccharomyces cerevisiae; identical to SEQ ID NO: 24931
  CDS (1)..(1131)

SEQ ID NO: 42077 - protein, 376 aa, Saccharomyces cerevisiae; identical to SEQ ID NO: 24932

SEQ ID NO: 42078 - DNA, 1995 bp, Bacillus subtilis; identical to SEQ ID NO: 24933
  CDS (1)..(1995)

SEQ ID NO: 42079 - protein, 664 aa, Bacillus subtilis; identical to SEQ ID NO: 24934

SEQ ID NO: 42080 - DNA, 2544 bp, Thermus aquaticus; identical to SEQ ID NO: 24935
  CDS (361)..(2211)

SEQ ID NO: 42081 - protein, 616 aa, Thermus aquaticus; identical to SEQ ID NO: 24936

SEQ ID NO: 42082 - DNA, 2394 bp, Arabidopsis thaliana (mouse-ear cress); identical to SEQ ID NO: 24937
  CDS (1)..(2394)

SEQ ID NO: 42083 - protein, 797 aa, Arabidopsis thaliana (mouse-ear cress); identical to SEQ ID NO: 24938

SEQ ID NO: 42084 - DNA, 853 bp, Arabidopsis thaliana (mouse-ear cress); identical to SEQ ID NO: 24939
  CDS (1)..(822)

SEQ ID NO: 42085 - protein, 273 aa, Arabidopsis thaliana (mouse-ear cress); identical to SEQ ID NO: 24940

SEQ ID NO: 42086 - DNA, 582 bp, Geodia cydonium; identical to SEQ ID NO: 24941
  CDS (62)..(511)

SEQ ID NO: 42087 - protein, 149 aa, Geodia cydonium; identical to SEQ ID NO: 24942

SEQ ID NO: 42088 - DNA, 2175 bp, Borrelia garinii PBi; identical to SEQ ID NO: 24943
  CDS (1)..(2175)

SEQ ID NO: 42089 - protein, 724 aa, Borrelia garinii PBi; identical to SEQ ID NO: 24944

SEQ ID NO: 42090 - DNA, 1956 bp, Symbiobacterium thermophilum; identical to SEQ ID NO: 24945
  CDS (1)..(1956)

SEQ ID NO: 42091 - protein, 651 aa, Symbiobacterium thermophilum; identical to SEQ ID NO: 24946

SEQ ID NO: 42092 - DNA, 1938 bp, Desulfotalea psychrophila; identical to SEQ ID NO: 24947
  CDS (1)..(1938)

SEQ ID NO: 42093 - protein, 645 aa, Desulfotalea psychrophila; identical to SEQ ID NO: 24948

SEQ ID NO: 42094 - DNA, 1119 bp, Kluyveromyces lactis NRRL Y; identical to SEQ ID NO: 24949
  CDS (1)..(1119)

SEQ ID NO: 42095 - protein, 372 aa, Kluyveromyces lactis NRRL Y; identical to SEQ ID NO: 24950

SEQ ID NO: 42096 - DNA, 624 bp, Kluyveromyces lactis NRRL Y; identical to SEQ ID NO: 24951
  CDS (1)..(624)

SEQ ID NO: 42097 - protein, 207 aa, Kluyveromyces lactis NRRL Y; identical to SEQ ID NO: 24952

SEQ ID NO: 42098 - DNA, 2031 bp, Erwinia carotovora; identical to SEQ ID NO: 24953
  CDS (1)..(2031)

SEQ ID NO: 42099 - protein, 676 aa, Erwinia carotovora; identical to SEQ ID NO: 24954

SEQ ID NO: 42100 - DNA, 1928 bp, Xenopus tropicalis; identical to SEQ ID NO: 24955
  CDS (128)..(1714)

SEQ ID NO: 42101 - protein, 528 aa, Xenopus tropicalis; identical to SEQ ID NO: 24956

SEQ ID NO: 42102 - DNA, 2058 bp, Acinetobacter sp; identical to SEQ ID NO: 24957
  CDS (1)..(2058)

SEQ ID NO: 42103 - protein, 685 aa, Acinetobacter sp; identical to SEQ ID NO: 24958

SEQ ID NO: 42104 - DNA, 1131 bp, Candida glabrata CBS138; identical to SEQ ID NO: 24959
  CDS (1)..(1131)

SEQ ID NO: 42105 - protein, 376 aa, Candida glabrata CBS138; identical to SEQ ID NO: 24960

SEQ ID NO: 42106 - DNA, 327 bp, Picrophilus torridus; identical to SEQ ID NO: 24961
  CDS (1)..(327)

SEQ ID NO: 42107 - protein, 108 aa, Picrophilus torridus; identical to SEQ ID NO: 24962

SEQ ID NO: 42108 - DNA, 354 bp, Photobacterium profundum; identical to SEQ ID NO: 24963
  CDS (1)..(354)

SEQ ID NO: 42109 - protein, 117 aa, Photobacterium profundum; identical to SEQ ID NO: 24964

SEQ ID NO: 42110 - DNA, 2043 bp, Photobacterium profundum; identical to SEQ ID NO: 24965
  CDS (1)..(2043)

SEQ ID NO: 42111 - protein, 680 aa, Photobacterium profundum; identical to SEQ ID NO: 24966

SEQ ID NO: 42112 - DNA, 1992 bp, Methanococcus maripaludis; identical to SEQ ID NO: 24967
  CDS (1)..(1992)

SEQ ID NO: 42113 - protein, 663 aa, Methanococcus maripaludis; identical to SEQ ID NO: 24968

SEQ ID NO: 42114 - DNA, 2097 bp, Parachlamydia sp; identical to SEQ ID NO: 24969
  CDS (1)..(2097)

SEQ ID NO: 42115 - protein, 698 aa, Parachlamydia sp; identical to SEQ ID NO: 24970

SEQ ID NO: 42116 - DNA, 2064 bp, Bdellovibrio bacteriovorus; identical to SEQ ID NO: 24971
  CDS (1)..(2064)

SEQ ID NO: 42117 - protein, 687 aa, Bdellovibrio bacteriovorus; identical to SEQ ID NO: 24972

SEQ ID NO: 42118 - DNA, 2217 bp, Brachydanio rerio; identical to SEQ ID NO: 24973
  CDS (65)..(1654)

SEQ ID NO: 42119 - protein, 529 aa, Brachydanio rerio; identical to SEQ ID NO: 24974

SEQ ID NO: 42120 - DNA, 2106 bp, uncultured bacterium; identical to SEQ ID NO: 24975
  CDS (1)..(2106)

SEQ ID NO: 42121 - protein, 701 aa, uncultured bacterium; identical to SEQ ID NO: 24976

SEQ ID NO: 42122 - DNA, 1998 bp, Listeria monocytogenes; identical to SEQ ID NO: 24977
  CDS (1)..(1998)

SEQ ID NO: 42123 - protein, 665 aa, Listeria monocytogenes; identical to SEQ ID NO: 24978

SEQ ID NO: 42124 - DNA, 1992 bp, Desulfovibrio vulgaris; identical to SEQ ID NO: 24979
  CDS (1)..(1992)

SEQ ID NO: 42125 - protein, 663 aa, Desulfovibrio vulgaris; identical to SEQ ID NO: 24980

SEQ ID NO: 42126 - DNA, 330 bp, Thermus thermophilus; identical to SEQ ID NO: 24981
  CDS (1)..(330)

SEQ ID NO: 42127 - protein, 109 aa, Thermus thermophilus; identical to SEQ ID NO: 24982

SEQ ID NO: 42128 - DNA, 2382 bp, Treponema denticola; identical to SEQ ID NO: 24983
  CDS (1)..(2382)

SEQ ID NO: 42129 - protein, 793 aa, Treponema denticola; identical to SEQ ID NO: 24984

SEQ ID NO: 42130 - DNA, 2331 bp, Nanoarchaeum equitans; identical to SEQ ID NO: 24985
  CDS (1)..(2331)

SEQ ID NO: 42131 - protein, 776 aa, Nanoarchaeum equitans; identical to SEQ ID NO: 24986

SEQ ID NO: 42132 - DNA, 615 bp, Ashbya gossypii; identical to SEQ ID NO: 24987
  CDS (1)..(615)

SEQ ID NO: 42133 - protein, 204 aa, Ashbya gossypii; identical to SEQ ID NO: 24988

SEQ ID NO: 42134 - DNA, 1116 bp, Ashbya gossypii; identical to SEQ ID NO: 24989
  CDS (1)..(1116)

SEQ ID NO: 42135 - protein, 371 aa, Ashbya gossypii; identical to SEQ ID NO: 24990

SEQ ID NO: 42136 - DNA, 1950 bp, Wolinella succinogenes; identical to SEQ ID NO: 24991
  CDS (1)..(1950)

SEQ ID NO: 42137 - protein, 649 aa, Wolinella succinogenes; identical to SEQ ID NO: 24992

SEQ ID NO: 42138 - DNA, 2043 bp, Porphyromonas gingivalis; identical to SEQ ID NO: 24993
  CDS (1)..(2043)

SEQ ID NO: 42139 - protein, 680 aa, Porphyromonas gingivalis; identical to SEQ ID NO: 24994

SEQ ID NO: 42140 - DNA, 336 bp, Photorhabdus luminescens; identical to SEQ ID NO: 24995
  CDS (1)..(336)

SEQ ID NO: 42141 - protein, 111 aa, Photorhabdus luminescens; identical to SEQ ID NO: 24996

SEQ ID NO: 42142 - DNA, 2028 bp, Photorhabdus luminescens; identical to SEQ ID NO: 24997
  CDS (1)..(2028)

SEQ ID NO: 42143 - protein, 675 aa, Photorhabdus luminescens; identical to SEQ ID NO: 24998

SEQ ID NO: 42144 - DNA, 2070 bp, Chromobacterium violaceum; identical to SEQ ID NO: 24999
  CDS (1)..(2070)

SEQ ID NO: 42145 - protein, 689 aa, Chromobacterium violaceum; identical to SEQ ID NO: 25000

SEQ ID NO: 42146 - DNA, 1629 bp, Anopheles gambiae str; identical to SEQ ID NO: 25001
  CDS (1)..(1629)

SEQ ID NO: 42147 - protein, 542 aa, Anopheles gambiae str; identical to SEQ ID NO: 25002

SEQ ID NO: 42148 - DNA, 339 bp, Rhodopirellula baltica; identical to SEQ ID NO: 25003
  CDS (1)..(339)

SEQ ID NO: 42149 - protein, 112 aa, Rhodopirellula baltica; identical to SEQ ID NO: 25004

SEQ ID NO: 42150 - DNA, 1932 bp, Helicobacter hepaticus; identical to SEQ ID NO: 25005
  CDS (1)..(1932)

SEQ ID NO: 42151 - protein, 643 aa, Helicobacter hepaticus; identical to SEQ ID NO: 25006

SEQ ID NO: 42152 - DNA, 2055 bp, Haemophilus ducreyi; identical to SEQ ID NO: 25007
  CDS (1)..(2055)

SEQ ID NO: 42153 - protein, 684 aa, Haemophilus ducreyi; identical to SEQ ID NO: 25008

SEQ ID NO: 42154 - DNA, 339 bp, Bordetella parapertussis; identical to SEQ ID NO: 25009
  CDS (1)..(339)

SEQ ID NO: 42155 - protein, 112 aa, Bordetella parapertussis; identical to SEQ ID NO: 25010

SEQ ID NO: 42156 - DNA, 342 bp, Bordetella bronchiseptica; identical to SEQ ID NO: 25011
  CDS (1)..(342)

SEQ ID NO: 42157 - protein, 113 aa, Bordetella bronchiseptica; identical to SEQ ID NO: 25012

SEQ ID NO: 42158 - DNA, 2079 bp, Bordetella bronchiseptica; identical to SEQ ID NO: 25013
  CDS (1)..(2079)

SEQ ID NO: 42159 - protein, 692 aa, Bordetella bronchiseptica; identical to SEQ ID NO: 25014

SEQ ID NO: 42160 - DNA, 759 bp, Oryza sativa; identical to SEQ ID NO: 25015
  CDS (1)..(759)

SEQ ID NO: 42161 - protein, 252 aa, Oryza sativa; identical to SEQ ID NO: 25016

SEQ ID NO: 42162 - DNA, 2053 bp, Xenopus laevis; identical to SEQ ID NO: 25017
  CDS (259)..(1845)

SEQ ID NO: 42163 - protein, 528 aa, Xenopus laevis; identical to SEQ ID NO: 25018

SEQ ID NO: 42164 - DNA, 2121 bp, Nitrosomonas europaea; identical to SEQ ID NO: 25019
  CDS (1)..(2121)

SEQ ID NO: 42165 - protein, 706 aa, Nitrosomonas europaea; identical to SEQ ID NO: 25020

SEQ ID NO: 42166 - DNA, 2043 bp, Shigella flexneri; identical to SEQ ID NO: 25021
  CDS (1)..(2043)

SEQ ID NO: 42167 - protein, 680 aa, Shigella flexneri; identical to SEQ ID NO: 25022

SEQ ID NO: 42168 - DNA, 333 bp, Vibrio vulnificus; identical to SEQ ID NO: 25023
  CDS (1)..(333)

SEQ ID NO: 42169 - protein, 110 aa, Vibrio vulnificus; identical to SEQ ID NO: 25024

SEQ ID NO: 42170 - DNA, 333 bp, Vibrio parahaemolyticus; identical to SEQ ID NO: 25025
  CDS (1)..(333)

SEQ ID NO: 42171 - protein, 110 aa, Vibrio parahaemolyticus; identical to SEQ ID NO: 25026

SEQ ID NO: 42172 - DNA, 2040 bp, Bacteroides thetaiotaomicron; identical to SEQ ID NO: 25027
  CDS (1)..(2040)

SEQ ID NO: 42173 - protein, 679 aa, Bacteroides thetaiotaomicron; identical to SEQ ID NO: 25028

SEQ ID NO: 42174 - DNA, 1983 bp, Vibrio vulnificus; identical to SEQ ID NO: 25029
  CDS (1)..(1983)

SEQ ID NO: 42175 - protein, 660 aa, Vibrio vulnificus; identical to SEQ ID NO: 25030

SEQ ID NO: 42176 - DNA, 333 bp, Vibrio vulnificus; identical to SEQ ID NO: 25031
  CDS (1)..(333)

SEQ ID NO: 42177 - protein, 110 aa, Vibrio vulnificus; identical to SEQ ID NO: 25032

SEQ ID NO: 42178 - DNA, 2010 bp, Streptococcus mutans; identical to SEQ ID NO: 25033
  CDS (1)..(2010)

SEQ ID NO: 42179 - protein, 669 aa, Streptococcus mutans; identical to SEQ ID NO: 25034

SEQ ID NO: 42180 - DNA, 1998 bp, Streptococcus agalactiae; identical to SEQ ID NO: 25035
  CDS (1)..(1998)

SEQ ID NO: 42181 - protein, 665 aa, Streptococcus agalactiae; identical to SEQ ID NO: 25036

SEQ ID NO: 42182 - DNA, 2031 bp, Shewanella oneidensis; identical to SEQ ID NO: 25037
  CDS (1)..(2031)

SEQ ID NO: 42183 - protein, 676 aa, Shewanella oneidensis; identical to SEQ ID NO: 25038

SEQ ID NO: 42184 - DNA, 2148 bp, Leptospira interrogans; identical to SEQ ID NO: 25039
  CDS (1)..(2148)

SEQ ID NO: 42185 - protein, 715 aa, Leptospira interrogans; identical to SEQ ID NO: 25040

SEQ ID NO: 42186 - DNA, 1209 bp, Plasmodium falciparum; identical to SEQ ID NO: 25041
  CDS (1)..(1209)

SEQ ID NO: 42187 - protein, 402 aa, Plasmodium falciparum; identical to SEQ ID NO: 25042

SEQ ID NO: 42188 - DNA, 330 bp, Thermoanaerobacter tengcongensis; identical to SEQ ID NO: 25043
  CDS (1)..(330)

SEQ ID NO: 42189 - protein, 109 aa, Thermoanaerobacter tengcongensis; identical to SEQ ID NO: 25044

SEQ ID NO: 42190 - DNA, 1230 bp, Oryza sativa; identical to SEQ ID NO: 25045
  CDS (1)..(1230)

SEQ ID NO: 42191 - protein, 409 aa, Oryza sativa; identical to SEQ ID NO: 25046

SEQ ID NO: 42192 - DNA, 858 bp, Encephalitozoon cuniculi GB; identical to SEQ ID NO: 25047
  CDS (1)..(858)

SEQ ID NO: 42193 - protein, 285 aa, Encephalitozoon cuniculi GB; identical to SEQ ID NO: 25048

SEQ ID NO: 42194 - DNA, 330 bp, Pyrococcus furiosus; identical to SEQ ID NO: 25049
  CDS (1)..(330)

SEQ ID NO: 42195 - protein, 109 aa, Pyrococcus furiosus; identical to SEQ ID NO: 25050

SEQ ID NO: 42196 - DNA, 327 bp, Pyrobaculum aerophilum; identical to SEQ ID NO: 25051
  CDS (1)..(327)

SEQ ID NO: 42197 - protein, 108 aa, Pyrobaculum aerophilum; identical to SEQ ID NO: 25052

SEQ ID NO: 42198 - DNA, 342 bp, Sulfolobus tokodaii; identical to SEQ ID NO: 25053
  CDS (1)..(342)

SEQ ID NO: 42199 - protein, 113 aa, Sulfolobus tokodaii; identical to SEQ ID NO: 25054

SEQ ID NO: 42200 - DNA, 324 bp, Thermoplasma volcanium; identical to SEQ ID NO: 25055
  CDS (1)..(324)

SEQ ID NO: 42201 - protein, 107 aa, Thermoplasma volcanium; identical to SEQ ID NO: 25056

SEQ ID NO: 42202 - DNA, 1032 bp, Drosophila melanogaster; identical to SEQ ID NO: 25057
  CDS (2)..(973)

SEQ ID NO: 42203 - protein, 323 aa, Drosophila melanogaster; identical to SEQ ID NO: 25058

SEQ ID NO: 42204 - DNA, 1726 bp, Drosophila melanogaster; identical to SEQ ID NO: 25059
  CDS (52)..(1629)

SEQ ID NO: 42205 - protein, 525 aa, Drosophila melanogaster; identical to SEQ ID NO: 25060

SEQ ID NO: 42206 - DNA, 1254 bp, Cricetulus griseus; identical to SEQ ID NO: 25061
  CDS (84)..(1163)

SEQ ID NO: 42207 - protein, 359 aa, Cricetulus griseus; identical to SEQ ID NO: 25062

SEQ ID NO: 42208 - DNA, 2010 bp, Bacillus anthracis; identical to SEQ ID NO: 25063
  CDS (28)..(2010)

SEQ ID NO: 42209 - protein, 660 aa, Bacillus anthracis; identical to SEQ ID NO: 25064

SEQ ID NO: 42210 - DNA, 1983 bp, Bacillus cereus; identical to SEQ ID NO: 25065
  CDS (1)..(1983)

SEQ ID NO: 42211 - protein, 660 aa, Bacillus cereus; identical to SEQ ID NO: 25066

SEQ ID NO: 42212 - DNA, 2112 bp, Chlorobium tepidum; identical to SEQ ID NO: 25067
  CDS (1)..(2112)

SEQ ID NO: 42213 - protein, 703 aa, Chlorobium tepidum; identical to SEQ ID NO: 25068

SEQ ID NO: 42214 - DNA, 1938 bp, Clostridium perfringens; identical to SEQ ID NO: 25069
  CDS (1)..(1938)

SEQ ID NO: 42215 - protein, 645 aa, Clostridium perfringens; identical to SEQ ID NO: 25070

SEQ ID NO: 42216 - DNA, 1926 bp, Clostridium tetani; identical to SEQ ID NO: 25071
  CDS (1)..(1926)

SEQ ID NO: 42217 - protein, 641 aa, Clostridium tetani; identical to SEQ ID NO: 25072

SEQ ID NO: 42218 - DNA, 2034 bp, Enterococcus faecalis; identical to SEQ ID NO: 25073
  CDS (25)..(2034)

SEQ ID NO: 42219 - protein, 669 aa, Enterococcus faecalis; identical to SEQ ID NO: 25074

SEQ ID NO: 42220 - DNA, 1911 bp, Fusobacterium nucleatum; identical to SEQ ID NO: 25075
  CDS (1)..(1911)

SEQ ID NO: 42221 - protein, 636 aa, Fusobacterium nucleatum; identical to SEQ ID NO: 25076

SEQ ID NO: 42222 - DNA, 2052 bp, Lactobacillus plantarum; identical to SEQ ID NO: 25077
  CDS (1)..(2052)

SEQ ID NO: 42223 - protein, 683 aa, Lactobacillus plantarum; identical to SEQ ID NO: 25078

SEQ ID NO: 42224 - DNA, 2139 bp, Methanosarcina acetivorans; identical to SEQ ID NO: 25079
  CDS (1)..(2139)

SEQ ID NO: 42225 - protein, 712 aa, Methanosarcina acetivorans; identical to SEQ ID NO: 25080

SEQ ID NO: 42226 - DNA, 2007 bp, Methanopyrus kandleri; identical to SEQ ID NO: 25081
  CDS (1)..(2007)

SEQ ID NO: 42227 - protein, 668 aa, Methanopyrus kandleri; identical to SEQ ID NO: 25082

SEQ ID NO: 42228 - DNA, 2148 bp, Methanosarcina mazei; identical to SEQ ID NO: 25083
  CDS (1)..(2148)

SEQ ID NO: 42229 - protein, 715 aa, Methanosarcina mazei; identical to SEQ ID NO: 25084

SEQ ID NO: 42230 - DNA, 2022 bp, Oceanobacillus iheyensis; identical to SEQ ID NO: 25085
  CDS (1)..(2022)

SEQ ID NO: 42231 - protein, 673 aa, Oceanobacillus iheyensis; identical to SEQ ID NO: 25086

SEQ ID NO: 42232 - DNA, 2850 bp, Oryza sativa; identical to SEQ ID NO: 25087
  CDS (44)..(2458)

SEQ ID NO: 42233 - protein, 804 aa, Oryza sativa; identical to SEQ ID NO: 25088

SEQ ID NO: 42234 - DNA, 2049 bp, Pasteurella multocida; identical to SEQ ID NO: 25089
  CDS (1)..(2049)

SEQ ID NO: 42235 - protein, 682 aa, Pasteurella multocida; identical to SEQ ID NO: 25090

SEQ ID NO: 42236 - DNA, 2175 bp, Pyrococcus furiosus; identical to SEQ ID NO: 25091
  CDS (1)..(2175)

SEQ ID NO: 42237 - protein, 724 aa, Pyrococcus furiosus; identical to SEQ ID NO: 25092

SEQ ID NO: 42238 - DNA, 2067 bp, Ralstonia solanacearum; identical to SEQ ID NO: 25093
  CDS (1)..(2067)

SEQ ID NO: 42239 - protein, 688 aa, Ralstonia solanacearum; identical to SEQ ID NO: 25094

SEQ ID NO: 42240 - DNA, 2034 bp, Salmonella typhi; identical to SEQ ID NO: 25095
  CDS (1)..(2034)

SEQ ID NO: 42241 - protein, 677 aa, Salmonella typhi; identical to SEQ ID NO: 25096

SEQ ID NO: 42242 - DNA, 1971 bp, Staphylococcus epidermidis; identical to SEQ ID NO: 25097
  CDS (1)..(1971)

SEQ ID NO: 42243 - protein, 656 aa, Staphylococcus epidermidis; identical to SEQ ID NO: 25098

SEQ ID NO: 42244 - DNA, 2001 bp, Streptococcus pyogenes; identical to SEQ ID NO: 25099
  CDS (4)..(2001)

SEQ ID NO: 42245 - protein, 665 aa, Streptococcus pyogenes; identical to SEQ ID NO: 25100

SEQ ID NO: 42246 - DNA, 1917 bp, Thermoanaerobacter tengcongensis; identical to SEQ ID NO: 25101
  CDS (1)..(1917)

SEQ ID NO: 42247 - protein, 638 aa, Thermoanaerobacter tengcongensis; identical to SEQ ID NO: 25102

SEQ ID NO: 42248 - DNA, 2196 bp, Vibrio cholerae; identical to SEQ ID NO: 25103
  CDS (145)..(2196)

SEQ ID NO: 42249 - protein, 683 aa, Vibrio cholerae; identical to SEQ ID NO: 25104

SEQ ID NO: 42250 - DNA, 2031 bp, Vibrio parahaemolyticus; identical to SEQ ID NO: 25105
  CDS (1)..(2031)

SEQ ID NO: 42251 - protein, 676 aa, Vibrio parahaemolyticus; identical to SEQ ID NO: 25106

SEQ ID NO: 42252 - DNA, 2085 bp, Xanthomonas axonopodis; identical to SEQ ID NO: 25107
  CDS (1)..(2085)

SEQ ID NO: 42253 - protein, 694 aa, Xanthomonas axonopodis; identical to SEQ ID NO: 25108

SEQ ID NO: 42254 - DNA, 2091 bp, Xanthomonas campestris; identical to SEQ ID NO: 25109
  CDS (1)..(2091)

SEQ ID NO: 42255 - protein, 696 aa, Xanthomonas campestris; identical to SEQ ID NO: 25110

SEQ ID NO: 42256 - DNA, 2109 bp, Xylella fastidiosa; identical to SEQ ID NO: 25111
  CDS (1)..(2109)

SEQ ID NO: 42257 - protein, 702 aa, Xylella fastidiosa; identical to SEQ ID NO: 25112

SEQ ID NO: 42258 - DNA, 1683 bp, Homo sapiens; identical to SEQ ID NO: 25113
  CDS (1)..(1587)

SEQ ID NO: 42259 - protein, 528 aa, Homo sapiens; identical to SEQ ID NO: 25114

SEQ ID NO: 42260 - DNA, 22 bp, Primer
atggaaaccgtggcttacgctg

SEQ ID NO: 42261 - DNA, 21 bp, Primer
ttatacgacgcgtacgcccgc

SEQ ID NO: 42262 - protein, 30 aa, consensus; identical to SEQ ID NO: 25513
  MISC_FEATURE (1)..(30): consensus for the disclosure of xaa see table XV

SEQ ID NO: 42263 - protein, 28 aa, consensus
  MISC_FEATURE (1)..(28): consensus for the disclosure of xaa see table XV
XXXXXXXXXXNXXXXXXXXXXXSXXXXX

SEQ ID NO: 42264 - DNA, 1008 bp, Escherichia coli
  CDS (1)..(1008)
atgactgataaaaccattgcgttttcgctactcgatctggcccccattcccgaaggttcttcagcgcgagaagcattctcccactctctcgatctcgcccgtctggctgaaaagcgcggctatcatcgctactggctggcagaacaccacaatatgactggcattgccagtgctgccacgtcggtattgatcggctatctggcggcgaataccaccacgctgcatctggggtctggcggcgtgatgttgcctaaccactcaccgttggtcattgcagaacagttcggcacgcttaatacactctatccggggcgaatcgatttggggctgggtcgtgctccgggtagtgaccaacggacaatgatggcgctacgtcgtcatatgagcggcgatattgataatttcccccgcgatgtggcggagctggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgctgttccaggcgctgcatctttatcgcagcaacttcaaaccgtcagcacggctggaaaaaccatacgcgatggtgtgcatcaatattatcgccgccgacagcaaccgcgacgctgaatttctgtttacctcaatgcagcaagcctttgtgaagctgcgccgtggcgaaaccgggcaactgccgccgccgattcaaaatatggatcagttctggtcaccgtctgagcagtatggcgtgcagcaggcgctgagtatgtcgttggtaggtgataaagcgaaagtgcgtcatggcttgcagtcgatcctgcgcgaaaccgacgccgatgagattatggtcaacgggcagattttcgaccaccaggcgcggctgcattcgtttgagctggcgatggatgttaaggaagagttgttgggatag

SEQ ID NO: 42265 - protein, 335 aa, Escherichia coli
MTDKTIAFSLLDLAPIPEGSSAREAFSHSLDLARLAEKRGYHRYWLAEHHNMTGIASAATSVLIGYLAANTTTLHLGSGGVMLPNHSPLVIAEQFGTLNTLYPGRIDLGLGRAPGSDQRTMMALRRHMSGDIDNFPRDVAELVDWFDARDPNPHVRPVPGYGEKIPVWLLGSSLYSAQLAAQLGLPFAFASHFAPDMLFQALHLYRSNFKPSARLEKPYAMVCINIIAADSNRDAEFLFTSMQQAFVKLRRGETGQLPPPIQNMDQFWSPSEQYGVQQALSMSLVGDKAKVRHGLQSILRETDADEIMVNGQIFDHQARLHSFELAMDVKEELLG

SEQ ID NO: 42266 - DNA, 1014 bp, Staphylococcus aureus subsp. aureus COL
  CDS (1)..(1014)
atggcgattaaatattcagcattaaaccttgtccctattcgagaaggtgaagatgaacaaacagcaattaatgatatggttaatctcgcacaacatttagacgaattatcatatgaaagatattggattgctgaacaccataacgctcccaacctagtaagttcagcaactgctttattaattcaacatacgttagaacatacgaaacacatacgtgtaggttctggaggcatcatgttacctaatcatgctccattaatcgttgcggaacaatttggcacgatggcaacattatttccaaatcgtgtcgatttaggattaggacgtgcacctggaacagatatgatgaccgcaagtgcattaagacgagatcaacatgatggtgtttataaatttccagaagaggtttcattattacaacaatatttcggccctgctcaccaacaagcatatgttcgtgcttatccagcagtaggtaaaaatgtgcctttatacattcttggttcttcaacagattctgcacatttagctgctcgcaaagggcttccatatgtgttcgctggacattttgcacctcaacaaatgaaagaagctatcgaaatttacaaaacgttatttgaaccttctgatgtattagacgaaccttatgttattgtatgtttaaatacaatcgttgctgaaaatgatgacgaagcacaatatttagcttcatctatggcacaagtaatggttagtatcactcgtggcagaatgcagcccgttcaaccgccaacacatgaactacaaaatatattaacgccgagagaatacgcgatggctatggaaagacagaaaatatcattaataggttcagaaaatactgttcaacaaaaaattcaagattttatggaaacttatggtgaagtcaacgaaattatggcaataagttatatttatgataaagatatgcaattagactcttatcgtcggttcaagaatgttataaatcagataaatgaaaaaaacactttataa

SEQ ID NO: 42267 - protein, 337 aa, Staphylococcus aureus subsp. aureus COL
MAIKYSALNLVPIREGEDEQTAINDMVNLAQHLDELSYERYWIAEHHNAPNLVSSATALLIQHTLEHTKHIRVGSGGIMLPNHAPLIVAEQFGTMATLFPNRVDLGLGRAPGTDMMTASALRRDQHDGVYKFPEEVSLLQQYFGPAHQQAYVRAYPAVGKNVPLYILGSSTDSAHLAARKGLPYVFAGHFAPQQMKEAIEIYKTLFEPSDVLDEPYVIVCLNTIVAENDDEAQYLASSMAQVMVSITRGRMQPVQPPTHELQNILTPREYAMAMERQKISLIGSENTVQQKIQDFMETYGEVNEIMAISYIYDKDMQLDSYRRFKNVINQINEKNTL

SEQ ID NO: 42268 - DNA, 1176 bp, Xanthomonas oryzae pv. oryzae KACC10331
  CDS (1)..(1176)
atgcgctcgcccatcagcaagctcaacaacgcagctacggctggtcgtagcccaccaacccagccgttgtccgactgctggaatgctgtaatccccctcgccaccaaccaagccgctggcaaacctgccagaccagccccatctgtggcccatcagtttctccggagtcatccgatgccccccatttccgtgctcgatctggcgccagtctgcgaaggcagcgacaccacccaggccttcgccaacatgctcgatctggcccagcacgccgagcgctggggctatcaacgctactggctggccgagcaccacaacatgccgggcatcgccagcgccgccaccgccgtactgatcggccatgtcgccggcggcaccaagaccatccgtgtgggcgccggcggcatcatgttgcccaaccacaccccgctgcatgtggccgaacaattcggcacgctggcttcgctgtatccgcagcgcatcgacctgggcttgggccgtgcacccggcaccgaccagcccaccgcacgcgccttgcgccgcgatttcgacagcgccgaccacttcccgcaggacgtggccgacttgatgcgctatttcgcgccagcggtgccagggcagctggtgcaggccgtgcccggcgccgggctggaggtgccggtgtggttgctggggtcgagcctgttcagtgcacgcgtggcggcagcgatgggtttgtcgtttgcgtttgcctcgcattttgcgcccgacgcgatggacgaagcggtggcaatctatcgccgcgaattccgcccatccacacagcttgccacgccgcacgtgatgctggctttgaacgtagtggcggccgacaccgaagcgcaggcacgccgtttgttcactagccagcagcagagcttcgtcgatctgcgtcgcggcaagccgggcaagattcccgcgcccatcgatgatatcgacagcttctggcagccgcatgagcgcgcgggtgtagagcgtgcactggcctgcacggtgcttggcgatgctgagcagatcacccaaggcgtggctgatttcatcgagcgccacacgccggacgaactgttgttcaccgccaacatctacgaccacgccgcgcgtttgcgctccttcgaaatcgccgctgcggcatgccgcgagctggatgtgactttggcgtga

SEQ ID NO: 42269 - protein, 391 aa, Xanthomonas oryzae pv. oryzae KACC10331
MRSPISKLNNAATAGRSPPTQPLSDCWNAVIPLATNQAAGKPARPAPSVAHQFLRSHPMPPISVLDLAPVCEGSDTTQAFANMLDLAQHAERWGYQRYWLAEHHNMPGIASAATAVLIGHVAGGTKTIRVGAGGIMLPNHTPLHVAEQFGTLASLYPQRIDLGLGRAPGTDQPTARALRRDFDSADHFPQDVADLMRYFAPAVPGQLVQAVPGAGLEVPVWLLGSSLFSARVAAAMGLSFAFASHFAPDAMDEAVAIYRREFRPSTQLATPHVMLALNVVAADTEAQARRLFTSQQQSFVDLRRGKPGKIPAPIDDIDSFWQPHERAGVERALACTVLGDAEQITQGVADFIERHTPDELLFTANIYDHAARLRSFEIAAAACRELDVTLA

SEQ ID NO: 42270 - DNA, 1008 bp, Bacillus halodurans C-125
  CDS (1)..(1008)
ttgaaattaagtgtgttagaccagtcaccgattgcttacggcagcaatgcaaaagaagctcttaggcagacaacggagctagcaaaagtgaccgaagctctaggataccatcgattctgggtatcagaacatcacgatgcatcgacccttgctggatcaagtccagaagtattaatagcacacctagccgcccatacgaaaaagattcgtctcgggtctggcggtgtgatgcttccccattatagtgcgtataaagttgctgagaacttcaagctattagaagcgctacatcctgggagaattgacgtagggcttggtagagccccaggagggatgccaattgcgaaaatggcattacaagaagggaaagagcaaaatattcataaataccctcttcaagtgaaagatgtaattgggtacttgcaggatgatttgccaacggatcatcgttttcatggcttaaaagcgaccccacttatcgatacagtacctgacgtttggctgctcggttcgagtggaggaagtgccaatgtagctgcggaaaatggtacaggctttgcgtttgctcacttcattaacggagaaggaggcgtgcaagcggttgagtcgtatcgcgagacttttcagccatctgctttgtttgacagaccacagacgagtgtcgcgatctttgtcatttgcgcagatacggatgaacaagcagatcagattgcttccagtttagacctttcgttaatcatgcttgaaaatgggcagctatcaaaaggaacaccttccatcgaaagcgccctttcctatccgtatagtccatttgaacgggcacgcatacgggaaaatcggaaacggatgattgtcggctcaccaaaagctgttcggcaacaattggtggagctagcgagggcctatgagacagaggaggttatcgttgtcacgattacccatcgctttgaagatcggattagatcatatgaactattaggggaagaatggaatgtaaacgtccattga

SEQ ID NO: 42271 - protein, 335 aa, Bacillus halodurans C-125
MKLSVLDQSPIAYGSNAKEALRQTTELAKVTEALGYHRFWVSEHHDASTLAGSSPEVLIAHLAAHTKKIRLGSGGVMLPHYSAYKVAENFKLLEALHPGRIDVGLGRAPGGMPIAKMALQEGKEQNIHKYPLQVKDVIGYLQDDLPTDHRFHGLKATPLIDTVPDVWLLGSSGGSANVAAENGTGFAFAHFINGEGGVQAVESYRETFQPSALFDRPQTSVAIFVICADTDEQADQIASSLDLSLIMLENGQLSKGTPSIESALSYPYSPFERARIRENRKRMIVGSPKAVRQQLVELARAYETEEVIVVTITHRFEDRIRSYELLGEEWNVNVH

SEQ ID NO: 42272 - DNA, 1002 bp, Pseudomonas aeruginosa PAO1
  CDS (1)..(1002)
atgacaacgcttgctgatattcccctgtccatgctcgacctggtgccggtgcgcaccggcggcagcgtggccgaagccctgcacaactccctggacctggcgcgccatgtggagcgcctgggcttcaaccgtttctggctggccgagcaccacaacatggatggcatcgccagctccgccaccgcgctgctgatcggccatatcgccggcggcacctcgcggatccgcgtcggctcgggtggggtgatgctgccgaaccatgcgccgctggtggtggcggaaaacttcggcaccctggagacgctctacccgggccgcatcgacctcggccttggccgcgcccccggcgccgaccaggcgaccatgcgcgccttgcgtcgcgaccgcctgggcaacggcgacgacttccccgagcaggtcgccgagctggaaatgctgctcggcccgcgccgttcccagcagagcctgctggcggtgccgggcgagggtacccaggtgccgatctggctactcggttcgagcctgttcagcgcccacctggcggcgcagaaaggcttgccctatgccttcgcttcgcattttgcaccgcgttacctgcacgaggcgctgcgcatctaccgcagcaacttccagccctcggcggtactcgacaaaccctacgcgatgatcggcgtgccgctgatcgccgcacctaccgacgaagaggccgagttcctcgccactaccgccttccagcgcgtgctggcgctgatccgcggcgagagcctgaaacagaagccgccggtggaaagtatggcgccgttgtggctgccccacgagcaggatgcggtcggcagcttcttcggcctggcggtgatcggcggtccggagaaggttcgcgcgcgtctggagatcctcctggagcagaccggcgccgacgagcttatcttcaccagcgacttctacgagcacgcccatcggctgcgctcttgcgaaatcgtcgcggagctgaaaggggcgtga

SEQ ID NO: 42273 - protein, 333 aa, Pseudomonas aeruginosa PAO1
MTTLADIPLSMLDLVPVRTGGSVAEALHNSLDLARHVERLGFNRFWLAEHHNMDGIASSATALLIGHIAGGTSRIRVGSGGVMLPNHAPLVVAENFGTLETLYPGRIDLGLGRAPGADQATMRALRRDRLGNGDDFPEQVAELEMLLGPRRSQQSLLAVPGEGTQVPIWLLGSSLFSAHLAAQKGLPYAFASHFAPRYLHEALRIYRSNFQPSAVLDKPYAMIGVPLIAAPTDEEAEFLATTAFQRVLALIRGESLKQKPPVESMAPLWLPHEQDAVGSFFGLAVIGGPEKVRARLEILLEQTGADELIFTSDFYEHAHRLRSCEIVAELKGA

SEQ ID NO: 42274 - DNA, 1017 bp, Halobacterium salinarum NRC-1
  CDS (1)..(1017)
atggacctctccgttgtcgacttgtctccggtcccggacggcggcactgccgccgacgcctacgccaacaccgtcgcggcggcccaacaggccgacgatctcggctacaaacgcttctgggtcgccgaacaccacggcatggagacgcttgccggcaccaccccggaagtcctgctggggcacctagccgccgaaaccgaccgaatccgcctgggatcgggggcggtgctggtgaaccactacagcccgctgaaggtggccgaacagttcggcgcgctcgacgggctcgcacccggccgcgtcgacgccggcctgggacgggccaacggctcgcccgcggtcgaccgcgcgctcgaaaccgagcgccactcctcggatccggacggcgaccacacggacgcagtcaaagcggtcctcggccacctccacgacgacttccccgaggaccacgcgtacagcgggatcgcggtccccggtggcgacgacgagccgccacagccgtggctcctgggatccagtccgtccagtgctgccatcgccggcgagctcgggctgcggtactgtttcgcggcgttcatccgcccacagttcgcgacccgcgcgttcgacgtctaccgggagtcgttcaccgcgtccacgctgcccggtggcgtcgacgaaccaaccggcatggtcgcggtgaacgccgtctgtgcggacaccgatgcggccgcggcgcgacggcgggcgtccgccgaggcgtcctaccagcgcatgaagcgcggcacggtcggcaccaccccgggcgtcgaggaagccatcgacgaactcgggggcgtgcccgatcccacccccgagacgcttcccgaaggggactggccgcgcgcgatttcgggcagcccggagacgctggctgggctgttcgaacagctggcggaccgcgtcggcgtcgaggaggtcatggtccagcagatcgtcccgggccacgacgcggcgctgcgctcccacgagttgcttgccgacgccgtcggactctga

SEQ ID NO: 42275 - protein, 338 aa, Halobacterium salinarum NRC-1
MDLSVVDLSPVPDGGTAADAYANTVAAAQQADDLGYKRFWVAEHHGMETLAGTTPEVLLGHLAAETDRIRLGSGAVLVNHYSPLKVAEQFGALDGLAPGRVDAGLGRANGSPAVDRALETERHSSDPDGDHTDAVKAVLGHLHDDFPEDHAYSGIAVPGGDDEPPQPWLLGSSPSSAAIAGELGLRYCFAAFIRPQFATRAFDVYRESFTASTLPGGVDEPTGMVAVNAVCADTDAAAARRRASAEASYQRMKRGTVGTTPGVEEAIDELGGVPDPTPETLPEGDWPRAISGSPETLAGLFEQLADRVGVEEVMVQQIVPGHDAALRSHELLADAVGL

SEQ ID NO: 42276 - DNA, 1017 bp, Deinococcus radiodurans R1
  CDS (1)..(1017)
atggctcctcttatttctgttctcgacctgacgccggtcagtaccggccagcagccgggcgaagcgctgcggcacacgctggagttggcggaagttgccgattcgtatcaatacacaaggttttggattgccgagcatcacaacagtggcgctttcgtcagcgcggccaccgaaatcttgatcgcgctcgccgctgcccggacaggccggatccgcgtcggctcgggcggcgtcatgctgcccaaccactcgccgctgaaggtggccgagaactttatgagtctggaagcgctgtttccgggccgtattgacctcggcctgggccgcgcgcccggcaccgatggacgcacggcactggcgctgcggcgctcgcgggaagcgctggccgccgacgattttcccacccagatcgcgctgctgcgggcctttgccggggaaacaccctggcccgccgggtcggtgtttgacggcgtgctggccgagccgcgcggtgtgaagctgccgccgctgtggattctgggctcaagcctctacggggcgcagctcgccggggaactgggggtcgggtacgcgttcgcctaccacttcagtcaagaagaccccgccgtggccgtgcagacctaccaccggcatttccgccccggcccgctcgccgagccctacgccatcctcggcgtcaatgcgctggcagcccccaccgaggacgaagcccgtgacctttcgctgacctcggcggcgctctcgctcggcatcctcagtggacagcgcggggtgctgcgctcgcccgaagaggcccggcagtggctgcaagagatggacaccgaccccgccaaactgctgaaaaaagcccgcatcggcacgccggagcaggtctgggccagcttgcaggaactcggcgaaagcaccggcgcccaggaaatgctggtcacgacctacgcccacgacccgcttaagcgccagcagtcgtaccggttgctcgctcaggcggcgggcatgacgccgcagaaggaagcctaa

SEQ ID NO: 42277 - protein, 338 aa, Deinococcus radiodurans R1
MAPLISVLDLTPVSTGQQPGEALRHTLELAEVADSYQYTRFWIAEHHNSGAFVSAATEILIALAAARTGRIRVGSGGVMLPNHSPLKVAENFMSLEALFPGRIDLGLGRAPGTDGRTALALRRSREALAADDFPTQIALLRAFAGETPWPAGSVFDGVLAEPRGVKLPPLWILGSSLYGAQLAGELGVGYAFAYHFSQEDPAVAVQTYHRHFRPGPLAEPYAILGVNALAAPTEDEARDLSLTSAALSLGILSGQRGVLRSPEEARQWLQEMDTDPAKLLKKARIGTPEQVWASLQELGESTGAQEMLVTTYAHDPLKRQQSYRLLAQAAGMTPQKEA

SEQ ID NO: 42278 - DNA, 1044 bp, Mycoplasma pulmonis UAB CTIP
  CDS (1)..(1044)
atggagaaaaataaaataaaattaagtgttttggattttgtacttttagatgaaaatcaagactatgagcaagcttttaaaaatacaataaaattagcaaaattagctgaaaaattaggctatcaaagctattgacttggagagcatcacggagtgcctactttgagcaattcagtacctgagctaactatgttaaaactagctcaagagactaaaaaaattaaaataggctcggctggaattatgctaaggcactactcagctactaaagcagctgaaataacaagtactttagagcttttttatcccggccgttttttgatttcctttggctcacacaaaggaactgttgctgtgcaaaaagctcttaattcccttgagtactatgaaaatgatgattatctacaaaaagttagagactatcaaaagatggtctcaaaacaacctcacatcattgagcttattcctagtttaaaaaaacctttagatacttatcttcttagtacaagtgttgaaaaagctctttttgctggagaaaataatttaaaacttattcaaggaccaggaatccatggagaagaccaaataacccaaaaagccattgagctctattacaaaaataacaaaaatactaaagctgaagttttgctttctttttttgttcttattgatgaagatgccaaaaaagttgaaaaatacaaaaaaacagctgaggtttatttaaatggaaaagatgaatttcaagaatttagattttttccatcatatgagagcataaaacactactcaaaagaaaaacaagattacttagatgtaagtaattttgacaataaagttatctatggaaactcaaaagaagttagagaaaaaattctaaatttgtcaaaaaaattcaaagttgatcattttttgattattccattagtttatggttctaaaaaccgtgaaaatagtttaaaattattaaaaaaagcctttgagcaaaaattaggagattattatgaaaaaatttgcaaattatttaattgttgaaaaagaaaataa

SEQ ID NO: 42279 - protein, 347 aa, Mycoplasma pulmonis UAB CTIP
MEKNKIKLSVLDFVLLDENQDYEQAFKNTIKLAKLAEKLGYQSYWLGEHHGVPTLSNSVPELTMLKLAQETKKIKIGSAGIMLRHYSATKAAEITSTLELFYPGRFLISFGSHKGTVAVQKALNSLEYYENDDYLQKVRDYQKMVSKQPHIIELIPSLKKPLDTYLLSTSVEKALFAGENNLKLIQGPGIHGEDQITQKAIELYYKNNKNTKAEVLLSFFVLIDEDAKKVEKYKKTAEVYLNGKDEFQEFRFFPSYESIKHYSKEKQDYLDVSNFDNKVIYGNSKEVREKILNLSKKFKVDHFLIIPLVYGSKNRENSLKLLKKAFEQKLGDYYEKICKLFNCWKRK

SEQ ID NO: 42280 - DNA, 1008 bp, Agrobacterium tumefaciens str. C58
  CDS (1)..(1008)
gtgacgatgtatacgctcagtttgctcgacaagagcccggtgccgacaggtgaggatgcggtaagcgcgttccgcgatacgatcaatctcgccaagcgcgccgaggaactgggatatcgccggttctgggtggccgaacatcacaattcgcctgaacttgccggttctgcgcccgaggcgctggtggcgtggattctggcgaagacctcccgcattcgcgtcggttcgggtggcgtgatgctgcagcattacagcccctacaaggttgccgaggtttttaatgtcctctcctcgctggcgcccggccgggtcgatcttggcgtcggcaagacaccgggcggcctgccgcttgcaacctccgccttgcagcaggcctatgatctcgcccggaagccggatttcgagacggcttttggtgagctcacgacatttctcgccggcagcgcaccgcaggaccaagctcaggccggactacaggcgacacccgtgccgccgattgcggcggaacgttttctgctcggtgccagcccggaaagcgcaaggcttgcagcgtccaaaggatggaatttcgtttttgccggccatctcaacggcgatccggaggttctgcgccgcagcctcttggctttccgtgagacaagcggcggaagcgcgccgatccttgccctctcggcttttgccgcgagcgatcccgcccatgcggcaagacaggtcgaaggccagcgcatctaccgcgtattcctgagcgatggcagggccttcaatctcggccgccgcgaacaggcggaagagttcgcccgccagtccggtgacagcgattatcgcatcgaagagcgcaagcccaatgtcctgcatggtgggccggacgatattcaccgggcgctgcgcgcgctttccgaagaacatggcatcgaggaattcatcatcgagccgccgcatgtcggggccgatcagcggcttgcttcgatcgagctcttggccacgcatcgcctttcccgggcagcgtaa

SEQ ID NO: 42281 - protein, 335 aa, Agrobacterium tumefaciens str. C58
MTMYTLSLLDKSPVPTGEDAVSAFRDTINLAKRAEELGYRRFWVAEHHNSPELAGSAPEALVAWILAKTSRIRVGSGGVMLQHYSPYKVAEVFNVLSSLAPGRVDLGVGKTPGGLPLATSALQQAYDLARKPDFETAFGELTTFLAGSAPQDQAQAGLQATPVPPIAAERFLLGASPESARLAASKGWNFVFAGHLNGDPEVLRRSLLAFRETSGGSAPILALSAFAASDPAHAARQVEGQRIYRVFLSDGRAFNLGRREQAEEFARQSGDSDYRIEERKPNVLHGGPDDIHRALRALSEEHGIEEFIIEPPHVGADQRLASIELLATHRLSRAA

SEQ ID NO: 42282 - DNA, 1026 bp, Staphylococcus aureus subsp. aureus Mu50
  CDS (1)..(1026)
ataaaaatggcgattaaatattcagcattaaaccttgtccctattcgagaaggtgacgatgaacgaacagcaattaatgatatggttaagctcgcacaacatttagatgaattatcgtatgaaagatattggattgctgaacaccataacgctcccaacctagtaagttcagcaactgctttattgattcaacatacgttagaacatacgaaacacatacgtgtaggttctggaggaatcatgttacctaaccatgctccattaatcgttgcggaacaattcggcacgatggcaacattatttccaaatcgtgtcgatttaggattaggacgtgcacctggaacagatatgatgaccgcaagtgcattaagacgagatcaacatgatggtgtttataaatttccagaagaagtttcattattacaacaatatttcggcccagctcaccaacaagcatatgttcgtgcttatccagcagtaggtaaaaatgtgcctttatacattcttggttcttcaacagattctgcacatttagctgctcgcaaagggcttccatatgtgttcgctggacattttgcacctcaacaaatgaaagaagctatcgaaatttacaaaacgttatttgaaccttctgatgtattagacgaaccttatgttattgtatgtttaaatacaatcgttgctgaaaatgatgacgaagcacaatatttagcttcatctatggcacaagtaatggttagtatcactcgtggcagaatgcagcccgttcaaccgccaacacatgatctacaaaatatattaacgccgagagaatatgcgatggctatggaaagacagaaaatatcattaataggttcagaaaatactgttcaacaaaaaattcaagattttatggaaacttatggtgaagtcaacgaaattatggcaataagttatatttatgataaagatatgcaattagactcttatcgtcggttcaagaatgttataaatcagataaatgaaaaaaaacactttataatgtga

SEQ ID NO: 42283 - protein, 341 aa, Staphylococcus aureus subsp. aureus Mu50
MKMAIKYSALNLVPIREGDDERTAINDMVKLAQHLDELSYERYWIAEHHNAPNLVSSATALLIQHTLEHTKHIRVGSGGIMLPNHAPLIVAEQFGTMATLFPNRVDLGLGRAPGTDMMTASALRRDQHDGVYKFPEEVSLLQQYFGPAHQQAYVRAYPAVGKNVPLYILGSSTDSAHLAARKGLPYVFAGHFAPQQMKEAIEIYKTLFEPSDVLDEPYVIVCLNTIVAENDDEAQYLASSMAQVMVSITRGRMQPVQPPTHDLQNILTPREYAMAMERQKISLIGSENTVQQKIQDFMETYGEVNEIMAISYIYDKDMQLDSYRRFKNVINQINEKKHFIM

SEQ ID NO: 42284 - DNA, 990 bp, Sinorhizobium meliloti 1021
  CDS (1)..(990)
atgatccccttttccattctcgacctgtcgccgatcaccgaagggggcagcatcgcagagtcgctcgaaaattcgcagcggctggcaatcgcggcggaggagaatggctatcagcgcttctggctggccgaacaccatggcatgaagggcattgccagcgccgcgacgtctctcgtgatttcgcatgtggcttcggccacgcggacgatccgcgtcggctcaggtggcatcatgctgcccaaccattcaccgctcgtcatcgccgagcaattcggcacgcttgcggcgctttaccccggccgcatcgatctcggcctcggccgcgcgcccggcacggacatgagaacggcgcaggcgctccgccgcaacatggaggcgagcgccaacaatttccccaacgatgtcgtggaactgcaggcgctgctcggcccggcgaccgaagaccagaagatcatcgccgttccgggcgcggattcgaacgtgccgatctggctgctcggttcgagccatttcagcgcccatctcgccggcatgctcggccttcccttcgccttcgcctcgcatttcgcgccggacatgctgctttccgcgctcgaaatataccgcgagcgcttcaccccgtcgccacagctcgacaagccgcatgtcatggtgggcgtcatgggcgtcgcagcggacacggacgaggaggcgaaccacctcttcacctccatgcagcaatccttcgtcgcgcttcgccgcaatgcgcgcgggcgcttcccgccgccggtcaaatcgatggacggcctctggagccaggacgagaagattttcgtcgaccacgcaatgagctacgcggtggtcggcggccccgagacgatccgccgaaagatcgaggcatttgtggatctcaccagggcggacgagctgatcgtctcaatgccgatcttcgacatggaagcgcggttgcgttcggtgaagcttttcggcggggtccgaagaacgggttga

SEQ ID NO: 42285 - protein, 329 aa, Sinorhizobium meliloti 1021
MIPFSILDLSPITEGGSIAESLENSQRLAIAAEENGYQRFWLAEHHGMKGIASAATSLVISHVASATRTIRVGSGGIMLPNHSPLVIAEQFGTLAALYPGRIDLGLGRAPGTDMRTAQALRRNMEASANNFPNDVVELQALLGPATEDQKIIAVPGADSNVPIWLLGSSHFSAHLAGMLGLPFAFASHFAPDMLLSALEIYRERFTPSPQLDKPHVMVGVMGVAADTDEEANHLFTSMQQSFVALRRNARGRFPPPVKSMDGLWSQDEKIFVDHAMSYAVVGGPETIRRKIEAFVDLTRADELIVSMPIFDMEARLRSVKLFGGVRRTG

SEQ ID NO: 42286 - DNA, 1014 bp, Caulobacter crescentus CB15
  CDS (1)..(1014)
atgcgccatctagcggacatgaccagcgccgctcttccgcccatttcggttcttgaccttgcgcccgttccgcaaggctccagtgtcgggcaggcgctgagaaacagcatcgatctggcgcaacatgctgaaacgctcgggtttcaccgctactggctcgccgagcaccacaacatgccgggaatcgccagcgcggcgacggccgtggtcatcggtcagatcgcggccgcgacgacaacgattcgggtcggctcaggcggcgtcatgctgccaaaccatgcaccactgatggtggccgagcagtttggcaccctgaacgcgctctatcctggacgcattgatctgggcctgggccgcgcgccaggtacggatcaggcgacgatgcgggcccttcgccgctatgccggcgcggtcgattcgttcgctcaggacgttgtcgagctgcagcactggttcaagccggcgagcaccgatcagagcgtgcgtgccgttccgggcgaaggccaggacgttcccatctggattctgggctcctcgacctggggggcgcagctggcggcggcgctgggcctgccctacgccttcgccgcgcactttgcgccggacgccctgatcgaggccctgacgctgtaccgccgccatttcaagccgtcggaaagcctggaccgcccctacgccatggtctgcatcggcgtttgcgccgccgacaccgacgaggaggccaagcggctgtcgacctcgactcagcagcagttcctggccttgcggcgtgggcgtccgggccttctgccgccgccggtggacgatattcgcgagcacgcctcaccgggcgagctggcggggctggatcacacgctgcagtacgccgcaatcggctcgcctgagacggtgaggcgcaagatcgacagagtgctcgaactgacaggcgcggacgaactgatggccgccgcccagatccatgatcacgcggcgcgcaggcgcagctatgagatcttggcgtccttgcgagcctag

SEQ ID NO: 42287 - protein, 337 aa, Caulobacter crescentus CB15
MRHLADMTSAALPPISVLDLAPVPQGSSVGQALRNSIDLAQHAETLGFHRYWLAEHHNMPGIASAATAVVIGQIAAATTTIRVGSGGVMLPNHAPLMVAEQFGTLNALYPGRIDLGLGRAPGTDQATMRALRRYAGAVDSFAQDVVELQHWFKPASTDQSVRAVPGEGQDVPIWILGSSTWGAQLAAALGLPYAFAAHFAPDALIEALTLYRRHFKPSESLDRPYAMVCIGVCAADTDEEAKRLSTSTQQQFLALRRGRPGLLPPPVDDIREHASPGELAGLDHTLQYAAIGSPETVRRKIDRVLELTGADELMAAAQIHDHAARRRSYEILASLRA

SEQ ID NO: 42288 - DNA, 1008 bp, Salmonella typhimurium LT2
  CDS (1)..(1008)
atgactgacaaaactattccgttctcggtgctggatctggcgccgatccctgaaggatcttcggcaaaagaagccttcacgcactcgctggatctcgcacggctggctgaaaagcgcggttatcaccgctactggctggcagaacatcacaacatgaccggtatcgccagcgcggcgacctcggtattgattggttatctggcagccaataccacaacattacatcttggctccggcggcgtgatgctgcctaaccattcaccgctggtgattgccgagcagttcggcacgctgaatacgctctacccgggacgtatcgacttagggttgggacgcgcgccgggtagcgatcagtcgacgatgcgcgcgctgcgtcgccatatgagcggcgatatcgataactttccacgcgatgtcgcagagctggtggactggttcgacgctcgcgaccctaatccgcatgtgcgcccggtgcccggctacggcgagcagatcccggtctggctgttgggatccagcctgtatagtgcgcaactggcggcccagcttggcctgccgttcgcctttgcttcgcatttcgcgccggatatgttgttccaggcgctgcatctgtaccgtacccagttcaaaccttcagcgcggctggaaaaaccgtacgcgatggtgtgtatcaatattatcgccgccgacagcaaccgcgacgccgaattcctgtttacctccatgcagcaggctttcgtgaagctacgccgtggggaaaccggccaactgccgccgccgattgagaatatggagaccttccggtcgccatccgagcagtatggcgtgcagcaggcgctgagtatgtcgctggtcggtgataaagcgaaagtccgccacgggctggaatccatcctgcgggagacccaggcggatgaaattatggtaaacgggcagattttcgaccaccaggcacgcctgcattcgtttgatttagcgatggatgttaaggaagagttgttgggctga

SEQ ID NO: 42289 - protein, 335 aa, Salmonella typhimurium LT2
MTDKTIPFSVLDLAPIPEGSSAKEAFTHSLDLARLAEKRGYHRYWLAEHHNMTGIASAATSVLIGYLAANTTTLHLGSGGVMLPNHSPLVIAEQFGTLNTLYPGRIDLGLGRAPGSDQSTMRALRRHMSGDIDNFPRDVAELVDWFDARDPNPHVRPVPGYGEQIPVWLLGSSLYSAQLAAQLGLPFAFASHFAPDMLFQALHLYRTQFKPSARLEKPYAMVCINIIAADSNRDAEFLFTSMQQAFVKLRRGETGQLPPPIENMETFRSPSEQYGVQQALSMSLVGDKAKVRHGLESILRETQADEIMVNGQIFDHQARLHSFDLAMDVKEELLG

SEQ ID NO: 42290 - DNA, 996 bp, Listeria innocua Clip11262
  CDS (1)..(996)
atgactattcgacttagcattttggatcaaagtattattaatcccggcgaacgtcctagtgaggctttacaaaacactgtagaacttgcagagcttgcagaacaacttggcttttatcgtttttgggttgctgaacatcataattcagacgaaatagccggagctgcgccggaagttcttttaggatatattgcggcaaaaacaactactattaagctcgcatccggtggcgtaatgctgcaacattatagtccatataaagttgctgaacaatttcacgtgcttgaaaacttagcgccaggacggatttcccttggtgtcggcaaagcgcccggcggatttcaaccagcgaccgatgcccttcagaaagactttgcaaagcctattcaaacgtttgatgctaaactgatagaattagtcgattttgtcacacggaaatctgcttccaaagtcgaagcaaaaccactaccagaaaataatccggaaatctttttacttggcggaagtgtagcaagtgcaagacaagctgccgaactgggaatttcttttgtgtttgcttattttattaacggcgaagaggaagttttaaaagaagcgcgggatatatttgagcagtatcaaattaaccaacaagcaagttttcaattagcgccaattgttgttgtagctgaaacaaaagctgctgcagaccgtcatattccagagcgagaatcaattaaagtagagctttcggacgggcggagagtcaatgtcggttcacgtgaacaagcagaagcctacgtgaaaaacatcagccaaccatatcgatttattacgcaaaaaattggagcaataactgggacgaaacaagacgttggagaagaaattaccagactttcaaaaaaatataatattcaagattttgtcgttttaacacctgtcaaatccgcggaaatcaaacgctattcgtaccaattattaagtgaatcaataaaggaggaagttgtccatggctaa

SEQ ID NO: 42291 - protein, 331 aa, Listeria innocua Clip11262
MTIRLSILDQSIINPGERPSEALQNTVELAELAEQLGFYRFWVAEHHNSDEIAGAAPEVLLGYIAAKTTTIKLASGGVMLQHYSPYKVAEQFHVLENLAPGRISLGVGKAPGGFQPATDALQKDFAKPIQTFDAKLIELVDFVTRKSASKVEAKPLPENNPEIFLLGGSVASARQAAELGISFVFAYFINGEEEVLKEARDIFEQYQINQQASFQLAPIVVVAETKAAADRHIPERESIKVELSDGRRVNVGSREQAEAYVKNISQPYRFITQKIGAITGTKQDVGEEITRLSKKYNIQDFVVLTPVKSAEIKRYSYQLLSESIKEEVVHG

SEQ ID NO: 42292 - DNA, 1053 bp, Ralstonia solanacearum GMI1000
  CDS (1)..(1053)
atgagccgcgatacggccgtccgcctgtccattctcgaccagagcccggtcatccacggccacagcgcgcgcgacgccatcgccgccacggtggacctggcccagatggccgatgcgctcggctacacacgctactggtgtgccgagcaccacggcctgcgcggcgtcagcaacccggcgcccgaagtgatgatcgcccgcgtggcgagcgcgacgcggcacctgcgcgtgggctccggcggggtgatgctgccctactacagcccgttcaagctggccgaacagttccgcctgctggaggcgctgttccccaaccgcatcgacctgggcgtgggccgcgcgcccggcggcgacatgcgcaccgcgcaggccgtcgccatgggcgactacaaccgcggcgaccactttccgcagcaggtgcaggaactgatctggcacctgagcggcacgctgccgcccgaccacccgacccatggcgtcatcctgcagcctgagatcgacacccggcccgagctgtggatgctgggctccagcgatttcggcggcgcgctggccgcacggctcggcatccgcttcgcctttgcccacttcatcaacccgcacgtcggccatatcgtcgcgcagcagtaccgcaccgacttcgcgcccggcttcgagccgcgcccgtacagtgccgccgccgtcttcgtgatcgccgccgatacggaagcggaggcgcgccgctgcgaggccgcggtcgatctgcgccgtgtgcagatggcgctcggggtcaacggcccgattccgaccatcgaacaggccgaagcgcaccgccataccgagcgcgaccaggccatcatcgcgcgcgaacgcccgcgcagcctcatcggcacacccgaatccgtggccgagcagatgctcaggctcaaggaccgcttcgtcgccgacgaactgatcgtgctgaccgtcgcgccgagctaccgggcacgcatgcgctcatacgagctgctggcccaggcgtttgcgctaccatctccggcttccgccacccaaccttcggcttgtcccgcatga

SEQ ID NO: 42293 - protein, 350 aa, Ralstonia solanacearum GMI1000
MSRDTAVRLSILDQSPVIHGHSARDAIAATVDLAQMADALGYTRYWCAEHHGLRGVSNPAPEVMIARVASATRHLRVGSGGVMLPYYSPFKLAEQFRLLEALFPNRIDLGVGRAPGGDMRTAQAVAMGDYNRGDHFPQQVQELIWHLSGTLPPDHPTHGVILQPEIDTRPELWMLGSSDFGGALAARLGIRFAFAHFINPHVGHIVAQQYRTDFAPGFEPRPYSAAAVFVIAADTEAEARRCEAAVDLRRVQMALGVNGPIPTIEQAEAHRHTERDQAIIARERPRSLIGTPESVAEQMLRLKDRFVADELIVLTVAPSYRARMRSYELLAQAFALPSPASATQPSACPA

SEQ ID NO: 42294 - DNA, 1002 bp, Agrobacterium tumefaciens str. C58
  CDS (1)..(1002)
atgatccccttttccattctcgacctttcgccgatcggcgaaggcgagagcgtcagcgcggcgctcgaaaattcccgccgcatggccatcaaggccgaagaacacggttataatcgcctctggctggcagagcatcacggcatgcccggcattgccagtgctgcaacctcgctggtgatcgcccatgtgggtgccgccaccaaacatatccgtgtcggttccggcggcatcatgctgcccaaccactccccgctcgtcattgccgagcagttcggaacactggcggcacttctgcccggtcgtgtcgatctcggcctaggccgcgctcccggaaccgatatgcgcacagcgcgagccctgcgccgcaacctcgatgccggcgcggaaaatttcccgcacgatatcgtcgaactccagcgttaccttggcccgccgcagccggatcaggcgatcctcgccgtgcccggcatgaattccaacgtaccgctctggctgctcggctccagcacctacagcgcgcatctcgccgcagcactcggcctgccctattccttcgcctcgcattttgcccctgatatgctgatggaggcgatccatatctatcgcgagcgtttccagccctccgaggtgctggacaagccctatgtgatggtcggtgtgatgggtgtcggcgccgatacggacgaagaggcgcagcatctcttcacctcgtcccagcagcaattcgtcaacctgcgccgcaatgtgcgcacgcagtttccgaaaccggtgcacagcatggacgattactggaacgagatggaacgtttctccgtcgaacacacgctgcgtttcgccgccgttggttcacccgaaacgatcgagcgccatctcgacggttttctcgctgaaacacaggcggatgaactgatcgtttccatgccgatccatgacatcgaaaagcggctgcgttccgtggaaattttcgccgatgtgcggaccgccatccgaaaggcagcctag

SEQ ID NO: 42295 - protein, 333 aa, Agrobacterium tumefaciens str. C58
MIPFSILDLSPIGEGESVSAALENSRRMAIKAEEHGYNRLWLAEHHGMPGIASAATSLVIAHVGAATKHIRVGSGGIMLPNHSPLVIAEQFGTLAALLPGRVDLGLGRAPGTDMRTARALRRNLDAGAENFPHDIVELQRYLGPPQPDQAILAVPGMNSNVPLWLLGSSTYSAHLAAALGLPYSFASHFAPDMLMEAIHIYRERFQPSEVLDKPYVMVGVMGVGADTDEEAQHLFTSSQQQFVNLRRNVRTQFPKPVHSMDDYWNEMERFSVEHTLRFAAVGSPETIERHLDGFLAETQADELIVSMPIHDIEKRLRSVEIFADVRTAIRKAA

SEQ ID NO: 42296 - DNA, 984 bp, Brucella melitensis 16M
  CDS (1)..(984)
atgatacctttatccgttcttgacctttcgcccgtttcagaaggcagcgatgcggcccattcgcttcgcaacacgctggagcttgcgcagcacgctgaacggctgggcttccaccgctactggctggcggaacatcacaatatgccgggcatcaccagcgcggctacctcggtcgtaatcggctatgtggccaacggaacctcgaccattcgcgtgggggcgggcggtgtcatgctgccgaaccattcgcctctggtgatcgcggaacagttcgggacacttgcttcgttgtttccgggccgcatcgatcttggccttgggcgcgcaccgggaacagacccagttacggcccatgcgcttcgccgcaatctggacagtgacgccaatgcgtttccgcaggatgtcgtggaactgctcaactatttcaaaccggccgaacccggccagcgggtgcgggccgtgccgggcgaggggttgaacgtgcctgtctggatattgggttccagcccgttcggtgcgcagcttgctgccatgctgggcctgccttacgcctttgcctcgcattttgctccggcggagatggagcgcgccatcgcgctttatcgcgaacgcttcgagccgtccgaatatatgcagaagccttatgtgatgctgggcctcaatgtgattgcagccgacacggacgaggaggcaaattatctgttcacctcgcagttacaggctttcatcaatttgcgcagcggtcgccccggcaagctgcctgcacctgtcgaaggctatatggagcggcttgatccggcagcacaagccctcgtccgccagatgctttcctgccgtgtagttggcgggccggagactgtggcgaagggcatcaaggcctttgcggaaaataccggcgcagatgagttgatgattaccggcatgatccacgaccacaaaaagcgtttgcgctcttacgagatcgtcagtaattcgattgcgtga

SEQ ID NO: 42297 - protein, 327 aa, Brucella melitensis 16M
MIPLSVLDLSPVSEGSDAAHSLRNTLELAQHAERLGFHRYWLAEHHNMPGITSAATSVVIGYVANGTSTIRVGAGGVMLPNHSPLVIAEQFGTLASLFPGRIDLGLGRAPGTDPVTAHALRRNLDSDANAFPQDVVELLNYFKPAEPGQRVRAVPGEGLNVPVWILGSSPFGAQLAAMLGLPYAFASHFAPAEMERAIALYRERFEPSEYMQKPYVMLGLNVIAADTDEEANYLFTSQLQAFINLRSGRPGKLPAPVEGYMERLDPAAQALVRQMLSCRVVGGPETVAKGIKAFAENTGADELMITGMIHDHKKRLRSYEIVSNSIA

SEQ ID NO: 42298 - DNA, 981 bp, Corynebacterium glutamicum ATCC 13032
  CDS (1)..(981)
atgtctatcccactttcactgattgattttgccaccatttttgagggcgaaaggcctggtgacagcttcaaacgatcagtggcattggcgcaaaaagctgaaggtttaggcttcaagcgcatttggtacgcagagcatcacaacatggagagcatttcttcagctgctcctgcagtgcttatttctcacatcggtgcgaacaccaagactattcgtctgggtgccggcggcgtcatgctgcccaaccactccccatatgtcatcgctgagcagttcggcaccttggcggagttgtacccagaccgcatcgacctcggcctgggccgtgcccctggcacggacatgaataccttgcgcgctttacgacgcgaccctcagtccgccgagaacttcccgtccgacgttgtcgagctgaactcttacctcaccggccgttcccgtctcccaggggttaacgcaattccaggcaagggcaccaacgtaccgctgtacatcttgggttcatccctctttggtgcacaattggcagcacagttgggtatgccttattccttcgcatcccacttcgcaccaactcaccttgagcacgcggtgcaaacctaccgggataactaccagccttcagagcagcatcctgagccttatgtcattgcggccgtcaatgtcaccgcatctgattccactgaacaagcccacgatgatttctacaaggtagcgcgtgcacgcgtgaagaacatggcattgcgtggccgacaagttactgatgagcaacttgatgaactcatggattcaccagctgctcgccaaattgtcgacatgcttcactacaccgctataggcactggatccgaagttaaagaatacctagacggttttgtaaagacggcacaggctgatgaactgatgatctccctgcaatcccccaacactgaagcaaccacgcgcaatatggaaattcttgcggatgcgtggattaattag

SEQ ID NO: 42299 - protein, 326 aa, Corynebacterium glutamicum ATCC 13032
MSIPLSLIDFATIFEGERPGDSFKRSVALAQKAEGLGFKRIWYAEHHNMESISSAAPAVLISHIGANTKTIRLGAGGVMLPNHSPYVIAEQFGTLAELYPDRIDLGLGRAPGTDMNTLRALRRDPQSAENFPSDVVELNSYLTGRSRLPGVNAIPGKGTNVPLYILGSSLFGAQLAAQLGMPYSFASHFAPTHLEHAVQTYRDNYQPSEQHPEPYVIAAVNVTASDSTEQAHDDFYKVARARVKNMALRGRQVTDEQLDELMDSPAARQIVDMLHYTAIGTGSEVKEYLDGFVKTAQADELMISLQSPNTEATTRNMEILADAWIN

SEQ ID NO: 42300 - DNA, 999 bp, Streptococcus pyogenes MGAS8232
  CDS (1)..(999)
atgaaagtcagtattcttgattatggggtgattgataaagaaaaaacatcccaagaagctttattagaaacgcgttgtttagcacaagtagccgacaaacttggctttcatcgtttttgggtagcagagcatcataatatttatgcctttgcaataagcagtccagagctgttgatgatgcatttagcagatcataccaaacagattcggataggttcaggaggtattatgcctctacattatagtagctttaagattgcagaatggataatgactttagaggccttgcaccctaatcggattgatttaggtattggcaactctttaggaactacgttagttcaaagagctctatcaagtatccattgcaaagacagctatagtcaggttgtcacagaattataccagtatcttaatcctgatcatttgtcaccactaccgatttttgttaaccctaggggtaatacttaccctcagatttggacgctaagcaatagtttggagacagcagaactggctggtcaattaggtttaggctatacctttggtattttcccctatataccaaaagatcctataacagaagctaaaagagtatcggcacattatagaaaggcttttaggccttcaaagctattaaaaatccccaagttaatattagcagtttttattgtcctttctgataccgacgaggaagcagaagctttggctaaaccgttggacatttggatgcttggtcagcaagattttaatgaatttaagacctaccctgatgttgaggaggctagaaactatcacttaacagagaaacaaagagaagccattgcagcaaatcgtagtcgcatggttattggatcacctcacacagtcaagaaacaattggataggctgatagaagcttgtcaagctgacgaattattagccatccccttagttcctgaatttgccaatagacaacgaaccttagagctgctagcagacttatacgtgaccatttaa

SEQ ID NO: 42301 - protein, 332 aa, Streptococcus pyogenes MGAS8232
MKVSILDYGVIDKEKTSQEALLETRCLAQVADKLGFHRFWVAEHHNIYAFAISSPELLMMHLADHTKQIRIGSGGIMPLHYSSFKIAEWIMTLEALHPNRIDLGIGNSLGTTLVQRALSSIHCKDSYSQVVTELYQYLNPDHLSPLPIFVNPRGNTYPQIWTLSNSLETAELAGQLGLGYTFGIFPYIPKDPITEAKRVSAHYRKAFRPSKLLKIPKLILAVFIVLSDTDEEAEALAKPLDIWMLGQQDFNEFKTYPDVEEARNYHLTEKQREAIAANRSRMVIGSPHTVKKQLDRLIEACQADELLAIPLVPEFANRQRTLELLADLYVTI

SEQ ID NO: 42302 - DNA, 1101 bp, Streptomyces coelicolor A3(2)
  CDS (1)..(1101)
atgcccgcagacgccgcagaggagatccggggcaccgcccacggcaccgctcccgtccccctctccgtactggacctggtgaccgtcggggccggccggaccgccaccgatgccctgcggaccggcgtggacatcgtgcggctcgccgaggcccgcggctttcagcgctactgggtcgccgagcaccactccatgcccggcgtcgcctcgtcctcccccgcggtcatcctggcccacctggcggcccacaccgaccgcatccggctcgggtccggcggcgtcatgctgcccaaccatgcgccgctcgtcatcgcggagcagttcgggacgctggaggcgatggcgccggggcgcgtcgacctcgggctcggccgggcacccggcaccgacggggccaccgccgccgccctgcgccgcaccgaccggctgaacgagggcgccgacgacttcccgcagcagctcgccgagctgatccggttcctggacgacgacttcccggacgggcacccgtacgcccgtatccacgccgtgccgggccccgtgcaggccacctcgcccgggggcgtgcagtcggcgcaccggccgccggtgtggctgctcgggtcctccgggttcagcgcgcggctggccggcaccctcgggctgccgttcgccttcgcgcaccacttctcggcgcagaacacgatcccggcgctcgacctgtaccgcgagtccttccggccgtccgccgtcctggacgcgccgtacgccctcatcggcgtctccgcgctcgccaccgacgacgagaaggaggcccgcaggcaggtgctggcggccgcgctgaacatggtccggctgcgcaccggccgcccggggctggtgccgacgccggaggaggccgaggcgtacgacttcagcccgatggagcaggacttcatccagtcctggaacgccaacgtcatccacggcaccgccgacgaggtgcgctccggcctcgacgacctgcacaagcgcaccggcgccgacgagctgatgctcaccgccaacgcccacggcggcgacgtacgcctgcgctcctacgagctgatcgccgacgcctacgggttgccgacgcccgcctga

SEQ ID NO: 42303 - protein, 366 aa, Streptomyces coelicolor A3(2)
MPADAAEEIRGTAHGTAPVPLSVLDLVTVGAGRTATDALRTGVDIVRLAEARGFQRYWVAEHHSMPGVASSSPAVILAHLAAHTDRIRLGSGGVMLPNHAPLVIAEQFGTLEAMAPGRVDLGLGRAPGTDGATAAALRRTDRLNEGADDFPQQLAELIRFLDDDFPDGHPYARIHAVPGPVQATSPGGVQSAHRPPVWLLGSSGFSARLAGTLGLPFAFAHHFSAQNTIPALDLYRESFRPSAVLDAPYALIGVSALATDDEKEARRQVLAAALNMVRLRTGRPGLVPTPEEAEAYDFSPMEQDFIQSWNANVIHGTADEVRSGLDDLHKRTGADELMLTANAHGGDVRLRSYELIADAYGLPTPA

SEQ ID NO: 42304 - DNA, 1110 bp, Xanthomonas axonopodis pv. citri str. 306
  CDS (1)..(1110)
ttgtccgactgctggaatgctgtaatccctcacggcacccaacacgccgctggcaatgccgccgggccagccccatctctggcatatcactcttcccggagtcatccgatgacccccatttccgtgctcgacctggcgccggtctgcgaaggcagcgacaccacccacgccttcgccaacatgctcgatctggcccagcacgccgagcgttggggctatcagcgctactggctggccgaacaccacaacatgccaggcatcgccagcgctgccaccgccgtgctgatcggtcacgtcgccggcggcaccaaggccattcgcgtgggtgccggcggcatcatgttgcccaaccacgcgccgctgcaggtggccgaacaattcggcacgctggcatcgctctatccgcagcgtatcgacctgggcctgggccgcgcgccgggcaccgatcagcccaccgcccgcgcattgcgccgctatttcgacagcgccgatcactttccgcaggacgtggccgaattgatgcgctatttcgcgccggcggtgccggggcagctggtacaggccgtgcccggcgccgggctggaggtgccggtgtggctgttgggatcgagcctgttcagcgcacgccttgccgccgcgatgggcttgtcgttcgcgttcgcctcgcatttcgcgccggacgcgatggacgaagcggtggcgatctatcgccgcgaattccgcccgtccgcacagctcgccaagccgcacgtgatgctggccctgaatgtggtggcggccgagacgcaagcgcaggcacggcgtctgttcactacccagcagcaaagcttcgtcaatctgcgtcgcggcaagccgggcaagatcccgccgcccatcgacgatatcgacagcttctggcaaccgcatgagcgtgtcggggtggagcgtgcactggcctgcacggtgctcggcgatgccgagcagattgcgcgcggcgtggccgagttcatcgagcgccacacgcccgacgagctgttgttcaccgccaacatctacgaccacgccgcgcgtctgcgctccttcgaaatcgccgctgccgcgtgccgcgagctggacgtgaccttggtgtga

SEQ ID NO: 42305 - protein, 369 aa, Xanthomonas axonopodis pv. citri str. 306
MSDCWNAVIPHGTQHAAGNAAGPAPSLAYHSSRSHPMTPISVLDLAPVCEGSDTTHAFANMLDLAQHAERWGYQRYWLAEHHNMPGIASAATAVLIGHVAGGTKAIRVGAGGIMLPNHAPLQVAEQFGTLASLYPQRIDLGLGRAPGTDQPTARALRRYFDSADHFPQDVAELMRYFAPAVPGQLVQAVPGAGLEVPVWLLGSSLFSARLAAAMGLSFAFASHFAPDAMDEAVAIYRREFRPSAQLAKPHVMLALNVVAAETQAQARRLFTTQQQSFVNLRRGKPGKIPPPIDDIDSFWQPHERVGVERALACTVLGDAEQIARGVAEFIERHTPDELLFTANIYDHAARLRSFEIAAAACRELDVTLV

SEQ ID NO: 42306 - DNA, 1056 bp, Yersinia pestis KIM
  CDS (1)..(1056)
atggacgattctatgattgataacaccggttctgtagtcgataaaaatactgtccccctttctgtgctcgatttatccccgatagcacagggtaaaacagcacgggatgcatttcatgcttcactggatttagcacaacatgctgaaaaatggggatatcagcgctactggctcgctgaacatcacaatatgaccggtatcgccagcgcggcgacgtcggtgctgatcggctatattgcgagtggcacgaataagatccgcgtcggcgctggtggtgtcatgctgccgaaccattcaccgctggtgattgctgagcagttcggtaccctcgcgtcgctctaccctgatcgtatcgatctcggtttgggccgtgcacccggtagcgatcaacgcaccatgatggcattacgtcgccatctctctggtgaagtggataatttcccagccgatgtgcgtgaactgcagaattactttgccgaagtacaaccggggcaagcagtacaagcagtgccaggccaggggctgcatgttccgctgtggctactaggctccagtctgtatagcgcacaactggccgccgcgatgggcctgccgtttgcctttgcctcacatttcgccccagatatgttgttacaggcactctcgctataccgtgagaactttacaccatccgctcaatggccaaagccctatgccattgtctgcgtaaacgtggtcgcggcagatagcgagcgcgatgcacgcttcctgtttacctcaatgcagcaacaatttgtcagcctgcgccgggggacaccgggccagttaccaccgccagtggagaatatggcggcaatttgctcgccagcggaacagtttggtgtcgatcaggcgctgcgcttatccatcgtcggtgataaaagtaaagtacgccatgggcttcagtcattattacgggaaacacaggctgacgaattgatgattaatggccaaatttttgatcatcaagcacggctgtattcctttgaaaccgttgccagcttacagcaagatctgatgcataccccgcgccggtaa

SEQ ID NO: 42307 - protein, 351 aa, Yersinia pestis KIM
MDDSMIDNTGSVVDKNTVPLSVLDLSPIAQGKTARDAFHASLDLAQHAEKWGYQRYWLAEHHNMTGIASAATSVLIGYIASGTNKIRVGAGGVMLPNHSPLVIAEQFGTLASLYPDRIDLGLGRAPGSDQRTMMALRRHLSGEVDNFPADVRELQNYFAEVQPGQAVQAVPGQGLHVPLWLLGSSLYSAQLAAAMGLPFAFASHFAPDMLLQALSLYRENFTPSAQWPKPYAIVCVNVVAADSERDARFLFTSMQQQFVSLRRGTPGQLPPPVENMAAICSPAEQFGVDQALRLSIVGDKSKVRHGLQSLLRETQADELMINGQIFDHQARLYSFETVASLQQDLMHTPRR

SEQ ID NO: 42308 - DNA, 1002 bp, Oceanobacillus iheyensis HTE831
  CDS (1)..(1002)
atgacacgtctaaacatcttagattatctattaatagatgaaggaaaaacagctatagatgcaattcatgacacgacagaattagcaaagctcgctgatgatttgggatatcatcgcttttgggtaccggaacagcatcatgctctttcgattgccagtagttcacctgaattattaatgatgcatctagctggacaaacgaagaatatacggatcggttctggtggaattatgctccctcattatagcccctttaaagtttctgagatttttcgcactttggaagcaattcaccctaatcggattgatttgggtattggaaatagtacaggaggaagattagtaaaccatgctttaaatgaggaaaaagaagaacgattaacgtatgagcaacaagtaagagatatccaaaagtatataagtgatgataaagaatcaagtcatcgtttccaaaaactaatcgctacaccagtgactgccacaagaccagaaatgtggatgctaggtgcaggaggttcaagtacgaaaattgctgcggaacttggtacggctttcacatacgcgcattttattaaaccttttgatgtaggaatcgaaatcgttaatacgtatcgaaaacaatttaaaccatctctgtttcatgaaaaaccaattgtttctattgctgtatttgtcgttgtcggaaaaacgacagacgaagctgaacagctagctaaatcctttgatttatggatggcgtcattagagactgctaagaatccgccattcttcccaaacgtccttacagcttctaacaaacattttagtccttttgaaaaacaaaaaataaataatatccgtaagagagctataataggcgactcgaattacgtaaaggaagaaattcaaaaactgattgccaaatataactgtgatgaagttatattgattcctaacattcctggaatcgagaatcgaaaaacagcaattgagttactcgccaaagaatttcaattaacttag

SEQ ID NO: 42309 - protein, 333 aa, Oceanobacillus iheyensis HTE831
MTRLNILDYLLIDEGKTAIDAIHDTTELAKLADDLGYHRFWVPEQHHALSIASSSPELLMMHLAGQTKNIRIGSGGIMLPHYSPFKVSEIFRTLEAIHPNRIDLGIGNSTGGRLVNHALNEEKEERLTYEQQVRDIQKYISDDKESSHRFQKLIATPVTATRPEMWMLGAGGSSTKIAAELGTAFTYAHFIKPFDVGIEIVNTYRKQFKPSLFHEKPIVSIAVFVVVGKTTDEAEQLAKSFDLWMASLETAKNPPFFPNVLTASNKHFSPFEKQKINNIRKRAIIGDSNYVKEEIQKLIAKYNCDEVILIPNIPGIENRKTAIELLAKEFQLT

SEQ ID NO: 42310 - DNA, 912 bp, Oceanobacillus iheyensis HTE831
  CDS (1)..(912)
atgaagcttagtatattagatcagtctcctgttttagaaggtactaccccaaagcaagctttggaggagacaattgagttagctaaactagcagatgacaaaggatatcatcgttattgggttgcagagcatcatggaatggcacaattagcaagcccatctccagatattttgttagctattattggaagtcaaacgtcaacaatacgaattggtgcgggtgcagtattattaccgaattatcgagcgtttccagttgctgagagataccacatgttagcatccatgtttcctggcagagttgatttaggaattggacgtgcgcctggtggttcggcggaagcttctattgcacttgcgggggattttttaagtaaagttaagaatctgcctatattaattgatgaattattacattttttacatgatgattttccagaggatcatttgtatgcgaaaattgatatttcacccaagtcaattgatcctccacgcccgtggctattaggtaccagtgaaaaaagcgcggttctggcggcagaaaaagaccttgcgtatgtgttcgggcactttatgacagatagtgatggtcctaaaatcattagaaagtatcaaaacgtaacagagaataaaaagcctataattgttgctgtttccgtcatatgcggtgaaactgaagaagaagctatacaattagctaaggaagcgtctgagtggaatcaaaaaacttcatcgtccgaagaggatggtatgtttcctaatatgattattggtaatccgatccaagtaaaacaacaactacaaactctacaacagttatatcaatgtgacgaattaatgattcttacaattacctcaaattatcgggatagaaagaaatcgtatgaacgaatagctaatatctgtctttaa

SEQ ID NO: 42311 - protein, 303 aa, Oceanobacillus iheyensis HTE831
MKLSILDQSPVLEGTTPKQALEETIELAKLADDKGYHRYWVAEHHGMAQLASPSPDILLAIIGSQTSTIRIGAGAVLLPNYRAFPVAERYHMLASMFPGRVDLGIGRAPGGSAEASIALAGDFLSKVKNLPILIDELLHFLHDDFPEDHLYAKIDISPKSIDPPRPWLLGTSEKSAVLAAEKDLAYVFGHFMTDSDGPKIIRKYQNVTENKKPIIVAVSVICGETEEEAIQLAKEASEWNQKTSSSEEDGMFPNMIIGNPIQVKQQLQTLQQLYQCDELMILTITSNYRDRKKSYERIANICL

SEQ ID NO: 42312 - DNA, 1020 bp, Oceanobacillus iheyensis HTE831
  CDS (1)..(1020)
atgttaacaaacgacaaacacaaaacatttcaaggtataccgctctctgtattagatttagctcctattgttcaaggttctaatgctaaacaagcttttcaagatagcgtgcgtttagcccagcatgtagaaaagctaggatttaatcgttattggctagcagagcatcataatatgcaaggtattggcagttcagcaacctcggttctaataggctatatagcaagccatacgaatcatatgagaattggatctggtggagtaatgttgccaaaccatgctacgcttgtgattgccgagcaattcggaacattagaatcactttatccaggcagaattgaccttggattaggtagagctcccggaagcgatcaagctaccgcttacgcattaagacgaacattacatgcaggtcccgacgagttccctatgcaggtaaatgaactacaagattatttttctaatgatcctgtatcacaagtaaaagcagttcctggtcaaggtttggatattcctatatggctactaggatctagtgactttagtgctcgattagcagctgaaaaaggacttcctttctcgtttgcttctcatttcgcaccacaatacaccgtgccagcgatacagttatataaacgaaatttccaaccttcaaatataatggaaaaaccgtatgcgatggttggaataaatgttattgccgcagataccgatgaagaagcggaatacttagcgaactctcatcgtatgcagtttctaaatttacgcagaggaaaagaatccaaacttcagccacctgtggaaaatatggacaccgtatggactccaatggagaaagctgcagtagaagaatctcttgatcctcgtacaaccataattggcagtaaagaaacaatcaaaaaaggaattgaagcattccaaaaagaaacagacgcagatgagatgataattacctctcaaatttatgatatgaaggctcgccttcgttcgtatgaaattattggagagattatggattaa

SEQ ID NO: 42313 - protein, 339 aa, Oceanobacillus iheyensis HTE831
MLTNDKHKTFQGIPLSVLDLAPIVQGSNAKQAFQDSVRLAQHVEKLGFNRYWLAEHHNMQGIGSSATSVLIGYIASHTNHMRIGSGGVMLPNHATLVIAEQFGTLESLYPGRIDLGLGRAPGSDQATAYALRRTLHAGPDEFPMQVNELQDYFSNDPVSQVKAVPGQGLDIPIWLLGSSDFSARLAAEKGLPFSFASHFAPQYTVPAIQLYKRNFQPSNIMEKPYAMVGINVIAADTDEEAEYLANSHRMQFLNLRRGKESKLQPPVENMDTVWTPMEKAAVEESLDPRTTIIGSKETIKKGIEAFQKETDADEMIITSQIYDMKARLRSYEIIGEIMD

SEQ ID NO: 42314 - DNA, 987 bp, Streptococcus agalactiae NEM316
  CDS (1)..(987)
atgaaattaagtgtccttgattatgggcttattgattatggaaaaactgcaagtgatgcaatacaagaaacgattcttttatcacaagaggcggagcgactaggatatcatcaattttgggtggctgaacatcacggtgttaaggcattcagtattagcaatccagaattaatgataatgcatttggctaaccagactaaatctatcaaaattggctctggaggtataatgcctctgcactatagtagttttaaactcgcggagactctcaagacattagagacatgtcatccgaatcgagtaagtattggtttaggaaattcactagggacagttaaagtttcaaatgcacttcgtagcttacataaagcacatgattacgaagaggtactggaggaattgaagtcatggcttattgataaatcatccagtaaggaaccattagttcaaccgactctttctagcttcccagacttatatgtgttggggagtggtcaaaaatcagcttatttagcggctaaacttggcttaggctttaccttcggtgtttttccttttatggacaaagacccattgacagaagctaaaaagctttcatctctttattatcatcagtttgaagaatattatcctaataagtctcctaatttgatggtagctgcatttgtagttatagctgatacttcagaagaagctgaaaacatagcaaagactttagatatctggatgctaggaaataaagacttcaatgaatttgcaacatttcctactattgaagaagctaatcattaccaattgactcctgaacaaaaagcaaaaattaaatcaaatcgccaccgtatgattgtaggtgatccaaaacaagttaaagacagccttgacgctttagttaatgctagtcaagcagaagaactacttttgattcctcttgttccaggacttgatcaacgaatcaaatccttaaaattattatcacagttatattaa

SEQ ID NO: 42315 - protein, 328 aa, Streptococcus agalactiae NEM316
MKLSVLDYGLIDYGKTASDAIQETILLSQEAERLGYHQFWVAEHHGVKAFSISNPELMIMHLANQTKSIKIGSGGIMPLHYSSFKLAETLKTLETCHPNRVSIGLGNSLGTVKVSNALRSLHKAHDYEEVLEELKSWLIDKSSSKEPLVQPTLSSFPDLYVLGSGQKSAYLAAKLGLGFTFGVFPFMDKDPLTEAKKLSSLYYHQFEEYYPNKSPNLMVAAFVVIADTSEEAENIAKTLDIWMLGNKDFNEFATFPTIEEANHYQLTPEQKAKIKSNRHRMIVGDPKQVKDSLDALVNASQAEELLLIPLVPGLDQRIKSLKLLSQLY

SEQ ID NO: 42316 - DNA, 1041 bp, Corynebacterium efficiens YS-314
  CDS (1)..(1041)
gtgacagcacaccccgtccccgttcgcacaaggaaagaaccaatgtcagtaccgttgaacatcctcgacctcgtgtccatctccgagggctccaccgcccgcgatgccatcgcagcctccatggacgccgcccggctcgccgatgaactggggtatcaccggctgtggttcgccgagcaccacaacaccgtgaacctggcctccagtgccaccgcactgctggtcgggcaggcggcctccgtcaccgaccggatccgggtgggctccggtggggtcatgctccccaaccacgccccactgatggtcgccgaacagtacggcaccctggccaacatgttcggcgaccggatcgatctgggtctgggccgcgcaccgggaaccgatgggatgaccgcccaggcactcagccgctcctccgccgaaccgcaggccttcgccgagagcatctatgacctgcagggatggttcagcgaggccggatcctcccacagcatgccgattgtctccgccgcctccgccggtaccgacgtgccgatctgggtactggggtccaccatcaacggcgccgccatcgccggacagctgggcctgccgttctccctcgcctcgcattttgcacccgaccagatcgatcaggccatccgggtctaccgggacaccttctccaccgagatgcccaccgcgcagatagacaagccctacatcatggccggcatcaatgtcctggtcgccgacaccgatgccgaggccgagcgcgaattcaccgtgatccagcagatgttcgccgacatccagaccgggcagcgccggaagctccaacccccggtggatccggcgaccctccccggtggcggtggggcccagtccatgctgcagatccaggcggtgggttcaccgaagacggccaccgcccagctggaggagttcgtggagcgcaccggcgccgatgagctgatcaccgtcacctacgccttcgacccgaaggtgcgggagcgttccctgcagctgctggccgaggcatggttccagggcgggcggtga

SEQ ID NO: 42317 - protein, 346 aa, Corynebacterium efficiens YS-314
MTAHPVPVRTRKEPMSVPLNILDLVSISEGSTARDAIAASMDAARLADELGYHRLWFAEHHNTVNLASSATALLVGQAASVTDRIRVGSGGVMLPNHAPLMVAEQYGTLANMFGDRIDLGLGRAPGTDGMTAQALSRSSAEPQAFAESIYDLQGWFSEAGSSHSMPIVSAASAGTDVPIWVLGSTINGAAIAGQLGLPFSLASHFAPDQIDQAIRVYRDTFSTEMPTAQIDKPYIMAGINVLVADTDAEAEREFTVIQQMFADIQTGQRRKLQPPVDPATLPGGGGAQSMLQIQAVGSPKTATAQLEEFVERTGADELITVTYAFDPKVRERSLQLLAEAWFQGGR

SEQ ID NO: 42318 - DNA, 966 bp, Corynebacterium efficiens YS-314
  CDS (1)..(966)
atggcaaaaccacgattgagcgttctcgacctcgttgccctcagtgagggtatgacggcgggtgaggcgatcgcgcattccgtggaggcggcccaaatcgccgaggcatccgggtatacccgttactggttggcggaacaccacaactcggaggctctggcctcctctgcgaccaccctgctcatgggacatatcgctggtcgcacctcctccatcagggtgggctccgggggcatcatgcttcccaatcactcccctctccatgtcgcggaggaactcggtacccttgatgcgatgtacccggggcggatcgaggcgggtctgggccgggccccgggaaccgatccggccacagcgagggaactcgggcggggaagtgcccatgtcggcgatgtcacggcgtcgataagcgctcttatccggtacctggacgacccggaggggcggccgacggtgatcgcccaccccggccggggatcgaaggtgcccctctacatgcttggttcctccatcaacggggctgcgatggcggcggagctcgggttgccgttcgccttcgccagtcatttcgcgccgttccagatggggccggcgatcgcctcctaccgtgagcgcgcggagaatccgtatgtcatggccgcggcgaatgtcatggttgccgatactgaggaggaggcacgtttccagctgtccaccctgcatcggatgttcgcgggtatcgtcaccaaccagcgttcggctctcgccccgcccgaacatgggctggaggagaagctcggacccatggtgtggaaacacatcacggattccctggagatcactttcgccggcacggccgagcaggtggccgcggatctggaggaattcgcccagcgctatgccctcgatgagatcatcactgtgacgtattccttcgatcccgccgttcggaaggcatccatcgaggcgctcggccgggtgtggtga

SEQ ID NO: 42319 - protein, 321 aa, Corynebacterium efficiens YS-314
MAKPRLSVLDLVALSEGMTAGEAIAHSVEAAQIAEASGYTRYWLAEHHNSEALASSATTLLMGHIAGRTSSIRVGSGGIMLPNHSPLHVAEELGTLDAMYPGRIEAGLGRAPGTDPATARELGRGSAHVGDVTASISALIRYLDDPEGRPTVIAHPGRGSKVPLYMLGSSINGAAMAAELGLPFAFASHFAPFQMGPAIASYRERAENPYVMAAANVMVADTEEEARFQLSTLHRMFAGIVTNQRSALAPPEHGLEEKLGPMVWKHITDSLEITFAGTAEQVAADLEEFAQRYALDEIITVTYSFDPAVRKASIEALGRVW

SEQ ID NO: 42320 - DNA, 1005 bp, Pseudomonas putida KT2440
  CDS (1)..(1005)
atgacgcagctgcgtgacctgaagatttccaccctggacctggtgcccgtacgcgccgacgctggccccgcgcaatcgctgcgcaactcgctggacctggcgcagcatgtcgagcgctttggctataaccgcttctgggtggccgagcaccacaacatggacggcatcgccagttcggcgactgcggtgctgatcggctacctggccggggggacctcacgtattcgcgtgggctctggcggggtgatgctgcccaaccatgcgccactggtgatcgccgagcagttcggcaccttggccagcctgtatccggggcgtatcgaccttggcctgggccgtgcaccgggttcggaccagatgacggcctatgccctgcgacgcgaccgtgccggcggcccggacgacttcccagacgatgtcgaggagctttcgcgctacctcgggccacgcactgatgatcaaaaagtgatcgccgtaccggggtacgacaccgacgtgccgatgtggttgctgggatccagcctgttcagtgcccagctggcgggcatgcgcggcatgccctacgccttcgcctcgcatttcgcgccacgctacatgcacgaggccattcgcgtgtaccgcaaccatttcaagccctcgaccacgctggacaagccgtatgtgatgctgggcattcccatggtggtggcgcagaccgacgagaaggccgaatacctggccacctcggtctaccagcgcatcctggcgctgattcgcggccagagcctgatgcagaagccacccgtggaaagcatggatgggctgtggttgccccatgagcgagagacggtgggcagcttcctggggctggccatgatcggcagcccgcggaaggtaaaggccaaggtagaagtgctgctggaacagacgggtgcggatgagctgatctttacctgtgacctgtatgagcatgcggaccgcattcggtcatatgagctgatggcgcaggccctcaagaccgagtga

SEQ ID NO: 42321 - protein, 334 aa, Pseudomonas putida KT2440
MTQLRDLKISTLDLVPVRADAGPAQSLRNSLDLAQHVERFGYNRFWVAEHHNMDGIASSATAVLIGYLAGGTSRIRVGSGGVMLPNHAPLVIAEQFGTLASLYPGRIDLGLGRAPGSDQMTAYALRRDRAGGPDDFPDDVEELSRYLGPRTDDQKVIAVPGYDTDVPMWLLGSSLFSAQLAGMRGMPYAFASHFAPRYMHEAIRVYRNHFKPSTTLDKPYVMLGIPMVVAQTDEKAEYLATSVYQRILALIRGQSLMQKPPVESMDGLWLPHERETVGSFLGLAMIGSPRKVKAKVEVLLEQTGADELIFTCDLYEHADRIRSYELMAQALKTE

SEQ ID NO: 42322 - DNA, 981 bp, Pseudomonas putida KT2440
  CDS (1)..(981)
atgactgcactgtccgtactggatctggtcatgatcggcgaaggcaagaccttcgccgacgcgatcgaagaatcccgccagctggcgcggcatgtcgagcaacagcactacagccgctactggatcgccgagcaccatgacatgccgggcattggctcggctgccacgtcgctggtgatcaacgaaatcgccaacgccacccgacacattcgtgtgggtgctggcggtatcatgctgcccaaccatgcgccgttggtggtggccgaacagtttggcaccctcaatacattgcacccaggtcgtatcgacctgggcctgggccgtgcgccaggcacgtccgggccgaccgttcgggcattgcgcggcgccgcgccagagcgggatttcggccaggacatcgccgagctgcgtgattacctggccgacaacggcaaacgccgggtgcgcggcgtaccgggtgcgcacgatgtgccggtgtggatcctcggttccagcctgttcggtgctgacctggcggcgaagctgggcctgccttatgccttcgcctcgcactttgccccgcgttacctgctgcaggccattgcccattaccgcgccaacttccagccttccgcgcaactggccaaaccctatgtgatggttggcatgaacctgttcgccgctgccagcgatgctgaggcggactacctggccagctcccaccgcaagtggatgctggacctgcatgtcgggcgctttggcttgctgcccaagccgcaagagggttacctcgaacgcttgccggaccacgagcgcgccgtgctcgatcaggtgatggcctgctccgtagccggagggcccgaacgggtgagggaagggctgcgctcgctgatcgagcagaccggggcggacgagctgatgatcgactgccgcatccatgacccgctggcgcggcagcggtcacatgcctatgccgcgcaggcgctggctgaactgggctga

SEQ ID NO: 42323 - protein, 326 aa, Pseudomonas putida KT2440
MTALSVLDLVMIGEGKTFADAIEESRQLARHVEQQHYSRYWIAEHHDMPGIGSAATSLVINEIANATRHIRVGAGGIMLPNHAPLVVAEQFGTLNTLHPGRIDLGLGRAPGTSGPTVRALRGAAPERDFGQDIAELRDYLADNGKRRVRGVPGAHDVPVWILGSSLFGADLAAKLGLPYAFASHFAPRYLLQAIAHYRANFQPSAQLAKPYVMVGMNLFAAASDAEADYLASSHRKWMLDLHVGRFGLLPKPQEGYLERLPDHERAVLDQVMACSVAGGPERVREGLRSLIEQTGADELMIDCRIHDPLARQRSHAYAAQALAELG

SEQ ID NO: 42324 - DNA, 996 bp, Staphylococcus epidermidis ATCC 12228
  CDS (1)..(996)
atgaaaaatataaaattatctgcgttaaacttagtacctatacgtgaaggtcaagaagataaagatgcaattaacgatatggttacactcgctcaagcattagatgatttagattatgagcgctactggattgcagagcatcataatgctccaaatttagttagttcagctacttctctattaattcaacatacattagaacatactcattctatcaaagtaggttctggaggcataatgttaccgaatcatgcaccactagtcgtagcagaacaatttgggacattggaaacattattccctcaacgtgtggacttaggattaggacgtgctcctggtacagatatgatgacagcgagcgcattaagaagaaatcagcataatggtgtttatcaattccctgaagaagttgaacaactgcaacaatattttggaccgagtcatcaacaagcatatgtacgtgcttatcctgcggtagataaaaatgtcccaatgtatattctaggttcatctacagattctgcacatttagctgcacgtaaagggttaccatatgtttttgcaggacattttgctccacaacaaatgaaggaagcactacaaatttatagagaattatttgaaccttcagaagtacttgataaaccttatgtaattgtttgtttaaatacaattgtgtcagattctgatgaacaagcagaatatttagcaactacgatgtctcaaataatggtaagtataacacgaggaaaaatgcaacctgtccaaccaccaacagatgatttaaaggccctattaacaccacgcgaatatgaattagcacaacaacgtttaaaagggtcacttataggatctgaagatacagttaaacaaaaacttgaatcgttcataaaagagtacggggatatcgatgaacttatggcaattagttatatctatgatcaagacaaacaaatagaatcatatcgaagattagaacgtgcaattaaatcatag

SEQ ID NO: 42325 - protein, 331 aa, Staphylococcus epidermidis ATCC 12228
MKNIKLSALNLVPIREGQEDKDAINDMVTLAQALDDLDYERYWIAEHHNAPNLVSSATSLLIQHTLEHTHSIKVGSGGIMLPNHAPLVVAEQFGTLETLFPQRVDLGLGRAPGTDMMTASALRRNQHNGVYQFPEEVEQLQQYFGPSHQQAYVRAYPAVDKNVPMYILGSSTDSAHLAARKGLPYVFAGHFAPQQMKEALQIYRELFEPSEVLDKPYVIVCLNTIVSDSDEQAEYLATTMSQIMVSITRGKMQPVQPPTDDLKALLTPREYELAQQRLKGSLIGSEDTVKQKLESFIKEYGDIDELMAISYIYDQDKQIESYRRLERAIKS

SEQ ID NO: 42326 - DNA, 1047 bp, Staphylococcus epidermidis ATCC 12228
  CDS (1)..(1047)
atgaagaggagatgtgtgttcatgagattaagtttacttgattatgtcccgttgttcgaagggcgtaccccaaatgacgccctaaagcatagtattaaattagcccaacacgctgagaaacttgggtacttacgatactgggttgcagaacatcatcaagtttattctgtcgtttctagtgcacctgaaataataatgatgtcgattttagaacacacacaacacatcagagttggtagtggaggtgtgatgttaccacattatagtccttataaagtagctgagcaatttaaaattatggaagcaagacacccccaacgtatcgatatggctatcggacgttcgccaagctttaaaaatgttaatgcagcactaaatgaaaacaaaaatgaaaaattaccattcaatactcagattactgatttgcttaaatacttcaataacgatacaactcaagaccatcgttttaaatcattattagctacacctatggttacttcatttcctcaactatatattttaggtatgagtaatagaagcgcaaaattagctgctcagcgcggactaccttttgttattgcacgaatgggacaatctgagacagaccttcatgaagctataagcacttatagaaaatattttaaagcttatcatggtgaaattaataatgcgaaaccatatgttattttagcaacttttgtggtaacagcttctaatttatctagagttaaacaattgctacatacgcttcaactttggttgatgcgtattaactatttaaatcaacctaagagttatccatcgattgaaacagcacagaacaagcattatagtcaacgagaattagaaaagcttgaaaagatgaaatcgaaaatcatatacggaatgccaaatgatgttgcggaacaacttaccttacttcatcaacaatttaaagtggatgaaatcatcatcttacctcatgtatttggtgaagacgctagaatggaattaattgagttaattgcgaatgaattgattccatcttgttcacgcgatgaattttag

SEQ ID NO: 42327 - protein, 348 aa, Staphylococcus epidermidis ATCC 12228
MKRRCVFMRLSLLDYVPLFEGRTPNDALKHSIKLAQHAEKLGYLRYWVAEHHQVYSVVSSAPEIIMMSILEHTQHIRVGSGGVMLPHYSPYKVAEQFKIMEARHPQRIDMAIGRSPSFKNVNAALNENKNEKLPFNTQITDLLKYFNNDTTQDHRFKSLLATPMVTSFPQLYILGMSNRSAKLAAQRGLPFVIARMGQSETDLHEAISTYRKYFKAYHGEINNAKPYVILATFVVTASNLSRVKQLLHTLQLWLMRINYLNQPKSYPSIETAQNKHYSQRELEKLEKMKSKIIYGMPNDVAEQLTLLHQQFKVDEIIILPHVFGEDARMELIELIANELIPSCSRDEF

SEQ ID NO: 42328 - DNA, 1008 bp, Bradyrhizobium japonicum USDA 110
  CDS (1)..(1008)
atgatccccttctccgtgctcgacctcgctcccatccgccagggtggcgacgccgcgcaggcgtttcgcaattcgcttgatcttgcccagcacgccgaggcctggggctacaagcggttctggctggccgagcatcacaacatgacggggattgcgagcgcggcgacgtccgtggtgatcgggcatgtcgcgggcgggacgaagacgatccgtgtcggctccggcggcgtcatgctgccgaaccattcgccgctggtcatcgccgagcagttcggcacgctggagtcgctctatccgggacggatcgatctcgggctcgggcgggcgccgggcaccgaccagttcacagcaagggcgctgcggcgtgacctcgccaccacgtccgagaattttccgcatgacgtgctggaattgcaggcgttgctcggcgatgtgcaaccgaaccagacgatccgcgccgtgcccggcatggggaccaaggtgccgctgtggatcctgggatcgagcacgttcggcgcgcagcttgcggccatgctcggcctgcccttcgccttcgcctcgcatttcgcgccgcagatgatgatgccggcgctgcgcgagtatcgcgcgcgtttcgagccctcggcgcagctcgacaagccctatgcgatggtcggcgtcaacgtgttcgcggcggagagcgacgccgaggcgcaacgcatgttctcctcgctgcagcagcagttcatcaacctgcgccgcggcacgcccggcccgctgccgccgccggtcgacgacatggacgcgctgtggtcgccggcggagaaggccatggtcggccagtcgctgtcctgctccgcggtcggctcgcccaccgtggtcgaagagaagctgaaggcgctgatcgccgagaccggcgcggacgaattgatgaccaccggccagatctacgaccacgccgcccggctgcgctcgttcgagatcgcggccgaggtgcgcggccggctggcggcgcaaccggcccggtga

SEQ ID NO: 42329 - protein, 335 aa, Bradyrhizobium japonicum USDA 110
MIPFSVLDLAPIRQGGDAAQAFRNSLDLAQHAEAWGYKRFWLAEHHNMTGIASAATSVVIGHVAGGTKTIRVGSGGVMLPNHSPLVIAEQFGTLESLYPGRIDLGLGRAPGTDQFTARALRRDLATTSENFPHDVLELQALLGDVQPNQTIRAVPGMGTKVPLWILGSSTFGAQLAAMLGLPFAFASHFAPQMMMPALREYRARFEPSAQLDKPYAMVGVNVFAAESDAEAQRMFSSLQQQFINLRRGTPGPLPPPVDDMDALWSPAEKAMVGQSLSCSAVGSPTVVEEKLKALIAETGADELMTTGQIYDHAARLRSFEIAAEVRGRLAAQPAR

SEQ ID NO: 42330 - DNA, 1014 bp, Bradyrhizobium japonicum USDA 110
  CDS (1)..(1014)
atgatcccgctctcagtccttgacctctccgtcgtcaccacaggcacaaaacccgccgcggcgctgcgcaacagcatcgatctggcgaagcatgtcgatgggctcggctatgtccgctactggctcgccgagcatcacaacctcgcctccgtcgcgagcccggcgcccgacgtgatgatcgggcagatcgcggcggtgacgaagcagatccgcgtcggctccggcggggtaatgctgcccaaccacgcgccgctggtggtggccgagcgcttcaagatgctggaggcgctgtttcccggccgcatcgacctgggcctcggccgcgcgcccggtaccgatggtgccacggcctacgcgctgcgcagccggctcgatcgccgcgagggcgacgattttctggagcggctgcacgaactgatcttgtgggagacgagagaatttccgtcagggcacccctacaacaacgtcgtcgcgatgcccgacgacaccaagctgccgccgatctggctgctcggctccagcgattattcgtcggagcttgccgcgcaagtcggcatgggcttcgccttcgcgcatcattttgcgtcccatgatgcgatcgatgcgatggtgcattaccgcaaccgcttccagccctcggcctggcgcgccacgccgcacgcgatccttgccgtcgccgtcatcgcggcggagaccgacgaggaagctgaaaagctcgcgacatccttcgacctcaatcgcctccgccgcgaccgcggccagtatctgccgctgccgagcgtcgaggaggcgctggcctatccctactccgacgccgagcgcatctcgatcgcccgcaaccgctcgcgcttattcgtcggcagccctgcgaccgtgcagaagaagctccagccgctgatcgattccagcaagccggacgaattgatggtgatcacggcggtgtacgaccacgaggcgcgaaagaagtcgtattcgctgctggcggcggcgttcggattggcgaaggcggcgtaa

SEQ ID NO: 42331 - protein, 337 aa, Bradyrhizobium japonicum USDA 110
MIPLSVLDLSVVTTGTKPAAALRNSIDLAKHVDGLGYVRYWLAEHHNLASVASPAPDVMIGQIAAVTKQIRVGSGGVMLPNHAPLVVAERFKMLEALFPGRIDLGLGRAPGTDGATAYALRSRLDRREGDDFLERLHELILWETREFPSGHPYNNVVAMPDDTKLPPIWLLGSSDYSSELAAQVGMGFAFAHHFASHDAIDAMVHYRNRFQPSAWRATPHAILAVAVIAAETDEEAEKLATSFDLNRLRRDRGQYLPLPSVEEALAYPYSDAERISIARNRSRLFVGSPATVQKKLQPLIDSSKPDELMVITAVYDHEARKKSYSLLAAAFGLAKAA

SEQ ID NO: 42332 - DNA, 1002 bp, Pseudomonas syringae pv. tomato str. DC3000
  CDS (1)..(1002)
atgaaacgtctggcagatgtaaaaatttcgacccttgatctggtgcccgtgcgccacgacaaagggcccgccgaatccctgcgcaattcgctcagcctcgctcagcacgttgaaaagctgggctacaaccgtttttgggtggctgaacaccacaacatggacggcattgcgagttcggcgacctccgtgctgctcgcgtacctggccgggggcacttcaaccattcgtgtgggcgctggcgggatcatgctgcccaatcacgcgccgctggtggttgccgagcagttcggcaccctggccagcctctatcctgatcgaattgatctaggcctgggccgcgcgccgggctccgatcagatgaccgcccgtgccttgcgccgcgagcgctccggcagcgccgaagactttccggatgatgtcactgaactgatggagtacctggggccgcgcacacctgatcaaaaagtgatcgcagtgccgggctccggcaccaatgtgccgatctggttgctgggctcgagcctgttcagcgcgcaattggcgggcatgcgcgggctgccttatgcgttcgcttcgcacttcgcaccgcgttacatgcacgaggccattcgcgtgtaccgcaatcacttccagccctcggccgtgctcgacaagccctacgtgatgctcggggttccgctgtcggcagccgataccgatgagcaggctgaatacctggccacctcggtctaccagcgcattctggcgctgatgcgcgggcacagtctgatgcagcggccaccggtcgattccatggacggcctgtggctgccacacgaacgtgaagcggtggcgagcttcctggggctggcgatggtcggcggcccggagaagatccgcgccaagctggacgtgctgcttgagcagaccgatgccgacgagctgatctttacctgcgacatgtacgagcatgaagacaggctgcggtcctacgagattctcgcgcaggtcgcacacggctag

SEQ ID NO: 42333 - protein, 333 aa, Pseudomonas syringae pv. tomato str. DC3000
MKRLADVKISTLDLVPVRHDKGPAESLRNSLSLAQHVEKLGYNRFWVAEHHNMDGIASSATSVLLAYLAGGTSTIRVGAGGIMLPNHAPLVVAEQFGTLASLYPDRIDLGLGRAPGSDQMTARALRRERSGSAEDFPDDVTELMEYLGPRTPDQKVIAVPGSGTNVPIWLLGSSLFSAQLAGMRGLPYAFASHFAPRYMHEAIRVYRNHFQPSAVLDKPYVMLGVPLSAADTDEQAEYLATSVYQRILALMRGHSLMQRPPVDSMDGLWLPHEREAVASFLGLAMVGGPEKIRAKLDVLLEQTDADELIFTCDMYEHEDRLRSYEILAQVAHG

SEQ ID NO: 42334 - DNA, 987 bp, Enterococcus faecalis V583
  CDS (1)..(987)
atgaaattaagtatcttagatcaattaacggttcctaaaaatcaatcagcaagcgacacattacaagaagccaaagagctcgctcaattagcggaaaaacttggttacacaagaatttggtatgccgaacatcacggctcagacgcctttgccagtgcaacgccagaaattttagttgcacatattgctagtgccaccgaaaaaattcgtgttggcgcgggtggcatcatgaccatgcattatgcgccatttaaagtcgcagaaacgtttaaaacgttagcagctttatatcctgatcgaatcgatttaggcatgggccgctcgcctggcggcagccctttaactacgttggcgttaaataatggtcagccaccacagctagaccaatttgataaattacctgaaattttactctttttaagagaggaatttcctgaagatcatttatattctaaaatttcagctgttccgcgggaagttctattaccacaaccttggttactaggtgctagcaaagaaagcgcacgttcagctggtgaatatggcattaatttttcctttgctcagtttattcatggacatttgcccaaagaagtattgtccgcatattacaagcatttccgaccagtaactgaacaacaagagccgcaagtgagcgctgcgtatttcacttttgccgccgacacgaaagaagaagcagaataccatgcggctagtttcgagcattatatctttgccaccgaacatgggcttccaaataaatttttatcgccagaagaagccctagctttcccttacagtgaaatggacaaactggttttagaacaaaataaacaacgctttgtcattggcagtagccaagaagttgcggagtttttccaccaacaagaagaactagggttgacagaagcaatgctaatcaccccaggttatgacaaacaaacgcgctttcaatcgtttgaacgcctagcaaaagaattattatag

SEQ ID NO: 42335 - protein, 328 aa, Enterococcus faecalis V583
MKLSILDQLTVPKNQSASDTLQEAKELAQLAEKLGYTRIWYAEHHGSDAFASATPEILVAHIASATEKIRVGAGGIMTMHYAPFKVAETFKTLAALYPDRIDLGMGRSPGGSPLTTLALNNGQPPQLDQFDKLPEILLFLREEFPEDHLYSKISAVPREVLLPQPWLLGASKESARSAGEYGINFSFAQFIHGHLPKEVLSAYYKHFRPVTEQQEPQVSAAYFTFAADTKEEAEYHAASFEHYIFATEHGLPNKFLSPEEALAFPYSEMDKLVLEQNKQRFVIGSSQEVAEFFHQQEELGLTEAMLITPGYDKQTRFQSFERLAKELL

SEQ ID NO: 42336 - DNA, 1017 bp, Streptomyces avermitilis MA-4680
  CDS (1)..(1017)
atggacgattcctatactgaccggatgatcaccgttccgctcagcgcgctcgaagtggccatggtccaagcgggcgcccgagccgcagacacgttacgagacaccaccgagttcgccctgcgcctcgaagacctcggctacctgcgactctggtacgccgagcatcaccattccccggccatcggagcgttcccgcccgtcgtcctgaccgcccacgcggccgcgttgacgtcgtccatccggctcggctccgggggcgttctcgctcccaaccacgctccgatcatgctggcggagcagttcggcacgctgtccgcactgcacgcgggccggatcgacctgggcatgggccgtgggccgggtaccttcgacgattccacggcgcgggccctgcgccgtggggccggtccgacaacggacgtcgagtaccgcgacgatgtgtcatcgactctgggtttcttggtggacgaggtcgcgctcggcccgctcccggagccatggctgctgtcctcgagcacggccggtgccgcgctcgctgcggaactcggactgccgatcgccttcgcccatcacattcgccctgacaacaccctggccgcgctcagccactaccgagagcgtttctccccctcccgttggtgcgagcgcccgcgcgtgctgatctgcgtggaaacggtatgcgccgagacgcaggaggaggcggcccggctcgccggtccgatggatgtcgtcaaggccggactcctcaaggggcgaggcgacatccccttccccacgcccgaagaggcggcgacccactcgttcaccgcggaagaggcgcaggcgctgacggccttccgtgcccaacaggcacacggctcacccgagaccgtggcgaagcacctgacggacctggtggacctgacgggtgcggacgaactcatgctggtgacgcccatctacgcgctggccgaccggttgaggtcgtacgagctcgtcaggcagcacgtcatgatgccgacggcgtcctggcaatga

SEQ ID NO: 42337 - protein, 338 aa, Streptomyces avermitilis MA-4680
MDDSYTDRMITVPLSALEVAMVQAGARAADTLRDTTEFALRLEDLGYLRLWYAEHHHSPAIGAFPPVVLTAHAAALTSSIRLGSGGVLAPNHAPIMLAEQFGTLSALHAGRIDLGMGRGPGTFDDSTARALRRGAGPTTDVEYRDDVSSTLGFLVDEVALGPLPEPWLLSSSTAGAALAAELGLPIAFAHHIRPDNTLAALSHYRERFSPSRWCERPRVLICVETVCAETQEEAARLAGPMDVVKAGLLKGRGDIPFPTPEEAATHSFTAEEAQALTAFRAQQAHGSPETVAKHLTDLVDLTGADELMLVTPIYALADRLRSYELVRQHVMMPTASWQ

SEQ ID NO: 42338 - DNA, 1008 bp, Streptomyces avermitilis MA-4680
  CDS (1)..(1008)
atgagctcagtgatcgcggcaacccgcttctccgtactcgaccgctcccgtacccgcgaagggcacgacggtgcggcggcgctgcgtgacacggtggggctcgcgcgggacctggagcgcctcggttaccaccggatctgggtctcggagcaccatggcgtgcccggagtcgccggttccgcgccgaccgtgctggccgcggccgtcgccgcggccacccgttccatccgggtgggcaccggcggggtgatgctgccgaaccaccaaccgctggtcgtggccgagcagttcggcgtactcgatgccctcttcccgggccgcgtcgacatggggctcggccggtccgtcggcttcaccgacggggtgcgcagggcgctgggccgggacaaggacgatgccgacgacttcgcggcgcagctcgacgagctcctcggctggttcctcggcacgtccccgaccggcgtgcacgcgcggcccgccgagggccggaccgtgccgcccttcgtgctggccatgggcgagggcgccacgatcgcggcccgcgccgggctgccgatggtgatcggcgacctcaggaaccgcgagaagatgcggcgcggcatcgaccactaccgcgagacgttccgcccctccccctgggcgcgggagccgtacgtcgtgatctccggcacgatcgcggtggccgacaccccgcagaacgcccgccgcctcctcgtccccgaagcctggtcgatggcgtactcacgcacgcacggcaccttcccgcccctgccgcccgccgagcgcgtcgagtccctgcggatgaccgccagggagcgcggcttctacgagtcgggcctcaccggtcacatcgccgggaccgaggaccaggtcgcccacgaactggagacggtgatcaaggagaccggcgcgcaggaggtgctggtcaccaccagcacgtacgaccgggacgcgctgctggactcctaccgggggctggcccggctcgcgggactgaccgccctctag

SEQ ID NO: 42339 - protein, 335 aa, Streptomyces avermitilis MA-4680
MSSVIAATRFSVLDRSRTREGHDGAAALRDTVGLARDLERLGYHRIWVSEHHGVPGVAGSAPTVLAAAVAAATRSIRVGTGGVMLPNHQPLVVAEQFGVLDALFPGRVDMGLGRSVGFTDGVRRALGRDKDDADDFAAQLDELLGWFLGTSPTGVHARPAEGRTVPPFVLAMGEGATIAARAGLPMVIGDLRNREKMRRGIDHYRETFRPSPWAREPYVVISGTIAVADTPQNARRLLVPEAWSMAYSRTHGTFPPLPPAERVESLRMTARERGFYESGLTGHIAGTEDQVAHELETVIKETGAQEVLVTTSTYDRDALLDSYRGLARLAGLTAL

SEQ ID NO: 42340 - DNA, 972 bp, Bordetella bronchiseptica RB50
  CDS (1)..(972)
atgaccgcgctttccgttctcgatctggtaatgatcggcgaagacaaggacctcgccaccgccatcgaagaatcccggcaacttgcccgccatgtagaccggcatggctacacgcgctactggatcgccgaacaccatgacatgcccggcatcggctcggccgcgacttccctcatcatcgaccagatcgccgccgccacctcgcgcatacgggtgggagcgggcggcatcatgttgcccaaccatgcgcccctggcgatagccgaacagttcggcaccctgaacgccctctatcccggccggatcgacctgggcatggggcgggccccgggcagcgccggcgccgcggtgcgcgcgctgcgccgcggcgcggccgagagcgacttcgccgccgatgtcacggaagtcatggactatctcgccaacaatggccgccagcctgcccgcggcgtgcccggacggcatgacgtaccggtgtggatcctgggttcgagcatgtacggcgcccagctggccgcggcgctgggcctgccctacgcattcgcctcgcatttcgcgccgcggttcctggaccaggccgtcgaccactatcgcaggaacttccgtccctccaggtggctcgcatccccgtacgtgatggtcggcgccaacatcttcgcggcggactcgaacgagcaggcggaatttctggccagttcccaccgccagtggatgctcgacctgcacatggggcgcctcgggctgctgccccgtcccgtgcacggctatgtcgaaggcctgcctgacaacgagcgccgggtgctcgacgaggtgctcgccatgaccgtcgccggcgacaaggcaaaggtcagggcttggatacacagcgtggtggaacggaccggcgccgacgagctgatgatagacagcaggatctacgatccgcacgaaagggccaggtcccacgagtacgtggcgcaggcattgcaatag

SEQ ID NO: 42341 - protein, 323 aa, Bordetella bronchiseptica RB50
MTALSVLDLVMIGEDKDLATAIEESRQLARHVDRHGYTRYWIAEHHDMPGIGSAATSLIIDQIAAATSRIRVGAGGIMLPNHAPLAIAEQFGTLNALYPGRIDLGMGRAPGSAGAAVRALRRGAAESDFAADVTEVMDYLANNGRQPARGVPGRHDVPVWILGSSMYGAQLAAALGLPYAFASHFAPRFLDQAVDHYRRNFRPSRWLASPYVMVGANIFAADSNEQAEFLASSHRQWMLDLHMGRLGLLPRPVHGYVEGLPDNERRVLDEVLAMTVAGDKAKVRAWIHSVVERTGADELMIDSRIYDPHERARSHEYVAQALQ

SEQ ID NO: 42342 - DNA, 1026 bp, Bordetella bronchiseptica RB50
  CDS (1)..(1026)
atgagtgtattggccagcgtgccgttctcggtcctcgaccttgcccccatcgtgcagggcggcacggccgcgcaggcgtttcgcaacaccgtcgacctggcgcgccacgtcgaaggctggggctatcgccgcttctggctggccgaacaccacaacatcaccggcgtggccagcagcgccacggcggtactgatcggccacgtcgccgcacataccagcacgctgcgggtgggctcgggcggcgtgatgctgcccaaccacgcgccgctcatcatcgccgagcagttcggcaccctggagagcctgtttcccggccgcatcgacctgggcctgggccgcgcgcccggcagcgacggggccacccagcaggcgctgcggcgcgggccgcgcagcggcctggactttcccgaactgctgcacgagctgcgcgcgtacctcgcgccggcgcggccgggccagccggtgcgcgcgattcccggcgccggcaccgacgtgcccatctggctgctgggctcgagcgatttcagcgcgcggctggccgccgagctgggcctgcccttctcgttcgcgggccacttctcgcccgaaggcatggccgccatgcgcctgtatcggcaactgttcaagccgtcgcagacgctggcgcgcccccatgccatgataggcgtgccggtggtggcggccgacaccgacgagcaggcgcatttcctgtccaccacccagcaactgaaattcctgtcgctgatccgcggcaaccgcctgccgctgcagccgcccgtggaaagcatggacggcatatggaacgagtgggagcgctccgcggtccaacagagactgggcgcggccatcgttggcggccccgatacggtcaagcgcgaactggagagcctggtcgcgcagacccaggccgacgaggtgatgatcgtttccgatttttacgacttttccgatcggctgcgttcgtacgagatcgtcgcctcgctcaagcaggacgcaggcgtatcgacccgcaccgcgaacgcctga

SEQ ID NO: 42343 - protein, 341 aa, Bordetella bronchiseptica RB50
MSVLASVPFSVLDLAPIVQGGTAAQAFRNTVDLARHVEGWGYRRFWLAEHHNITGVASSATAVLIGHVAAHTSTLRVGSGGVMLPNHAPLIIAEQFGTLESLFPGRIDLGLGRAPGSDGATQQALRRGPRSGLDFPELLHELRAYLAPARPGQPVRAIPGAGTDVPIWLLGSSDFSARLAAELGLPFSFAGHFSPEGMAAMRLYRQLFKPSQTLARPHAMIGVPVVAADTDEQAHFLSTTQQLKFLSLIRGNRLPLQPPVESMDGIWNEWERSAVQQRLGAAIVGGPDTVKRELESLVAQTQADEVMIVSDFYDFSDRLRSYEIVASLKQDAGVSTRTANA

SEQ ID NO: 42344 - DNA, 1032 bp, Chromobacterium violaceum ATCC 12472
  CDS (1)..(1032)
atgaccccttccccatccccgcgcctctccatgctggagctggcgcccatcgtcgccggcggcgacgccgcccaggcgctgcgcaacagcgcggccctggcccgccatgtcgagcaactgggctacacccgcttctgggtggccgagcaccacaatatggccggcgtggccagctccgccaccgcggtgctgatcggccacatcgccgcccacacccagcgcatacgcgtcggctccggcggcatcatgctgcccaaccacgcgccgctggtggtggccgagcagttcggcacgctggcgacgctgttccccggccgcatcgacctgggcctgggccgcgcgcccgggaccgatccgctcaccgcccgcgcgctgcgccgcgaccggctgggcgccggcgacgacttcccgcagcaggtcgccgagctgcgcggctacctggggccggaacaagctggccaagcggtgcgcgccattcccggaaccggcaccgacgtgccggtatggctgctgggctccagcctctacggcgcccagctggccgcgcagctgggcctgcccttcgccttcgccgcccacttcgccccggcccagctgcatcaggcgctgaaactgtaccgccagttgttccagccctcccctgcgctgagccagccgtacgcgatggcctgcatcccggtgctggccgcggacagcgaggagaaagcccagcgcctcgccaccacgccgtaccagaaattccttaacctgatccgcggcgaccgccgcccgctgccgccgccggtggacagcatggacggcctgtggagcccgcgcgaggaattcgccgtcctgggcgaatggctgggcgcggcggtgttcggcgggccggagacggtgcaggccgggctgcaaaagctgctggacgagaccggcgtggacgagatcatgctgtcggtcgactgccacgacttttccgaccggctgcgctgctgcgagatcgtcgccgacctgctgccgcggctgagcgcggccaagactgcgccggcctga

SEQ ID NO: 42345 - protein, 343 aa, Chromobacterium violaceum ATCC 12472
MTPSPSPRLSMLELAPIVAGGDAAQALRNSAALARHVEQLGYTRFWVAEHHNMAGVASSATAVLIGHIAAHTQRIRVGSGGIMLPNHAPLVVAEQFGTLATLFPGRIDLGLGRAPGTDPLTARALRRDRLGAGDDFPQQVAELRGYLGPEQAGQAVRAIPGTGTDVPVWLLGSSLYGAQLAAQLGLPFAFAAHFAPAQLHQALKLYRQLFQPSPALSQPYAMACIPVLAADSEEKAQRLATTPYQKFLNLIRGDRRPLPPPVDSMDGLWSPREEFAVLGEWLGAAVFGGPETVQAGLQKLLDETGVDEIMLSVDCHDFSDRLRCCEIVADLLPRLSAAKTAPA

SEQ ID NO: 42346 - DNA, 1017 bp, Rhodopseudomonas palustris CGA009
  CDS (1)..(1017)
atgttgccactctcgatcctcgatctgtccgtcgtcaccaccggcacaccgccggcggcgtcattgcgcaactcgatcgaccttgcgcgccacgcggattcgctgggctatgtgcgctactggctggccgagcatcacaatcttccctcggtcgccagtcccgcgcccgaaatcatgattgggcagatcgcggcggtgaccgaacgcattcgcgtcggctccggtggcgtgatgctgccgaaccacgcgccgctggtcgtggcggaacgcttcaagatgcttgaagcgctgttccccggtcggatcgatctcggtatcggccgcgcaccgggcaccgaccaggcgacgatgcacgcgttgcgccgccggctcgatggccgtgagggcgacgattttctggagcggctgcaagagctgacgctgtgggagacgcgcggctttccgccgggtcatccgtacaacaacgtcgtcgcgatgcccgacgatacgccgctgccgccgatctggctgctcggctccagcgactacagttccgagctcgccgcgcaggtcggtatgggcttcgcgttcgcgcaccacttcgcctcgcacgatgcggtcgaggcactgacgcattatcgcagtaacttccgtccgacgcgctggcggtcgacgccacacggtattttagccgtcgccgccgttgtcgccgccaccgatgaggacgcggagcggctggcgagttcgatggatctcagtcgcctgctacgcgaccgtggccgctacgtgccgctgccaagtgtcgaggaagctctgtcttattcgtacactgaagccgaccgtgcctcgatcgcgcgcaatcgctcgcggctgttcgtcggcagtccggcgacggttcggcaggcgctgcagccgctgattaccgcaagccgcgccgacgagctgatggtgatcaccgcggtgtatgaccacgatgcgcgcaagcgttcctacagcttgctggccgacgcgttcgagctgcagaaggtggcagcttag

SEQ ID NO: 42347 - protein, 338 aa, Rhodopseudomonas palustris CGA009
MLPLSILDLSVVTTGTPPAASLRNSIDLARHADSLGYVRYWLAEHHNLPSVASPAPEIMIGQIAAVTERIRVGSGGVMLPNHAPLVVAERFKMLEALFPGRIDLGIGRAPGTDQATMHALRRRLDGREGDDFLERLQELTLWETRGFPPGHPYNNVVAMPDDTPLPPIWLLGSSDYSSELAAQVGMGFAFAHHFASHDAVEALTHYRSNFRPTRWRSTPHGILAVAAVVAATDEDAERLASSMDLSRLLRDRGRYVPLPSVEEALSYSYTEADRASIARNRSRLFVGSPATVRQALQPLITASRADELMVITAVYDHDARKRSYSLLADAFELQKVAA

SEQ ID NO: 42348 - DNA, 1122 bp, Mycobacterium avium subsp. paratuberculosis str. k10
  CDS (1)..(1122)
atgaccgtgactccgctgtcgatcctggacctcgcgccgatcagcgcgggctgcgacgccgcgaccgcgctgcgcaacaccatcgacctggcccggcacgccgagcgctggggctatcaccggtactggctcgccgagcaccatttcgtggcggtggccagctccgcaccggtgacgctgatcggccaggtcgccgcggccacctcgcgcatccgggtcgggacggccgcggtgcagatcggccacaccaccgcggtcgccgtggtggagaacttcggcattctcgacgcgctgtatcccggccgaatcgacatggggctgggccgatccgggcagcgtcgcgccgaggcggccgcgtcgtcggccgcggcctcccggcccgaggcccggccgtggcggcagacggacgggctggtcatccccgcccccttcgaccagacggcgctgatgaaaagcgaacggatccgggcgcagtcgtcggtcctggccccgccgtgcgcacaacccgcggacttcggcgaacagatcgccgacatcgaggcgatgctggacggcagctatgccgtcaacggccatcggctgcaggtggtgccgggcgagcacgccgagctgacgccgtggatcttcggcagcacccgcggccagagcgccgaggtcgccggggcccgcgggcttccgttcgtcgcgagttaccacatcaccccgggcaccgcgctcgacgcaatcgaggcctaccgcaatgcttttcggccgtccgcccggctggcgcggccctacgtggtggtgtcggccgacgttgtggtcgccgaggacagcgccaccgcgcgccatctcgcgtccagctacggccactgggtgtattccatccgcagcggccagggcgcgatcccctacccggacccggacctgtgcgatccattgaccgaggagcagcgggcgctggtggccgaccgcaccgcaacacaattcgtcggcaaccccgacgaggtggccgaccggctcgaggtgctgcgccgggtcagcggtgccgacgagctggtgatcacctcggtgacgcatcggcacgccgaccggctgcgctcgcacgaactgatcgccaaacgctgggggctcaccggatga

SEQ ID NO: 42349 - protein, 373 aa, Mycobacterium avium subsp. paratuberculosis str. k10
MTVTPLSILDLAPISAGCDAATALRNTIDLARHAERWGYHRYWLAEHHFVAVASSAPVTLIGQVAAATSRIRVGTAAVQIGHTTAVAVVENFGILDALYPGRIDMGLGRSGQRRAEAAASSAAASRPEARPWRQTDGLVIPAPFDQTALMKSERIRAQSSVLAPPCAQPADFGEQIADIEAMLDGSYAVNGHRLQVVPGEHAELTPWIFGSTRGQSAEVAGARGLPFVASYHITPGTALDAIEAYRNAFRPSARLARPYVVVSADVVVAEDSATARHLASSYGHWVYSIRSGQGAIPYPDPDLCDPLTEEQRALVADRTATQFVGNPDEVADRLEVLRRVSGADELVITSVTHRHADRLRSHELIAKRWGLTG

SEQ ID NO: 42350 - DNA, 1032 bp, Mycobacterium avium subsp. paratuberculosis str. k10
  CDS (1)..(1032)
gtgcgtctttccgtcctcgatctcgtcccggtgcgcaccgaccagaccaccggcgacgcgctggccgccaccgtggcgctggcgcaggccgccgatcggctcggtttcacccgctactgggtggccgagcaccacaacatgccgtcggtgggcgccaccagcccgccggtgctgctcgcgtacctggccccgcagaccacccggctgcggctcggctcgggcggggtgatgctgccgaaccatgcgccgctggcggtggccgagcagttcgcgctgctggaggccgccgcgccgggccggatcgacctcggcatcggccgggcgcccggctccgatccggtcacctcgtacgcgctgcgcggcggccgcggcgacgaggacatccagcgcttccccgactacctcgacgacgtggcggcgttgatgagcgcgcgcggcgtggtggtgccgctgcgctcgggggactaccggctcagggccacccctgccgccgccggcgagccgcggctgtggctgctgggctcgtcgatgtactccgcgcacctggccgccgccaaggggttgccctacgtgttcgcccatcacttctccggcaagggaaccgaggaggcgctcgaggtctaccggtcgcggttccggcccagcgcgctgacgcccgagccgctcacctttttgacggtcaacgccgtagtggccgaaacccgggacgaggcaacggctttgatgctgcccaacctgcagatgatggcgaagcttcgcaccgggcagccgctcgggccggtgccgctggtcgaggaggccgagcacgccgagctcaccgccgagcagcggcgcatcgtggacagcgggctgcggcgcgcggtgttgggcggcccggccgaggccgccgagcaggttcgggcgctcgccgagcggttcggtgtcgacgaggtgatggtgaatccggtggcgtcggcccgccgcgggacggaccccgccaccgcgccggcccgggtcgcgacgctggagctgctggccaaggagctgttctga

SEQ ID NO: 42351 - protein, 343 aa, Mycobacterium avium subsp. paratuberculosis str. k10
MRLSVLDLVPVRTDQTTGDALAATVALAQAADRLGFTRYWVAEHHNMPSVGATSPPVLLAYLAPQTTRLRLGSGGVMLPNHAPLAVAEQFALLEAAAPGRIDLGIGRAPGSDPVTSYALRGGRGDEDIQRFPDYLDDVAALMSARGVVVPLRSGDYRLRATPAAAGEPRLWLLGSSMYSAHLAAAKGLPYVFAHHFSGKGTEEALEVYRSRFRPSALTPEPLTFLTVNAVVAETRDEATALMLPNLQMMAKLRTGQPLGPVPLVEEAEHAELTAEQRRIVDSGLRRAVLGGPAEAAEQVRALAERFGVDEVMVNPVASARRGTDPATAPARVATLELLAKELF

SEQ ID NO: 42352 - DNA, 1011 bp, Bdellovibrio bacteriovorus HD100
  CDS (1)..(1011)
atgtctgatactaaaaagctttctgaaattcagctctctgtcctggaccttgcgcccatcatcgacggtaaatccgtcgcggactcttttcacaacactctggatctggctcagcacacagaaaagtggggatacaaccgctattggctggccgaacatcacaacctggatggtatcgccagttctgcgacctctgtgctgattgggtatgtggcaggcgggaccaaaaccatccgcgtgggctctggcggcgtgatgctgccgaatcatgcgccgctggtcatcgccgaacagttcggcacgcttgcgcatttatacccgggtcgcattgacctggggttgggacgtgcccccggcacggatcgtctgaccatgcacgctttacggcgcgatatgcagggaaatgaaaacgacttcccggaaaatgtgcgcgagctgatcggatacttcgcaaaaagccatggacatgaacgtgtgcgcgccatcccggcaatgggaaccgaagttccggtgtggctgttagggtccagcctttacagtgctcaactggcggcagtcatggggcttccttattcctttgccgaccacttcgccccggaacaaatggaagaggcgattcatgtctaccgctcgggtttccaggcttcacggtatttaaagaaaccttatgtgatggtgggcttgcaggttgtcgccgccgacaccagtgaaaaagcccagcgcctggctaccaccttgtatctgcgatttttgggaattattcgcaatcagcgcgtgaatctgctgcccccagtaagcagtatggagcagatctggcgaccaggggaaaaagaaattgtcttaagcaaattaagcaacgccatcatcggcgacaaagacgaagtcaaagccggcctggagcgatttatccagcgcaccggggctgatgaggtgatgattttgtctgatatgtacgatcacgctgatcgcctgcgctcttttgaactgaccgctgaagtctggaaaagctag

SEQ ID NO: 42353 - protein, 336 aa, Bdellovibrio bacteriovorus HD100
MSDTKKLSEIQLSVLDLAPIIDGKSVADSFHNTLDLAQHTEKWGYNRYWLAEHHNLDGIASSATSVLIGYVAGGTKTIRVGSGGVMLPNHAPLVIAEQFGTLAHLYPGRIDLGLGRAPGTDRLTMHALRRDMQGNENDFPENVRELIGYFAKSHGHERVRAIPAMGTEVPVWLLGSSLYSAQLAAVMGLPYSFADHFAPEQMEEAIHVYRSGFQASRYLKKPYVMVGLQVVAADTSEKAQRLATTLYLRFLGIIRNQRVNLLPPVSSMEQIWRPGEKEIVLSKLSNAIIGDKDEVKAGLERFIQRTGADEVMILSDMYDHADRLRSFELTAEVWKS

SEQ ID NO: 42354 - DNA, 972 bp, Anopheles gambiae str. PEST
  CDS (1)..(972)
atgttgaaattaagcattttagatcagtcgccagtaattaagggaggcacagcagagcttgcgctcaggaatagtctggagcttgccaggatggcagatgtgtccggataccacagtatattatattccgagcatcacggagtaggagcttacggaagttccagtccggagttactaacagccatagtccttgcagaaacaaaaaagataaaagccggaacaggaggtattatgctgcggaattattctgcatttaaaattgccgaatggtccaaaatgcttgcaacaatgtttccgcatagatttatattgggtttgggaaaagctcccggaggattgaaagatgccgttttagcattaaataacaataaaccgcctgttcttaacgatctgaataaaaagcttgaagagataatagcctatattaaagggcaaaatcctgtatatgtagatttagtcgctcagccagaagagcctttagtcttgccagaaatactgtggttgggttcaggagttggttcagcaaaggaagctgcagctaaaggagtaggatattcaatggctggttttatttccgacaatgccggagaagatgcttataatgtgtatcatgaagaatttaataatgatggatatacagataaatcggtttttcaagttgcattatcagtttcagtagccgcagatacagaacaagcacggaaaaatgcctacggaatggtataccagtttgtacaatccagaaaattattagctccagataagcttatgccttatgctgaagtggaagcactggttgcaggaagtgatgatgaaagtttgttttactccttgctggataaagttgtcataggcactcccgatacaatatcatctcaattagacaagaaagcaattcagtataaaaccgacgatcttatgctgttatgcaatatgtttaatgaagaagatcgattgtttacttacaaatag

SEQ ID NO: 42355 - protein, 323 aa, Anopheles gambiae str. PEST
MLKLSILDQSPVIKGGTAELALRNSLELARMADVSGYHSILYSEHHGVGAYGSSSPELLTAIVLAETKKIKAGTGGIMLRNYSAFKIAEWSKMLATMFPHRFILGLGKAPGGLKDAVLALNNNKPPVLNDLNKKLEEIIAYIKGQNPVYVDLVAQPEEPLVLPEILWLGSGVGSAKEAAAKGVGYSMAGFISDNAGEDAYNVYHEEFNNDGYTDKSVFQVALSVSVAADTEQARKNAYGMVYQFVQSRKLLAPDKLMPYAEVEALVAGSDDESLFYSLLDKVVIGTPDTISSQLDKKAIQYKTDDLMLLCNMFNEEDRLFTYK

SEQ ID NO: 42356 - DNA, 1014 bp, Staphylococcus aureus subsp. aureus MRSA252
  CDS (1)..(1014)
atggcgattaaatattcagcattaaaccttgtccctattcgagaaggtgaagatgaacgaacagcaattaatgatatggttaagctcgcacaacatttagacgaattatcatatgaaagatattggattgctgaacaccataacgctcccaacctagtaagttcagcaactgctttattaattcaacatacgttagaacatacgaaacacatacgtgtaggttctggaggaatcatgttacctaaccatgctccattaatcgttgcggaacaatttggcacgatggcaacattatttccaaatcgtgtcgatttaggattaggacgtgcacctggaacagatatgatgaccgcaagtgcattaagacgagatcaacatgatggtgtttataaatttccggaagaagtttcattattacaacaatatttcggccccgctcaccaacaagcatatgttcgtgcttatccagcagtaggtaaaaatgtgcctttatatattcttggttcttcaacagattctgcacatttagctgctcgcaaagggcttccatatgtgttcgctggacattttgcacctcaacaaatgaaagaagctatcgaaatctacaaaacgttatttgaaccttctgatgtattagacgaaccttatgttattgtatgtttaaatacaatcgttgctgaaaatgatgacgaagcacaatatttagcttcatctatggcacaagtaatggttagtatcactcgtggcagaatgcagcccgttcaaccgccaacacatgaactgcaaaatatattaacgccgagagaatatgcgatggctatggaaagacagaaaatatcattaataggttcagaaaatactgttcaacaaaaaattcaagattttatggaaacttatggtgaagtcaacgaaattatggctataagttatatttatgataaagatatgcaattagactcttatcgtcgattcaaaaatgttataaatcagttaaatgaaaaaaacactttataa

SEQ ID NO: 42357 - protein, 337 aa, Staphylococcus aureus subsp. aureus MRSA252
MAIKYSALNLVPIREGEDERTAINDMVKLAQHLDELSYERYWIAEHHNAPNLVSSATALLIQHTLEHTKHIRVGSGGIMLPNHAPLIVAEQFGTMATLFPNRVDLGLGRAPGTDMMTASALRRDQHDGVYKFPEEVSLLQQYFGPAHQQAYVRAYPAVGKNVPLYILGSSTDSAHLAARKGLPYVFAGHFAPQQMKEAIEIYKTLFEPSDVLDEPYVIVCLNTIVAENDDEAQYLASSMAQVMVSITRGRMQPVQPPTHELQNILTPREYAMAMERQKISLIGSENTVQQKIQDFMETYGEVNEIMAISYIYDKDMQLDSYRRFKNVINQLNEKNTL

SEQ ID NO: 42358 - DNA, 1023 bp, Acinetobacter sp. ADP1
  CDS (1)..(1023)
atgagagtcaatatgtctgtggcaacgctcaaagatacgcacttttcaattcttgaactggcgcccgttcgtgatgatcaaacgattcaattttctttacatcatgccttagaacttgcaaaacatgcagaacaactggggtatcgacgcttgtggctggcagaacatcataatatggatggaattgcgagctccgctacggctgttttacttggatatcttgcggcaaatacccagcacctacgcttaggctctggcggagtcatgctaccaaatcatgcacctttagttgtggcagaacaatttggaacattagcaacgctctatcctcatcgaattgaacttggtttaggtcgcgcaccaggaacagatcaggtgaccatgcgagcactacgacgaggtcgacaagaaacagaggatcaatttccacaggacgtgttagaaatcttaaaatattttgatgatcctgagccacatcaaaagattgttgcaacaccaggtcatggaacacatgtgccagtgtggctcttaggttcgagtctattcagtgcacaactggctgccaaacttggacttccctattcatttgcttcacattttgcgccacgtatgctgtcccaggcagtacagctttaccgtgaaaattttcaagcttctaaatatttagagcagccttatgtatcgattggcgttcccactgtagtcgcaccaacagatgaagaagcacattttctagcgaccagcgcttatcaacgggtactggggttaatgcgtgggcaaagtctaaagttaaaaccacccgtaaaatccatggaacacatatggagtgcatctgaaaaactttcagtgaataacttttatgcgatggcgcaagttggttcacctgcgactgttaaagctggcctggaagatttacttgaacatgtaaaggttgatgaatttatttttacctgtgatatttatgatactcaaaaacgcttagaaaattttagttatttgatggatatcaagaacgcactttaa

SEQ ID NO: 42359 - protein, 340 aa, Acinetobacter sp. ADP1
MRVNMSVATLKDTHFSILELAPVRDDQTIQFSLHHALELAKHAEQLGYRRLWLAEHHNMDGIASSATAVLLGYLAANTQHLRLGSGGVMLPNHAPLVVAEQFGTLATLYPHRIELGLGRAPGTDQVTMRALRRGRQETEDQFPQDVLEILKYFDDPEPHQKIVATPGHGTHVPVWLLGSSLFSAQLAAKLGLPYSFASHFAPRMLSQAVQLYRENFQASKYLEQPYVSIGVPTVVAPTDEEAHFLATSAYQRVLGLMRGQSLKLKPPVKSMEHIWSASEKLSVNNFYAMAQVGSPATVKAGLEDLLEHVKVDEFIFTCDIYDTQKRLENFSYLMDIKNAL

SEQ ID NO: 42360 - DNA, 981 bp, Erwinia carotovora subsp. atroseptica SCRI1043
  CDS (1)..(981)
atgggatataagctcagtttattagatcaaagccctatcgccgaaggaatgagcgcggcgcaggcgttggcacaaaccgtgtcgttggcgaaagtggcggaagcgcttggctattaccgcttttgggtttccgaacatcataattccgatgagctggcggggtcgtctcccgaggtcttgatcacctggctgttggcgcatacgacaacgctgcgcattggctccggcggcgtgatgttacagcattacagcccgtataaagtcgcggagaatttccatgtcatcagcgcgttggcaggcggacgtgtagatttgggtatcggtaaagcgccgggcgggttgccacttgcgacacgggcgttacagcaggaaatcggtgaagcgcagcgggtcgccttcacggagaaattacatcagctcaatcgttttctcggtagcaatgacgatacggtcgatcgtctgaatgcgacaccgctgccggaacatgcgccacagcgctttctgctaggggccagtcaggatagtgcgagattagcggcatcgcttggctggaatttcgtgttcgctgggttcattaacgccagcgaaacgctgctggcagaatcactcttgagctatcgggaattgaagccagccagtgcacatacgttgctatcgctgtcggtgattgccgccgaacgtcatgaggatgcggaagcgctggccagcacgcagcataactataaggtttatattgaaaacaagccgccgctaacggttggaagtcaggaacaggcagaaaatttcgttcgacaggcaggcgtgacggatttccgtattgagcaggagccacgccatgtgctttacggtacgccggaagatattcatcagcgtctggagaactatcatcagcgctttggcgtagatgagttcattatccatacgcccgtgacatcaccccgtgagcgtgaggcgtctatccggctgttggcgcaacgctga

SEQ ID NO: 42361 - protein, 326 aa, Erwinia carotovora subsp. atroseptica SCRI1043
MGYKLSLLDQSPIAEGMSAAQALAQTVSLAKVAEALGYYRFWVSEHHNSDELAGSSPEVLITWLLAHTTTLRIGSGGVMLQHYSPYKVAENFHVISALAGGRVDLGIGKAPGGLPLATRALQQEIGEAQRVAFTEKLHQLNRFLGSNDDTVDRLNATPLPEHAPQRFLLGASQDSARLAASLGWNFVFAGFINASETLLAESLLSYRELKPASAHTLLSLSVIAAERHEDAEALASTQHNYKVYIENKPPLTVGSQEQAENFVRQAGVTDFRIEQEPRHVLYGTPEDIHQRLENYHQRFGVDEFIIHTPVTSPREREASIRLLAQR

SEQ ID NO: 42362 - DNA, 981 bp, Propionibacterium acnes KPA171202
  CDS (1)..(981)
ttgaaactgagcgccttggagcagattccgctgtttgtcggacatgacgtcacccaaacccttgacgagaccgtcaccttggcacaaaaacttgaggagatcggtttccaccggttctggttggccgagcaccacaacaccgaccacttcctgtcgagtgcgccagatctgctcatggcgcgcatcgcgacggcgacgcagtcgatccggcttgggtctggcggagtgatggccatgcactacgggtccctgcaaatggcggaacggttttcgaccctcacagcgttcttcggtgatcgtatcgacatggggctgggccgagctcccggcggtgacatgctctccgcccatgccctcaatcaggggcaggtcatccgccctgaggccattaattccctcatcgccgaaacggtagggttcgtgcgcgaaacgctgccgccgaagcatccgtacgcaaaggtcgtcgtgaccccggcaggtcagatccagccacagacgtggctgctgggatcgtcgggccagtcagcggcgtgggctggtgagcagggtatggactacgcctacgcccagtttttcaccgggcgccaggacaccgggatcatggatcactaccgcgcgcacctgtccgacggcttccccggcaggaccctctcggcagtgtgtgtatcggctgctccgacacgacaggaggccttggagcagtcgctcatggcggcgaacttccgggtgagtctggggacggggcggccggtaacctttgtcacggcctctcaaatggacgcagagacccgttcgctgctgacgagctacgtcctatcgaacgaggacacgattttcgttggggattacgacgaggtggccgacaaactcaccgccttccaggatgctcaccacgtcgacgagttgatgctcatcagttacatcgacaacgtgcagaccaaagtggagcggtaccgtcagctcgcaaagcggctgatctga

SEQ ID NO: 42363 - protein, 326 aa, Propionibacterium acnes KPA171202
MKLSALEQIPLFVGHDVTQTLDETVTLAQKLEEIGFHRFWLAEHHNTDHFLSSAPDLLMARIATATQSIRLGSGGVMAMHYGSLQMAERFSTLTAFFGDRIDMGLGRAPGGDMLSAHALNQGQVIRPEAINSLIAETVGFVRETLPPKHPYAKVVVTPAGQIQPQTWLLGSSGQSAAWAGEQGMDYAYAQFFTGRQDTGIMDHYRAHLSDGFPGRTLSAVCVSAAPTRQEALEQSLMAANFRVSLGTGRPVTFVTASQMDAETRSLLTSYVLSNEDTIFVGDYDEVADKLTAFQDAHHVDELMLISYIDNVQTKVERYRQLAKRLI

SEQ ID NO: 42364 - DNA, 1014 bp, Symbiobacterium thermophilum IAM 14863
  CDS (1)..(1014)
gtgcagggcatgaagctctcgattctggatctgtcgcccattccgtcagggtctaccgccagtcaggccctgcagaacaccctggagctcgcccagctggccgaccggctgggctacgagcgttactggctggcggagcatcacaacaccgccgccatcgccagcgtggcgccggagatcatgatcggccaggtggcccgggtcacccgtcgcatccgcgtcggcgcagggggcatcatgctgcccaaccatgcccccctgaaggtggccgaggccttcctcaccctggaggcgctgttccccggccggatcgacctgggcatcggccgggccccgggtacggaccccgtgaccgcccgcgccctgcggcggacggcctccctgggggcagaggacttccccgaacagctggccgacctgttccacttcgcccggggggacttcccggagggccaccccttccgcagcgtgcaggccacgccgccgggcgtgccgctgccgccggtctggctgctgggctccagcgattacagcgcccggctggccgcccggctggggctggctttcagctttgccgcccacttcagccccttcgacccggtgctgccgatgcggctgtaccgggcgcagttccgtccgtccgagcaccgggcggagccccacgcgattctggcggtcgcagccatctgcgccgacacccgggcggaggccgagcggctggcccgggccctggacctcttctggctgcagatccgccgcggggaacggcgaccgctgccgagcccggaggaggccgaggcctacccgtggacggcggaggagctggccgccgtgcaggagcaccggcgcttgctcttcctgggcgaacccgacgaggtcgccgccgggatccggtcgctggcgctggcgacccaggccgacgaggtcatggtggtttcccacatccacgaccaccggcagcggctgcgttcctacgaactgttggccgaggccttcgcgctggaccgtacctga

SEQ ID NO: 42365 - protein, 337 aa, Symbiobacterium thermophilum IAM 14863
MQGMKLSILDLSPIPSGSTASQALQNTLELAQLADRLGYERYWLAEHHNTAAIASVAPEIMIGQVARVTRRIRVGAGGIMLPNHAPLKVAEAFLTLEALFPGRIDLGIGRAPGTDPVTARALRRTASLGAEDFPEQLADLFHFARGDFPEGHPFRSVQATPPGVPLPPVWLLGSSDYSARLAARLGLAFSFAAHFSPFDPVLPMRLYRAQFRPSEHRAEPHAILAVAAICADTRAEAERLARALDLFWLQIRRGERRPLPSPEEAEAYPWTAEELAAVQEHRRLLFLGEPDEVAAGIRSLALATQADEVMVVSHIHDHRQRLRSYELLAEAFALDRT

SEQ ID NO: 42366 - DNA, 993 bp, Bacillus licheniformis ATCC 14580
  CDS (1)..(993)
ttgatgcagctcagcattcttgaccaggttcctatatcaaaaggctcggatgcgcattcagctctaaagcattctgcagagctggcggaacttgcggatcaatgggggtacaaaaggtattggtttgccgagcatcacagcacacgggggcttgccagcaccgctccagaaatcatgatcgcacacattgcggcaaagacggcgaatattcgcgtcggttcgggcggcgttctgctgccccaatacagtccctttaaagtggctgaaaactttcggcagcttgaagccctttatcccgggagaattgacctggggatcggccgctctccgggaggcacaactaaaacgaggctggcgctgacagacggggttcataaaagcctgcacgaattcccgagacagttacaagacttggttagctttctgactgattccgtgccttccggacatgattacttcggaattaaagcctcccctttgacggattcgcccccggaggtgtggcttttaggcctgggagaaaacagcgcaaaattggccggtagcatgggagcgggatacgtattcggccatttcatctctcccgcgagaggaaagaacgcctttcaatcataccgtgaaagctttcggccttcccctttctttaaacgcccccaatcattggccgccgttttcgtcgtttgtgcggagtccgatgaaaaagccgaggagctctgcttgagccaagatttatggcttctccgggttgaaaaagggctggacagccttgtcccaagcattgaagaggcgaaatcggccgcttacacagctgccgataaaaagaagcttgcccaaaaccgcagccgtatggtgatcgggtctcctcaaacagtcaaaagaaaactgctcgagctttctgaacgatatcaaacagatgagtttatgattttaactaacgtctaccggtttgaagataagaagcagtcttacgaaagactggcagaattattttga

SEQ ID NO: 42367 - protein, 330 aa, Bacillus licheniformis ATCC 14580
MMQLSILDQVPISKGSDAHSALKHSAELAELADQWGYKRYWFAEHHSTRGLASTAPEIMIAHIAAKTANIRVGSGGVLLPQYSPFKVAENFRQLEALYPGRIDLGIGRSPGGTTKTRLALTDGVHKSLHEFPRQLQDLVSFLTDSVPSGHDYFGIKASPLTDSPPEVWLLGLGENSAKLAGSMGAGYVFGHFISPARGKNAFQSYRESFRPSPFFKRPQSLAAVFVVCAESDEKAEELCLSQDLWLLRVEKGLDSLVPSIEEAKSAAYTAADKKKLAQNRSRMVIGSPQTVKRKLLELSERYQTDEFMILTNVYRFEDKKQSYERLAELF

SEQ ID NO: 42368 - DNA, 1038 bp, Mannheimia succiniciproducens MBEL55E
  CDS (1)..(1038)
atgaaactatccattctcaacttagtccccgttcgtgaagggcaaaattatcaacaggcaatggcgtcaatggtgacccttgcgcaatatgcggagcaaatcggtatcgaacgttactggattgccgaacatcacaacaccaaaaatcttgccagttccgccaccgctttactgattcagcatacgctggcgcataccgaaaccttgcgggtcggttccggcggggtgatgttgccaaatcacagcccctatattgtggcggaacagtacggcacgctggaaactctttatccgaaccgcgtagagcttggcttagggcgcgcacccggtacggatatgcgcactgcttatgcactgcgtaaagggcgtgaacattcagatttcccgacggaaattgccgaattgcgcggatactttgaaaatacgaatccggtatcagcctatcctgcggcgggcttgaaggtgccgttttatattctcggttccagcaccgaaagcgcttatttggcggccgaactgggtttgccttatgcttttgcctcgcattttgctcctagaatgatggaaatggcggtagaaatttatcgcaaacaattcaagccctcaccacatttagcggcaccttatgtgatattaggggtgaacgcgattgtcgcgcaaaccgatgagcaagctcggcaattagccacaactcaaacccaatttttcttaaatgtggtcaccaacgcccagcaaaacctgcaaccgccgttggcttccgccgatgatgtgtggaaacggcacctgagcgcacaattcccgccgcatttcggcccggtagattttcaagaaatcccgctgtataaccaagaacgcgccgtggtcgaacagatgactgcctgttctctgattggcagctctgcaagtgtgacacatcaactgaatactttacgcgatcaagtccactttgatgaaatcatggcggttagctatatttttgacgaacagctacaacggctgtcttataagatgttgaaagagattgtggataagatataa

SEQ ID NO: 42369 - protein, 345 aa, Mannheimia succiniciproducens MBEL55E
MKLSILNLVPVREGQNYQQAMASMVTLAQYAEQIGIERYWIAEHHNTKNLASSATALLIQHTLAHTETLRVGSGGVMLPNHSPYIVAEQYGTLETLYPNRVELGLGRAPGTDMRTAYALRKGREHSDFPTEIAELRGYFENTNPVSAYPAAGLKVPFYILGSSTESAYLAAELGLPYAFASHFAPRMMEMAVEIYRKQFKPSPHLAAPYVILGVNAIVAQTDEQARQLATTQTQFFLNVVTNAQQNLQPPLASADDVWKRHLSAQFPPHFGPVDFQEIPLYNQERAVVEQMTACSLIGSSASVTHQLNTLRDQVHFDEIMAVSYIFDEQLQRLSYKMLKEIVDKI

SEQ ID NO: 42370 - DNA, 1008 bp, Bacillus licheniformis ATCC 14580
  CDS (1)..(1008)
atgttgtcattaagcatactggatcagactcctgtttctgaaggaagcaaacctgaactggctttgcagcatacggtggagcttgcgcaagcggcggagcggctcggatacaagaggttttgggtttctgagcaccatttttccaggaacttggcagggtcaagtccggaggttctgatcggttatcttgcggctaaaacagagaagatccgtataggatccggcggcgtcatgcttccgcattacagcgcctacaaggtggcggaaaacttccgcgtcttggaaggactagcgcccggcaggattgatctaggtgtcggacgtgctccgggagggatgccgatcgcttcaatggcccttcaaaatggaggaagacggatggctgaccaatatccagaacaaattcaggacctcgtcacatatttatacgatcaagccgatgaacatcaccgctttcccaacttgaccgcaacgccgaacatcgccacagcgcccgctgtttggctgctcggctcctcaggggaaagcgcaaggcttgccgcccaaacaggggcatcatatacatttgctcaatttattaacggtgaaggcggagaagaggcggccagactgtacaaagagaggttcgaaccttctgtattaggggaacagccaaatgtgatcgttgccgtatttgtgatttgcgctgagacagaagagaaagcggagaaccttgccaaaagcttggatttttctttattggccaatgaacaggggatggtgaccgaaggctttccatcattggaaacggccctgtcctatcaatattctccttatgaaagaaagagagtggaagacaatcgaaaacggatggtcatcggaacgccgcagcaggtaaaggaacagctgcttgaactggccggcgcttacggaacggacgaaatcatggcggtgacgatcacccacgattttcaagacagattggattcataccggctgctggccgaagcgtttcatcagtcaatttag

SEQ ID NO: 42371 - protein, 335 aa, Bacillus licheniformis ATCC 14580
MLSLSILDQTPVSEGSKPELALQHTVELAQAAERLGYKRFWVSEHHFSRNLAGSSPEVLIGYLAAKTEKIRIGSGGVMLPHYSAYKVAENFRVLEGLAPGRIDLGVGRAPGGMPIASMALQNGGRRMADQYPEQIQDLVTYLYDQADEHHRFPNLTATPNIATAPAVWLLGSSGESARLAAQTGASYTFAQFINGEGGEEAARLYKERFEPSVLGEQPNVIVAVFVICAETEEKAENLAKSLDFSLLANEQGMVTEGFPSLETALSYQYSPYERKRVEDNRKRMVIGTPQQVKEQLLELAGAYGTDEIMAVTITHDFQDRLDSYRLLAEAFHQSI

SEQ ID NO: 42372 - DNA, 1002 bp, Burkholderia mallei ATCC 23344
  CDS (1)..(1002)
atgtcttattcgttatcgctgctggacaagagcccaatcgccgaaggcgcgacggcggccgacgcgctgcgcttcacggtcgcgctcgcgcagcgcgccgaggcgctcggctatcgccgcttctggatcgccgagcatcatggcgcgccggggctcgcgagctccgcgcccgagatcgtcgtgtcgcatgtgctcgcgcatacgtcgtcgatccgcgtcggctcgggcggcgtgatgcttcagcactacagcccgttcaaggtcgccgagacgttcaagctgctcgcgtcgctcgcgcccgggcgcgtcgatctcggcgtcggcaaggcgccgggcggcctgccgctcacgacgcgcgcgctgcaatcgctgcacgacaagccgcgccggcccgcgtttgccgagcagctcgccgagctcgacgcgttcctgaactggggcgtcgccgaggatcatccgctcgccggcgcgctcgcgctgccggtgccgcccgaggcgccggagcgcgtgctgctcggcggctcgcccgagagcgccgcgctcgccgcgcggctcggctggcagttctgctatgccgggcacttcaacggcgacgaggcgaacgtcgagcgctcgctcgacgcctaccgcagcgcgacggggcgcgcgccgctgctcgcgctgtacgcggtggccgcgccgacgaagggcgacgccgagcggctgatcggcgcgctgcggatcttcaagctgaagctcgcgagcggccagagcgtcaatctcggcagcgcgcaggcggcggccgagttcgcgcgccagagcggggcgaccgactatcggatcgacgaactgcgtccgcacgtgatcgccggcgcgccggacgacgtgcaccgcgagctcgacgcgctgtcgcgccgctacgggctcgccgagttcgtcgtcgattcgcccgtcacgcactatccggcgcggctcgcgtccgtcgagctgctcgcgccgcagcgacagcctgcgggaacctga

SEQ ID NO: 42373 - protein, 333 aa, Burkholderia mallei ATCC 23344
MSYSLSLLDKSPIAEGATAADALRFTVALAQRAEALGYRRFWIAEHHGAPGLASSAPEIVVSHVLAHTSSIRVGSGGVMLQHYSPFKVAETFKLLASLAPGRVDLGVGKAPGGLPLTTRALQSLHDKPRRPAFAEQLAELDAFLNWGVAEDHPLAGALALPVPPEAPERVLLGGSPESAALAARLGWQFCYAGHFNGDEANVERSLDAYRSATGRAPLLALYAVAAPTKGDAERLIGALRIFKLKLASGQSVNLGSAQAAAEFARQSGATDYRIDELRPHVIAGAPDDVHRELDALSRRYGLAEFVVDSPVTHYPARLASVELLAPQRQPAGT

SEQ ID NO: 42374 - DNA, 1059 bp, Burkholderia pseudomallei K96243
  CDS (1)..(1059)
atgcgccggcccgcgttccgtccccatgccaaccgttccgtcgtcgccatgatcccgttttccgttctcgacctcgcgccgattcccgccggcgccgacgccgcccaggcgttgcgccattccgtcgacctcgcgcggcacgccgagcgcctcggctatcgccgctactggctcgccgagcaccacaacatgcccggcatcgcgagcgcggcgaccgcggtcgtgatcggccacgtcgcgggcgcgacgcggacgattcgcgtcggctcgggcggcgtgatgctgccgaaccatgcgccgctcgtgatcgccgagcagttcggcacgctcgcgtcgctgtacccgggccgcatcgatctcggtctcgggcgcgcgcccggcaccgatcagacgacggcccgcgcgctgcgccgcgacctgatcggcagcgccgattcgttccccgacgacgtggtggagttgcagcgctacttcgccgcacccgccgccggccagcgcgtgcgcgccgtgccgggcgcggggctcgacgtgccgatctggctgctcggctcgagcctgttcagcgcgcagctcgccgcgatgctcgggctgccgttcgcgttcgcttcgcatttcgcgccggactacctgatgcgcgcgctcgacgtgtaccgcgcgcagttccggccgtccgccgcgctcgacaagccgtatgcgatggtcggcgtgaacgtgttcgccgccgacaccgacgacgacgcgcgacgcctgttcacgtcgctgcagcagcagttcctgaagctgcggcgcggcacgcccggccaactgccgccgcccgtcgaatcgctcgacgcgctcggcgcgaccgagcaggaactcgcgaacgtcgcgcatgcactgtcgttcgccgcggtcggctcgcgcgacaccgtgcacgagcggctgcggcggttgatcgcgcagacgggcgcggacgagctgatcgtcgccgcgcaaatcttcgatcacggcgcacgggtgcgctcgtacgagatcgccgcgcaggtgcgcgacgcgcttcgcgacgaagccggggtttga

SEQ ID NO: 42375 - protein, 352 aa, Burkholderia pseudomallei K96243
MRRPAFRPHANRSVVAMIPFSVLDLAPIPAGADAAQALRHSVDLARHAERLGYRRYWLAEHHNMPGIASAATAVVIGHVAGATRTIRVGSGGVMLPNHAPLVIAEQFGTLASLYPGRIDLGLGRAPGTDQTTARALRRDLIGSADSFPDDVVELQRYFAAPAAGQRVRAVPGAGLDVPIWLLGSSLFSAQLAAMLGLPFAFASHFAPDYLMRALDVYRAQFRPSAALDKPYAMVGVNVFAADTDDDARRLFTSLQQQFLKLRRGTPGQLPPPVESLDALGATEQELANVAHALSFAAVGSRDTVHERLRRLIAQTGADELIVAAQIFDHGARVRSYEIAAQVRDALRDEAGV

SEQ ID NO: 42376 - DNA, 1185 bp, Nocardia farcinica IFM 10152
  CDS (1)..(1185)
atgagcgtgccgctgtcggttctcgacctcgccccggtgagcgcgggctcctccccgcgtcaggcgttgcgcaacaccgtcgagctggcgcgcaaggccgaggagtggggttatcaccggtactggctggccgaacaccatttcgtcgccgtggccagcgccagcccgatcacgctgatcgcgctggtggccgcggccacctcccggatccgggtgggttcgggagcggtgcagctcggacaccacacctcggcgtcgatcgtggagggcttcggcaccgtcgacgcgctgcacccggggcggctggacctgggcatcggccggtccgggcaccggcgcgcccagttcggcgcggaggcgggcgcgcccaagggcgcgcacccggtcgacgacgccgccaccggccgcaccacggtccgtgacggcgtggtggtgccgccgcccttcgatccacgcggactcggcgaccgccgccgctacctggccgggttggccgccctgcacctgccaggcgccgaaccgctcgatttcgccgagcaggtcgccgagatccgggcgttgctggacggcacctacgtcaccgccgacggtgtgccgctgcacgcggtgcccggcgagggcgcgcgggtgcaactgtgggtgttcggcagcagcggtggcgagagcgcggaactcgcgggcaggctcggcctgccgttcgcggcggcctaccacaccgcacccggcacggcgctggaggcggtggccgcctatcgggccgccttccgcccgtcggtgcagctggccgagccgtacgtggtggtctcggccgatgtcgtggtcgccgaggacgacgccgccgcccggcatctggcctcgacgtacggccactgggtgcacagcattcgcgcgggcggcggcgcggccgagatcctggatcccgacaccgccgcgccgctcacccccgatcagcgcaggctggtcgaggaccggctggccacccagttcgtcggcagcccggccacggtggtggaacggctcggcgcgttgcagcgggccaccggcgcgaacgaactgctcgtcaccagcgtcacctacgaccacgccgcccgcctggcttcgcaccggctgctcgccgaggcgtggggactactacccgccgcccgcgacggtcacgcccggacgggggcggcggtgactccgtag

SEQ ID NO: 42377 - protein, 394 aa, Nocardia farcinica IFM 10152
MSVPLSVLDLAPVSAGSSPRQALRNTVELARKAEEWGYHRYWLAEHHFVAVASASPITLIALVAAATSRIRVGSGAVQLGHHTSASIVEGFGTVDALHPGRLDLGIGRSGHRRAQFGAEAGAPKGAHPVDDAATGRTTVRDGVVVPPPFDPRGLGDRRRYLAGLAALHLPGAEPLDFAEQVAEIRALLDGTYVTADGVPLHAVPGEGARVQLWVFGSSGGESAELAGRLGLPFAAAYHTAPGTALEAVAAYRAAFRPSVQLAEPYVVVSADVVVAEDDAAARHLASTYGHWVHSIRAGGGAAEILDPDTAAPLTPDQRRLVEDRLATQFVGSPATVVERLGALQRATGANELLVTSVTYDHAARLASHRLLAEAWGLLPAARDGHARTGAAVTP

SEQ ID NO: 42378 - DNA, 1032 bp, Nocardia farcinica IFM 10152
  CDS (1)..(1032)
atgaccagcgcgacaccgaccggcaccgtccgattctcgatcctggatcgatcgcgggtgcgccgcggccagccgcatccggccgcgttgcgcgagacggtcgagttcgcccggctcgcggagcggtgggggtaccaccggttctgggtgtccgagcaccacagcgtgcctggcgtggccgggtcggcgccgacggtgctcgccgccgccgtcgccgccgcgaccgagcgcatccgggtcggcaccggcggggtgatgctgcccaaccaccagccgctggtcgtggccgaacagttcggggtgctcgaatcgctgtatccggggcgcatcgacatgggcctgggccggtcggtcggcttcaccgaggcagtgcgccgggcgctggcccacggcgagagcgacgcggccgacttcgacgcccggctcaccgaggtgctggactatctggcgcgcgggcgcgcgggcgtgcacgcgtggcccgcggagggcctgtccgttcccgcgtttctgctggccaccggttccggtgcggcgcgggccgcccggttcgggttgccgctggtgatcgcgccggtcggcggcttcgaccggatggccgaggcgatcgcccgctatcgcgccgacttcacccgcaccccgtggggcgagcagccctacgtcatggtctccacgacggtgatgatcgcggacacgaccgagcaggcacatcgattgctgtggccggaagcgtggtcgaacgcctattcccggaccaaaggcgaattcccgccgctgcccgatcccgccaccatcgatccggcggcactcgcgccccgcgagcgggcgtatttcgacgaagcgctgcgcgatcagatccacggcaccgaagacgaggtcgccgaagcactcgagcagttgctcgccgccacctccgccgacgaggtcctggtgcacaccagcacattcgaccgggcggcccggctggagtcgcatcggcgactggcgctgctcaccggcctgaccgcgcgggcacaggcatatcccgccgcctga

SEQ ID NO: 42379 - protein, 343 aa, Nocardia farcinica IFM 10152
MTSATPTGTVRFSILDRSRVRRGQPHPAALRETVEFARLAERWGYHRFWVSEHHSVPGVAGSAPTVLAAAVAAATERIRVGTGGVMLPNHQPLVVAEQFGVLESLYPGRIDMGLGRSVGFTEAVRRALAHGESDAADFDARLTEVLDYLARGRAGVHAWPAEGLSVPAFLLATGSGAARAARFGLPLVIAPVGGFDRMAEAIARYRADFTRTPWGEQPYVMVSTTVMIADTTEQAHRLLWPEAWSNAYSRTKGEFPPLPDPATIDPAALAPRERAYFDEALRDQIHGTEDEVAEALEQLLAATSADEVLVHTSTFDRAARLESHRRLALLTGLTARAQAYPAA

SEQ ID NO: 42380 - DNA, 993 bp, Nocardia farcinica IFM 10152
  CDS (1)..(993)
atgatcgacgtcccactgtccgtgctcgatctcgcgccggtgcaggagggcgccgacccgggtgccgcgctcgccgcgaccaccgagctggcccgccgcaccgaggagctgggctaccggcggttctgggtggccgagcaccacaacatgcccggcatcgccagctcggcgcccgcggtcctgatcgcgcacgtggccgccgccaccagccgcatccgcgtcggttccggtggggtcatgctgcccaaccacgcgccgctggtggtcgccgaacagttcggcacgctgcacgcactgcatcccgggcgcatcgacctgggcatcggccgcgcccccggcaccgaccaggccaccgcccgggcgctgcgccgcaccgaggcgggcctgtcggcggagaacttcccccaggaactggccgacctgctgcgctacttccgcggcaccggtcccggcggcatcgccgcgacgcccggccggggcgaggaacccgagatctggttgctcggctccagcggctacagcgcgcaggtcgccgccgtgctcggcctgcgtttcgcgttcgcccaccacatcaatccggccgccaccgaggccgcactcgccctgtaccgcaccgaattccgtccgtccgcgcagctcgaggcgccctacgcgatggtcgcggcggcggcgctgtgcgccgacaccgacgagcgggccgaggaactggctcgcccgcgcgacctggccttcctgcagctggccgcgggcaggccgcgcgagctgcccacccccgagcaggccgcggccttccagccgagcgagggcgaacgccagttcatcgaacagcgccgcgccggacaggcgctcggctcgccggagaccgtgcacgcccagctcaccgacctgctgcaccgtaccgaggccgacgaactgatgatcaacacgctcgtctacgacatcgacgaccgcacccgctccttcgaactcatccgcaagctcgcccagggctga

SEQ ID NO: 42381 - protein, 330 aa, Nocardia farcinica IFM 10152
MIDVPLSVLDLAPVQEGADPGAALAATTELARRTEELGYRRFWVAEHHNMPGIASSAPAVLIAHVAAATSRIRVGSGGVMLPNHAPLVVAEQFGTLHALHPGRIDLGIGRAPGTDQATARALRRTEAGLSAENFPQELADLLRYFRGTGPGGIAATPGRGEEPEIWLLGSSGYSAQVAAVLGLRFAFAHHINPAATEAALALYRTEFRPSAQLEAPYAMVAAAALCADTDERAEELARPRDLAFLQLAAGRPRELPTPEQAAAFQPSEGERQFIEQRRAGQALGSPETVHAQLTDLLHRTEADELMINTLVYDIDDRTRSFELIRKLAQG

SEQ ID NO: 42382 - DNA, 1029 bp, Haloarcula marismortui ATCC 43049
  CDS (1)..(1029)
atggacctctcaatcgttgacctctctccggtcccgaatgacggaactgcgactgacgcgtatgcgaacaccgtcgacgcagcccagcaggccgaacgcctcggctattcccggttctgggtggcggaacaccacgggatgggggataagctcgcaggaacaacacccgaggtactgctcggcagcctcgccgccgaaaccgactcaatccgcctcggatcgggagcggtcctgctcaatcactacagtccgttcaaggtcgcagaactgttcggttcgctcgacgcgctcgcgccgggacgcatcgacgcggggcttgggcgggccaacggctctccggccgtcgaccgggcactcgggacgaaccgacgtgtccggaaccccgacgaagaccacgccgaaaaaatcgaagccgtcgtttcgcacctctacgacggctacccggatggacacgcgtacagtgatcttgaaatcccccggtcaggtggggagccaccagtcccgtgggttctcgggtcaagtccgtcgagcgccgcgctggccggcgagcttggtctgcgctactgtttcgccgcgttcatccgaccggggttagccacccgttccttcgaggaataccgaacccacttcgaaccctcgcagttggccggcggcgtcgacgagccacagggaatggtcgcggtaaacgcggtctgtgccgaaaccgacgaggaagcggcgcggctccgcgccgtggcggaagcgtcattcaagcggatggaacgcggggttgtcggcacgacaccatctgtcgaggaagcaatcgacgagctcggggctgtgcccgaaccgacgcctgccacgctggatgccggtgagtggccgcgggcgatttccggcagtccagagacactcagcgacatactcgaacaactgtctgaccgtgttggcgtcgatgaggtgatgattcagcacgtcgtcggcaaccacgctgacgcactccgctcccacgagttgctcgcagatggtgtcggcctcacaccacgctaa

SEQ ID NO: 42383 - protein, 342 aa, Haloarcula marismortui ATCC 43049
MDLSIVDLSPVPNDGTATDAYANTVDAAQQAERLGYSRFWVAEHHGMGDKLAGTTPEVLLGSLAAETDSIRLGSGAVLLNHYSPFKVAELFGSLDALAPGRIDAGLGRANGSPAVDRALGTNRRVRNPDEDHAEKIEAVVSHLYDGYPDGHAYSDLEIPRSGGEPPVPWVLGSSPSSAALAGELGLRYCFAAFIRPGLATRSFEEYRTHFEPSQLAGGVDEPQGMVAVNAVCAETDEEAARLRAVAEASFKRMERGVVGTTPSVEEAIDELGAVPEPTPATLDAGEWPRAISGSPETLSDILEQLSDRVGVDEVMIQHVVGNHADALRSHELLADGVGLTPR

SEQ ID NO: 42384 - DNA, 1011 bp, Geobacillus kaustophilus HTA426
  CDS (1)..(1011)
atgatcatgccgctaaagctcagcgttcttgatcaatcgcccatcgccgaaggcatgaccgcggaagaagcgcttgaaaacacggtccggctcgcccagtttgtcgaagagctcggctacaagcgtttttgggtgtccgaacaccacgacgcgaacagcctcgccggctcgtctccagaagtgctgcttggacacatcggggcgaaaacgtcgcgcattcgcatcggctcaggcggagtgatgctgccgcactacagcgcctataaagtggcagaaaacttccgcgtgttggcgggtctagcccccggccgcgtcgatctcggcatcggccgcgcgcctggcggcatgccgcgggcgacgatggcgctccaagacggccggccgcgttcagcggaccgctatcgggagcaaatcgatgacttgcttgggtatttgcacgatgcgcttccgcccgtccacccgctttatggcgtcaaggcgacgccgattgtgcaatcgcctccagacgtttggctgctcggatccagttcggaaacagcgaagctggcggcggaaaaagggctgccgtacgccttcgcgcaatttattaacggcgaaggcggccaagagtacatgcaactgtatcgcgaccggtttaccccatcgccgcatttggacgagccgcgtacactcgtggctgtatttgcgatttgcgccgaaacggatgaaaaagcggaatggatcgcgggaagccttgacttgacgctcctcatgatcgaacaagggatggccgtcaacggcacgccgagtccggaaaaagcagccgcctacccatacagcccgtatgaacgcaaacggatcgcagacaatcggaagcggatgatcgtcggcagtccggcgcgcgtcaaagacgagctgtatcggctgagcgaaaagtatgaaacagaggaaatcatgctcgtgacgattacatacgacttcgaggataaactcgcgagtttccggctcatcgccgacgctgtatgggggtga

SEQ ID NO: 42385 - protein, 336 aa, Geobacillus kaustophilus HTA426
MIMPLKLSVLDQSPIAEGMTAEEALENTVRLAQFVEELGYKRFWVSEHHDANSLAGSSPEVLLGHIGAKTSRIRIGSGGVMLPHYSAYKVAENFRVLAGLAPGRVDLGIGRAPGGMPRATMALQDGRPRSADRYREQIDDLLGYLHDALPPVHPLYGVKATPIVQSPPDVWLLGSSSETAKLAAEKGLPYAFAQFINGEGGQEYMQLYRDRFTPSPHLDEPRTLVAVFAICAETDEKAEWIAGSLDLTLLMIEQGMAVNGTPSPEKAAAYPYSPYERKRIADNRKRMIVGSPARVKDELYRLSEKYETEEIMLVTITYDFEDKLASFRLIADAVWG

SEQ ID NO: 42386 - DNA, 984 bp, Idiomarina loihiensis L2TR
  CDS (1)..(984)
atgaaatactcagttcttgatttagcgcccattaccgaaggtgggtctgtggctgaatcattgcataactcggctgatttggcccagcatgcagagcggtggggttaccaccgcttctggatggctgaacatcacaatatgaccggaattgcctcggccgcaaccgcggttgctttaggttatgtcgccggtaaaactgacaaaattcgagtgggctcaggcggtgttatgttaccaaaccacgcgccttttgtggtcgctgagcagtttggtacgctggatgccctgtaccccggacgtattgatattggtctgggcagagcaccgggaacagacggccgaactttacgcgcgttaagacgtaaaccagatgatgcggaacagtttcctaacgatgttcaggagcttttaggttatctggaagaagcgcaggaaagcgacccaattaaagcggtgcccgggtttggacagaaaattccggtgtggttgctcggctcaagcacttttggcgctcagcttgctgcacacttaggcctgccttatgcctttgcttcgcattttgcaccagactatttgcagcatgcgttaaaagcgtatcgcgagaactttcgtccgtcgcgttacctcagcaagccttatgttgctgcggcaatgaacgtttttgcggcagacagcgaaaccgatgcgcgaaaaatgatgagttcaatgcaacaacagtttattgcgttgcggcgcggtacacccgggcctttaaaagcaccggtggatgacataagaacggttgctgcgcctcatgaactggccggggcgaatcatgcattaacctatacggcggttggtactaaggattcagttcaacggcatattaatcagtttattgatgataccggtatagatgaagttattcttacttgtcatgcctttgatcatcaggctcgtttaaggtcgttcgaaattgccgcggaagctttaaacggaaagtga

SEQ ID NO: 42387 - protein, 327 aa, Idiomarina loihiensis L2TR
MKYSVLDLAPITEGGSVAESLHNSADLAQHAERWGYHRFWMAEHHNMTGIASAATAVALGYVAGKTDKIRVGSGGVMLPNHAPFVVAEQFGTLDALYPGRIDIGLGRAPGTDGRTLRALRRKPDDAEQFPNDVQELLGYLEEAQESDPIKAVPGFGQKIPVWLLGSSTFGAQLAAHLGLPYAFASHFAPDYLQHALKAYRENFRPSRYLSKPYVAAAMNVFAADSETDARKMMSSMQQQFIALRRGTPGPLKAPVDDIRTVAAPHELAGANHALTYTAVGTKDSVQRHINQFIDDTGIDEVILTCHAFDHQARLRSFEIAAEALNGK

SEQ ID NO: 42388 - DNA, 1005 bp, Silicibacter pomeroyi DSS-3
  CDS (1)..(1005)
ttgaccccggacccgacccgcatgctctattccctgctcgaccttgccccggtgcccgagggcagcgacattcccgaggcgctggccaacagcgccgatctggccgcccatgccgaggccttgggctatcaccgctactggctggccgagcatcacaacatgcccggcatcgccagcgccgcaaccgcggtgctgatcggccatatcgccagccggaccagcaccatgcggatcggcgcgggcggcatcatgctgcccaaccatgcgccctacatggtggccgaagcctttggcactctggcgtcgctttatggcgaccgcatcgacctgggccttggccgggcgccgggcaccgacatggccaccgcgcgcgcgctgcgccggggtctgtcacaacaggacagtttcccgcaggatgtgatcgagctgatcggctttctcggccccgaggatccagaggcgcgggtgcgcgcctttcccggccagaacacccatgtgccggtctggatcctggggtccagcctctatggtgcgcaactggccgcgcagttgggcctgccttacgcctttgcctcgcatttcgcgccgcaggcgctggaggaagcgctgcaggtctatcgccgcagcttccgcccctcggtctatctgggccaacctcatgcgatgatggcaatcaatgtctttgccgccgaaaccgatgccgagggggtgcgcctgcgcaccaccatgcaacaggcctttgcccgcctcaggttggggcggcccggcaagctgccggcaccggttgacgatatcgccgcccatctggatcgcgccacgctggccggggtgaatgccgcgctcagcgtctcggcagtgggcagccccgagacggtgcgcgccgatctgacccacgtcatcgaccgttatcaacccgacgaagtgatcctgaccgggcaaatccacgatcacaccgcgcgcaaacgctcgttcgagatcgcggccgggatcctgcgctcactctga

SEQ ID NO: 42389 - protein, 334 aa, Silicibacter pomeroyi DSS-3
MTPDPTRMLYSLLDLAPVPEGSDIPEALANSADLAAHAEALGYHRYWLAEHHNMPGIASAATAVLIGHIASRTSTMRIGAGGIMLPNHAPYMVAEAFGTLASLYGDRIDLGLGRAPGTDMATARALRRGLSQQDSFPQDVIELIGFLGPEDPEARVRAFPGQNTHVPVWILGSSLYGAQLAAQLGLPYAFASHFAPQALEEALQVYRRSFRPSVYLGQPHAMMAINVFAAETDAEGVRLRTTMQQAFARLRLGRPGKLPAPVDDIAAHLDRATLAGVNAALSVSAVGSPETVRADLTHVIDRYQPDEVILTGQIHDHTARKRSFEIAAGILRSL

SEQ ID NO: 42390 - DNA, 999 bp, Bacillus clausii KSM-K16
  CDS (1)..(999)
atgaaaacaagtgtgacattatcggttttaaacttggctcctgtccgcgaaggattgggcgtgagcgacgcgctaaggcaatcaatcaaattagcccagaaaatagaagaattcggctaccaccggttttgggtggcagagcaccataatatgccagggattgcaagctctgctacggctgtacttattgggcaaattgcaggagccacgaaagcgattcgtgtcggttctggcgggatcatgcttccgaaccatgccccactcacgattgcagaacaatttggaacgttaaacgccctttacccagggcgcattgacttaggccttggacgtgcgccagggaccgaccagctaacggcccatgcgcttagacgccacggccaagatgcaaatgactttcctgagcttgtagaagagctgcaagcgtatttccaaccagaaagcacgacaaaacgcgtccgcgcttatccaggagaaggagaaaatattcccatttggttgcttggttccagtgggtttagtgctaggcttgcaggtgaaatggggttgccgtttgcttttgctggccacttcgcacctcaacatatgatgccagcattaatggtttataaagaatcctttaaaccttctgctgtattggctgaaccatacagcatggtggcggttaacgcgattgttgcggaaacagccaaagaggcagaagtgcttgcttcgagtctgtaccagcagtttttggcgatgatccgcaaccggccaggcaagctgaaacctgctgtagaaaatatcgatgacatatggacaccttacgaaaaacaaatggtgatggaacaattaggtggctcttttattggcacagctgctgatgtccacgaccggttgctgcgatttgccgaaaaaacagaaacaaacgagttcatgttgcatagcactatttacgatgagcagaaacaatatgaatcgtttcgtctccttgctgagcaatttgggctcctttcctaa

SEQ ID NO: 42391 - protein, 332 aa, Bacillus clausii KSM-K16
MKTSVTLSVLNLAPVREGLGVSDALRQSIKLAQKIEEFGYHRFWVAEHHNMPGIASSATAVLIGQIAGATKAIRVGSGGIMLPNHAPLTIAEQFGTLNALYPGRIDLGLGRAPGTDQLTAHALRRHGQDANDFPELVEELQAYFQPESTTKRVRAYPGEGENIPIWLLGSSGFSARLAGEMGLPFAFAGHFAPQHMMPALMVYKESFKPSAVLAEPYSMVAVNAIVAETAKEAEVLASSLYQQFLAMIRNRPGKLKPAVENIDDIWTPYEKQMVMEQLGGSFIGTAADVHDRLLRFAEKTETNEFMLHSTIYDEQKQYESFRLLAEQFGLLS

SEQ ID NO: 42392 - DNA, 1005 bp, Bacillus clausii KSM-K16
  CDS (1)..(1005)
gtgataaaacttagtgtcctagaccaagttcctcgctccagtgagacaacaaatgaaattgccttaaaggaaacagccgacttggctcaagcagctgaaagcatgggctatttccgttactgggtggccgaacaccacgatttgcatggcttgctttcgccaagcccagaaattttactagcctacatcggtgctaaaaccaactcaatccgcttaggagctggagcaatcttgcttcctcattatgccccttttaaagtggcagagtcttttcacatgcttgccaacctttttccagggcggatcgaccttggcttgggccgttcgccagggggttcggcagaggctgcggaagccctttctggcaactttatcgaacgcattcatacgatggacgagcgtatgacggagctaatgcactttctgaaacgtgactttccagaagggcataaatacgcttccttacaagctgtgcctcttccttatgaacagccggcggtgtatatgcttggaacgtctaagaagagcgctgccttagcggctaaacataacctccagtatgtttatggccattttatggatgatcaaaacggccaagatgtcattgcccactatcgaaagcgtgcgaatcaggctacgaagccaattgtttgtgtgtttgttttatgcgccgaatcgaacgaaaaagcgaggcagctttaccgctctgtgcggctgtggcaaacagccaatcaacaagggaggatgatggccgcgatcccgactgaagcggaaacggcttattttctcacccaattgaacgaagaagaccgtgctgctgtaatgaatgtgccatcaaccgccattgtgggcgacaaacagcatgtgaaagaacgcatggatgccattgctaattcgcttcatgtcgatgagttgatggtgttgacgcatgcgcctgagcttagcgatcgccttcattcataccggctattggctgaaatttacccacaacttgtttccttatag

SEQ ID NO: 42393 - protein, 334 aa, Bacillus clausii KSM-K16
MIKLSVLDQVPRSSETTNEIALKETADLAQAAESMGYFRYWVAEHHDLHGLLSPSPEILLAYIGAKTNSIRLGAGAILLPHYAPFKVAESFHMLANLFPGRIDLGLGRSPGGSAEAAEALSGNFIERIHTMDERMTELMHFLKRDFPEGHKYASLQAVPLPYEQPAVYMLGTSKKSAALAAKHNLQYVYGHFMDDQNGQDVIAHYRKRANQATKPIVCVFVLCAESNEKARQLYRSVRLWQTANQQGRMMAAIPTEAETAYFLTQLNEEDRAAVMNVPSTAIVGDKQHVKERMDAIANSLHVDELMVLTHAPELSDRLHSYRLLAEIYPQLVSL

SEQ ID NO: 42394 - DNA, 984 bp, Rhodobacter sphaeroides 2.4.1
  CDS (1)..(984)
atgatcccctattccgttctcgacctcgctccggtgccggaaggcgccaccacgtccgaggctctcgcccagaccgtcaccctcgcccgccatgccgaagccctgggctttcaccgctactggctggccgagcatcatgccatgccgggcatcgcctcggcggcgacggcggttctcatcggccatgtcgcggcccacacccagcgcatccgcgtggggtcgggcgggatcatgctgcccaaccacgccccgctgatggtggccgaagcgttcggcactctggccgagctgcatccgggccggatcgatctgggcctcggccgggcccccggcaccgacgggcgcaccgcgcaggcgctgcggcgcaacctcgatgtcaccgacagtttccctgccgacgtgctggaactcctgcgctacttcggcgagccggagccgggcgcgatccaggccatccccggccagggcacccgcgtgccgctgtggatcctcggctcgagcctctatggcgcgcagctcgcggcccatttcggcctgccctatgccttcgcctcgcatttcgcgccgcccgccctcgaggcggcgctggcggcctaccggcagggcttccggccctcggcccagctcgacaggccccgcgccatggtggcgatcaacgtctttgccggggccgacgatgccgagggccgctacctccgctcctccgcccagctggccttcgccaatctccgcctgggccgcccaggcaagctgccgcgcccggtcgaggatatctcggcccatgtcgatcccggcatgctccggacggtcgatcaggcgctgtccgtctcggccaccggcggccccgacaccgtgcggcgcgagctggcggcccttctcgagcggcaccggcccgacgaggtgatcctcaccgggcagatccacgaccccgcggcgcggctgcgctcgttcacgatcgcggccgaggctctggccagcctctga

SEQ ID NO: 42395 - protein, 327 aa, Rhodobacter sphaeroides 2.4.1
MIPYSVLDLAPVPEGATTSEALAQTVTLARHAEALGFHRYWLAEHHAMPGIASAATAVLIGHVAAHTQRIRVGSGGIMLPNHAPLMVAEAFGTLAELHPGRIDLGLGRAPGTDGRTAQALRRNLDVTDSFPADVLELLRYFGEPEPGAIQAIPGQGTRVPLWILGSSLYGAQLAAHFGLPYAFASHFAPPALEAALAAYRQGFRPSAQLDRPRAMVAINVFAGADDAEGRYLRSSAQLAFANLRLGRPGKLPRPVEDISAHVDPGMLRTVDQALSVSATGGPDTVRRELAALLERHRPDEVILTGQIHDPAARLRSFTIAAEALASL

SEQ ID NO: 42396 - DNA, 996 bp, Azotobacter vinelandii
  CDS (1)..(996)
atgccacgactggccgacaccgcgctttccattctcgacctggcgccgatccgcgacgacggcggcccggcccaggccctgcagaattccctggccctggcccggcatgccgaggccctgggcttcacccgcttctgggtggccgaacaccacaacatggacggcatcgcctgttccgccaccgccgtgctgatcggctatctggcggcgggcacccatcacatccgcgtcggcgccggcggcatcatgctgcccaaccatgcgccgctggtgatcgccgagcagttcggcaccctcgccaccctttatccgggacgcatcgacctcggcctcggccgcgcgccgggaaccgatccctacaccgcccacgccttgcgccgcgaccgcctgggcagcgaagaggaattcccggcggacgtcgaggaactgcaggccctgctcggcccggcgcgtcccgaccagcgggtgatcgccgtgccgggagccggcaccgaggtgccgatctggctgctcggctccagcctgttcactgcccgcctggcggcgcgcaagggcctgccctacgccttcgcctcgcacttcgcgccgcgctacatgcacgaggcgatccgcctctaccgcgacaatttccagccctcggcggtgctcgacaaaccctacgtgatgctcggcgtgccgctggtcgccgcgcccagcgacgaggaagcggaattcctcgccaccaccgccctccagcgcgccctggcgctggtccgcggcgagagccgggtactgcgtccgccggtggaatcgatggccggccgctggcagccgcacgagcaggcggcggtcggcgacttcctcggcctggcggtgatcggcggcccggaaaaggtccgcgcgcgcctggacgtgctgctcgaacagaccggcgccgacgaattgatcttcaccggcgacatctacgatccggacgcccgcctgcgctcgttcgagatcctcgccgggctgcgctga

SEQ ID NO: 42397 - protein, 331 aa, Azotobacter vinelandii
MPRLADTALSILDLAPIRDDGGPAQALQNSLALARHAEALGFTRFWVAEHHNMDGIACSATAVLIGYLAAGTHHIRVGAGGIMLPNHAPLVIAEQFGTLATLYPGRIDLGLGRAPGTDPYTAHALRRDRLGSEEEFPADVEELQALLGPARPDQRVIAVPGAGTEVPIWLLGSSLFTARLAARKGLPYAFASHFAPRYMHEAIRLYRDNFQPSAVLDKPYVMLGVPLVAAPSDEEAEFLATTALQRALALVRGESRVLRPPVESMAGRWQPHEQAAVGDFLGLAVIGGPEKVRARLDVLLEQTGADELIFTGDIYDPDARLRSFEILAGLR

SEQ ID NO: 42398 - DNA, 1050 bp, Actinobacillus pleuropneumoniae serovar 1 str. 4074
  CDS (1)..(1050)
atgtatcacactatgcaactttctattttaaatctcgtcccagtgcgtgaaggacaagactacgcacaagcaatgcaatctatggtaaaactggcacaactggcggaagagctggatttggctcgctattggattgccgaacaccataatatgaaaaacttagccagctcggcgaccactctgctgattcaacacaccttagccaatactaagaaaattgcggtcggctcaggcggtgtgatgttaccgaaccacagcccttatattgtggcggaacaatacggcacgcttgcgactctttatccgaatcgtgttcaacttggcttaggcagagcgcccggaaccgatatgcgtaccgctaatgcgttacgccgaggggcaaaacacctcgaatttccggatgaaatcgcagaactgcgtggttatttccaaaacaccaatccggtttccgcttaccctgccgctggtttagatatcccattctatattttaggctccagcaccgaaagtgcgtatttagccgcagaattaggcttaccttatgcatttgcctcacatttcgctccacgtatgatgatggaagcggtcgaaatttatcgtcgttatttcaaaccgtccgactatttggcaaaaccttatgtgattatgggcgtgaatgcgattgtggcggacagcgatgcggaagcacaaagtctggcaacgacacaaacgcaattctttatcaatgtcgtcaccaacgcacagcagaatttacaaccgccgatggcaaatgatgcggaagtgtggcaaaactttaatcgtacggaaaacgagctacacttcggaccggtcgatttaaatgaaattccgatttatcatcaagaaaaagcggtggtaaaacaaatgaccgcttgcacactagtcggctcgccggcaacagttaaagctcaattaacccaattaactaaacaagtggaaattgatgaaattatggcggtgacttatatctacgatgaacaaaaacaagcgaaatcttaccgcttgttaaaagaaatcgtagcgagtatgtaa

SEQ ID NO: 42399 - protein, 349 aa, Actinobacillus pleuropneumoniae serovar 1 str. 4074
MYHTMQLSILNLVPVREGQDYAQAMQSMVKLAQLAEELDLARYWIAEHHNMKNLASSATTLLIQHTLANTKKIAVGSGGVMLPNHSPYIVAEQYGTLATLYPNRVQLGLGRAPGTDMRTANALRRGAKHLEFPDEIAELRGYFQNTNPVSAYPAAGLDIPFYILGSSTESAYLAAELGLPYAFASHFAPRMMMEAVEIYRRYFKPSDYLAKPYVIMGVNAIVADSDAEAQSLATTQTQFFINVVTNAQQNLQPPMANDAEVWQNFNRTENELHFGPVDLNEIPIYHQEKAVVKQMTACTLVGSPATVKAQLTQLTKQVEIDEIMAVTYIYDEQKQAKSYRLLKEIVASM

SEQ ID NO: 42400 - DNA, 972 bp, Pseudomonas aeruginosa UCBPP-PA14
  CDS (1)..(972)
atgctcgacctggtgccggtgcgcaccggcggcagcgtggccgaagccctgcacaactccctggacctggcgcgccatgtggagcgcctgggcttcaaccgtttctggctggccgagcaccacaacatggatggcatcgccagctccgccaccgcgctgctgatcggccatatcgccggcggcacctcgcggatccgcgtcggctcgggtggggtgatgctgccgaaccatgcgccgctggtggtggcggaaaacttcggcaccctggagacgctctacccgggccgcatcgacctcggccttggccgcgccccgggcgccgaccaggcgaccatgcgcgccttgcgtcgcgaccgcctgggcaacggcgacgacttccccgagcaggtcgccgagctggaaatgctgctcggcccgcgccgttcccagcagagcctgctggcggtgccgggcgagggtacccaggtgccgatctggctactcggttcgagcctgttcagcgcccacctggcggcgcagaaaggcttgccctatgccttcgcttcgcatttcgcaccgcgttacctgcacgaggcgctgcgcatctaccgcagcaacttccagccctcggcggtactcgacaaaccttacgcgatgatcggcgtgccgctgatcgccgcacctaccgacgaagaggccgagttcctcgccactaccgccttccagcgcgtgctggcgctgatccgcggcgagagcctgaaacagaagccgccggtggaaagcatggcgccgttgtggctgccccacgagcaggatgcggtcggcagcttcttcggcctggcggtgatcggcggtccggagaaggttcgcgcgcgcctggagatcctcctggagcagaccggcgccgacgagcttatcttcaccagcgacttctacgagcacgcccatcggctgcgctcttgcgaaatcgtcgcggggctgaaaggggcgtga

SEQ ID NO: 42401 - protein, 323 aa, Pseudomonas aeruginosa UCBPP-PA14
MLDLVPVRTGGSVAEALHNSLDLARHVERLGFNRFWLAEHHNMDGIASSATALLIGHIAGGTSRIRVGSGGVMLPNHAPLVVAENFGTLETLYPGRIDLGLGRAPGADQATMRALRRDRLGNGDDFPEQVAELEMLLGPRRSQQSLLAVPGEGTQVPIWLLGSSLFSAHLAAQKGLPYAFASHFAPRYLHEALRIYRSNFQPSAVLDKPYAMIGVPLIAAPTDEEAEFLATTAFQRVLALIRGESLKQKPPVESMAPLWLPHEQDAVGSFFGLAVIGGPEKVRARLEILLEQTGADELIFTSDFYEHAHRLRSCEIVAGLKGA

SEQ ID NO: 42402 - DNA, 1005 bp, Dechloromonas aromatica RCB
  CDS (1)..(1005)
atgaacccgctcgccaatctcaagctctccatgctcgatctggtcgccgtccgcgaaggcggcacggtggccgatgcgctggccatttcgctgcgcaccgcccgccatgtcgaagcgctcggctacacccgctactggctggcagaacaccacaacatgccgggcatcgccagttcagccaccgccgtgctggtcggccacatcgctggcaacacccagcgcatccgcgtcggctcgggcggcatcatgctgcccaaccacgccccgctcgtcgtcgccgaagccttcggcacgctggccgagctttaccccggccgcatcgatctcggcctcggccgcgccccaggtaccgacggcctgaccatgcgcgccctgcgccgcgaccgcatcgaaaccgaagccgacttcccgcgtgacgtcgccgaactgcagcgcctgctcggcccccgccagccagagcagcaagtcgtcgccgtgcccggcgccggtaccgaagtgccgatctggctgctcggttccagcctgttctcggcccgcctggcggccgaacgcggcctgccctacgcctttgcctcgcacttcgccccggcgctgctgctgcaggccatcgagctttatcggcacaacttcaagccgtcggacaagctcgacaagccctacgtaatcatcggcgtgccgctcatcgcggcgccgaccgacgacgaagccgaatttctcgccaccagtaccttccagcgcgtgctcggcatcctgcgtggcgaccgtcgcccgttgccgccgccggtcgaaggtttcctacagagcctccacccgcgcgaacattcaggcattgccgatttcctcggcgccgcggtcatcggcggcccgcaacgcgtccgcgacggcctacgcgatctgcacgccgccaccggtgccgatgaaatgatgttcgtcagcgatgtcttcgatcccgaattgcgcctgcgctcgttggacatcgccacccgcgcctgctggcagccctga

SEQ ID NO: 42403 - protein, 334 aa, Dechloromonas aromatica RCB
MNPLANLKLSMLDLVAVREGGTVADALAISLRTARHVEALGYTRYWLAEHHNMPGIASSATAVLVGHIAGNTQRIRVGSGGIMLPNHAPLVVAEAFGTLAELYPGRIDLGLGRAPGTDGLTMRALRRDRIETEADFPRDVAELQRLLGPRQPEQQVVAVPGAGTEVPIWLLGSSLFSARLAAERGLPYAFASHFAPALLLQAIELYRHNFKPSDKLDKPYVIIGVPLIAAPTDDEAEFLATSTFQRVLGILRGDRRPLPPPVEGFLQSLHPREHSGIADFLGAAVIGGPQRVRDGLRDLHAATGADEMMFVSDVFDPELRLRSLDIATRACWQP

SEQ ID NO: 42404 - DNA, 1026 bp, Ralstonia eutropha JMP134
  CDS (1)..(1026)
atgactgcgaaccgaccccggctgcgcctgtccgtgctcgaccagagcccggtgatcgccggccataccgcgcgtgacgcgcttgctgccaccatcgaactggcccagatggccgacgcgctcggctacacgcgctactggtgcgccgagcatcacggcctgcgcggcgtctgcaatccggcgcccgaagtcatgctcgcgcgcatcggcagcgtgacgcagcgcatccggctcggctcgggtggcgtgatgctgccctactacagcccgttcaaggttgccgagcaattccgcatgctcgaaggactgttcccgtaccgtatcgacctcggcgtgggccgcgcgcctggcggcgatatgcgcactgcacaggctgtggcgatgggccagtatgatcgcggctcgcagtttgaggagcaggtgcgtgaccttgcatgcctgctgagcggcgaggtcccttccggccatctcgctgaaggcgtattgctccagcccgtcatcgatacgcggcccgaactgtgggtgctcggttcgagcgactacggcggcgcactggctgcaaagcttgggctgcggtttgcctttgcgcacttcatcaacgcgcacaccggccaccacgtcgcgcggcagtatcgcgaggacttccaggaaggctacgaggccaagccctacagtgccgccgcgatcttcgtgatctgcgccgacactgacgcggaggcagccgaactcgagcgcgctgtcgacctgcgccgcctgcagatggcctacggcgtaaatgcgccgattccctctctggaacaggccggaagccacacgccgaccgaacgcgaccggttgatcatcgagcgcgaacgtccgcgcacgatctgcggcacgccggaacgcgtgaccgagcggatgcttgcgctgcgcgagcaattcgctgcggacgaactcgtcgtgctcagcgtgaccgccacctacgccgcgcggctgcgcacgtacgaactgctcgccgaagcgttcgaactgaattccgaaaactga

SEQ ID NO: 42405 - protein, 341 aa, Ralstonia eutropha JMP134
MTANRPRLRLSVLDQSPVIAGHTARDALAATIELAQMADALGYTRYWCAEHHGLRGVCNPAPEVMLARIGSVTQRIRLGSGGVMLPYYSPFKVAEQFRMLEGLFPYRIDLGVGRAPGGDMRTAQAVAMGQYDRGSQFEEQVRDLACLLSGEVPSGHLAEGVLLQPVIDTRPELWVLGSSDYGGALAAKLGLRFAFAHFINAHTGHHVARQYREDFQEGYEAKPYSAAAIFVICADTDAEAAELERAVDLRRLQMAYGVNAPIPSLEQAGSHTPTERDRLIIERERPRTICGTPERVTERMLALREQFAADELVVLSVTATYAARLRTYELLAEAFELNSEN

SEQ ID NO: 42406 - DNA, 1002 bp, Methylobacillus flagellatus KT
  CDS (1)..(1002)
atgatgattccattttccatccttgacctctgccccatcgttcaaggcagcacgcctgcgcaggcgttcagcaactccgtcgagctggcgcagctcggcgaaacgctgggttatcgtcgcttctggctggcggaacaccacaacatgcccggcatcgccagcgctgcgacggctgtcgtcattggccatgtcgccggccatacccagacaatccgcgtcggtgccggcggcatcatgctgcccaaccatgctccgctggcgattgctgagcaattcggcacgctggaatcgctctatcccggacgcattgacctcggactgggccgggcgcccggtagcgacatggccaccgcccgcgccttgcggcgcaacttgcatgcgcatggcgaagacttccccgagctagtggcagaactgcagggctactttgacttgccccagccagggcaaagcatcagggcggtgcccggggccgggctagccattcccatctgggtactgggttccagcctgtatggcgcccaatttgccgctgcacatggcttgccgttcgcctttgcctcgcattttgcgcctaccttcctgttgcaggcgctggacacctaccgccgcaacttccagccttccacctcgctggacaggccttatttcatggtgacggccaatatcctggtcgctgacaccgatgaagaagcacgctactggttcagctcccagcaacaggcgtttaccaatctccatcgcggcataccgggacaattgccgccgccggtggacgatatcgagcaatactggacgccagccgagaaaatcagcgtggagcgcatgctggcctgttcgctggtcggctcttccaccaccgtggaggccggcctgagaaaactgctcaacgatctcgcccctgatgagttgatggtgaccggccatgtgttcgaccaagacatcagattgcaatcgtaccgtgccgtcgccactatccgcgacaggctgaccgcggaatga

SEQ ID NO: 42407 - protein, 333 aa, Methylobacillus flagellatus KT
MMIPFSILDLCPIVQGSTPAQAFSNSVELAQLGETLGYRRFWLAEHHNMPGIASAATAVVIGHVAGHTQTIRVGAGGIMLPNHAPLAIAEQFGTLESLYPGRIDLGLGRAPGSDMATARALRRNLHAHGEDFPELVAELQGYFDLPQPGQSIRAVPGAGLAIPIWVLGSSLYGAQFAAAHGLPFAFASHFAPTFLLQALDTYRRNFQPSTSLDRPYFMVTANILVADTDEEARYWFSSQQQAFTNLHRGIPGQLPPPVDDIEQYWTPAEKISVERMLACSLVGSSTTVEAGLRKLLNDLAPDELMVTGHVFDQDIRLQSYRAVATIRDRLTAE

SEQ ID NO: 42408 - DNA, 990 bp, Exiguobacterium sp. 255-15
  CDS (1)..(990)
atgcgcttaggaatcttggatcaggtcccgcttcacgagggggatacgatcgaacagacgatggagtcaacaaaacgactggtcgtcgaggcggaacgtctcggctatgaccggtactggtttgccgaacatcacaacacgaacggtttgctcagtgcggcaccggaattattcattgcccggatgggggacgcgacctcgaagattaaacttggttccggcgggatcttattgccgcagtatcatccgctcaaaatcgccgagtcattttcgacccttgccgcattttatccgaaccggatcgagctcggaatcggcaattcacccggtggcagtgaacggacccggcgtgccttgacggacggggccgagaatgccgctgctgagtttccgcgactgcttgatgaagtcgacggctttttgaccgaccggttatcatcgcgccacccgtaccggatcgtcaagacgacaccgcggattaaggaacggttaccgttatccgtgctcggactgtctccgcgcagtgccgcacttgctgccgagcggggacacggactcgtgtttggtcatttcatcaatcccgacaagtgggaagaaacgctgcagacgtatcgcgacgcattcgttccggtcgacggacggacaccgaatgtcatcgtctgcgttttcgtcatctgtgccgaaacgatggaagaagcggaagccttggcacggacgcaagacgcctggattcaaggaatccggcttggccattcgatcgtgccgtcgtttgcgactacagaaagcaagtcgtggaatgccgagcaacaacaacgaatccagcacgaccgccggcggacgatcgtcgggacaccggaaaccgtcgcgcaagaattgcaggagttgtccgaccgttaccagaccgatcagtttctgttgatcaataatgcgtttgatcaggacaagcggctccggtcctatcagttgattgccgaacgattgctccattaa

SEQ ID NO: 42409 - protein, 329 aa, Exiguobacterium sp. 255-15
MRLGILDQVPLHEGDTIEQTMESTKRLVVEAERLGYDRYWFAEHHNTNGLLSAAPELFIARMGDATSKIKLGSGGILLPQYHPLKIAESFSTLAAFYPNRIELGIGNSPGGSERTRRALTDGAENAAAEFPRLLDEVDGFLTDRLSSRHPYRIVKTTPRIKERLPLSVLGLSPRSAALAAERGHGLVFGHFINPDKWEETLQTYRDAFVPVDGRTPNVIVCVFVICAETMEEAEALARTQDAWIQGIRLGHSIVPSFATTESKSWNAEQQQRIQHDRRRTIVGTPETVAQELQELSDRYQTDQFLLINNAFDQDKRLRSYQLIAERLLH

SEQ ID NO: 42410 - DNA, 987 bp, Mesorhizobium sp. BNC1
  CDS (1)..(987)
atgatccccttttccgtgcttgacctcgcccccattccggagggcgcctccccggccaatgcgctgcaaaacaccgtagacatcgcgcagcatgcggagcgttggggctatcaccggtactggctggcggagcaccacaacatgccgggcattgcgagtgccgcgaccgccgtgcttatcggacaggtagcggcaaagacctccaccatccgcgtcggtgccggaggcatcatgcttcccaaccacgctcctttgatggtggcggaacagttcggcacacttgccacgctttatccggaccggatcgatttggggcttggccgtgctcccggaaccgacatggggactgcgcgggcgctgagacgcggcctcgacaacggcgaaggctttccgcaggacgtgctcgagctgatcgcctatctcgacgatcctgtgccgggacagcaggtaagagccataccggggatgagcacacgcgttccggtgtggattctcggatcaagcctttatggcgcgcagctcgccgcccatcttggcctgccctatgccttcgcctcacatttcgcgccggcagcacttgagcatgcgctctcggtctatcgcgagactttccggccttcaaagcatcttgagcagccgcatttcatgctggctctcaacgtgttcgcagccgatacggacgaagaagggcttttcctgaaaacctccatgcagctcgcctttgccaatctgcgtaccggcaggccgggcccgctgccgcggccggtgaaggatatttccgagcatgtggattcggccatcatgccgtacatcgatcaagcgcttgcctgttcggcagcaggctcgccggaaacggtgcgaggccaactcaagtgcttcatcgagcgttacagcccggacgaagtgatcatcacaggtcagattcatgatcaccgcgcacgtgtcaggtcgttccagctcgcagccgagttgctgcgcgagctgtga

SEQ ID NO: 42411 - protein, 328 aa, Mesorhizobium sp. BNC1
MIPFSVLDLAPIPEGASPANALQNTVDIAQHAERWGYHRYWLAEHHNMPGIASAATAVLIGQVAAKTSTIRVGAGGIMLPNHAPLMVAEQFGTLATLYPDRIDLGLGRAPGTDMGTARALRRGLDNGEGFPQDVLELIAYLDDPVPGQQVRAIPGMSTRVPVWILGSSLYGAQLAAHLGLPYAFASHFAPAALEHALSVYRETFRPSKHLEQPHFMLALNVFAADTDEEGLFLKTSMQLAFANLRTGRPGPLPRPVKDISEHVDSAIMPYIDQALACSAAGSPETVRGQLKCFIERYSPDEVIITGQIHDHRARVRSFQLAAELLREL

SEQ ID NO: 42412 - DNA, 1011 bp, Exiguobacterium sp. 255-15
  CDS (1)..(1011)
atgaaattaagtattttagaccaatcgccggtctcaaaaggacagaccccgtcagaagctttacaggaaacggtagaccttgcgaagattgctgatgaactcggatatacacggttatgggtatcagaacaccattttgcgaaaacacttgccggatcaagtccggaagtcttgattgcttacatggcagccgttacgaaacagatccgtctcggttcaggaggcgtcatgttaccgcattacagtccgtataaagtcgcggagaacttccgtgtcctcgagggacttgcaccaaaccggatcgatttaggtctcggtcgggcaccgggtggcatgccgctcgcaacccgcgcccttcaggaaggatcgtccacacgattcggcggagccgattacggcgcacaactcgatgatctcgtcgattatttaaaagacggggccccggctgatcaccggtttgcaggacttgttgcgacaccggaagtcgatacgacaccggaagcctggttgctcgggtcaagcggcggcagtgccttgaatgcggcgcagcgcggatttggtttcgcgtttgcccacttcatcaacggacagggtggtcaagaagtgatggattattaccgtcataacttcatggcgacgtcgtttaatgagacgccgcagacactcgtctcgattttcgtgacatgtgccgagacaacggaagaagcggaacgattggcttcgagtcttgatttgtcattgctcctgcttgagaaaggtgtctcgtcaacaggcacgccgactccggaagaagcggcggcttaccagtactcgttccaagatcagttccggatcgccgaaaaccggaaacggatgattgtcggaaatccggaagacgtcgcgcgtcagttgcaaaacctcgccgattcatatggaacagatgaagtgatgattgcttcgatgattgccgacaaggatgcgaaacaacaatcactccgtctgattatggatgcagtcaaagcaacggtttaa

SEQ ID NO: 42413 - protein, 336 aa, Exiguobacterium sp. 255-15
MKLSILDQSPVSKGQTPSEALQETVDLAKIADELGYTRLWVSEHHFAKTLAGSSPEVLIAYMAAVTKQIRLGSGGVMLPHYSPYKVAENFRVLEGLAPNRIDLGLGRAPGGMPLATRALQEGSSTRFGGADYGAQLDDLVDYLKDGAPADHRFAGLVATPEVDTTPEAWLLGSSGGSALNAAQRGFGFAFAHFINGQGGQEVMDYYRHNFMATSFNETPQTLVSIFVTCAETTEEAERLASSLDLSLLLLEKGVSSTGTPTPEEAAAYQYSFQDQFRIAENRKRMIVGNPEDVARQLQNLADSYGTDEVMIASMIADKDAKQQSLRLIMDAVKATV

SEQ ID NO: 42414 - DNA, 1050 bp, Burkholderia cepacia R18194
  CDS (1)..(1050)
atgtcttattcgctttcgctgctggacaagagtccgatcgccgacggcgcgaacgccgccgacgcgctgcgcttcaccacgacgctcgcgcaacgcgtcgaacagctcggctacgaacgcttctgggtcgccgagcatcacggcacgccgggtttcgcgagctcggcgccggaaatcgtcgtcgcacacctgctcgcgcatacgtcgcgcattcgcgtcggctcgggcggcgtgatgctgcagcactacagcccgttcaaggtcgccgaagccttcaaggtgctggccgcgctcgcgccgggccgcgtcgatctcggcatcggcaaggcgcccggcgggttgccgctgaccacgcgcgcgctgcagtggttccacgacaaggcgcgcaagccggacttcgcgggccagttggcggagctcgacgcgtttctcggctggggcgtcgccgaggatcacccgcttgccggcgcggtcgcgctgcccgtgccgccgcagccgcccgaacgcatcctgctcggcggctcgccggacagcggcgcgctggccgctcgcaacggctggcgcttctgctacgcggggcatttcaacggcgacgacgcgaacctcgaacgctcgctggacgcataccgcagcgcggatggcacacggccgctggtcgcgctgtacgcggtggccgcaccgacgcgcgacgaagccgagcaactgatcgggccaatgaaaatcttcaagctgcagttcgcgggcggccagagcttcaacctgaccagcgcgcaggcagccgccgaatttgcgcggcagagcggcgcgtccgactaccggatcgacgagttgcgcccgacggtgctcgccgatacgcccgagcgcatccaccgcgcgctcgatgcactgagccggcggctcgacgtcgatgcgttcgtgatcgattcgccggtgaccgactacgcggcgcggctcgcatcggccgaatggctcggcggcgcgctgtcggccacgccgttgcaggcggccctcgcggccgaccgctccctttcccctgaccagaacgcgtga

SEQ ID NO: 42415 - protein, 349 aa, Burkholderia cepacia R18194
MSYSLSLLDKSPIADGANAADALRFTTTLAQRVEQLGYERFWVAEHHGTPGFASSAPEIVVAHLLAHTSRIRVGSGGVMLQHYSPFKVAEAFKVLAALAPGRVDLGIGKAPGGLPLTTRALQWFHDKARKPDFAGQLAELDAFLGWGVAEDHPLAGAVALPVPPQPPERILLGGSPDSGALAARNGWRFCYAGHFNGDDANLERSLDAYRSADGTRPLVALYAVAAPTRDEAEQLIGPMKIFKLQFAGGQSFNLTSAQAAAEFARQSGASDYRIDELRPTVLADTPERIHRALDALSRRLDVDAFVIDSPVTDYAARLASAEWLGGALSATPLQAALAADRSLSPDQNA

SEQ ID NO: 42416 - DNA, 999 bp, Burkholderia cepacia R1808
  CDS (1)..(999)
atgattccgttttccgtactcgacctcgcccccatccccgaaggcgccgacgccgcgcaggcattccgcaacaccgtcgatctggcgcagcatgcggaacgcctcggctaccgccgctactggctcgccgagcaccacaacatgccgggtatcgcgagcgcggcgaccgccgtcgtgatcggccacgtggcgggcgcgacgcagacgatccgcgtcggctcgggcgggatcatgctgccgaaccacgcgccgctcgtgatcgccgagcagttcggcacgctggcgtcgctgtaccccggccgcatcgacctcgggctcggccgcgcgcccggcaccgaccagaccacgtcgcgcgcgctgcggcgtgacctgatcggcagcgccgattcctttccggacgacgtcgccgagctgcagcgctacttcgcggcgccggtgcccggccagcgcgtgcgggcggtgcccggcgcggggctcgacgtgccgatctggctgctcggctcgagcctgttcagcgcgcagctcgccgcgatgctcggcttgccgttcgcattcgcatcgcactttgcgccggactatctgatgcgcgcgctcgaactctatcgcgcgcaataccgcccgtcggccgcgtggccgaagccgtatgcgatggtcggcgtgaacgtgttcgccgccgataccgacgaagaagcacggcgcctcttcacgtcgctgcagcagcagttcatcaacctgcgccgcggcacgccgggcaagctgccgccgccggtcgacgcgctcgaggccagcgaattcgaactcgcgaacgtcgcgcatgcgctgtcgttcgcggccgtcggctcgcgcgacacggtgcgcgaccagttacgcgaccggatcgcgcagacgggtgcggacgagctgatcgtcaccgcccagatctacgatcacgcggcgcggctgcgctcgttcgagctggccgcgcagatccgcgacgagctggcgagcgaaacgcgctga

SEQ ID NO: 42417 - protein, 332 aa, Burkholderia cepacia R1808
MIPFSVLDLAPIPEGADAAQAFRNTVDLAQHAERLGYRRYWLAEHHNMPGIASAATAVVIGHVAGATQTIRVGSGGIMLPNHAPLVIAEQFGTLASLYPGRIDLGLGRAPGTDQTTSRALRRDLIGSADSFPDDVAELQRYFAAPVPGQRVRAVPGAGLDVPIWLLGSSLFSAQLAAMLGLPFAFASHFAPDYLMRALELYRAQYRPSAAWPKPYAMVGVNVFAADTDEEARRLFTSLQQQFINLRRGTPGKLPPPVDALEASEFELANVAHALSFAAVGSRDTVRDQLRDRIAQTGADELIVTAQIYDHAARLRSFELAAQIRDELASETR

SEQ ID NO: 42418 - DNA, 1032 bp, Burkholderia cepacia R1808
  CDS (1)..(1032)
ttgctggacaagagtccgatcgccgacggcgcgagcgcggccgacgcactgcgcttcacgacgacgctcgcgcagcgcgccgaacagctcggctacgagcgcttctgggtcgccgagcatcacggcgcgccgggcctcgcgagttccgcgcccgagatcgtcgtcgcgcatctgctggcgcatacgtcgcgcatccgcgtgggttcgggcggcgtgatgctgcagcactacagcccgttcaaggtcgccgagacgttcaagctgctcgccgcgctcgggccgggccgcgtcgatctcggcatcggcaaggcgccgggcgggctgccgctgacgacgcgcgcgctccaatggggccacgaccacgcgcgcaaacccgacttcgcgacacggctcgcgacgctcgacgcattcctcggctggggtgtcgccgaagatcatccgctcgccggcgcggtcgcgctgccggtgccgccgcacgcgcccgaacgcatcctgctcggcggctcgcccgacagcggcgcgctcgccgcccgccatggctggcgcttctgctacgccggccacttcaacggcgacgacgcgaacctcgaacgctcgctcgccgcataccgcgatgcgggcggcacgcgaccgctcgttgcgctgtacgcggtcgccgccgcgacccgcgacgaagcggaacgactgatcggcgcgctcaggatcttcaagctgcaattcgccggcggctcgagcttcaacctcgcgagcgcacaagccgccgccgaattcgcgcggcaaagcggcgcgtccgattaccggatcgacgaactgcgcccgaccgtgctggccgatacgcccgagcgcatccatcgcgcgctcgacgcgctcagccgccggctcgacgtcgatgcgttcgtgatcgactcgccggtgaccgattacgccgcgcggctcgcgtcgaccgaatggctgggcggtgcgcagtcgatcagccgcgcgcaaccggccgtcgcggccgaacgcgccccttcccccgaccacaacgcgtga

SEQ ID NO: 42419 - protein, 343 aa, Burkholderia cepacia R1808
MLDKSPIADGASAADALRFTTTLAQRAEQLGYERFWVAEHHGAPGLASSAPEIVVAHLLAHTSRIRVGSGGVMLQHYSPFKVAETFKLLAALGPGRVDLGIGKAPGGLPLTTRALQWGHDHARKPDFATRLATLDAFLGWGVAEDHPLAGAVALPVPPHAPERILLGGSPDSGALAARHGWRFCYAGHFNGDDANLERSLAAYRDAGGTRPLVALYAVAAATRDEAERLIGALRIFKLQFAGGSSFNLASAQAAAEFARQSGASDYRIDELRPTVLADTPERIHRALDALSRRLDVDAFVIDSPVTDYAARLASTEWLGGAQSISRAQPAVAAERAPSPDHNA

SEQ ID NO: 42420 - DNA, 996 bp, Listeria monocytogenes str. 1/2a F6854
  CDS (1)..(996)
atgacgattcgatttagtattttggaccaaagtattattaatccgggcgagcaaccaagtgaagccttacgaaatacagtagaacttgcgcaactcgcagaaaaactcggctatcatcgtttctgggttgccgagcatcataattcagacgaaatagctggcgcagctccggaggttcttttagggtatattgctgcaaaaacgagcacaatcaagcttgcgtctggcggaataatgctacaacactatagtccatataaagttgctgaacaatttcatgtgcttgaaaacatagcgccaggtcggatttcacttggcatcggaaaagcgccaggtggatttcagccagcaaccgatgcccttcaaaaagacttcgttaaacccactcgtacatttgatgctaaattggaagaactagtcgattttgtcacccgtcattcagatacaactattgcagcaaaaccacttccagaaaacaaaccagagatatttttgcttggaggaagtgcatcgagcgcgaaacaagctgccaaactagggatttcctttgtatttgcttattttattaacggagaagaagctgttttaaaagaagcacgcgagctatttgaacagtaccaaataaacacaaaagctagttttcaactagcaccaattgttgtagtagctgagactaaaatcgcagcagaccgacatattccagagcgagagtcaatcaaagtcgagcttgcagacggacgtagagttaatgtcggatcgcgcgaacaagccgaagcctacgtaaaagatatcgaccaaacataccggtttattacccaacgaattggtgcgataacaggaaccaaacaagaagtcggagtagagattaaacgcctttcaaaagaatataatatccaagattttgttgttttaactccagtcaaatctgctgaaattaaacgttattcctatcaactattaagtgaatcgataaaggaggaagttgtccatggctaa

SEQ ID NO: 42421 - protein, 331 aa, Listeria monocytogenes str. 1/2a F6854
MTIRFSILDQSIINPGEQPSEALRNTVELAQLAEKLGYHRFWVAEHHNSDEIAGAAPEVLLGYIAAKTSTIKLASGGIMLQHYSPYKVAEQFHVLENIAPGRISLGIGKAPGGFQPATDALQKDFVKPTRTFDAKLEELVDFVTRHSDTTIAAKPLPENKPEIFLLGGSASSAKQAAKLGISFVFAYFINGEEAVLKEARELFEQYQINTKASFQLAPIVVVAETKIAADRHIPERESIKVELADGRRVNVGSREQAEAYVKDIDQTYRFITQRIGAITGTKQEVGVEIKRLSKEYNIQDFVVLTPVKSAEIKRYSYQLLSESIKEEVVHG

SEQ ID NO: 42422 - DNA, 1044 bp, Rubrivivax gelatinosus PM1
  CDS (1)..(1044)
atgcaactctcggtcctcgaccagtccatcgcactcgccggtgtcggcgaggacgcggcgatccgcgacaccgtcgatctcgccgtgcactgcgagacgctcggctaccggcgcttctggttgagcgagcaccacaacctgccgaccatcgtgggcaccgcgcccgaggtgctgatggccgcggtggccgcacgcacccgccgcatccgcatcggcagtgcgggcgtgatgctgccgcactacgcagcgctgaaggtggcggaacagttccgcgtcctcgacgcgctggcgccggggcgcatcgatctgggcgtgggccgcgcgccgggcggcgacatgcggaccgcgctcgcgctcaacccgcaggcccacggcgcggctgaccagttccccgagcagatccgcgacctgcaggcctggaccgccgggcggcaacaccgcggcatcgtggcgcatccccggccgccggcggacgcgcgcgacttcgagcgggcccccgcgctctgggtgctcggcagctccgactacggcgcccggctcgcggcgcacttcggcctgccctacgccttcgcctacttcttcatggacggccagggcgtcgagcaggccctgtcgctgtatcgcgcgctgtaccagccgagcgaacggcacccgacgccgcaggccacgatctgcgtctgggcgctcgccgccgacagcgaggccgaggcacggcaccacgcgctcagccgcgaccgctggcggatcgaccgcgctcgcggccgtcttggcccgctgctgtcgcccgacgcagttgccgaacgcggcttcagcgccgaggaaggaccggccctggaggcccagcatcgcaaagccttcgtcggcagcgccccgcaggtcgccgcgcagctgagggagctggcgaccgcgctggggctcgatgaactggtggtcaacacctgggcgcacgacccggccgtgcgccgccgctcctatgcgctgctggcgcgcgagttcggcttggcgccggacctcgcaacaacacccccggagaacgctgcatga

SEQ ID NO: 42423 - protein, 347 aa, Rubrivivax gelatinosus PM1
MQLSVLDQSIALAGVGEDAAIRDTVDLAVHCETLGYRRFWLSEHHNLPTIVGTAPEVLMAAVAARTRRIRIGSAGVMLPHYAALKVAEQFRVLDALAPGRIDLGVGRAPGGDMRTALALNPQAHGAADQFPEQIRDLQAWTAGRQHRGIVAHPRPPADARDFERAPALWVLGSSDYGARLAAHFGLPYAFAYFFMDGQGVEQALSLYRALYQPSERHPTPQATICVWALAADSEAEARHHALSRDRWRIDRARGRLGPLLSPDAVAERGFSAEEGPALEAQHRKAFVGSAPQVAAQLRELATALGLDELVVNTWAHDPAVRRRSYALLAREFGLAPDLATTPPENAA

SEQ ID NO: 42424 - DNA, 1002 bp, Pseudomonas fluorescens PfO-1
  CDS (1)..(1002)
atgaagcaactgtccgacgtaaagttttccaccctcgacctggtgccggtgcgcgagaacggcagcccggcccagtcgctgcgcaactcgctggatctggcacagcacgtcgaaaagttcggctacacccggttctgggtcgccgagcaccacaacatggatggcatcgccagttccgccacctcggtgttgctgggctatctggccggcggcacgtcgaccatccgggtcggctctggcggtgtgatgctgcccaaccatgcgccgctggtgatcgccgagcagtttggcacccttgaaagcctctatccgggtcggatcgacctcggcctgggccgtgcaccgggttccgatcagatgactgcccgtgccctgcgccgcgagcgctccggcagcgccgatgatttccctgaagacgtggctgaactggcgcgctatctcgggccgcgcacccctgatcagcgcgtgatcgcgatgccgggcaccggcaccaatgtgccgatctggctgctcggctccagcctgttcagtgcgcaactggccggcgagcgcggtttgccctacgccttcgcctcgcatttcgctccgcgcttcatgcacgaggcgattcgcgtctaccgcaatcacttcaagccgtcagcggtactcgataagccgtacgtgatgctcggcgtgccgctggtggccgcggacactgatgaacaggccgattacctggcgacctcggtgtaccaacgaatcctcgcgctgatgcgtgggcaaagtctggtgcagcgtccgccggtaaaaaccatggacggcctgtggttgccccacgagcgtgaggcggtgggggatttcctcggtctggcgatggtcggcagtccgcagaaaatccgcgcgaaactcgaagtgctgatcgaacagacccaggctgatgagctgatcttcaccagcgacctgtacgaacacgccgatcgcctgcactcctacgagctgctggcgcaggtgatgaagggctga

SEQ ID NO: 42425 - protein, 333 aa, Pseudomonas fluorescens PfO-1
MKQLSDVKFSTLDLVPVRENGSPAQSLRNSLDLAQHVEKFGYTRFWVAEHHNMDGIASSATSVLLGYLAGGTSTIRVGSGGVMLPNHAPLVIAEQFGTLESLYPGRIDLGLGRAPGSDQMTARALRRERSGSADDFPEDVAELARYLGPRTPDQRVIAMPGTGTNVPIWLLGSSLFSAQLAGERGLPYAFASHFAPRFMHEAIRVYRNHFKPSAVLDKPYVMLGVPLVAADTDEQADYLATSVYQRILALMRGQSLVQRPPVKTMDGLWLPHEREAVGDFLGLAMVGSPQKIRAKLEVLIEQTQADELIFTSDLYEHADRLHSYELLAQVMKG

SEQ ID NO: 42426 - DNA, 1002 bp, Rhodospirillum rubrum
  CDS (1)..(1002)
atgacctcgctctcgatccttgatcttgtccgcgtcaccgaggcgaccgacgcccggggcgcgctgaacaacgcccgcgatctggccgcccatgccgaaacctggggctatcgccgcttctgggtggccgagcaccacaatatgcccggcatcgccagcgccgccaccgccgtggtcatcggccatatcctggagggaacccgcaagatccgggttggcgccggcggcgtcatgctgcccaatcacgcgcctttgatcatcgccgaacaattcggcaccctggcccggcttttccccgaccgcgtcgacctcggcctgggccgggcgccgggcaccgacccaacaacggtgcgcgccctgcgccgcccgttctcggccgtcgacagcttccccagcgacatcctggaactccagggctacttcgcccccgccgccgccaacgccctgcaggccgttcccgccgccggaaccaacgtgccgctgtggatcttgggatcaagcacctatggggcgcggctggcggccgattacggcctgccttacgccttcgcctcgcatttcgccccggccgaactggggctggcccttgatctctatcgccgcggcttcaagccgtcggcgcagttggcccggccccatgtcgccgttggcgtcaatatcatcgccgccgacagcgaggccgaggcgcggcgactggcgaccaccacccagatggccttcaccaatttgctgcgcggcacccgccagcttggccagccgccgatcgatgacatcgaccaatactggtcgccggcggaaaaggcccaggtcggccttatgctggcctgctcgatcatcggcgcccccgccaccctgcgcgagggaatcaaggccctgatcgccgagacggcggccgatgagctgatcatcgtctcggacatctacgaccacgaggcccgcctgcgctcgttcgagctgatcgccgaggtggccggtccgtccgcccacggcgccggcggctaa

SEQ ID NO: 42427 - protein, 333 aa, Rhodospirillum rubrum
MTSLSILDLVRVTEATDARGALNNARDLAAHAETWGYRRFWVAEHHNMPGIASAATAVVIGHILEGTRKIRVGAGGVMLPNHAPLIIAEQFGTLARLFPDRVDLGLGRAPGTDPTTVRALRRPFSAVDSFPSDILELQGYFAPAAANALQAVPAAGTNVPLWILGSSTYGARLAADYGLPYAFASHFAPAELGLALDLYRRGFKPSAQLARPHVAVGVNIIAADSEAEARRLATTTQMAFTNLLRGTRQLGQPPIDDIDQYWSPAEKAQVGLMLACSIIGAPATLREGIKALIAETAADELIIVSDIYDHEARLRSFELIAEVAGPSAHGAGG

SEQ ID NO: 42428 - DNA, 1017 bp, Ralstonia metallidurans CH34
  CDS (1)..(1017)
atgactccctattccctgctcgacctctcgcccatcatcgaaggcagcgacgccacccaggccatgcgcaacacgctgagcctggcgcagcacgcggaacgtcttggctatcggcgcttctggctggccgaacaccacaacatgccgggcattgccagtgccgccacggcggtgctgatcgggtacgtcgccaacggcacctcgacgatccgggtcggctccggtggcatcatgctgcccaaccattccccgctggtggtggccgaacagttcggcacgctggcctcactctatccgggccggatcgacctcgggctgggccgcgcccccggcaccgaccaggccacggcacgcgcgctgcgccgaaccctgagccacgactcggccgactcgttcccgcaggatgtggaagaactgcaagcgtactttgatgaggtgcgacccggccagcgcgtgcgcgccgtgccgggcgcggggctcaaggtgccgctgtggctcctcggttccagccttttcggcgcgcagctagcagcggcgatgggcctgcctttcgcgtttgcttcgcactttgccccgggcttcatgcggcaggcggtagacctgtatcgccgcaccttccgcccgtcggagcagctcgatcgtccgcacgtgatgcttggcctcaacgtgttcgccgccgagaccgatgccgaggcgcgtcgcctgttcagttcgctgcagcagcagtttctggcgctggttcgcggcacgccgggacagctcaagccgccggtcgacgatatcgagcgtctgtgggatgccagcgaagcggagcatatccgccggtccctcgcctgctcggtcgtgggagacccggcaacggtacgcgagggcatccagcgtttcgtggacgatctgcggccggacgagctgatgctgaccggccagatctacgaccatgccgcgcggctgcgatcgttcgagatcgcagccgatgccatgcgcgcgctacagcccgcatcatcgcagacggcgtga

SEQ ID NO: 42429 - protein, 338 aa, Ralstonia metallidurans CH34
MTPYSLLDLSPIIEGSDATQAMRNTLSLAQHAERLGYRRFWLAEHHNMPGIASAATAVLIGYVANGTSTIRVGSGGIMLPNHSPLVVAEQFGTLASLYPGRIDLGLGRAPGTDQATARALRRTLSHDSADSFPQDVEELQAYFDEVRPGQRVRAVPGAGLKVPLWLLGSSLFGAQLAAAMGLPFAFASHFAPGFMRQAVDLYRRTFRPSEQLDRPHVMLGLNVFAAETDAEARRLFSSLQQQFLALVRGTPGQLKPPVDDIERLWDASEAEHIRRSLACSVVGDPATVREGIQRFVDDLRPDELMLTGQIYDHAARLRSFEIAADAMRALQPASSQTA

SEQ ID NO: 42430 - DNA, 1020 bp, Ralstonia metallidurans CH34
  CDS (1)..(1020)
atgagccaaccccgccccaagctgcgcctgtccgtgctcgaccagagcccggtcatcgccggccataccgcgcgcgacgcggtggctgcgaccgtcgaactggcccagatggccgacgatctcggctatacccgctactggtgcgccgagcaccacggtctgcaaggcgtctgcaatcccgcgcccgaagtcatgcttgcgcggctgggcagcgcgacgaagcgcatccgcgtgggctccggcggcgtgatgctgccctactacagcccgttcaaggtggccgagcagttccgtatgctcgaagcgctgtttccgaaccgcgtcgacctgggcgtgggccgcgcgcccggcggcgatatgcgcactgcgcaggcggtggccatggggcagtacaaccgtggcgaccagttcccgcaacaggtgcaggacctggcctggctgctgcgcggggaagtcccgcccgaccatctggccgaaggggtgctgctgcagccggtgatcgacaccaaacccgaactctgggtgcttggttcgagcgatttcggcggcgcgctggccgcccgtctcgggctgcgattcgcgtttgcccacttcatcaatgcgcacagcgggcatctggttacccagcaatatcgcgaagcgttcgagcctggctacgaggacaagccttacagcgccgcggctatcttcgtgatctgcgccgataccgaacaggaagccgcgacgctggaacgcgcggtcgatatccgccggctgcagatggcctacggcgtgaacgcgcccattccctcgctggcgcaggccgccgacttcacgccgaccgaacgcgaccggatgatcatcgagcgcgaacggccgcgcacgatctgtggcacgcccgagcaggttgccgagcggatgctggcgctcaaggaccggttcgcggcggacgaactagttgtgctgagcgtgacggcctcctacaaggcgcgtctgcgcacctatcagttgctggccgaggcattcgacctggccgcctga

SEQ ID NO: 42431 - protein, 339 aa, Ralstonia metallidurans CH34
MSQPRPKLRLSVLDQSPVIAGHTARDAVAATVELAQMADDLGYTRYWCAEHHGLQGVCNPAPEVMLARLGSATKRIRVGSGGVMLPYYSPFKVAEQFRMLEALFPNRVDLGVGRAPGGDMRTAQAVAMGQYNRGDQFPQQVQDLAWLLRGEVPPDHLAEGVLLQPVIDTKPELWVLGSSDFGGALAARLGLRFAFAHFINAHSGHLVTQQYREAFEPGYEDKPYSAAAIFVICADTEQEAATLERAVDIRRLQMAYGVNAPIPSLAQAADFTPTERDRMIIERERPRTICGTPEQVAERMLALKDRFAADELVVLSVTASYKARLRTYQLLAEAFDLAA

SEQ ID NO: 42432 - DNA, 999 bp, Burkholderia fungorum LB400
  CDS (1)..(999)
atggtcggctccgggactaccacgcaccaagccctggaagcgaccgtcaagctggcccagcatgcagagaacctaggtttcacccgctattggatggccgagcatcacggtgttcccggcgttgccagttccgccccggtggtgacaatcggcgcgctagcagcggccacccgcagcattcatgtcggtgcaggcggcgtgatgttgccgaaccatgtccccttggtcgtcgcagagcagttcagcacgctggcagcgctttatccgggccgtatcgatcttggcgtcggtagggccacgcctgaccctggtactgcgatggtacttgcccgttccctggcgggatacggcagcgatcagttcaccttgcagctcgggcaactggctggcttcctgcgtggcgatttccctgacggtcatccatatcgcgacgtattcgtctcgccccgggcagaagaacctccggcgctatggattctcggtgcgagcgtccaaagcgctggtctggcagcgtcgctcggactgccgttcgccttcgcgcatcacttcggtaggggagaagcagcacccgccttcgagcattaccggcgcagcttcaagccctctgcggctctcagcgagccctatgcaattgtcacggcactggtggtctgtgcgccctccgacgaggaagccgatcaaatagcgcggtcggctgacctcatgttccggcttctgttccagggacgtccgggcaaactgccttcaccggaggaggttgcggctcacccatggacgcaagaagacctggcctttgtccgccagcgtcggcgcgggcaagcgatcggaagccccgaaaccgttcgctcggtgctgacggaactccttgaggctaccggagcagacgaactgatgatgacgacgcagatgtaccgccttgaggaccgtatccgttccctggaaatggtcagcgaaatgttcatccacgccgacatggatctcggccgcacagccccatga

SEQ ID NO: 42433 - protein, 332 aa, Burkholderia fungorum LB400
MVGSGTTTHQALEATVKLAQHAENLGFTRYWMAEHHGVPGVASSAPVVTIGALAAATRSIHVGAGGVMLPNHVPLVVAEQFSTLAALYPGRIDLGVGRATPDPGTAMVLARSLAGYGSDQFTLQLGQLAGFLRGDFPDGHPYRDVFVSPRAEEPPALWILGASVQSAGLAASLGLPFAFAHHFGRGEAAPAFEHYRRSFKPSAALSEPYAIVTALVVCAPSDEEADQIARSADLMFRLLFQGRPGKLPSPEEVAAHPWTQEDLAFVRQRRRGQAIGSPETVRSVLTELLEATGADELMMTTQMYRLEDRIRSLEMVSEMFIHADMDLGRTAP

SEQ ID NO: 42434 - DNA, 1002 bp, Burkholderia fungorum LB400
  CDS (1)..(1002)
atgtcctattcactttcgattctcgacaagagtccgatcgccgacggaacaagtgcgtatgatgcgctgcgctttacggtccggcttgcgcagcgcgcagaggcgttgggttacaagcgttactggatcgccgagcaccacggggcgtcagggctcgccagttccgcaccggagattgtcgtgtcccatctgctcgcgcacacatcgcgcatccgggttggctccggcggcgtaatgcttcagcattacagccctttcaaggttgcggagtcgttccgggtgcttgcatcactggcgccgggtcgcgttgatctcggcgttggcaaggccccgggcgggttgccgttgacgacgcgagcgctgcaatggtttcacgacaaggcgaagaagcccgatttcgcgcatcagctcgctgagctcgacgcgttcctgaagtttggcgtcgccgaagatcacccgctggcgggggcagttgcgctgcccacgccgccggagtctgcgcagggcttcctgctaggaggcagccctgagagcgcggcgctcgccgcgcagcacggctggcagttctgctatgccggccatttcaatcgcgacgaggctaacctgaagcgttcgattgacacctatcgcagcgcgaccggtcgcgcgccgctgctcgcgctctacgcttttgcagcggagtcgaaggccgaggccgaacgtcaggtcggaccgctgcgtattttcaagctgcagctctcaaccgggcagagtgtcaatctcggcagttccgaggcagctgcagagttcgcccgccaggttggcgtgacggactaccggattgacgaattgcatccgcacctcatcaccggcacgtccgacgatgtgcgccaggaactcaacgcattgcacgaacgctttggcatcgaggaattcgtgcttgacagcccggttgcggactacgcattgcgcctggcttcggtagaagcgctggccggtgcggagcaggccgcgcgagtctga

SEQ ID NO: 42435 - protein, 333 aa, Burkholderia fungorum LB400
MSYSLSILDKSPIADGTSAYDALRFTVRLAQRAEALGYKRYWIAEHHGASGLASSAPEIVVSHLLAHTSRIRVGSGGVMLQHYSPFKVAESFRVLASLAPGRVDLGVGKAPGGLPLTTRALQWFHDKAKKPDFAHQLAELDAFLKFGVAEDHPLAGAVALPTPPESAQGFLLGGSPESAALAAQHGWQFCYAGHFNRDEANLKRSIDTYRSATGRAPLLALYAFAAESKAEAERQVGPLRIFKLQLSTGQSVNLGSSEAAAEFARQVGVTDYRIDELHPHLITGTSDDVRQELNALHERFGIEEFVLDSPVADYALRLASVEALAGAEQAARV

SEQ ID NO: 42436 - DNA, 996 bp, Burkholderia fungorum LB400
  CDS (1)..(996)
atgatccccttttcagtcctcgacctctcgccggtcaccgcgggcgccacgccggcagacgcgttcaggaatacgctcgacctcgcccagcacgcggaaaactggaattaccggcgcttctggctggcggaacatcacaacatgacgggcattgccagcgcggcgacctcggtggtgatcggctacgtcgcgggcggcacgaaaaaaatccgcgtcggctcgggcggcatcatgctgccgaaccacgcgccgctcgtgatcgcggaacagttcggcacgctcgcctcgctttaccccgaccggatcgacctgggcctcggccgcgcgcccggcacggatcagagcaccgcccgcgcgttgcgccgcgatctgcaaaacagcgcggactcgtttcccgacgacgtggtcgaattgcagcgttatttcgccgaaccggtgccgggccagcggattcgcgcggtgccgggcgcgggtctgaacgtgccgctgtggctgctcggctcgtcgctcttcagcgcgcagctcgccgcggcgctcggcctgccgttcgcgttcgcgtcgcatttcgcgccggattacatgctcaccgcgctgcaaatgtatcgcgcgcaattccgtccgtcggccgcgctcgacaaaccgtatgcgatggtcggcgtcaacctgttcgccgcggataccaacgaagaagcgcaacgtctattcacctcgctgcaacagcagttcatcaatctgcggcgcggcacgccgggtcagctgcagccgccggttgagcggctcgaggcgtcggaaatggaattgaacaacgtggcgcactcgctcgcctgcacggcgctgggcgaccgtcacgcggtgcgcgaggcattgaagtcgatcatcgatcaaaccggcgcggacgaattgatgctcaccgcgcagatctacgatcacaaggcgcggctgcggtcgtttgagatcggtgcgcaagtgcgtgaggagttggcggcgggttgttaa

SEQ ID NO: 42437 - protein, 331 aa, Burkholderia fungorum LB400
MIPFSVLDLSPVTAGATPADAFRNTLDLAQHAENWNYRRFWLAEHHNMTGIASAATSVVIGYVAGGTKKIRVGSGGIMLPNHAPLVIAEQFGTLASLYPDRIDLGLGRAPGTDQSTARALRRDLQNSADSFPDDVVELQRYFAEPVPGQRIRAVPGAGLNVPLWLLGSSLFSAQLAAALGLPFAFASHFAPDYMLTALQMYRAQFRPSAALDKPYAMVGVNLFAADTNEEAQRLFTSLQQQFINLRRGTPGQLQPPVERLEASEMELNNVAHSLACTALGDRHAVREALKSIIDQTGADELMLTAQIYDHKARLRSFEIGAQVREELAAGC

SEQ ID NO: 42438 - DNA, 1020 bp, Burkholderia fungorum LB400
  CDS (1)..(1020)
atgacgcgactatccgtactcgatcaaacgccggtgattgccgggcactcggtggcggacgcgattgccgccacggttgaactcgcgcaactcgccgacgacctcggctacacgcgttactggtgcgccgagcatcatggcctgcgtggcgtgtcgaatccctgccccgaggtgatgctggcgcgcctcggcagcgtgacggaccacatccggctgggctccggcggcgtgatgctgccgtactacagcccgttcaaggtcgccgagcaattcatgatgctcgaggcgctgtttcccaatcgtatcgatctgggcgtgggacgcgcgccgggcggcgacatgcgcaccgcgcaagcggtcgccgccggcgactataatcgcggcgacattttcccgcagcaggtggccgatctgctcggcctgatgcacggcacgttgcccgccgatcacattgcgggcggcgtgctgctgcagccgcaaatcgatacgcgcccgcaagtatggatgctggggtcgagtgaattcggcggattgctggccgcgcaactcggcattccgtttgcatttgcgcacttcatcaacgcgcatttcgggcatcaggtcgcgcatgcgtatcgtgagcgcttcaaggccggccaggacatacagcaagcgtatctggccgccgccgtgttcgtgatctgcgcggacaccgaacaggacgccgctgatctggaaaaagccgtcgacctgcgccgcgtgcagatggcctatggtttgaacgaaccgattccgtccatcgaacagggcattgcgcaggagtacggcgagcgcgagcaactcgtgatctcgcgcgaaaagccgcgcagtatcatcggcacgcccgcaaccgtcactgaacggcttcatgtgttgcaggagcagttcgaggcggacgagctgatcgtgctcacggttgcgggcagctatcgcgcccggttgcgctcctatgaacttcttgccgaggcgttccagctcgaacgcccggcgtccactccttaa

SEQ ID NO: 42439 - protein, 339 aa, Burkholderia fungorum LB400
MTRLSVLDQTPVIAGHSVADAIAATVELAQLADDLGYTRYWCAEHHGLRGVSNPCPEVMLARLGSVTDHIRLGSGGVMLPYYSPFKVAEQFMMLEALFPNRIDLGVGRAPGGDMRTAQAVAAGDYNRGDIFPQQVADLLGLMHGTLPADHIAGGVLLQPQIDTRPQVWMLGSSEFGGLLAAQLGIPFAFAHFINAHFGHQVAHAYRERFKAGQDIQQAYLAAAVFVICADTEQDAADLEKAVDLRRVQMAYGLNEPIPSIEQGIAQEYGEREQLVISREKPRSIIGTPATVTERLHVLQEQFEADELIVLTVAGSYRARLRSYELLAEAFQLERPASTP

SEQ ID NO: 42440 - DNA, 993 bp, Novosphingobium aromaticivorans DSM 12444
  CDS (1)..(993)
atgaaactttcggtcctcgatctggtcagcgtggtcgagggcggaacggtgcgcgaggcgctcgacaattcggccgccgcagccagggtcgcggaggagtgcggctatcagcgctactgggtggccgaacaccacggcatggaaggcatcgccagcgcggctgtcgcggtgacgctcgcgcatatcggtcatgccacctccaccatccggatcggcgcgggcgggatcatgctgcccaaccacaatcccctcgtaatcgccgaacagttcgggacgctcgacgcgctctttccgggccggatcgacctcggcctgggccgtgcgccgggtgccgaccagcggatcgtcagggccctgcgcaaggataccaatcgcgcggccgaggattttccggccgacgtcgtcgaactccagctccagttcgcgggcgatccgcgcgtcccgctccaggcggtgccgggcaagggcgccaggccgcagatgtggattctcggctccagcctgttcggggcgcagctcgccgcgatgcttggcctgccctatgcctttgcctcgcacttcgcccctgaccacctcgatgcggcgctgaagatctaccgcgagcgcttccagccttccgacgttctcgacgctccctactgcgccgccgcgatcaacgccgtcgccgccgagaccgacgaggaggccacgcttctcgcttcctcgatggaccaggctttcgtcgcgctgcgcactggcaatccgggcaagctcaagcctcccgtacccggctaccgggacagcctgccgccccccgcgctggcgatgctggagcatgtgcgccaggtcagcgctacgggttcggtggagacggtgcggcgcggtctcaaggctttcgtggagcgcaccggcgtcgacgaagtcattgttgcggcatcgatattcgaccaggaagcgcgccgccgctcgctgcgtttggtggccgaggctgcgcgtgaaacggtaacgacctga

SEQ ID NO: 42441 - protein, 330 aa, Novosphingobium aromaticivorans DSM 12444
MKLSVLDLVSVVEGGTVREALDNSAAAARVAEECGYQRYWVAEHHGMEGIASAAVAVTLAHIGHATSTIRIGAGGIMLPNHNPLVIAEQFGTLDALFPGRIDLGLGRAPGADQRIVRALRKDTNRAAEDFPADVVELQLQFAGDPRVPLQAVPGKGARPQMWILGSSLFGAQLAAMLGLPYAFASHFAPDHLDAALKIYRERFQPSDVLDAPYCAAAINAVAAETDEEATLLASSMDQAFVALRTGNPGKLKPPVPGYRDSLPPPALAMLEHVRQVSATGSVETVRRGLKAFVERTGVDEVIVAASIFDQEARRRSLRLVAEAARETVTT

SEQ ID NO: 42442 - DNA, 1014 bp, Cytophaga hutchinsonii
  CDS (1)..(1014)
atgaaaaaaattaaactcggcattctggatcaatcggttgttcagaaaaataaatcaccgaaagatgcggttgatgaaacagttgataccgtgaaacttgcagagcagttggggtattcccgcttttgggtttcagaacaccacaactctacctttattgcgggttcaacgccggaaattttaatggtgaagctggccgaagttacggatcacattcgcattggctcaggcggcattatgcttcctaaccacagtgccttaaaagtggcggagaattttcgcatgttagaaacacttttccccgggcgcattgatctgggaatgggcagagcaccgggtacagacagactcacatcctctttattaaatccttcaaatgattttgctgaagaaagttatttacgccagctggatcatttacaaaactttttttcagatacggcttataccagagataaccggagaatacttgccgtaccgcagtgcgaaacagttccggatcaatggatcttaagctcaagcggaggaagcagcctgattgctgcacgctttggccttgggcttgtggttgcaaaatttattaatggatttgccacacgggaagtgattgatacgtataaaaagaatttcaaaccatcggaatattttccgttgcccaaagccatgttatctatttttgtattgtgtgcagaaacagatacaaaagttaaggagatgcgtaagtttatggattatatttttattcaatttgaaaaaggcaattttcatgatttcggagactatgaaaccatacagaagtatgtgtttacacaggaagaattagagcgcattaactacaatagcggaagaattatttcaggtactccggcatcggttaaacagcagctggaaaagctggcagctgaatttgatgtagatgaaattattatttctaccatggccggaaatgctgccgaccggaaacgctcgtttgaactgattgcacaggcatttgaattgacacctgcaaattaa

SEQ ID NO: 42443 - protein, 337 aa, Cytophaga hutchinsonii
MKKIKLGILDQSVVQKNKSPKDAVDETVDTVKLAEQLGYSRFWVSEHHNSTFIAGSTPEILMVKLAEVTDHIRIGSGGIMLPNHSALKVAENFRMLETLFPGRIDLGMGRAPGTDRLTSSLLNPSNDFAEESYLRQLDHLQNFFSDTAYTRDNRRILAVPQCETVPDQWILSSSGGSSLIAARFGLGLVVAKFINGFATREVIDTYKKNFKPSEYFPLPKAMLSIFVLCAETDTKVKEMRKFMDYIFIQFEKGNFHDFGDYETIQKYVFTQEELERINYNSGRIISGTPASVKQQLEKLAAEFDVDEIIISTMAGNAADRKRSFELIAQAFELTPAN

SEQ ID NO: 42444 - DNA, 987 bp, Silicibacter sp. TM1040
  CDS (1)..(987)
atgcgctattccgtcctcgatctcgccccggtgccagaaggcgccaccactgcagaggcgctcgccaatagcgccgacctcgcccgacacgccgaacgctggggctatcaccgctactggctggcggagcatcacaacatgcccggcattgcgagcgcggcaacggcggtgatgatcggccatattgcacaggcaacctcgaccatccgggttggcgcgggcggcatcatgctgcccaatcacgcgccctacatggtggccgaagcctttggtacccttgtagaaattcacggcgaccggatcgacctcggcgttgggcgcgcaccgggcacggatatggcggcgatgcgggcgatgcggcgcgggttgcaggactccggcgatcgcttccccgaggacgtgcaggagctcatctcccatctcggcccccgccgcacagagagcaatctgcgcgccatccccggtgagggcaccgaggttccagtctggatgctggggtcgagcctttacggggcacagctcgccgccatgctggggctgccttatgcctttgcctcgcattttgcgccccaagcgctctcgcaggcctttgaggtctatcgccgccagtttcgcccctcaaagacgctacaaaagccgcatgcgatgctggcggtcaacgtctttgccgccgccacggatgcagagggcatccggctgcgcaccaccatgcagcaagcctttgcccggttgcgccttggcaccccgggcaagctgcctgccccggtagagaatatcgcagatgtgctgacgccggacattcttgccggggtcaatcaggcgctgacgatttcggcggttggcgcaaaggacagtgtgcgcgaagatctggcacggctcattgagacctaccagcccgacgaggtgatcctgaccgggcagatccatgaccatgacgcgcggctgcgctcgtttgagatcgcggcagagatcctggggaacagctag

SEQ ID NO: 42445 - protein, 328 aa, Silicibacter sp. TM1040
MRYSVLDLAPVPEGATTAEALANSADLARHAERWGYHRYWLAEHHNMPGIASAATAVMIGHIAQATSTIRVGAGGIMLPNHAPYMVAEAFGTLVEIHGDRIDLGVGRAPGTDMAAMRAMRRGLQDSGDRFPEDVQELISHLGPRRTESNLRAIPGEGTEVPVWMLGSSLYGAQLAAMLGLPYAFASHFAPQALSQAFEVYRRQFRPSKTLQKPHAMLAVNVFAAATDAEGIRLRTTMQQAFARLRLGTPGKLPAPVENIADVLTPDILAGVNQALTISAVGAKDSVREDLARLIETYQPDEVILTGQIHDHDARLRSFEIAAEILGNS

SEQ ID NO: 42446 - DNA, 1020 bp, Psychrobacter sp. 273-4
  CDS (1)..(1020)
atgagtaaccctattcccttatctttcttagatttagcccctgttcctgagggtaaaactattgctgaaggcattgcccaaacggttgaaaccgcgcagcaagctgaaaaatctggcttaaaccgttactggatggcagagcatcataatatgcccggtatcgctagtgcagcgacgtcggtactactgtcgcatattggtgctcagaccaagcgtatacgtattggcgcaggcggcgtcatgctgcccaatcatgcaccgcttgttatcgcagagcagtttggtactttgcaagcattatatggcgaccgcatagatttggggttgggtcgtgcgcccggtacagatggtgcaacttttcaagcattacgtcgtcagatgcaagatgccgatcgctttccacaagatgtgcaagagttgatgtactttttggggaatggcacagatgatagcccagtacaggcatttccgggtgcaaaatctaacattcctatttggatattaggttcgtctctttttggtgcgaccttagcagcgcacttaggattgccatatgtgtttgcctcgcactttgcaccgcaaatgcttggacaagccattacagcttatcgtgagcaatttagaccatcggcctatttagataagccttatgtcatgctagcggcaaatttattgcttgctgatgatgatgcgacggcgcagtatcactttacttcagcccagcagagttttgtgcgtttacgccgtggtgaaacaggtcaaatgccaaagcctactcatgatatggatagtatctggaacgctgctgagaaaatgatggtggatagtgcgttgtcggtatcctttatcggctctgttgaaaccgtcaaaccaaagcttgcgacgtttcttgctacctatcagccagatgagctgattgtgacagcaaacgtttatgaccaagcagcacgtatgcgctcgcttgagcttgtctctgagcttaatttgtttgatttacaaccaacagcaacgcttgcataa

SEQ ID NO: 42447 - protein, 339 aa, Psychrobacter sp. 273-4
MSNPIPLSFLDLAPVPEGKTIAEGIAQTVETAQQAEKSGLNRYWMAEHHNMPGIASAATSVLLSHIGAQTKRIRIGAGGVMLPNHAPLVIAEQFGTLQALYGDRIDLGLGRAPGTDGATFQALRRQMQDADRFPQDVQELMYFLGNGTDDSPVQAFPGAKSNIPIWILGSSLFGATLAAHLGLPYVFASHFAPQMLGQAITAYREQFRPSAYLDKPYVMLAANLLLADDDATAQYHFTSAQQSFVRLRRGETGQMPKPTHDMDSIWNAAEKMMVDSALSVSFIGSVETVKPKLATFLATYQPDELIVTANVYDQAARMRSLELVSELNLFDLQPTATLA

SEQ ID NO: 42448 - DNA, 1020 bp, Rubrobacter xylanophilus DSM 9941
  CDS (1)..(1020)
atggccccagcgctgtccgtactggatctctcgccggttagcgccgggtcgggctcctcccgcgccctgcgcaacaccctggagctggcgcgcctcgccgaccggctcggctacgcccgctactggctcgccgagcaccacaacctcccgagcgtcgcgagccccgcgccggaggtcatgatcgggcacgtggcgaacgcgacggcccgcatccgggtcggggccggaggcatcatgctccccaaccacgccccgctgaaggtcgtcgagaccttccggctgctcgaggccctgcaccccgggcgcatagacctcgggatagggcgcgccccgggcaccgaccccgtcaccgcggccgccctgcgcaggggccggggggcggaggccgacgacttcccagagctcttcggcgagctcctggccttcgccggcgagggcttccccgagggacaccccttcgcctccgtgaaggccgtcccggaggacgcggagctgccccccatctggctcctcggctccagcggctactccgcgaaggccgccggggagatgggcctcggctacgccttcgcctcccacttcagccccgtggaccccgccccgccgatgctcgcctaccgcgagcacttccggccctcggagcgcttccccgagccccacgccatcctcgccgcctccgtggtctgcgccaggacgcgggagagggccgaggagctcgcctcctccatgggcctcgcctgggtgaggatgcgcaccggcaagcccggcccgctgccgagccccgaggaggcgctctcctacccctacagccccgcggagcggcgcctgctcgagagctaccgctccatgcaggtcgtcggcgacccggcgtccgtccgaaagaggctcgcggagatggcggagagaaccgcggccgaggaggtcatggtcaccaccatggtctacgaccacgaggccaggctccgctcctacgagctcctggcggaggccttcgggctcggccagcgtcgggagagctag

SEQ ID NO: 42449 - protein, 339 aa, Rubrobacter xylanophilus DSM 9941
MAPALSVLDLSPVSAGSGSSRALRNTLELARLADRLGYARYWLAEHHNLPSVASPAPEVMIGHVANATARIRVGAGGIMLPNHAPLKVVETFRLLEALHPGRIDLGIGRAPGTDPVTAAALRRGRGAEADDFPELFGELLAFAGEGFPEGHPFASVKAVPEDAELPPIWLLGSSGYSAKAAGEMGLGYAFASHFSPVDPAPPMLAYREHFRPSERFPEPHAILAASVVCARTRERAEELASSMGLAWVRMRTGKPGPLPSPEEALSYPYSPAERRLLESYRSMQVVGDPASVRKRLAEMAERTAAEEVMVTTMVYDHEARLRSYELLAEAFGLGQRRES

SEQ ID NO: 42450 - DNA, 1002 bp, Polaromonas sp. JS666
  CDS (1)..(1002)
atgcttagcctgtctgttcttgaccagtcggtggccgtcagcggccgtactgaagatgcctccatccgtgaaaccctggcgctggcccggcactgtgaagccctgggttaccaccgcttctgggtgagcgaacaccacagtcaccccagcatcgtcggctcggcccccgaggtgctgatggcggcgattgccgccaccacccagcgcatgcgcgtgggcagcgccggcgtcatgctgccgcactatgcggcgctcaaggtggccgagcagtttcgtgtgctggaggcgctggcgcccgggcgcattgacctgggcgtggggcgcgcgccaggttcggacatgcgcaccgcgcggcttttgagggctgacccgcaccaggcggcggaaaattttccggtgcaggtgcgcgagttgcaggcctgggtgtcgggggtcgatttgccggaaggtcatcccgggcatggcgtcaccgccaaccccatggggcccaccacccccgagttgtggatgctgggcagctccgactatggtgcgcagctggcggcacactacggcctgccctacgcctttgcgcacttcatcaccgacggacggggtgcgcagcaggcgctggatttatatcgccggctgtaccagcccagcccgcgccatcccgagccgcaggctgtgctgtgcgtctgggccctggcggccgataccgaggcagaggcctggcatcatttttcgggccgcgagcgctggaaaatcgacaggaacaaaggcgcgctggggccgctgctttctccagccgaggtggcgctgcggccctatagcgaagccgagcagccggagcttgcccaactcaggcagactgcgctggtgggcagcgggccgcaggtggccgcgaggctgcgcagcctggccgatacactggaggttgaagaactggcggtgatcacctggacccacgatccggcggcgcgccggcgctcctacgaattgctggcccgcgagtttgtgtga

SEQ ID NO: 42451 - protein, 333 aa, Polaromonas sp. JS666
MLSLSVLDQSVAVSGRTEDASIRETLALARHCEALGYHRFWVSEHHSHPSIVGSAPEVLMAAIAATTQRMRVGSAGVMLPHYAALKVAEQFRVLEALAPGRIDLGVGRAPGSDMRTARLLRADPHQAAENFPVQVRELQAWVSGVDLPEGHPGHGVTANPMGPTTPELWMLGSSDYGAQLAAHYGLPYAFAHFITDGRGAQQALDLYRRLYQPSPRHPEPQAVLCVWALAADTEAEAWHHFSGRERWKIDRNKGALGPLLSPAEVALRPYSEAEQPELAQLRQTALVGSGPQVAARLRSLADTLEVEELAVITWTHDPAARRRSYELLAREFV

SEQ ID NO: 42452 - DNA, 954 bp, Corynebacterium glutamicum
  CDS (1)..(954)
ttgagcgtgcttgatctcgtcgcgctgagtgaagggatgacggccggcgaggccattgcacacagtgttcgcgctgcgcagatcgccgaagagcacaattatgcgcgtttctgggtggcggagcaccacaactcggaaggcttggcatcttccgcgacgacgctgctcatgggtcatattgcaggccacacttcacgcattcgcgttggctccggtggcatcatgatgcccaaccactccgcgctgcacgtcgccgaagaactcggcacccttgaggccatttaccccggccgcatcgaggccggcctagggcgcgcaccaggaaccgaccccatgacggcgcgggaattgggtcgggcaagttcgcttgtcgacgacgtcctctccacaatcgtctccctccagaattatttggacacccccgaagaacgcccgaacatcatcgcgcatccaggaataaattcccgtgtgccgctattcatgctgggatcttccctcaacggcgctgcgatggccgctaaattagaccttccattcgccttcgccagccacttcgcacccttccaaatggggcccgccatcgcctcctatcgcgaactagcagccaatccttatgtcatggccgcagcgaatgtcctggtgtgcgacaccgaggaagaagccgaattccagatctccacactgcaccaaatgttcgccggaatcgtgacgaactcccgcggcaaacttgccccaccagtgcggaatctgaaagacaaactcgacccgatgatctggaaacacatcgaagattcattggaaatgactttcatcggaacagccgaatcagtggtattacaactgcaggaattcgctgatcgctacaagttagatgagatcattacagtcacctactcctacgaccccgaagtcaggttccgctccatagctgcacttggcacggcatggaattag

SEQ ID NO: 42453 - protein, 317 aa, Corynebacterium glutamicum
MSVLDLVALSEGMTAGEAIAHSVRAAQIAEEHNYARFWVAEHHNSEGLASSATTLLMGHIAGHTSRIRVGSGGIMMPNHSALHVAEELGTLEAIYPGRIEAGLGRAPGTDPMTARELGRASSLVDDVLSTIVSLQNYLDTPEERPNIIAHPGINSRVPLFMLGSSLNGAAMAAKLDLPFAFASHFAPFQMGPAIASYRELAANPYVMAAANVLVCDTEEEAEFQISTLHQMFAGIVTNSRGKLAPPVRNLKDKLDPMIWKHIEDSLEMTFIGTAESVVLQLQEFADRYKLDEIITVTYSYDPEVRFRSIAALGTAWN

SEQ ID NO: 42454 - DNA, 981 bp, uncultured bacterium 311
  CDS (1)..(981)
gtgaagataagtgcagttgatcagtctccaattttttcgaacacaaatgcaaactcagcaattagagagaccattgagctagctaaattctgtgattctattggcatgcatcgattttgggttgctgagcaccatggttctgattcttttgcgggctgttctcctgaaatttttattccgtccttagctaacgagaccagttctattcgaataggttcgggaggggttatgttgatgcattacagcccttacaaggttgcagaaaattttagacttttagaatctttatatcctggaaggatagatctaggattaggaagagctcctggaagcaatcccattcaagctggggcattagcttacggttctaagaccactggtcctgaattttttactacaaaaatgaatgacttaaagtcttttttgataggagagaatcccgaaacagaggcttttgaatcagtagatgtaactcctggtttaggcagcttacctgagacatggctcttagtttcttctgaaaacggagctgacttagcagccctttttggtttgcccatgtccctagctcattttattgaacaagattgtcttcatttagcagatcgttacagaaaaaactttaaaccttctgtattttctaatgatccaaaagtaagtgttggtatttttgctatatgcgcagaaagtgatgaagaggccttaagactatctgcaagcgcttctgcttggagaagaagagtccagtcaggaaaagcttctagctttcctttagtagaggaggctctcagcgaaataaatatagagtctctgggtaaaggagaaactagaccatttgttggatctcaagatactatttacgagagactaaagcctttaattaagaaagtagatccagaggagttaaaaataattacaatttgtgaaccttttgatgacaaagctaaatcttataaattaattaaagatttatttgattaa

SEQ ID NO: 42455 - protein, 326 aa, uncultured bacterium 311
MKISAVDQSPIFSNTNANSAIRETIELAKFCDSIGMHRFWVAEHHGSDSFAGCSPEIFIPSLANETSSIRIGSGGVMLMHYSPYKVAENFRLLESLYPGRIDLGLGRAPGSNPIQAGALAYGSKTTGPEFFTTKMNDLKSFLIGENPETEAFESVDVTPGLGSLPETWLLVSSENGADLAALFGLPMSLAHFIEQDCLHLADRYRKNFKPSVFSNDPKVSVGIFAICAESDEEALRLSASASAWRRRVQSGKASSFPLVEEALSEINIESLGKGETRPFVGSQDTIYERLKPLIKKVDPEELKIITICEPFDDKAKSYKLIKDLFD

SEQ ID NO: 42456 - DNA, 1035 bp, Yersinia enterocolitica
  CDS (1)..(1035)
atggacgattctatgactgacaaaaaaactgtaccgctttctgttctcgatttatcaccgatagctcagggcaagacgccacaagatgcatttcgcgcctcgctggacttggctcaacatgctgaaaagtggggataccatcgctactggctggctgaacatcataatatgaccggtattgccagtgctgcgacctctgtgctaattggctatattgccggtggcaccagcaccatccgcgtcggttcaggtggtattatgctgccaaaccattcgccattagtgatagctgagcagtttggtaccctcgcctcgctgtaccctggccgtatcgacctcggtctgggccgggcacctggcactgatcagcgcaccatgatggcactacgccgacacctctccggtgaggtagataacttcccgtctgacgtgcgcgaactgcaaaactactttgccgaggtgcaacctgggcaagcagtccaagcggttcccggtcaaggtttgcatattcctctgtggctgctgggttccagcctgtatagcgcgcaactggcagcggctatggggctacctttcgctttcgcttcgcattttgcgccggacatgctattccaggcgcttaaattgtatcgcgaaaacttcaaaccctccgctcaatggccgcaaccttatgcgattgtgtgtgtgaatgtcgccgccgcagacaacgagcgtgatgcccgtttcttgtttacctcgatgcagcagcagtttgtcaatttgcgccgtggcacaccggggcagcttcctccgccagtcgaagatatggcgaaaatctgctcgccagctgaacagtttggtattgatcaagcactgcgtctgtccattattggtgataagagtaaagtccgacacgggcttcagtcgttattgcgtgaaactcaggctgatgagttaatggtgaatggccagatctttgatcaccaggcgagattatattcatttgagatagttgccagcctgcaacaagacttgcaacttggcgagtatctctaa

SEQ ID NO: 42457 - protein, 344 aa, Yersinia enterocolitica
MDDSMTDKKTVPLSVLDLSPIAQGKTPQDAFRASLDLAQHAEKWGYHRYWLAEHHNMTGIASAATSVLIGYIAGGTSTIRVGSGGIMLPNHSPLVIAEQFGTLASLYPGRIDLGLGRAPGTDQRTMMALRRHLSGEVDNFPSDVRELQNYFAEVQPGQAVQAVPGQGLHIPLWLLGSSLYSAQLAAAMGLPFAFASHFAPDMLFQALKLYRENFKPSAQWPQPYAIVCVNVAAADNERDARFLFTSMQQQFVNLRRGTPGQLPPPVEDMAKICSPAEQFGIDQALRLSIIGDKSKVRHGLQSLLRETQADELMVNGQIFDHQARLYSFEIVASLQQDLQLGEYL

SEQ ID NO: 42458 - DNA, 942 bp, Bacillus subtilis
  CDS (1)..(942)
gtgacaactctccagcattcggttgagcttgcccaattaagcgaacagtggggctataagcgttattggtttgccgagcatcacagcacgaaaggactggcaagcacagcgcctgaaatcatgatcgcccgcatcgcagcacagacaaacaccattcgtgtcggatcaggcggcgtgcttctgccccaatacagcccatttaaagtggctgaaacctttcgccagcttgaggccctgtatccaaaccggattgacctcggcgtcggtcgctcccccggcggcacgacaaaaaccagacttgcattaacggacggggtgaaaaaaagcttaaccgaatttaacagacagctgcaggatgtctcttattttctaacagattcccttcctcccgaccatccgtatgccggaatcaaagcggcgccccttattggtacggcacccgagctatgggtgctcggtcttggtgaaaacagcgcaagacgcgcggcgcaccaggggattggatatgtatttgggcatttcattaatcccgagcgaggagaaaatgcattccgcatctaccgggaaagctttcggccctcagcccatttttcgaatccatccgcactgtttacgatttttgtcatttgcgcaaaaacagatgaagaggcagaagaactcgcattaagccaggatctgtggcttcttcgcgtcggaaaaggcttggacagccgcgtgccaagcatcgaggaagcgaaagctcatccctatacagcgtccgataaaaaactcatagaagaaaacagaaagcggatggtgatcggttctcccaccactgtcaaacaacagctgttagacctcacaggctgctacgaaacaaatgaaatcatggttctgtgcaatgtgtttgattttgaggcgaaaaaagaatcttatgagcgccttgccgaattgtttctataa

SEQ ID NO: 42459 - protein, 313 aa, Bacillus subtilis
MTTLQHSVELAQLSEQWGYKRYWFAEHHSTKGLASTAPEIMIARIAAQTNTIRVGSGGVLLPQYSPFKVAETFRQLEALYPNRIDLGVGRSPGGTTKTRLALTDGVKKSLTEFNRQLQDVSYFLTDSLPPDHPYAGIKAAPLIGTAPELWVLGLGENSARRAAHQGIGYVFGHFINPERGENAFRIYRESFRPSAHFSNPSALFTIFVICAKTDEEAEELALSQDLWLLRVGKGLDSRVPSIEEAKAHPYTASDKKLIEENRKRMVIGSPTTVKQQLLDLTGCYETNEIMVLCNVFDFEAKKESYERLAELFL

SEQ ID NO: 42460 - DNA, 1020 bp, Bacillus subtilis
  CDS (1)..(1020)
atgaaaaaatttgatatatctgttttatcagttgctccattaagacaaggagaaacaatgaaacaagggattgattctgcagtgtcattagctaaagctgtagataatatgggctataaacggatttggtttgcagagcatcataatcacgacgcttatgcaagtgcagcaaccgtatcaattgtacaacatatattagcaaatacaaaagacattcgcgtaggttcagggggtattatgttgccaaatcattccccattaatcgtagcggagcaatttggaacacttgaaacattatatccaaatcgtgtagatttggcattaggacgcgcacccggaacggatcaaaaaacggccgatgtgattcgtcgttccaaccataatggagtgtttttctttgaaagagaagtaaatgatattttgcgttttgtcggggataagagtgtacagggtgaggttcgcgcttatccgggtattggaacgcatgtgcctgtttttgtgttaggatcctcaacggattcagcggaaattgctgcaaagcttggtttaccctatgcatttggcgctcaattttcaccccattcgatggaagaagcgctctctatttatcgagaaaatttccaaccgtcttcttatttacaagaaccttatgtgatcgcttgcattaatgtgattgcagcagaatctatagacgaggcatcttttatttctgcaagtcatttgcaggtgtatattgatatttatacaaataatttaagtaagcttattccacccactgaaaacttcctagaatcgttatcacagtttgaattagaaattctccacagtcgactggggtatacaatcatgggtgatcgagaaacaattcgtcgcgaactaattgatttccaacaaatgtatcacgcagatgaattaattgtgttatctaatatttacgaattgagcaaggaaattcagtcgtacgagattttaaaacaggttgtggatgagttgtttaaaaaaagaatggagcaactttag

SEQ ID NO: 42461 - protein, 339 aa, Bacillus subtilis
MKKFDISVLSVAPLRQGETMKQGIDSAVSLAKAVDNMGYKRIWFAEHHNHDAYASAATVSIVQHILANTKDIRVGSGGIMLPNHSPLIVAEQFGTLETLYPNRVDLALGRAPGTDQKTADVIRRSNHNGVFFFEREVNDILRFVGDKSVQGEVRAYPGIGTHVPVFVLGSSTDSAEIAAKLGLPYAFGAQFSPHSMEEALSIYRENFQPSSYLQEPYVIACINVIAAESIDEASFISASHLQVYIDIYTNNLSKLIPPTENFLESLSQFELEILHSRLGYTIMGDRETIRRELIDFQQMYHADELIVLSNIYELSKEIQSYEILKQVVDELFKKRMEQL

SEQ ID NO: 42462 - DNA, 1005 bp, Bacillus subtilis
  CDS (1)..(1005)
atgatccgcttaagtattttagaccaaagcttgattggtgaaggggagacagcagctgatacattacagcatacagtgaaattggcacaaatggctgaagaatgtggatatcaccgattttgggtggccgaacatcacaacaatgatgagattgcagggtctgcacccgaggttcttttaggctatcttgctgcaagcacaagaaaaattcgtttagcatcaggcggagtgatgctgcagcattacagctcttataaagtagcggagcaattccatcttctatcagcgttagctcccggccgtatagatcttggagtgggcaaagcgcccggcgggtttcagctgtccacagacgcgctgcaggccgaatataaaaaaccggtgcgtcagtttgatgaaaaactggaggagcttactcatttcgttcgggatgattttcctgatacccaccgctatgccgcattgcgtcctaggccgcaggttgatcggaagccgggtatttttctattgggaggaagcacagagagtgccatttctgctgcaaaactgggaatctcttttgtctttgcttactttattaacggtgaagaggaagtgctgaaggaagcccgccgagcatttgacgcgcatctcccgccaggatctgaggctgaatttcatcttgcccccgctgtttttgcggcacatacaaaagaagaagcggaaaaacatattgtgtcgcgtgaatcgataaaagtggttttgaaagacgggcgtaaggtcaacgtcggttcccgcgaacaggctgaggcctatctggaaaacgtcacagagccctatgacatcatcgtgcaaaaaaccgggattattgccggaacaaaggaagaagtggcagaagaattaacacgtttatcaggcacatacaaaatcaatgattttgttatttttacaccgatcaaaaatgctgtagaaaaacagctgtcttatcagctgctgagcgatgcagttttagctgcaaaacgttaa

SEQ ID NO: 42463 - protein, 334 aa, Bacillus subtilis
MIRLSILDQSLIGEGETAADTLQHTVKLAQMAEECGYHRFWVAEHHNNDEIAGSAPEVLLGYLAASTRKIRLASGGVMLQHYSSYKVAEQFHLLSALAPGRIDLGVGKAPGGFQLSTDALQAEYKKPVRQFDEKLEELTHFVRDDFPDTHRYAALRPRPQVDRKPGIFLLGGSTESAISAAKLGISFVFAYFINGEEEVLKEARRAFDAHLPPGSEAEFHLAPAVFAAHTKEEAEKHIVSRESIKVVLKDGRKVNVGSREQAEAYLENVTEPYDIIVQKTGIIAGTKEEVAEELTRLSGTYKINDFVIFTPIKNAVEKQLSYQLLSDAVLAAKR

SEQ ID NO: 42464 - DNA, 1011 bp, Bacillus subtilis
  CDS (1)..(1011)
atgtctaacaaccaacgcaaagataccttgctttctgtcttgaatttatctccggttgttcagggaggaacgattgcagaatcattccgaaacagcatggacttggcgcgccgggcagaggaatggggctatcaccgttactggcttgctgaacatcataatatagaaggtgttgcaagctctgccaccgcagttttgattggccatattgccggaggcacgaagaaaatccgcgtcggttccggcggcattatgctccccaaccactcttcattagtcattgctgaacaattcggcacactggaaacactgtatcccgggcggattgatctggggcttggacgtgcgccgggaacagaccaattgacagccagagcgctccgcagaaacatcaacagcggggaggattttccagaacaattagaggaactgcgcaattattttaaaccgtcaggaaatgtgcgcaatcaagttcgcgccattcccggagagggcatagatgtgccgatttggctgctgggctcaagcggcttcagcgcccgtctggctggcgaacttggtcttccgtttgcgttcgcggcccatttctcaccggcgaatacggttcccgctttggagctgtaccgcaattccttcacgccgtcagacgtgctcgacgaaccgtatgcgatggtcggtgtcaccattatcgcggcagatacaaacgagaaagcgcagcaccttgcgacttcccattatcaaaggtttcttgatcttgtccgcggtacgcctaaccagcttaaaccgcctgttgaggatatggaccaaatctggagcccgtatgaaaaagcgatggtcaatgagcagctgagctccacgattgtcggaggtccggaagaagtgaaggcgaagcttgaagatttcgtcaaaacgacacaggctgacgaaattatggttaactcagaaacctttgaacacgcagacagaatgcgttcgtttgaaatcatcgctgacgtttggaaaaacagataa

SEQ ID NO: 42465 - protein, 336 aa, Bacillus subtilis
MSNNQRKDTLLSVLNLSPVVQGGTIAESFRNSMDLARRAEEWGYHRYWLAEHHNIEGVASSATAVLIGHIAGGTKKIRVGSGGIMLPNHSSLVIAEQFGTLETLYPGRIDLGLGRAPGTDQLTARALRRNINSGEDFPEQLEELRNYFKPSGNVRNQVRAIPGEGIDVPIWLLGSSGFSARLAGELGLPFAFAAHFSPANTVPALELYRNSFTPSDVLDEPYAMVGVTIIAADTNEKAQHLATSHYQRFLDLVRGTPNQLKPPVEDMDQIWSPYEKAMVNEQLSSTIVGGPEEVKAKLEDFVKTTQADEIMVNSETFEHADRMRSFEIIADVWKNR

SEQ ID NO: 42466 - DNA, 1002 bp, Bacillus subtilis
  CDS (1)..(1002)
atggtttcattaagtatattagatcaatctccagtatcagagggcagcaatgcagaaacggccttacagcaaaccgttgcgcttgcccaagctgctgaggaccttggatataagagattttgggtttctgagcatcacttttcaaaacggctggcagggtccagtcctgaggtgctaatcagtcatatagcagcgaaaacaaagcgaattcgtgttggatcaggaggagtcatgctgccgcattacagtgcttataaagtagctgaaaactttcgtgttctggaggggctgacaccaggaagaattgacctggggcttggcagagcaccggggggaatgccgattgcatcatgggcgctgaatgacggtggtaagcgcaatgctgatcagtatccgcagcaaattaaggagctgaccatgtatttgcatgatttggcggatgacaaacaccgttttccgaatctgaccgctgcgccgcatatttcaacggctccggatgtgtggctgctcggctcatctggagaaagcgcgctgctcgcagctgaatctggcgctggctatatgtttgcccattttatcaatggagagggcggagagggtactgtcagacagtataagaggcgattcaaaccgtctgtgttaggagatacgcctcgagcggcagttgctgtttttgttctttgtgctgacacggaggagaaggcagaggagcttggggctgtgcttgattttacacttttggcgggagagcagggtattcctttagagggagttccttcgtatgaagctgttcggaaaaatacgtattctccttatgaacagagacgaattgctgataatcgaaatcgaatgattgttggtacgaaagaacaggttaaggagcggctgttagctttgagtaacgcgtatgaaacagaggaaatcatggtggtgaccatcacgcatcattttgaagataagctccgatcgtatcgcttattgcaggaggcgtttgctgactga

SEQ ID NO: 42467 - protein, 333 aa, Bacillus subtilis
MVSLSILDQSPVSEGSNAETALQQTVALAQAAEDLGYKRFWVSEHHFSKRLAGSSPEVLISHIAAKTKRIRVGSGGVMLPHYSAYKVAENFRVLEGLTPGRIDLGLGRAPGGMPIASWALNDGGKRNADQYPQQIKELTMYLHDLADDKHRFPNLTAAPHISTAPDVWLLGSSGESALLAAESGAGYMFAHFINGEGGEGTVRQYKRRFKPSVLGDTPRAAVAVFVLCADTEEKAEELGAVLDFTLLAGEQGIPLEGVPSYEAVRKNTYSPYEQRRIADNRNRMIVGTKEQVKERLLALSNAYETEEIMVVTITHHFEDKLRSYRLLQEAFAD

SEQ ID NO: 42468 - DNA, 26 bp, Primer
atgactgataaaaccattgcgttttc

SEQ ID NO: 42469 - DNA, 26 bp, Primer
ttatcccaacaactcttccttaacat

SEQ ID NO: 42470 - protein, 413 aa, consensus
  MISC_FEATURE (1)..(413): consensus for the disclosure of xaa see table XV
SXLDXXXXXXGXXXXXAXXXXXXLAXXXXXXGYXRXWXAEHHXXXXXXXXXXXXXXXXXXXXXTXXIRXGXGGXMLPXXXPXXXAEXFXXLXXLXPXRXDLGXGRAXXXXXXXXXXXXXXXXXXPGXXXXXXXALXXXXXXXXXXXXXXXXXXXXXXXXXXXXXXXXXXXXXXXXXXXFXXXXXXLXXXXXXXXXXXXXXXXXXXXXXXPXXXXXXXXXXXXXXXXXXXXXLGXSXXXXAXXAAXXGXXXXFAXXXXXXXXXXXXXXXXYRXXXXXXXXXXXXXXPXXXXXXXXXXAXXXXXAXXXXXXXXXXXXXXXXGXXXXXXXXXXXXXXXXXXXXXXXXXXXXXXXXXXXXXXXXXXXXXXXXXXXXXXXGXXXXVXXXXXXXXXXXXXXXEXXXXXXXXXXXXXXXS

SEQ ID NO: 42471 - protein, 82 aa, consensus
  MISC_FEATURE (1)..(82): consensus for the disclosure of xaa see table XV
XXXXXXXXXXXXWXXEHHXXXXXXXXXXXXXXXXXXXXXTXXXXXXXXXXXXXXXXXXXXXEXXXXXXXXXXXRXXXXXGXX

SEQ ID NO: 42472 - protein, 26 aa, consensus
  MISC_FEATURE (1)..(26): consensus for the disclosure of xaa see table XV
XXXXXXXXXXXXXAXXXXXXXXXXXX

SEQ ID NO: 42473 - DNA, 725 bp, Escherichia coli K12; identical to SEQ ID NO: 31626
  CDS (4)..(432)

SEQ ID NO: 42474 - protein, 142 aa, Escherichia coli K12 [sequence omitted]

SEQ ID NO: 42475 - DNA, 982 bp, Spinacia oleracea (spinach); identical to SEQ ID NO: 31628
  CDS (40)..(792)

SEQ ID NO: 42476 - protein, 250 aa, Spinacia oleracea (spinach); identical to SEQ ID NO: 31629

SEQ ID NO: 42477 - DNA, 444 bp, Mycobacterium tuberculosis; identical to SEQ ID NO: 31630
  CDS (1)..(444)

SEQ ID NO: 42478 - protein, 147 aa, Mycobacterium tuberculosis; identical to SEQ ID NO: 31631

SEQ ID NO: 42479 - DNA, 453 bp, Chlamydia trachomatis; identical to SEQ ID NO: 31632
  CDS (1)..(453)

SEQ ID NO: 42480 - protein, 150 aa, Chlamydia trachomatis; identical to SEQ ID NO: 31633

SEQ ID NO: 42481 - DNA, 429 bp, Pseudomonas aeruginosa; identical to SEQ ID NO: 31634
  CDS (1)..(429)

SEQ ID NO: 42482 - protein, 142 aa, Pseudomonas aeruginosa; identical to SEQ ID NO: 31635

SEQ ID NO: 42483 - DNA, 474 bp, Caulobacter crescentus; identical to SEQ ID NO: 31636
  CDS (1)..(474)

SEQ ID NO: 42484 - protein, 157 aa, Caulobacter crescentus; identical to SEQ ID NO: 31637

SEQ ID NO: 42485 - DNA, 757 bp, Arabidopsis thaliana (mouse-ear cress); identical to SEQ ID NO: 31638
  CDS (1)..(726)

SEQ ID NO: 42486 - protein, 241 aa, Arabidopsis thaliana (mouse-ear cress); identical to SEQ ID NO: 31639

SEQ ID NO: 42487 - DNA, 465 bp, Agrobacterium tumefaciens; identical to SEQ ID NO: 31640
  CDS (1)..(465)

SEQ ID NO: 42488 - protein, 154 aa, Agrobacterium tumefaciens; identical to SEQ ID NO: 31641

SEQ ID NO: 42489 - DNA, 465 bp, Brucella melitensis; identical to SEQ ID NO: 31642
  CDS (1)..(465)

SEQ ID NO: 42490 - protein, 154 aa, Brucella melitensis; identical to SEQ ID NO: 31643

SEQ ID NO: 42491 - DNA, 438 bp, Listeria monocytogenes; identical to SEQ ID NO: 31644
  CDS (1)..(438)

SEQ ID NO: 42492 - protein, 145 aa, Listeria monocytogenes; identical to SEQ ID NO: 31645

SEQ ID NO: 42493 - DNA, 456 bp, Nostoc sp. PCC 7120; identical to SEQ ID NO: 31646
  CDS (1)..(456)

SEQ ID NO: 42494 - protein, 151 aa, Nostoc sp. PCC 7120; identical to SEQ ID NO: 31647

SEQ ID NO: 42495 - DNA, 438 bp, Haloarcula marismortui; identical to SEQ ID NO: 31648
  CDS (1)..(438)

SEQ ID NO: 42496 - protein, 145 aa, Haloarcula marismortui; identical to SEQ ID NO: 31649

SEQ ID NO: 42497 - DNA, 441 bp, Mycoplasma genitalium; identical to SEQ ID NO: 31650
  CDS (1)..(441)

SEQ ID NO: 42498 - protein, 146 aa, Mycoplasma genitalium; identical to SEQ ID NO: 31651

SEQ ID NO: 42499 - DNA, 441 bp, Borrelia burgdorferi (Lyme disease spirochete); identical to SEQ ID NO: 31652
  CDS (1)..(441)

SEQ ID NO: 42500 - protein, 146 aa, Borrelia burgdorferi (Lyme disease spirochete); identical to SEQ ID NO: 31653

SEQ ID NO: 42501 - DNA, 429 bp, Pyrococcus horikoshii; identical to SEQ ID NO: 31654
  CDS (1)..(429)

SEQ ID NO: 42502 - protein, 142 aa, Pyrococcus horikoshii; identical to SEQ ID NO: 31655

SEQ ID NO: 42503 - DNA, 432 bp, Neisseria meningitidis; identical to SEQ ID NO: 31656
  CDS (1)..(432)

SEQ ID NO: 42504 - protein, 143 aa, Neisseria meningitidis; identical to SEQ ID NO: 31657

SEQ ID NO: 42505 - DNA, 429 bp, Vibrio cholerae; identical to SEQ ID NO: 31658
  CDS (1)..(429)

SEQ ID NO: 42506 - protein, 142 aa, Vibrio cholerae; identical to SEQ ID NO: 31659

SEQ ID NO: 42507 - DNA, 423 bp, Methanococcus jannaschii; identical to SEQ ID NO: 31660
  CDS (1)..(423)

SEQ ID NO: 42508 - protein, 140 aa, Methanococcus jannaschii; identical to SEQ ID NO: 31661

SEQ ID NO: 42509 - DNA, 435 bp, Clostridium acetobutylicum; identical to SEQ ID NO: 31662
  CDS (1)..(435)

SEQ ID NO: 42510 - protein, 144 aa, Clostridium acetobutylicum; identical to SEQ ID NO: 31663

SEQ ID NO: 42511 - DNA, 483 bp, Helicobacter pylori; identical to SEQ ID NO: 31664
  CDS (19)..(444)

SEQ ID NO: 42512 - protein, 141 aa, Helicobacter pylori; identical to SEQ ID NO: 31665

SEQ ID NO: 42513 - DNA, 429 bp, Treponema pallidum subsp. pallidum (syphilis spirochete); identical to SEQ ID NO: 31666
  CDS (1)..(429)

SEQ ID NO: 42514 - protein, 142 aa, Treponema pallidum subsp. pallidum (syphilis spirochete); identical to SEQ ID NO: 31667

SEQ ID NO: 42515 - DNA, 849 bp, Methanobacterium thermoautotrophicum; identical to SEQ ID NO: 31668
  CDS (1)..(849)

SEQ ID NO: 42516 - protein, 282 aa, Methanobacterium thermoautotrophicum; identical to SEQ ID NO: 31669

SEQ ID NO: 42517 - DNA, 525 bp, Deinococcus radiodurans; identical to SEQ ID NO: 31670
  CDS (1)..(525)

SEQ ID NO: 42518 - protein, 174 aa, Deinococcus radiodurans; identical to SEQ ID NO: 31671

SEQ ID NO: 42519 - DNA, 426 bp, Campylobacter jejuni; identical to SEQ ID NO: 31672
  CDS (1)..(426)

SEQ ID NO: 42520 - protein, 141 aa, Campylobacter jejuni; identical to SEQ ID NO: 31673

SEQ ID NO: 42521 - DNA, 447 bp, Ureaplasma urealyticum; identical to SEQ ID NO: 31674
  CDS (1)..(447)

SEQ ID NO: 42522 - protein, 148 aa, Ureaplasma urealyticum; identical to SEQ ID NO: 31675

SEQ ID NO: 42523 - DNA, 438 bp, Staphylococcus aureus; identical to SEQ ID NO: 31676
  CDS (1)..(438)

SEQ ID NO: 42524 - protein, 145 aa, Staphylococcus aureus; identical to SEQ ID NO: 31677

SEQ ID NO: 42525 - DNA, 522 bp, Plasmodium falciparum; identical to SEQ ID NO: 31678
  CDS (1)..(522)

SEQ ID NO: 42526 - protein, 173 aa, Plasmodium falciparum; identical to SEQ ID NO: 31679

SEQ ID NO: 42527 - DNA, 468 bp, Rickettsia prowazekii; identical to SEQ ID NO: 31680
  CDS (1)..(468)

SEQ ID NO: 42528 - protein, 155 aa, Rickettsia prowazekii; identical to SEQ ID NO: 31681

SEQ ID NO: 42529 - DNA, 429 bp, Xylella fastidiosa; identical to SEQ ID NO: 31682
  CDS (1)..(429)

SEQ ID NO: 42530 - protein, 142 aa, Xylella fastidiosa; identical to SEQ ID NO: 31683

SEQ ID NO: 42531 - DNA, 438 bp, Halobacterium sp. NRC-1; identical to SEQ ID NO: 31684
  CDS (1)..(438)

SEQ ID NO: 42532 - protein, 145 aa, Halobacterium sp. NRC-1; identical to SEQ ID NO: 31685

SEQ ID NO: 42533 - DNA, 429 bp, Buchnera sp; identical to SEQ ID NO: 31686
  CDS (1)..(429)

SEQ ID NO: 42534 - protein, 142 aa, Buchnera sp; identical to SEQ ID NO: 31687

SEQ ID NO: 42535 - DNA, 447 bp, Lactococcus lactis subsp. lactis; identical to SEQ ID NO: 31688
  CDS (1)..(447)

SEQ ID NO: 42536 - protein, 148 aa, Lactococcus lactis subsp. lactis; identical to SEQ ID NO: 31689

SEQ ID NO: 42537 - DNA, 429 bp, Haemophilus influenzae; identical to SEQ ID NO: 31690
  CDS (1)..(429)

SEQ ID NO: 42538 - protein, 142 aa, Haemophilus influenzae; identical to SEQ ID NO: 31691

SEQ ID NO: 42539 - DNA, 471 bp, Archaeoglobus fulgidus; identical to SEQ ID NO: 31692
  CDS (1)..(471)

SEQ ID NO: 42540 - protein, 156 aa, Archaeoglobus fulgidus; identical to SEQ ID NO: 31693

SEQ ID NO: 42541 - DNA, 438 bp, Bacillus subtilis; identical to SEQ ID NO: 31694
  CDS (1)..(438)

SEQ ID NO: 42542 - protein, 145 aa, Bacillus subtilis; identical to SEQ ID NO: 31695

SEQ ID NO: 42543 - DNA, 450 bp, Thermotoga maritima; identical to SEQ ID NO: 31696
  CDS (1)..(450)

SEQ ID NO: 42544 - protein, 149 aa, Thermotoga maritima; identical to SEQ ID NO: 31697

SEQ ID NO: 42545 - DNA, 468 bp, Aeropyrum pernix; identical to SEQ ID NO: 31698
  CDS (1)..(468)

SEQ ID NO: 42546 - protein, 155 aa, Aeropyrum pernix; identical to SEQ ID NO: 31699

SEQ ID NO: 42547 - DNA, 450 bp, Chlamydophila pneumoniae, Chlamydia pneumoniae; identical to SEQ ID NO: 31700
  CDS (1)..(450)

SEQ ID NO: 42548 - protein, 149 aa, Chlamydophila pneumoniae, Chlamydia pneumoniae; identical to SEQ ID NO: 31701

SEQ ID NO: 42549 - DNA, 435 bp, Mycoplasma pulmonis; identical to SEQ ID NO: 31702
  CDS (1)..(435)

SEQ ID NO: 42550 - protein, 144 aa, Mycoplasma pulmonis; identical to SEQ ID NO: 31703

SEQ ID NO: 42551 - DNA, 447 bp, Streptococcus pneumoniae; identical to SEQ ID NO: 31704
  CDS (1)..(447)

SEQ ID NO: 42552 - protein, 148 aa, Streptococcus pneumoniae; identical to SEQ ID NO: 31705

SEQ ID NO: 42553 - DNA, 435 bp, Aquifex aeolicus; identical to SEQ ID NO: 31706
  CDS (1)..(435)

SEQ ID NO: 42554 - protein, 144 aa, Aquifex aeolicus; identical to SEQ ID NO: 31707

SEQ ID NO: 42555 - DNA, 438 bp, Bacillus halodurans; identical to SEQ ID NO: 31708
  CDS (1)..(438)

SEQ ID NO: 42556 - protein, 145 aa, Bacillus halodurans; identical to SEQ ID NO: 31709

SEQ ID NO: 42557 - DNA, 438 bp, Staphylococcus carnosus; identical to SEQ ID NO: 31710
  CDS (1)..(438)

SEQ ID NO: 42558 - protein, 145 aa, Staphylococcus carnosus; identical to SEQ ID NO: 31711

SEQ ID NO: 42559 - DNA, 438 bp, Sulfolobus acidocaldarius; identical to SEQ ID NO: 31712
  CDS (1)..(438)

SEQ ID NO: 42560 - protein, 145 aa, Sulfolobus acidocaldarius; identical to SEQ ID NO: 31713

SEQ ID NO: 42561 - DNA, 492 bp, Saccharomyces cerevisiae; identical to SEQ ID NO: 31714
  CDS (1)..(492)

SEQ ID NO: 42562 - protein, 163 aa, Saccharomyces cerevisiae; identical to SEQ ID NO: 31715

SEQ ID NO: 42563 - DNA, 444 bp, Mycobacterium leprae; identical to SEQ ID NO: 31716
  CDS (1)..(444)

SEQ ID NO: 42564 - protein, 147 aa, Mycobacterium leprae; identical to SEQ ID NO: 31717

SEQ ID NO: 42565 - DNA, 429 bp, chloroplast Porphyra purpurea; identical to SEQ ID NO: 31718
  CDS (1)..(429)

SEQ ID NO: 42566 - protein, 142 aa, chloroplast Porphyra purpurea; identical to SEQ ID NO: 31719

SEQ ID NO: 42567 - DNA, 450 bp, Sulfolobus solfataricus; identical to SEQ ID NO: 31720
  CDS (1)..(450)

SEQ ID NO: 42568 - protein, 149 aa, Sulfolobus solfataricus; identical to SEQ ID NO: 31721

SEQ ID NO: 42569 - DNA, 456 bp, Synechocystis sp; identical to SEQ ID NO: 31722
  CDS (1)..(456)

SEQ ID NO: 42570 - protein, 151 aa, Synechocystis sp; identical to SEQ ID NO: 31723

SEQ ID NO: 42571 - DNA, 420 bp, chloroplast Odontella sinensis; identical to SEQ ID NO: 31724
  CDS (1)..(420)

SEQ ID NO: 42572 - protein, 139 aa, chloroplast Odontella sinensis; identical to SEQ ID NO: 31725

SEQ ID NO: 42573 - DNA, 444 bp, Streptomyces coelicolor; identical to SEQ ID NO: 31726
  CDS (1)..(444)

SEQ ID NO: 42574 - protein, 147 aa, Streptomyces coelicolor; identical to SEQ ID NO: 31727

SEQ ID NO: 42575 - DNA, 474 bp, Schizosaccharomyces pombe; identical to SEQ ID NO: 31728
  CDS (1)..(474)

SEQ ID NO: 42576 - protein, 157 aa, Schizosaccharomyces pombe; identical to SEQ ID NO: 31729

SEQ ID NO: 42577 - DNA, 540 bp, Burkholderia mallei ATCC 23344; identical to SEQ ID NO: 31730
  CDS (112)..(540)

SEQ ID NO: 42578 - protein, 142 aa, Burkholderia mallei ATCC 23344; identical to SEQ ID NO: 31731

SEQ ID NO: 42579 - DNA, 438 bp, Bacillus cereus ZK; identical to SEQ ID NO: 31732
  CDS (1)..(438)

SEQ ID NO: 42580 - protein, 145 aa, Bacillus cereus ZK; identical to SEQ ID NO: 31733

SEQ ID NO: 42581 - DNA, 462 bp, Bacteroides fragilis; identical to SEQ ID NO: 31734
  CDS (1)..(462)

SEQ ID NO: 42582 - protein, 153 aa, Bacteroides fragilis; identical to SEQ ID NO: 31735

SEQ ID NO: 42583 - DNA, 438 bp, Bacillus licheniformis DSM 13; identical to SEQ ID NO: 31736
  CDS (1)..(438)

SEQ ID NO: 42584 - protein, 145 aa, Bacillus licheniformis DSM 13; identical to SEQ ID NO: 31737

SEQ ID NO: 42585 - DNA, 444 bp, Mannheimia succiniciproducens MBEL55E; identical to SEQ ID NO: 31738
  CDS (1)..(444)

SEQ ID NO: 42586 - protein, 147 aa, Mannheimia succiniciproducens MBEL55E; identical to SEQ ID NO: 31739

SEQ ID NO: 42587 - DNA, 465 bp, Borrelia garinii PBi; identical to SEQ ID NO: 31740
  CDS (1)..(465)

SEQ ID NO: 42588 - protein, 154 aa, Borrelia garinii PBi; identical to SEQ ID NO: 31741

SEQ ID NO: 42589 - DNA, 432 bp, Symbiobacterium thermophilum; identical to SEQ ID NO: 31742
  CDS (1)..(432)

SEQ ID NO: 42590 - protein, 143 aa, Symbiobacterium thermophilum; identical to SEQ ID NO: 31743

SEQ ID NO: 42591 - DNA, 468 bp, Rickettsia typhi; identical to SEQ ID NO: 31744
  CDS (1)..(468)

SEQ ID NO: 42592 - protein, 155 aa, Rickettsia typhi; identical to SEQ ID NO: 31745

SEQ ID NO: 42593 - DNA, 444 bp, Propionibacterium acnes; identical to SEQ ID NO: 31746
  CDS (1)..(444)

SEQ ID NO: 42594 - protein, 147 aa, Propionibacterium acnes; identical to SEQ ID NO: 31747

SEQ ID NO: 42595 - DNA, 447 bp, Leifsonia xyli; identical to SEQ ID NO: 31748
  CDS (1)..(447)

SEQ ID NO: 42596 - protein, 148 aa, Leifsonia xyli; identical to SEQ ID NO: 31749

SEQ ID NO: 42597 - DNA, 429 bp, Desulfotalea psychrophila; identical to SEQ ID NO: 31750
  CDS (1)..(429)

SEQ ID NO: 42598 - protein, 142 aa, Desulfotalea psychrophila; identical to SEQ ID NO: 31751

SEQ ID NO: 42599 - DNA, 432 bp, Gracilaria tenuistipitata var; identical to SEQ ID NO: 31752
  CDS (1)..(432)

SEQ ID NO: 42600 - protein, 143 aa, Gracilaria tenuistipitata var; identical to SEQ ID NO: 31753

SEQ ID NO: 42601 - DNA, 525 bp, Debaryomyces hansenii CBS767; identical to SEQ ID NO: 31754
  CDS (1)..(525)

SEQ ID NO: 42602 - protein, 174 aa, Debaryomyces hansenii CBS767; identical to SEQ ID NO: 31755

SEQ ID NO: 42603 - DNA, 468 bp, Kluyveromyces lactis NRRL Y; identical to SEQ ID NO: 31756
  CDS (1)..(468)

SEQ ID NO: 42604 - protein, 155 aa, Kluyveromyces lactis NRRL Y; identical to SEQ ID NO: 31757

SEQ ID NO: 42605 - DNA, 453 bp, Mesoplasma florum; identical to SEQ ID NO: 31758
  CDS (1)..(453)

SEQ ID NO: 42606 - protein, 150 aa, Mesoplasma florum; identical to SEQ ID NO: 31759

SEQ ID NO: 42607 - DNA, 429 bp, Acinetobacter sp; identical to SEQ ID NO: 31760
  CDS (1)..(429)

SEQ ID NO: 42608 - protein, 142 aa, Acinetobacter sp; identical to SEQ ID NO: 31761

SEQ ID NO: 42609 - DNA, 504 bp, Candida glabrata CBS138; identical to SEQ ID NO: 31762
  CDS (1)..(504)

SEQ ID NO: 42610 - protein, 167 aa, Candida glabrata CBS138; identical to SEQ ID NO: 31763

SEQ ID NO: 42611 - DNA, 465 bp, Bartonella quintana; identical to SEQ ID NO: 31764
  CDS (1)..(465)

SEQ ID NO: 42612 - protein, 154 aa, Bartonella quintana; identical to SEQ ID NO: 31765

SEQ ID NO: 42613 - DNA, 465 bp, Bartonella henselae; identical to SEQ ID NO: 31766
  CDS (1)..(465)

SEQ ID NO: 42614 - protein, 154 aa, Bartonella henselae; identical to SEQ ID NO: 31767

SEQ ID NO: 42615 - DNA, 477 bp, Fremyella diplosiphon; identical to SEQ ID NO: 31768
  CDS (1)..(477)

SEQ ID NO: 42616 - protein, 158 aa, Fremyella diplosiphon; identical to SEQ ID NO: 31769

SEQ ID NO: 42617 - DNA, 435 bp, Mycoplasma mobile; identical to SEQ ID NO: 31770
  CDS (1)..(435)

SEQ ID NO: 42618 - protein, 144 aa, Mycoplasma mobile; identical to SEQ ID NO: 31771

SEQ ID NO: 42619 - DNA, 429 bp, Photobacterium profundum; identical to SEQ ID NO: 31772
  CDS (1)..(429)

SEQ ID NO: 42620 - protein, 142 aa, Photobacterium profundum; identical to SEQ ID NO: 31773

SEQ ID NO: 42621 - DNA, 432 bp, Parachlamydia sp; identical to SEQ ID NO: 31774
  CDS (1)..(432)

SEQ ID NO: 42622 - protein, 143 aa, Parachlamydia sp; identical to SEQ ID NO: 31775

SEQ ID NO: 42623 - DNA, 441 bp, Bdellovibrio bacteriovorus; identical to SEQ ID NO: 31776
  CDS (1)..(441)

SEQ ID NO: 42624 - protein, 146 aa, Bdellovibrio bacteriovorus; identical to SEQ ID NO: 31777

SEQ ID NO: 42625 - DNA, 456 bp, Mycoplasma mycoides; identical to SEQ ID NO: 31778
  CDS (1)..(456)

SEQ ID NO: 42626 - protein, 151 aa, Mycoplasma mycoides; identical to SEQ ID NO: 31779

SEQ ID NO: 42627 - DNA, 444 bp, Corynebacterium diphtheriae; identical to SEQ ID NO: 31780
  CDS (1)..(444)

SEQ ID NO: 42628 - protein, 147 aa, Corynebacterium diphtheriae; identical to SEQ ID NO: 31781

SEQ ID NO: 42629 - DNA, 459 bp, Onion yellows phytoplasma; identical to SEQ ID NO: 31782
  CDS (1)..(459)

SEQ ID NO: 42630 - protein, 152 aa, Onion yellows phytoplasma; identical to SEQ ID NO: 31783

SEQ ID NO: 42631 - DNA, 435 bp, Desulfovibrio vulgaris; identical to SEQ ID NO: 31784
  CDS (1)..(435)

SEQ ID NO: 42632 - protein, 144 aa, Desulfovibrio vulgaris; identical to SEQ ID NO: 31785

SEQ ID NO: 42633 - DNA, 492 bp, Thermus thermophilus; identical to SEQ ID NO: 31786
  CDS (1)..(492)

SEQ ID NO: 42634 - protein, 163 aa, Thermus thermophilus; identical to SEQ ID NO: 31787

SEQ ID NO: 42635 - DNA, 450 bp, Leptospira interrogans; identical to SEQ ID NO: 31788
  CDS (1)..(450)

SEQ ID NO: 42636 - protein, 149 aa, Leptospira interrogans; identical to SEQ ID NO: 31789

SEQ ID NO: 42637 - DNA, 438 bp, Bacillus cereus; identical to SEQ ID NO: 31790
  CDS (1)..(438)

SEQ ID NO: 42638 - protein, 145 aa, Bacillus cereus; identical to SEQ ID NO: 31791

SEQ ID NO: 42639 - DNA, 459 bp, Wolbachia pipientis wMel; identical to SEQ ID NO: 31792
  CDS (1)..(459)

SEQ ID NO: 42640 - protein, 152 aa, Wolbachia pipientis wMel; identical to SEQ ID NO: 31793

SEQ ID NO: 42641 - DNA, 429 bp, Treponema denticola; identical to SEQ ID NO: 31794
  CDS (1)..(429)

SEQ ID NO: 42642 - protein, 142 aa, Treponema denticola; identical to SEQ ID NO: 31795

SEQ ID NO: 42643 - DNA, 444 bp, Mycobacterium paratuberculosis; identical to SEQ ID NO: 31796
  CDS (1)..(444)

SEQ ID NO: 42644 - protein, 147 aa, Mycobacterium paratuberculosis; identical to SEQ ID NO: 31797

SEQ ID NO: 42645 - DNA, 432 bp, Geobacter sulfurreducens; identical to SEQ ID NO: 31798
  CDS (1)..(432)

SEQ ID NO: 42646 - protein, 143 aa, Geobacter sulfurreducens; identical to SEQ ID NO: 31799

SEQ ID NO: 42647 - DNA, 444 bp, Lactobacillus johnsonii; identical to SEQ ID NO: 31800
  CDS (1)..(444)

SEQ ID NO: 42648 - protein, 147 aa, Lactobacillus johnsonii; identical to SEQ ID NO: 31801

SEQ ID NO: 42649 - DNA, 489 bp, Nanoarchaeum equitans; identical to SEQ ID NO: 31802
  CDS (1)..(489)

SEQ ID NO: 42650 - protein, 162 aa, Nanoarchaeum equitans; identical to SEQ ID NO: 31803

SEQ ID NO: 42651 - DNA, 471 bp, Ashbya gossypii; identical to SEQ ID NO: 31804
  CDS (1)..(471)

SEQ ID NO: 42652 - protein, 156 aa, Ashbya gossypii; identical to SEQ ID NO: 31805

SEQ ID NO: 42653 - DNA, 690 bp, Oryza sativa; identical to SEQ ID NO: 31806
  CDS (1)..(690)

SEQ ID NO: 42654 - protein, 229 aa, Oryza sativa; identical to SEQ ID NO: 31807

SEQ ID NO: 42655 - DNA, 420 bp, Wolinella succinogenes; identical to SEQ ID NO: 31808
  CDS (1)..(420)

SEQ ID NO: 42656 - protein, 139 aa, Wolinella succinogenes; identical to SEQ ID NO: 31809

SEQ ID NO: 42657 - DNA, 429 bp, Vibrio vulnificus; identical to SEQ ID NO: 31810
  CDS (1)..(429)

SEQ ID NO: 42658 - protein, 142 aa, Vibrio vulnificus; identical to SEQ ID NO: 31811

SEQ ID NO: 42659 - DNA, 456 bp, Porphyromonas gingivalis; identical to SEQ ID NO: 31812
  CDS (1)..(456)

SEQ ID NO: 42660 - protein, 151 aa, Porphyromonas gingivalis; identical to SEQ ID NO: 31813

SEQ ID NO: 42661 - DNA, 429 bp, Photorhabdus luminescens; identical to SEQ ID NO: 31814
  CDS (1)..(429)

SEQ ID NO: 42662 - protein, 142 aa, Photorhabdus luminescens; identical to SEQ ID NO: 31815

SEQ ID NO: 42663 - DNA, 459 bp, Gloeobacter violaceus; identical to SEQ ID NO: 31816
  CDS (1)..(459)

SEQ ID NO: 42664 - protein, 152 aa, Gloeobacter violaceus; identical to SEQ ID NO: 31817

SEQ ID NO: 42665 - DNA, 429 bp, Chromobacterium violaceum; identical to SEQ ID NO: 31818
  CDS (1)..(429)

SEQ ID NO: 42666 - protein, 142 aa, Chromobacterium violaceum; identical to SEQ ID NO: 31819

SEQ ID NO: 42667 - DNA, 552 bp, Neurospora crassa; identical to SEQ ID NO: 31820
  CDS (1)..(552)

SEQ ID NO: 42668 - protein, 183 aa, Neurospora crassa; identical to SEQ ID NO: 31821

SEQ ID NO: 42669 - DNA, 453 bp, Synechococcus sp; identical to SEQ ID NO: 31822
  CDS (1)..(453)

SEQ ID NO: 42670 - protein, 150 aa, Synechococcus sp; identical to SEQ ID NO: 31823

SEQ ID NO: 42671 - DNA, 456 bp, Rhodopirellula baltica; identical to SEQ ID NO: 31824
  CDS (1)..(456)

SEQ ID NO: 42672 - protein, 151 aa, Rhodopirellula baltica; identical to SEQ ID NO: 31825

SEQ ID NO: 42673 - DNA, 432 bp, Prochlorococcus marinus subsp; identical to SEQ ID NO: 31826
  CDS (1)..(432)

SEQ ID NO: 42674 - protein, 143 aa, Prochlorococcus marinus subsp; identical to SEQ ID NO: 31827

SEQ ID NO: 42675 - DNA, 453 bp, Prochlorococcus marinus; identical to SEQ ID NO: 31828
  CDS (1)..(453)

SEQ ID NO: 42676 - protein, 150 aa, Prochlorococcus marinus; identical to SEQ ID NO: 31829

SEQ ID NO: 42677 - DNA, 453 bp, Prochlorococcus marinus; identical to SEQ ID NO: 31830
  CDS (1)..(453)

SEQ ID NO: 42678 - protein, 150 aa, Prochlorococcus marinus; identical to SEQ ID NO: 31831

SEQ ID NO: 42679 - DNA, 429 bp, Helicobacter hepaticus; identical to SEQ ID NO: 31832
  CDS (1)..(429)

SEQ ID NO: 42680 - protein, 142 aa, Helicobacter hepaticus; identical to SEQ ID NO: 31833

SEQ ID NO: 42681 - DNA, 423 bp, Haemophilus ducreyi; identical to SEQ ID NO: 31834
  CDS (1)..(423)

SEQ ID NO: 42682 - protein, 140 aa, Haemophilus ducreyi; identical to SEQ ID NO: 31835

SEQ ID NO: 42683 - DNA, 420 bp, Candidatus Blochmannia floridanus; identical to SEQ ID NO: 31836
  CDS (1)..(420)

SEQ ID NO: 42684 - protein, 139 aa, Candidatus Blochmannia floridanus; identical to SEQ ID NO: 31837

SEQ ID NO: 42685 - DNA, 429 bp, Bordetella pertussis; identical to SEQ ID NO: 31838
  CDS (1)..(429)

SEQ ID NO: 42686 - protein, 142 aa, Bordetella pertussis; identical to SEQ ID NO: 31839

SEQ ID NO: 42687 - DNA, 618 bp, Arabidopsis thaliana; identical to SEQ ID NO: 31840
  CDS (1)..(618)

SEQ ID NO: 42688 - protein, 205 aa, Arabidopsis thaliana; identical to SEQ ID NO: 31841

SEQ ID NO: 42689 - DNA, 1001 bp, Chlorarachnion sp; identical to SEQ ID NO: 31842
  CDS (48)..(869)

SEQ ID NO: 42690 - protein, 273 aa, Chlorarachnion sp; identical to SEQ ID NO: 31843

SEQ ID NO: 42691 - DNA, 453 bp, Chlamydophila caviae; identical to SEQ ID NO: 31844
  CDS (1)..(453)

SEQ ID NO: 42692 - protein, 150 aa, Chlamydophila caviae; identical to SEQ ID NO: 31845

SEQ ID NO: 42693 - DNA, 444 bp, Streptomyces avermitilis; identical to SEQ ID NO: 31846
  CDS (1)..(444)

SEQ ID NO: 42694 - protein, 147 aa, Streptomyces avermitilis; identical to SEQ ID NO: 31847

SEQ ID NO: 42695 - DNA, 435 bp, Nitrosomonas europaea; identical to SEQ ID NO: 31848
  CDS (1)..(435)

SEQ ID NO: 42696 - protein, 144 aa, Nitrosomonas europaea; identical to SEQ ID NO: 31849

SEQ ID NO: 42697 - DNA, 429 bp, Coxiella burnetii; identical to SEQ ID NO: 31850
  CDS (1)..(429)

SEQ ID NO: 42698 - protein, 142 aa, Coxiella burnetii; identical to SEQ ID NO: 31851

SEQ ID NO: 42699 - DNA, 426 bp, Tropheryma whipplei; identical to SEQ ID NO: 31852
  CDS (1)..(426)

SEQ ID NO: 42700 - protein, 141 aa, Tropheryma whipplei; identical to SEQ ID NO: 31853

SEQ ID NO: 42701 - DNA, 603 bp, Dictyostelium discoideum; identical to SEQ ID NO: 31854
  CDS (1)..(603)

SEQ ID NO: 42702 - protein, 200 aa, Dictyostelium discoideum; identical to SEQ ID NO: 31855

SEQ ID NO: 42703 - DNA, 429 bp, Xylella fastidiosa; identical to SEQ ID NO: 31856
  CDS (1)..(429)

SEQ ID NO: 42704 - protein, 142 aa, Xylella fastidiosa; identical to SEQ ID NO: 31857

SEQ ID NO: 42705 - DNA, 429 bp, Vibrio parahaemolyticus; identical to SEQ ID NO: 31858
  CDS (1)..(429)

SEQ ID NO: 42706 - protein, 142 aa, Vibrio parahaemolyticus; identical to SEQ ID NO: 31859

SEQ ID NO: 42707 - DNA, 429 bp, Pseudomonas syringae; identical to SEQ ID NO: 31860
  CDS (1)..(429)

SEQ ID NO: 42708 - protein, 142 aa, Pseudomonas syringae; identical to SEQ ID NO: 31861

SEQ ID NO: 42709 - DNA, 444 bp, Lactobacillus plantarum; identical to SEQ ID NO: 31862
  CDS (1)..(444)

SEQ ID NO: 42710 - protein, 147 aa, Lactobacillus plantarum; identical to SEQ ID NO: 31863

SEQ ID NO: 42711 - DNA, 435 bp, Clostridium tetani; identical to SEQ ID NO: 31864
  CDS (1)..(435)

SEQ ID NO: 42712 - protein, 144 aa, Clostridium tetani; identical to SEQ ID NO: 31865

SEQ ID NO: 42713 - DNA, 462 bp, Bacteroides thetaiotaomicron; identical to SEQ ID NO: 31866
  CDS (1)..(462)

SEQ ID NO: 42714 - protein, 153 aa, Bacteroides thetaiotaomicron; identical to SEQ ID NO: 31867

SEQ ID NO: 42715 - DNA, 438 bp, Staphylococcus epidermidis; identical to SEQ ID NO: 31868
  CDS (1)..(438)

SEQ ID NO: 42716 - protein, 145 aa, Staphylococcus epidermidis; identical to SEQ ID NO: 31869

SEQ ID NO: 42717 - DNA, 444 bp, Yersinia pestis; identical to SEQ ID NO: 31870
  CDS (1)..(444)

SEQ ID NO: 42718 - protein, 147 aa, Yersinia pestis; identical to SEQ ID NO: 31871

SEQ ID NO: 42719 - DNA, 429 bp, Wigglesworthia glossinidia brevipalpis; identical to SEQ ID NO: 31872
  CDS (1)..(429)

SEQ ID NO: 42720 - protein, 142 aa, Wigglesworthia glossinidia brevipalpis; identical to SEQ ID NO: 31873

SEQ ID NO: 42721 - DNA, 459 bp, Synechococcus elongatus; identical to SEQ ID NO: 31874
  CDS (1)..(459)

SEQ ID NO: 42722 - protein, 152 aa, Synechococcus elongatus; identical to SEQ ID NO: 31875

SEQ ID NO: 42723 - DNA, 447 bp, Streptococcus mutans; identical to SEQ ID NO: 31876
  CDS (1)..(447)

SEQ ID NO: 42724 - protein, 148 aa, Streptococcus mutans; identical to SEQ ID NO: 31877

SEQ ID NO: 42725 - DNA, 447 bp, Streptococcus agalactiae; identical to SEQ ID NO: 31878
  CDS (1)..(447)

SEQ ID NO: 42726 - protein, 148 aa, Streptococcus agalactiae; identical to SEQ ID NO: 31879

SEQ ID NO: 42727 - DNA, 429 bp, Shewanella oneidensis; identical to SEQ ID NO: 31880
  CDS (1)..(429)

SEQ ID NO: 42728 - protein, 142 aa, Shewanella oneidensis; identical to SEQ ID NO: 31881

SEQ ID NO: 42729 - DNA, 438 bp, Oceanobacillus iheyensis; identical to SEQ ID NO: 31882
  CDS (1)..(438)

SEQ ID NO: 42730 - protein, 145 aa, Oceanobacillus iheyensis; identical to SEQ ID NO: 31883

SEQ ID NO: 42731 - DNA, 441 bp, Mycoplasma penetrans; identical to SEQ ID NO: 31884
  CDS (1)..(441)

SEQ ID NO: 42732 - protein, 146 aa, Mycoplasma penetrans; identical to SEQ ID NO: 31885

SEQ ID NO: 42733 - DNA, 444 bp, Corynebacterium efficiens; identical to SEQ ID NO: 31886
  CDS (1)..(444)

SEQ ID NO: 42734 - protein, 147 aa, Corynebacterium efficiens; identical to SEQ ID NO: 31887

SEQ ID NO: 42735 - DNA, 465 bp, Brucella suis; identical to SEQ ID NO: 31888
  CDS (1)..(465)

SEQ ID NO: 42736 - protein, 154 aa, Brucella suis; identical to SEQ ID NO: 31889

SEQ ID NO: 42737 - DNA, 450 bp, Bifidobacterium longum; identical to SEQ ID NO: 31890
  CDS (1)..(450)

SEQ ID NO: 42738 - protein, 149 aa, Bifidobacterium longum; identical to SEQ ID NO: 31891

SEQ ID NO: 42739 - DNA, 447 bp, Streptococcus pyogenes; identical to SEQ ID NO: 31892
  CDS (1)..(447)

SEQ ID NO: 42740 - protein, 148 aa, Streptococcus pyogenes; identical to SEQ ID NO: 31893

SEQ ID NO: 42741 - DNA, 453 bp, Chlorobium tepidum; identical to SEQ ID NO: 31894
  CDS (1)..(453)

SEQ ID NO: 42742 - protein, 150 aa, Chlorobium tepidum; identical to SEQ ID NO: 31895

SEQ ID NO: 42743 - DNA, 375 bp, Candidatus Tremblaya princeps; identical to SEQ ID NO: 31896
  CDS (1)..(375)

SEQ ID NO: 42744 - protein, 124 aa, Candidatus Tremblaya princeps; identical to SEQ ID NO: 31897

SEQ ID NO: 42745 - DNA, 429 bp, Xanthomonas axonopodis; identical to SEQ ID NO: 31898
  CDS (1)..(429)

SEQ ID NO: 42746 - protein, 142 aa, Xanthomonas axonopodis; identical to SEQ ID NO: 31899

SEQ ID NO: 42747 - DNA, 444 bp, Corynebacterium glutamicum; identical to SEQ ID NO: 31900
  CDS (1)..(444)

SEQ ID NO: 42748 - protein, 147 aa, Corynebacterium glutamicum; identical to SEQ ID NO: 31901

SEQ ID NO: 42749 - DNA, 429 bp, Streptococcus pyogenes; identical to SEQ ID NO: 31902
  CDS (1)..(429)

SEQ ID NO: 42750 - protein, 142 aa, Streptococcus pyogenes; identical to SEQ ID NO: 31903

SEQ ID NO: 42751 - DNA, 489 bp, Methanosarcina mazei; identical to SEQ ID NO: 31904
  CDS (1)..(489)

SEQ ID NO: 42752 - protein, 162 aa, Methanosarcina mazei; identical to SEQ ID NO: 31905

SEQ ID NO: 42753 - DNA, 432 bp, Thermoanaerobacter tengcongensis; identical to SEQ ID NO: 31906
  CDS (1)..(432)

SEQ ID NO: 42754 - protein, 143 aa, Thermoanaerobacter tengcongensis; identical to SEQ ID NO: 31907

SEQ ID NO: 42755 - DNA, 435 bp, Fusobacterium nucleatum; identical to SEQ ID NO: 31908
  CDS (1)..(435)

SEQ ID NO: 42756 - protein, 144 aa, Fusobacterium nucleatum; identical to SEQ ID NO: 31909

SEQ ID NO: 42757 - DNA, 432 bp, Methanosarcina acetivorans; identical to SEQ ID NO: 31910
  CDS (1)..(432)

SEQ ID NO: 42758 - protein, 143 aa, Methanosarcina acetivorans; identical to SEQ ID NO: 31911

SEQ ID NO: 42759 - DNA, 480 bp, Methanopyrus kandleri; identical to SEQ ID NO: 31912
  CDS (1)..(480)

SEQ ID NO: 42760 - protein, 159 aa, Methanopyrus kandleri; identical to SEQ ID NO: 31913

SEQ ID NO: 42761 - DNA, 429 bp, Pyrococcus furiosus; identical to SEQ ID NO: 31914
  CDS (1)..(429)

SEQ ID NO: 42762 - protein, 142 aa, Pyrococcus furiosus; identical to SEQ ID NO: 31915

SEQ ID NO: 42763 - DNA, 435 bp, Clostridium perfringens; identical to SEQ ID NO: 31916
  CDS (1)..(435)

SEQ ID NO: 42764 - protein, 144 aa, Clostridium perfringens; identical to SEQ ID NO: 31917

SEQ ID NO: 42765 - DNA, 429 bp, Ralstonia solanacearum; identical to SEQ ID NO: 31918
  CDS (1)..(429)

SEQ ID NO: 42766 - protein, 142 aa, Ralstonia solanacearum; identical to SEQ ID NO: 31919

SEQ ID NO: 42767 - DNA, 564 bp, Pyrobaculum aerophilum; identical to SEQ ID NO: 31920
  CDS (1)..(564)

SEQ ID NO: 42768 - protein, 187 aa, Pyrobaculum aerophilum; identical to SEQ ID NO: 31921

SEQ ID NO: 42769 - DNA, 465 bp, Rhizobium meliloti; identical to SEQ ID NO: 31922
  CDS (1)..(465)

SEQ ID NO: 42770 - protein, 154 aa, Rhizobium meliloti; identical to SEQ ID NO: 31923

SEQ ID NO: 42771 - DNA, 702 bp, Oryza sativa; identical to SEQ ID NO: 31924
  CDS (1)..(702)

SEQ ID NO: 42772 - protein, 233 aa, Oryza sativa; identical to SEQ ID NO: 31925

SEQ ID NO: 42773 - DNA, 465 bp, Rhizobium loti; identical to SEQ ID NO: 31926
  CDS (1)..(465)

SEQ ID NO: 42774 - protein, 154 aa, Rhizobium loti; identical to SEQ ID NO: 31927

SEQ ID NO: 42775 - DNA, 429 bp, Pasteurella multocida; identical to SEQ ID NO: 31928
  CDS (1)..(429)

SEQ ID NO: 42776 - protein, 142 aa, Pasteurella multocida; identical to SEQ ID NO: 31929

SEQ ID NO: 42777 - DNA, 846 bp, Ceratopteris richardii; identical to SEQ ID NO: 31930
  CDS (54)..(479): n means a or g or c or t/u

SEQ ID NO: 42778 - protein, 141 aa, Ceratopteris richardii; identical to SEQ ID NO: 31931
  misc_feature (101)..(101): Xaa can be Gln or Pro or Arg or Leu
  misc_feature (134)..(134): Xaa can be Asn or His or Asp or Tyr

SEQ ID NO: 42779 - DNA, 414 bp, Arabidopsis thaliana; identical to SEQ ID NO: 31932
  CDS (1)..(414)

SEQ ID NO: 42780 - protein, 137 aa, Arabidopsis thaliana; identical to SEQ ID NO: 31933

SEQ ID NO: 42781 - DNA, 432 bp, Cyanidium caldarium; identical to SEQ ID NO: 31934
  CDS (1)..(432)

SEQ ID NO: 42782 - protein, 143 aa, Cyanidium caldarium; identical to SEQ ID NO: 31935

SEQ ID NO: 42783 - DNA, 432 bp, Guillardia theta; identical to SEQ ID NO: 31936
  CDS (1)..(432)

SEQ ID NO: 42784 - protein, 143 aa, Guillardia theta; identical to SEQ ID NO: 31937

SEQ ID NO: 42785 - DNA, 435 bp, Buchnera aphidicola; identical to SEQ ID NO: 31938
  CDS (1)..(435)

SEQ ID NO: 42786 - protein, 144 aa, Buchnera aphidicola; identical to SEQ ID NO: 31939

SEQ ID NO: 42787 - DNA, 618 bp, Drosophila melanogaster; identical to SEQ ID NO: 31940
  CDS (31)..(567)

SEQ ID NO: 42788 - protein, 178 aa, Drosophila melanogaster; identical to SEQ ID NO: 31941

SEQ ID NO: 42789 - DNA, 839 bp, Homo sapiens; identical to SEQ ID NO: 31942
  CDS (40)..(576)

SEQ ID NO: 42790 - protein, 178 aa, Homo sapiens; identical to SEQ ID NO: 31943

SEQ ID NO: 42791 - DNA, 26 bp, Primer
atgaaaacttttacagctaaaccaga

SEQ ID NO: 42792 - DNA, 24 bp, Primer
ttagatgtcaagaacttgcggttg

SEQ ID NO: 42793 - protein, 162 aa, consensus; identical to SEQ ID NO: 31946
  MISC_FEATURE (1)..(162): consensus for the disclosure of xaa see table XV

SEQ ID NO: 42794 - protein, 58 aa, consensus; identical to SEQ ID NO: 31947
  MISC_FEATURE (1)..(58): consensus for the disclosure of xaa see table XV

SEQ ID NO: 42795 - protein, 26 aa, consensus
  MISC_FEATURE (1)..(26): consensus for the disclosure of xaa see table XV
XXXXXXXMXXXXXXXXXXXXXXXXXX

SEQ ID NO: 42796 - DNA, 1059 bp, Escherichia coli K12; identical to SEQ ID NO: 21544
  CDS (1)..(1059)

SEQ ID NO: 42797 - protein, 352 aa, Escherichia coli K12; identical to SEQ ID NO: 21545

SEQ ID NO: 42798 - DNA, 897 bp, Bacillus halodurans; identical to SEQ ID NO: 21546
  CDS (1)..(897)

SEQ ID NO: 42799 - protein, 298 aa, Bacillus halodurans; identical to SEQ ID NO: 21547

SEQ ID NO: 42800 - DNA, 954 bp, Yersinia pestis; identical to SEQ ID NO: 21548
  CDS (1)..(954)

SEQ ID NO: 42801 - protein, 317 aa, Yersinia pestis; identical to SEQ ID NO: 21549

SEQ ID NO: 42802 - DNA, 885 bp, Listeria innocua; identical to SEQ ID NO: 21550
  CDS (1)..(885)

SEQ ID NO: 42803 - protein, 294 aa, Listeria innocua; identical to SEQ ID NO: 21551

SEQ ID NO: 42804 - DNA, 903 bp, Nostoc sp. PCC 7120; identical to SEQ ID NO: 21552
  CDS (1)..(903)

SEQ ID NO: 42805 - protein, 300 aa, Nostoc sp. PCC 7120; identical to SEQ ID NO: 21553

SEQ ID NO: 42806 - DNA, 1056 bp, Salmonella enterica subsp. enterica serovar Typhi; identical to SEQ ID NO: 21554
  CDS (1)..(1056)

SEQ ID NO: 42807 - protein, 351 aa, Salmonella enterica subsp. enterica serovar Typhi; identical to SEQ ID NO: 21555

SEQ ID NO: 42808 - DNA, 939 bp, Xylella fastidiosa; identical to SEQ ID NO: 21556
  CDS (1)..(939)

SEQ ID NO: 42809 - protein, 312 aa, Xylella fastidiosa; identical to SEQ ID NO: 21557

SEQ ID NO: 42810 - DNA, 918 bp, Neisseria meningitidis; identical to SEQ ID NO: 21558
  CDS (1)..(918)

SEQ ID NO: 42811 - protein, 305 aa, Neisseria meningitidis; identical to SEQ ID NO: 21559

SEQ ID NO: 42812 - DNA, 906 bp, Clostridium acetobutylicum; identical to SEQ ID NO: 21560
  CDS (1)..(906)

SEQ ID NO: 42813 - protein, 301 aa, Clostridium acetobutylicum; identical to SEQ ID NO: 21561

SEQ ID NO: 42814 - DNA, 990 bp, Streptococcus pneumoniae; identical to SEQ ID NO: 21562
  CDS (1)..(990)

SEQ ID NO: 42815 - protein, 329 aa, Streptococcus pneumoniae; identical to SEQ ID NO: 21563

SEQ ID NO: 42816 - DNA, 993 bp, Vibrio cholerae; identical to SEQ ID NO: 21564
  CDS (1)..(993)

SEQ ID NO: 42817 - protein, 330 aa, Vibrio cholerae; identical to SEQ ID NO: 21565

SEQ ID NO: 42818 - DNA, 936 bp, Lactococcus lactis subsp. lactis; identical to SEQ ID NO: 21566
  CDS (1)..(936)

SEQ ID NO: 42819 - protein, 311 aa, Lactococcus lactis subsp. lactis; identical to SEQ ID NO: 21567

SEQ ID NO: 42820 - DNA, 882 bp, Clostridium acetobutylicum; identical to SEQ ID NO: 21568
  CDS (1)..(882)

SEQ ID NO: 42821 - protein, 293 aa, Clostridium acetobutylicum; identical to SEQ ID NO: 21569

SEQ ID NO: 42822 - DNA, 891 bp, Bacillus subtilis; identical to SEQ ID NO: 21570
  CDS (1)..(891)

SEQ ID NO: 42823 - protein, 296 aa, Bacillus subtilis; identical to SEQ ID NO: 21571

SEQ ID NO: 42824 - DNA, 1008 bp, Pseudomonas aeruginosa; identical to SEQ ID NO: 21572
  CDS (1)..(1008)

SEQ ID NO: 42825 - protein, 335 aa, Pseudomonas aeruginosa; identical to SEQ ID NO: 21573

SEQ ID NO: 42826 - DNA, 894 bp, Caulobacter crescentus; identical to SEQ ID NO: 21574
  CDS (1)..(894)

SEQ ID NO: 42827 - protein, 297 aa, Caulobacter crescentus; identical to SEQ ID NO: 21575

SEQ ID NO: 42828 - DNA, 933 bp, Haemophilus influenzae; identical to SEQ ID NO: 21576
  CDS (1)..(933)

SEQ ID NO: 42829 - protein, 310 aa, Haemophilus influenzae; identical to SEQ ID NO: 21577

SEQ ID NO: 42830 - DNA, 1026 bp, Pseudomonas putida; identical to SEQ ID NO: 21578
  CDS (1)..(1026)

SEQ ID NO: 42831 - protein, 341 aa, Pseudomonas putida; identical to SEQ ID NO: 21579

SEQ ID NO: 42832 - DNA, 969 bp, Erwinia carotovora subsp; identical to SEQ ID NO: 21580
  CDS (1)..(969)

SEQ ID NO: 42833 - protein, 322 aa, Erwinia carotovora subsp; identical to SEQ ID NO: 21581

SEQ ID NO: 42834 - DNA, 933 bp, Photobacterium profundum; identical to SEQ ID NO: 21582
  CDS (1)..(933)

SEQ ID NO: 42835 - protein, 310 aa, Photobacterium profundum; identical to SEQ ID NO: 21583

SEQ ID NO: 42836 - DNA, 753 bp, Bdellovibrio bacteriovorus; identical to SEQ ID NO: 21584
  CDS (1)..(753)

SEQ ID NO: 42837 - protein, 250 aa, Bdellovibrio bacteriovorus; identical to SEQ ID NO: 21585

SEQ ID NO: 42838 - DNA, 903 bp, Corynebacterium diphtheriae; identical to SEQ ID NO: 21586
  CDS (1)..(903)

SEQ ID NO: 42839 - protein, 300 aa, Corynebacterium diphtheriae; identical to SEQ ID NO: 21587

SEQ ID NO: 42840 - DNA, 855 bp, Thermus thermophilus; identical to SEQ ID NO: 21588
  CDS (1)..(855)

SEQ ID NO: 42841 - protein, 284 aa, Thermus thermophilus; identical to SEQ ID NO: 21589

SEQ ID NO: 42842 - DNA, 894 bp, Bacillus cereus; identical to SEQ ID NO: 21590
  CDS (1)..(894)

SEQ ID NO: 42843 - protein, 297 aa, Bacillus cereus; identical to SEQ ID NO: 21591

SEQ ID NO: 42844 - DNA, 951 bp, Geobacter sulfurreducens; identical to SEQ ID NO: 21592
  CDS (1)..(951)

SEQ ID NO: 42845 - protein, 316 aa, Geobacter sulfurreducens; identical to SEQ ID NO: 21593

SEQ ID NO: 42846 - DNA, 969 bp, Vibrio vulnificus; identical to SEQ ID NO: 21594
  CDS (1)..(969)

SEQ ID NO: 42847 - protein, 322 aa, Vibrio vulnificus; identical to SEQ ID NO: 21595

SEQ ID NO: 42848 - DNA, 888 bp, Porphyromonas gingivalis; identical to SEQ ID NO: 21596
  CDS (1)..(888)

SEQ ID NO: 42849 - protein, 295 aa, Porphyromonas gingivalis; identical to SEQ ID NO: 21597

SEQ ID NO: 42850 - DNA, 975 bp, Photorhabdus luminescens; identical to SEQ ID NO: 21598
  CDS (1)..(975)

SEQ ID NO: 42851 - protein, 324 aa, Photorhabdus luminescens; identical to SEQ ID NO: 21599

SEQ ID NO: 42852 - DNA, 882 bp, Gloeobacter violaceus; identical to SEQ ID NO: 21600
  CDS (1)..(882)

SEQ ID NO: 42853 - protein, 293 aa, Gloeobacter violaceus; identical to SEQ ID NO: 21601

SEQ ID NO: 42854 - DNA, 909 bp, Chromobacterium violaceum; identical to SEQ ID NO: 21602
  CDS (1)..(909)

SEQ ID NO: 42855 - protein, 302 aa, Chromobacterium violaceum; identical to SEQ ID NO: 21603

SEQ ID NO: 42856 - DNA, 894 bp, Mycobacterium bovis; identical to SEQ ID NO: 21604
  CDS (1)..(894)

SEQ ID NO: 42857 - protein, 297 aa, Mycobacterium bovis; identical to SEQ ID NO: 21605

SEQ ID NO: 42858 - DNA, 939 bp, Haemophilus ducreyi; identical to SEQ ID NO: 21606
  CDS (1)..(939)

SEQ ID NO: 42859 - protein, 312 aa, Haemophilus ducreyi; identical to SEQ ID NO: 21607

SEQ ID NO: 42860 - DNA, 909 bp, Bordetella pertussis; identical to SEQ ID NO: 21608
  CDS (1)..(909)

SEQ ID NO: 42861 - protein, 302 aa, Bordetella pertussis; identical to SEQ ID NO: 21609

SEQ ID NO: 42862 - DNA, 918 bp, Streptomyces avermitilis; identical to SEQ ID NO: 21610
  CDS (1)..(918)

SEQ ID NO: 42863 - protein, 305 aa, Streptomyces avermitilis; identical to SEQ ID NO: 21611

SEQ ID NO: 42864 - DNA, 921 bp, Nitrosomonas europaea; identical to SEQ ID NO: 21612
  CDS (1)..(921)

SEQ ID NO: 42865 - protein, 306 aa, Nitrosomonas europaea; identical to SEQ ID NO: 21613

SEQ ID NO: 42866 - DNA, 885 bp, Enterococcus faecalis; identical to SEQ ID NO: 21614
  CDS (1)..(885)

SEQ ID NO: 42867 - protein, 294 aa, Enterococcus faecalis; identical to SEQ ID NO: 21615

SEQ ID NO: 42868 - DNA, 828 bp, Coxiella burnetii; identical to SEQ ID NO: 21616
  CDS (1)..(828)

SEQ ID NO: 42869 - protein, 275 aa, Coxiella burnetii; identical to SEQ ID NO: 21617

SEQ ID NO: 42870 - DNA, 912 bp, Tropheryma whipplei; identical to SEQ ID NO: 21618
  CDS (1)..(912)

SEQ ID NO: 42871 - protein, 303 aa, Tropheryma whipplei; identical to SEQ ID NO: 21619

SEQ ID NO: 42872 - DNA, 903 bp, Myxococcus xanthus; identical to SEQ ID NO: 21620
  CDS (1)..(903)

SEQ ID NO: 42873 - protein, 300 aa, Myxococcus xanthus; identical to SEQ ID NO: 21621

SEQ ID NO: 42874 - DNA, 939 bp, Streptococcus pyogenes; identical to SEQ ID NO: 21622
  CDS (1)..(939)

SEQ ID NO: 42875 - protein, 312 aa, Streptococcus pyogenes; identical to SEQ ID NO: 21623

SEQ ID NO: 42876 - DNA, 969 bp, Vibrio parahaemolyticus; identical to SEQ ID NO: 21624
  CDS (1)..(969)

SEQ ID NO: 42877 - protein, 322 aa, Vibrio parahaemolyticus; identical to SEQ ID NO: 21625

SEQ ID NO: 42878 - DNA, 1035 bp, Pseudomonas syringae; identical to SEQ ID NO: 21626
  CDS (1)..(1035)

SEQ ID NO: 42879 - protein, 344 aa, Pseudomonas syringae; identical to SEQ ID NO: 21627

SEQ ID NO: 42880 - DNA, 924 bp, Clostridium tetani; identical to SEQ ID NO: 21628
  CDS (1)..(924)

SEQ ID NO: 42881 - protein, 307 aa, Clostridium tetani; identical to SEQ ID NO: 21629

SEQ ID NO: 42882 - DNA, 969 bp, Bradyrhizobium japonicum; identical to SEQ ID NO: 21630
  CDS (1)..(969)

SEQ ID NO: 42883 - protein, 322 aa, Bradyrhizobium japonicum; identical to SEQ ID NO: 21631

SEQ ID NO: 42884 - DNA, 936 bp, Streptococcus mutans; identical to SEQ ID NO: 21632
  CDS (1)..(936)

SEQ ID NO: 42885 - protein, 311 aa, Streptococcus mutans; identical to SEQ ID NO: 21633

SEQ ID NO: 42886 - DNA, 930 bp, Streptococcus agalactiae; identical to SEQ ID NO: 21634
  CDS (1)..(930)

SEQ ID NO: 42887 - protein, 309 aa, Streptococcus agalactiae; identical to SEQ ID NO: 21635

SEQ ID NO: 42888 - DNA, 966 bp, Shewanella oneidensis; identical to SEQ ID NO: 21636
  CDS (1)..(966)

SEQ ID NO: 42889 - protein, 321 aa, Shewanella oneidensis; identical to SEQ ID NO: 21637

SEQ ID NO: 42890 - DNA, 894 bp, Oceanobacillus iheyensis; identical to SEQ ID NO: 21638
  CDS (1)..(894)

SEQ ID NO: 42891 - protein, 297 aa, Oceanobacillus iheyensis; identical to SEQ ID NO: 21639

SEQ ID NO: 42892 - DNA, 903 bp, Corynebacterium efficiens; identical to SEQ ID NO: 21640
  CDS (1)..(903)

SEQ ID NO: 42893 - protein, 300 aa, Corynebacterium efficiens; identical to SEQ ID NO: 21641

SEQ ID NO: 42894 - DNA, 855 bp, Chlorobium tepidum; identical to SEQ ID NO: 21642
  CDS (1)..(855)

SEQ ID NO: 42895 - protein, 284 aa, Chlorobium tepidum; identical to SEQ ID NO: 21643

SEQ ID NO: 42896 - DNA, 903 bp, Corynebacterium glutamicum; identical to SEQ ID NO: 21644
  CDS (1)..(903)

SEQ ID NO: 42897 - protein, 300 aa, Corynebacterium glutamicum; identical to SEQ ID NO: 21645

SEQ ID NO: 42898 - DNA, 951 bp, Xanthomonas campestris; identical to SEQ ID NO: 21646
  CDS (1)..(951)

SEQ ID NO: 42899 - protein, 316 aa, Xanthomonas campestris; identical to SEQ ID NO: 21647

SEQ ID NO: 42900 - DNA, 951 bp, Xanthomonas axonopodis; identical to SEQ ID NO: 21648
  CDS (1)..(951)

SEQ ID NO: 42901 - protein, 316 aa, Xanthomonas axonopodis; identical to SEQ ID NO: 21649

SEQ ID NO: 42902 - DNA, 888 bp, Thermoanaerobacter tengcongensis; identical to SEQ ID NO: 21650
  CDS (1)..(888)

SEQ ID NO: 42903 - protein, 295 aa, Thermoanaerobacter tengcongensis; identical to SEQ ID NO: 21651

SEQ ID NO: 42904 - DNA, 933 bp, Clostridium perfringens; identical to SEQ ID NO: 21652
  CDS (1)..(933)

SEQ ID NO: 42905 - protein, 310 aa, Clostridium perfringens; identical to SEQ ID NO: 21653

SEQ ID NO: 42906 - DNA, 954 bp, Aeromonas hydrophila; identical to SEQ ID NO: 21654
  CDS (1)..(954)

SEQ ID NO: 42907 - protein, 317 aa, Aeromonas hydrophila; identical to SEQ ID NO: 21655

SEQ ID NO: 42908 - DNA, 936 bp, Pasteurella multocida; identical to SEQ ID NO: 21656
  CDS (1)..(936)

SEQ ID NO: 42909 - protein, 311 aa, Pasteurella multocida; identical to SEQ ID NO: 21657

SEQ ID NO: 42910 - DNA, 918 bp, Streptomyces coelicolor; identical to SEQ ID NO: 21658
  CDS (1)..(918)

SEQ ID NO: 42911 - protein, 305 aa, Streptomyces coelicolor; identical to SEQ ID NO: 21659

SEQ ID NO: 42912 - DNA, 876 bp, Cytophaga johnsonae; identical to SEQ ID NO: 21660
  CDS (1)..(876)

SEQ ID NO: 42913 - protein, 291 aa, Cytophaga johnsonae; identical to SEQ ID NO: 21661

SEQ ID NO: 42914 - DNA, 21 bp, Primer
atgaataagcgcgatgcaatc

SEQ ID NO: 42915 - DNA, 24 bp, Primer
ttattcaggcgtaaagtggcgtaa

SEQ ID NO: 42916 - protein, 45 aa, consensus; identical to SEQ ID NO: 22568
  MISC_FEATURE (1)..(45): consensus for the disclosure of xaa see table XV

SEQ ID NO: 42917 - DNA, 1131 bp, Escherichia coli
  CDS (1)..(1131)
atgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatttgtttgtggtagaagatgccgctcagggcgtgatgtccacttacaaagggcgtgcactgggaaccattggtcatattggctgctttagcttccatgaaaccaaaaactacacggcgggcggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcatacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttttcctga

SEQ ID NO: 42918 - protein, 376 aa, Escherichia coli
MIPFNAPPVVGTELDYMQSAMGSGKLCGDGGFTRRCQQWLEQRFGSAKVLLTPSCTASLEMAALLLDIQPGDEVIMPSYTFVSTANAFVLRGAKIVFVDVRPDTMNIDETLIEAAITDKTRVIVPVHYAGVACEMDTIMALAKKHNLFVVEDAAQGVMSTYKGRALGTIGHIGCFSFHETKNYTAGGEGGATLINDKALIERAEIIREKGTNRSQFFRGQVDKYTWRDIGSSYLMSDLQAAYLWAQLEAADRINQQRLALWQNYYDALAPLAKAGRIELPSIPDGCVQNAHMFYIKLRDIDDRSALINFLKEAEIMAVFHYIPLHGCPAGEHFGEFHGEDRYTTKESERLLRLPLFYNLSPVNQRTVIATLLNYFS

SEQ ID NO: 42919 - DNA, 1137 bp, Mesorhizobium loti MAFF303099
  CDS (1)..(1137)
atgctcttggtgagcgccccgatcctaggcgtgccggagaaggcagccctgtcaaaggtgattgacagcggctggcttaccatgggggagcgggtgcgcgcattcgagttggcctttgccgacatgcatggcgcgcaggactgcgtggcggtcggttcctgcaccgcggcgctccacctcatcctgcatgcgctgggaataggccctggcgacgaagtactggtcccgtcgctgaccttcgtggcgaccgcgaatgcggtgctctatgtcggggcgactccggtctttgtcgatatcgagtcggtcgacgtgccgttaatgtcgctcgcggaagccgaagcgcggtgcacatcacgcacaaaggcggtcatcctcgttcacttcgcgggctatctcgccaatcgggaacaatggcagcggttcgcccgggttcgagggctccacatcatcgaggacgctgcgcatgcgcccggcctgagggaagtggggacgttcggcactgcggccgccttcagcttctacggcaacaagaacatgacaacagcggaagggggcgccgtgatcgcccgtgactccgatctgctcgacaaaatccgccaggcccgcgggcatgggatgaccagcgggacccatcagcggctgaacagccgtaccccgcaatatgatgtcaccatgctcgggttcaactaccgcatggacgagatgcgggcggcgattgggctggtccagctgcagaacctgcaagagtggaacgagatcaggcgtatcctggccgtcctgtaccggcgcctcatcgccgaacattgcccggccgtgaccattccattcagcgaacccaggacgtcggctcaccacatcatgccggtcctcctgccgcgctacgcgaggcggcaggcggttatcgacgaactgcggacgcaggggatacagaccacgattcattatccgccggtgcaccagatgacgttctatcgcgagcgttaccccggcgttgccttgccgcgtacagaggactttgctcagcgagaactgacaatcccattgcacccccagatcacttcacctgtcgccgaagcggttgtggctgcactcgcaagcgcactcaacggcgacgcccaaacaggaactgccgcatga

SEQ ID NO: 42920 - protein, 378 aa, Mesorhizobium loti MAFF303099
MLLVSAPILGVPEKAALSKVIDSGWLTMGERVRAFELAFADMHGAQDCVAVGSCTAALHLILHALGIGPGDEVLVPSLTFVATANAVLYVGATPVFVDIESVDVPLMSLAEAEARCTSRTKAVILVHFAGYLANREQWQRFARVRGLHIIEDAAHAPGLREVGTFGTAAAFSFYGNKNMTTAEGGAVIARDSDLLDKIRQARGHGMTSGTHQRLNSRTPQYDVTMLGFNYRMDEMRAAIGLVQLQNLQEWNEIRRILAVLYRRLIAEHCPAVTIPFSEPRTSAHHIMPVLLPRYARRQAVIDELRTQGIQTTIHYPPVHQMTFYRERYPGVALPRTEDFAQRELTIPLHPQITSPVAEAVVAALASALNGDAQTGTAA

SEQ ID NO: 42921 - DNA, 1143 bp, Mesorhizobium loti MAFF303099
  CDS (1)..(1143)
atgcagttcatcgatcttggcgcacagcgcgaacgcatccgcgaccgactgaaggccgcgatcgaccgtgtcgtcgacgaaggccgctatatcctgggaccgcaggtcgccgaattcgaaaacaagcttgcggcctatgtcggcaccaaacatgtggtggcctgcgccaacggcaccgatgcgctgctgctgccgctgtttgccgccgggatcggcccgggcgacgcggtgttcgtgccgagcttcactttcgccgccaccgcagaagtggtggcgctggccaaggcggaacctgtcttcgtcgatgtcgatccggtgacctacaacgtcgacatcgccagcctcgaggcggccatcgccatgatcaagaaggaaggccggctgaagccgaaggcgatcatcccggtcgacctgttcggtctcgccgccgattacgatgcgatcatggcgatcgccaaccgcgaagggctgttggtgatcgaggacgccgcccagtccatgggtgggtcgcttgacggcaagatgtgcggtgcgttcggccatgtcggctcgaccagcttctatcccgccaagccgcttggctgctatggcgacggtggcgcgatgttcaccaacgacgacgagatggccgacaagctgcgttcctttgccttccacggcaagggcgagacgcaatacgacaacatccgcgtcggcatcaattcgcggctcgacacgctgcaggcggcgatcctcatcgaaaaactcgccattctcgaagacgagatggtggcacgccaggtggtggcaaaccgctatgccgagggacttggcgatgtcgtgacagcggcccgtaacctcgacggcagccgttcggcctgggcgcagtacgccatcgagacgcccaagcgcgatggcctgaaggcgcatctgagcgaaaagggcattccgtccgtcatctactacgtcaagccgctgcacgcgcaggtcgcctacagcgactacccacgcacgccgaccggtcttgccgtctcggaggagctgccgaagcgcatcctgtgcctgccgatgcatccctatctcagcgaagccgaccaggaccggatcatcgagacgatccgcaactatatcggctcgaactcggcgcaggcagcagccgagtaa

SEQ ID NO: 42922 - protein, 380 aa, Mesorhizobium loti MAFF303099
MQFIDLGAQRERIRDRLKAAIDRVVDEGRYILGPQVAEFENKLAAYVGTKHVVACANGTDALLLPLFAAGIGPGDAVFVPSFTFAATAEVVALAKAEPVFVDVDPVTYNVDIASLEAAIAMIKKEGRLKPKAIIPVDLFGLAADYDAIMAIANREGLLVIEDAAQSMGGSLDGKMCGAFGHVGSTSFYPAKPLGCYGDGGAMFTNDDEMADKLRSFAFHGKGETQYDNIRVGINSRLDTLQAAILIEKLAILEDEMVARQVVANRYAEGLGDVVTAARNLDGSRSAWAQYAIETPKRDGLKAHLSEKGIPSVIYYVKPLHAQVAYSDYPRTPTGLAVSEELPKRILCLPMHPYLSEADQDRIIETIRNYIGSNSAQAAAE

SEQ ID NO: 42923 - DNA, 1101 bp, Pyrococcus abyssi GE5
  CDS (1)..(1101)
atgataccaatagctaaacccataatcgaggatgaggagataaatgccgttgttaatgtgttaaagagcggaatgctcgcccagggaaaggaagttgaagccttcgaaaaggaattctcagaatacctgggggttaagcatgctatagcggtaacgaacgggacaatagctttggacgtagctttgaaagcccttaaaatagggcaaggagatgaggttataacaacccccttcactttcatagcttcggctaactctatactattccagggagctaagcccgtctttgcggatatagatccaaaaacttttaacttagatccaaacgacgttttagaaaagataacgagtaaaaccaaggctatactggttgttcatctgtatgggcaacccgcggacatgaaagccttcagggagatagcggaggatcacaatctctacttaatagaagactgtgcccaagctcacggggccgaattcgaaggcaaaaaggttggaaccttcggggatatagctgcgttcagcttttacccaacgaagaacatgacgacaggagaagggggaatggtcgtcacggacaacgatgaattagctgagagagcaaggctaataagggatcatggccaggctgagaagtacctccacgtggagctcggctacaactacaggatgaccaacatagcagcagccataggtagagctcagctcaagaagcttgataagtggaacgagataagaatcaagaacgccgaaattctctcaagggggatagagaggattaaaggattgacacccccattcgtagacccgagggttaaacacgtcttccaccagtacgtgataagggttgaagatgattatccccttagcagggacgaactagcaaaagagcttagaaacaggggtattggaaccgccgttcactacccagttcctgttcatcaccagccactgtatcagaagcttggctatccaagggatatttgtccaaacgccattgaagcttctagaaaagtcctcagccttccagttcacccagctgtgagtagggaagaccttgattacataatcagaaccttggaggagctgggtggggaatga

SEQ ID NO: 42924 - protein, 366 aa, Pyrococcus abyssi GE5
MIPIAKPIIEDEEINAVVNVLKSGMLAQGKEVEAFEKEFSEYLGVKHAIAVTNGTIALDVALKALKIGQGDEVITTPFTFIASANSILFQGAKPVFADIDPKTFNLDPNDVLEKITSKTKAILVVHLYGQPADMKAFREIAEDHNLYLIEDCAQAHGAEFEGKKVGTFGDIAAFSFYPTKNMTTGEGGMVVTDNDELAERARLIRDHGQAEKYLHVELGYNYRMTNIAAAIGRAQLKKLDKWNEIRIKNAEILSRGIERIKGLTPPFVDPRVKHVFHQYVIRVEDDYPLSRDELAKELRNRGIGTAVHYPVPVHHQPLYQKLGYPRDICPNAIEASRKVLSLPVHPAVSREDLDYIIRTLEELGGE

SEQ ID NO: 42925 - DNA, 1239 bp, Treponema pallidum subsp. pallidum str. Nichols
  CDS (1)..(1239)
atggaaggtaccgtgaaaaaaaagaaagagggtgttcgtgatgataacgcgcagcatgcggtgttcaacaaacaagtgccgttttttgtgccctcgttttctgaagcggaagagcgcgcagtctgcgatgtgttgcgttcaggatggattacgacgggaacacaagcactcgcgtttgaaaaagagtttgccgcgtatgtgggtgctccctatgcgtgtgcggttaactcagctaccagtggtttgcttctcacctttgatgcaatgggcattgggccggatagtaagatacttaccagtccttatacgtttgtgtctacggcgagctctgcactccacctaggtgcgcaggtggtgtacgccgatatcgagcgcgactcttataatatcagtgcagagtgtgttgaagcgtgtttaaaaaaggatgcgcgcatccgtgctattgtacccatccatattgccgggaatgtatgcaatatgcgtgatctcaatgctcttgcgcgtaagtatcaagtggcagtggtggaagatgcagcacacgcttttccatcgaagactgcgtgtgggtatgcaggcacactgtcacatgcgggggtattttccttttatgccaccaagccgttaaccaccggtgaaggaggtatggtttgcacaaatgatgcgaagcttgcagcgcgtattgcgtgtttgcgttcacatggcattgaccgggctatttgggatcggtacacaaatggcaccgcaccgtggcgttatgacgtaacaagccttgggtggaagtgtaacctgccggatattttagcagcaattggacgcgtacagttgcagaaggcggcgcatctttttgcacaacgcgcgcgtattgccgccgcgttcacgcgtgctttttctcgttatgaatttttttgtactccgcctgatggggatggaaacgcgtggcatttgtatttgttgcgcttagttcctggaacgctttctgtttctcgggacgagttcgtcagattattgcaggaacggggattgggcgtttctatgcattttattcctcatttcgagatgacgttttttaagaaaagtctgtgtgtacgagcggaagatttccctgagtgtgcgcacaagtatcagcacacgcttacgcttccgttgtggccgggaatggatgacagttgcgtggcgtatgtgatagagaccgtggtgcgcaccgcacaagaatgtgcaaagggaagagcatatatatga

SEQ ID NO: 42926 - protein, 412 aa, Treponema pallidum subsp. pallidum str. Nichols
MEGTVKKKKEGVRDDNAQHAVFNKQVPFFVPSFSEAEERAVCDVLRSGWITTGTQALAFEKEFAAYVGAPYACAVNSATSGLLLTFDAMGIGPDSKILTSPYTFVSTASSALHLGAQVVYADIERDSYNISAECVEACLKKDARIRAIVPIHIAGNVCNMRDLNALARKYQVAVVEDAAHAFPSKTACGYAGTLSHAGVFSFYATKPLTTGEGGMVCTNDAKLAARIACLRSHGIDRAIWDRYTNGTAPWRYDVTSLGWKCNLPDILAAIGRVQLQKAAHLFAQRARIAAAFTRAFSRYEFFCTPPDGDGNAWHLYLLRLVPGTLSVSRDEFVRLLQERGLGVSMHFIPHFEMTFFKKSLCVRAEDFPECAHKYQHTLTLPLWPGMDDSCVAYVIETVVRTAQECAKGRAYI

SEQ ID NO: 42927 - DNA, 1152 bp, Thermotoga maritima MSB8
  CDS (1)..(1152)
atgattccgttatcaaggcccgatataaacgagcaggacatcgaaagggtagtggaagttttaaaaagcggaaggctcagtctcggtgaatacacgaagcgttttggagagatggtggccgaatacacgggtgccagattcggctgggcggtgagcagtggaacagctgcgctccatctcatcctggagagtctcgatatcgacgagggagatctgatccttgtgccttccttcaccttcatcgcttctgttaacgtaatcctaatgaaaagggcaattcccgttttcgtggatgtggatgagagaactctgaacgtttctccagaaacactggaggaggcggtgaaaaggtgcctcaaaggattcaaacagggaaacattgagataaaaggaaaaccccgtctcttcatggccgttgatgtttttgggcatcccctcgactgggacgggattctcgacgtctgtcagaggtacggcatcgcggtggtggaagactcctgtgaagctcttggatccgagtacaaaggaagaaaggtgggcacctttggagtggccggcgctttcgcattctacccgaacaaacagatcaccacaggagagggcggtgttgttgtgacgaacgatgaaaagatacacaccgctgtgaagagcatgagcaaccagggaagaggtgaaggagacgaatggctctaccatgtgcgtttcggttacaactacagaatcgacgagatgtcggccgcgcttggatgctctcaaatggaaagaatcgatgagatcgtagaaaaacgcgcagaagcggcggagagatattcaaagatgttgaaggagttttcctgggtaaaggtgcccgtcgtggaagattacgtcactaagatgagctggttcgtctacgtcgtgagactggaaggtccagatagaaaccgtgtgatgaggtacatggaagaaaagggagtccaggttagaaactacttttatcccgtccactttcaaccattctacgaaaaactcttcggcagcatgaaaggactgcttcccgtgacggagagggaatctgagaaaacgctcgccattccgttctttacgagcatcacagaaagtgaacagaagacggtggtggagatcctcagagaggcggtggagagggttggttag

SEQ ID NO: 42928 - protein, 383 aa, Thermotoga maritima MSB8
MIPLSRPDINEQDIERVVEVLKSGRLSLGEYTKRFGEMVAEYTGARFGWAVSSGTAALHLILESLDIDEGDLILVPSFTFIASVNVILMKRAIPVFVDVDERTLNVSPETLEEAVKRCLKGFKQGNIEIKGKPRLFMAVDVFGHPLDWDGILDVCQRYGIAVVEDSCEALGSEYKGRKVGTFGVAGAFAFYPNKQITTGEGGVVVTNDEKIHTAVKSMSNQGRGEGDEWLYHVRFGYNYRIDEMSAALGCSQMERIDEIVEKRAEAAERYSKMLKEFSWVKVPVVEDYVTKMSWFVYVVRLEGPDRNRVMRYMEEKGVQVRNYFYPVHFQPFYEKLFGSMKGLLPVTERESEKTLAIPFFTSITESEQKTVVEILREAVERVG

SEQ ID NO: 42929 - DNA, 1134 bp, Thermotoga maritima MSB8
  CDS (1)..(1134)
atgatccccctttttgatctcacgaggcagtacgagagaatcaggggagaaatcttgaacgcgatagacaagctgatctcttcgggaaatgtgattctcggagagaacgtgagaagactcgaggaagaaatcgccagttttaccggcgtgaagcacggtgttggtgttgcgagcgggagcgacgcgcttctcatagcgctgagggcgatgggagtggaaaagggagatacggtggttacaacaccctacaccttctttgccacggcgagcgcaccctacagactcggtgccagggtaattttcgtcgacgtggacgaaagcaccttcaacatggatctgaaccagctcgagcatgttctgaaaaaagagaaggtgaaggcgatcattcccgttcatctcttcggtagaaccgtggatctcgaggcgctgagctttttgagggagaaatacggagtgatgattcttgaagactgtgctcagtcgatgggatcggagtggaagttctcgagcggcgagattagaaaaagtggttctgtgggggatgcggcgattttctctttctttcccacgaagaacctggggacctacggcgacggcgggatgatcgtgacaaacagcgatgagatagcggaagaaagcaggatcctgagagtgcacggtgcaagaaagaagtactttcacgaaaaggtgggatacaactcgaggctcgacgagatacacgcggcgattctgagggtgaaactcaggtatctggaaaggtggacagaagagagaacacgtgtggcgaggacgtaccaaaaactgttcgaggagaaaaaactgcctgtggtctatccccgcgtggaggagaaaggcttcaggtaccacgttttccaccagtatgtggtgctcttcgaaaatgaagaggtgagggagagagtcagagaaggattgaaagagagaggcattcagacagcgatttattaccccctgcctctccaccttcaaaagtgcttcagggatctgggatatcaggaaggagatttcccggtggccgaatctctttcgaagagaagtcttgcgcttcccatgttcccagaactgagagacgacgagataaaagaagtcgtcgacacgatagcgctctttctttag

SEQ ID NO: 42930 - protein, 377 aa, Thermotoga maritima MSB8
MIPLFDLTRQYERIRGEILNAIDKLISSGNVILGENVRRLEEEIASFTGVKHGVGVASGSDALLIALRAMGVEKGDTVVTTPYTFFATASAPYRLGARVIFVDVDESTFNMDLNQLEHVLKKEKVKAIIPVHLFGRTVDLEALSFLREKYGVMILEDCAQSMGSEWKFSSGEIRKSGSVGDAAIFSFFPTKNLGTYGDGGMIVTNSDEIAEESRILRVHGARKKYFHEKVGYNSRLDEIHAAILRVKLRYLERWTEERTRVARTYQKLFEEKKLPVVYPRVEEKGFRYHVFHQYVVLFENEEVRERVREGLKERGIQTAIYYPLPLHLQKCFRDLGYQEGDFPVAESLSKRSLALPMFPELRDDEIKEVVDTIALFL

SEQ ID NO: 42931 - DNA, 1104 bp, Vibrio cholerae O1 biovar eltor str. N16961
  CDS (1)..(1104)
atgattcctgtatacgaaccaagtttggatggaaatgagcgtaaatatctaaacgattgcattgattccggttgggtatcctcaagggggaaatatattgatcgcttcgaaactgagtttgcggagtttttaaaagtaaagcacgccacaacagtatctaatggaacagttgcgctacatttggcaatgagcgcgttgggaataactcaaggcgatgaagtgattgtaccaacattcacttatgttgcctcggttaataccatagtccagtgtggtgcgttacccgtttttgctgaaatcgaaggtgagtctctacaagtgagcgtagaggacgttaaacgtaaaataaataaaaagacaaaagcagttatggccgttcacatatatggacaagcttgcgatattcaatctttaagagatctgtgtgatgagcacggcctctatttaattgaagactgtgcagaagcaataggtactgctgttaatggcaaaaaagtaggtacatttggcgatgtgtcaacgtttagtttctttggaaataaaaccatcacatcgggcgagggtggtatggttgtgtcaaactcagacataattatagataaatgtttacgcttaaaaaaccaaggggtagtggcagggaagcgctactggcatgacctagttgcgtataactatagaatgacgaatctatgtgctgcgattggtgttgctcagcttgaaagagttgataaaattataaagcgcaagcgtgatatagctgaaatttataggtctgaactcgctggactaccaatgcaagtgcacaaagagtctaatggaactttccactcatattggttgacgtctattatattagaccaagagtttgaagtgcaccgcgatgggttgatgaccttcttagaaaataatgacatcgagtctagaccatttttctatcctgctcacacgctgccaatgtacgagcatttggcagaaaagacagcttttccgttatcaaatagctactctcatcgaggtattaatttacccagttggccagggttatgcgatgatcaagtaaaagaaatttgcaactgtattaaaaattatttcaactgtatttga

SEQ ID NO: 42932 - protein, 367 aa, Vibrio cholerae O1 biovar eltor str. N16961
MIPVYEPSLDGNERKYLNDCIDSGWVSSRGKYIDRFETEFAEFLKVKHATTVSNGTVALHLAMSALGITQGDEVIVPTFTYVASVNTIVQCGALPVFAEIEGESLQVSVEDVKRKINKKTKAVMAVHIYGQACDIQSLRDLCDEHGLYLIEDCAEAIGTAVNGKKVGTFGDVSTFSFFGNKTITSGEGGMVVSNSDIIIDKCLRLKNQGVVAGKRYWHDLVAYNYRMTNLCAAIGVAQLERVDKIIKRKRDIAEIYRSELAGLPMQVHKESNGTFHSYWLTSIILDQEFEVHRDGLMTFLENNDIESRPFFYPAHTLPMYEHLAEKTAFPLSNSYSHRGINLPSWPGLCDDQVKEICNCIKNYFNCI

SEQ ID NO: 42933 - DNA, 1170 bp, Pasteurella multocida subsp. multocida str. Pm70
  CDS (1)..(1170)
atgctcaatacaccttttgcaccttggccatccttttcagaacaagaaattgatgccgtcgtcaaagtacttcggtctaatcaagtcaattactggacaggacaagtatgccgagaatttgaaaaagaatttgcacactacactcaaacaaagcatgccattgcgttgatgaatggtacagttgcactggatcttgccttaaaagccctcgacattaaagctggcgatgatgtgattgtgacttctcgcacttttcttgcttcagcaagctgtattatcactgccggcgcaaatcctgtgtttgccgatgttgagcttgattcacaaaatatctctcgtcgaactattgaagccgttttaacgccgaatacaaaagctatcatctgtgtacatttagcagggctaatgtgtgatatggatccgattatggcgctggctcacgaaagaggattgtatgtcattgaagactgtgctcaagctcatggcgcaatgtataaaggacgttccgcaggttccataggtcacattggtgcctggtcattctgccaagacaaaatcatgacaactggcggagaaggcggaatggtgactacgaatgatacggtcctttggaataagatgtggtcctataaagatcatggtaaaagttttgacgcagtttatcataaaacacatcctgcaggctttaaatggcttcacgaatcttttggcaccaactggcgcatgatggaaattcaagcggcgattggacgtattcaacttacaaaaatgccagaatggacgaaaaaacgaaatcaaaatatgcaacgtattttggccgcatttgctgactcgccttattttacgcaacatacactaacaccagattatgttcatgccgcctataaatgttacgtacaagtcaacccgacaacactacctcaaggctgggatcgtgatcgtatcatgcaacatatcaatgcattaggcgtgccttgttatagcggttcttgctcagaagtttatttagaaaaagcatttgagcacaccacatggcgaccaaataaacgtttagaaaacgcgaaacaattaggggaaaccagtttaatgtttttagtccatcccacattaactgaatcagacatcagtcgatgtgtggaagtgataaaaacagtaattgaacaaatttaa

SEQ ID NO: 42934 - protein, 389 aa, Pasteurella multocida subsp. multocida str. Pm70
MLNTPFAPWPSFSEQEIDAVVKVLRSNQVNYWTGQVCREFEKEFAHYTQTKHAIALMNGTVALDLALKALDIKAGDDVIVTSRTFLASASCIITAGANPVFADVELDSQNISRRTIEAVLTPNTKAIICVHLAGLMCDMDPIMALAHERGLYVIEDCAQAHGAMYKGRSAGSIGHIGAWSFCQDKIMTTGGEGGMVTTNDTVLWNKMWSYKDHGKSFDAVYHKTHPAGFKWLHESFGTNWRMMEIQAAIGRIQLTKMPEWTKKRNQNMQRILAAFADSPYFTQHTLTPDYVHAAYKCYVQVNPTTLPQGWDRDRIMQHINALGVPCYSGSCSEVYLEKAFEHTTWRPNKRLENAKQLGETSLMFLVHPTLTESDISRCVEVIKTVIEQI

SEQ ID NO: 42935 - DNA, 1080 bp, Pseudomonas aeruginosa PAO1
  CDS (1)..(1080)
atgattgaattcatcgacctgaagaaccagcaagcgcgtatcaaggacaagatcgatgccggtatccagcgcgtgctgagacacgggcagtacattcttggcccggaagtcactgagcttgaggatcgcctcgccgatttcgtcggcgctaagtactgcatcagttgcgccaacggtactgacgctctacagattgtgcagatggccttgggtgttggcccaggtgacgaagtaatcacccctggttttacttatgttgcgacagcggagaccgtcgcgcttttgggagccaagccggtttacgtggatattgatccacgcacctacaatcttgatccgcagttgctggaggctgcgatcacaccgcgtacgaaggctatcattcctgtttcgctgtatggccagtgtgcagacttcgatgcaatcaacgccattgcctccaaatatggtatccctgtcattgaggatgctgcacagagcttcggtgcttcgtacaagggtaagcgttcttgtaatctgagtaccgttgcctgcaccagcttcttcccgagcaaaccgttgggttgctatggggatggtggagcgatcttcactaacgacgatgaactggctactgctattcgtcaaattgcccggcatggtcaggaccgccgctatcatcacattcgtgtgggggtgaatagtcggttggacacattgcaggctgcgattcttctaccgaagcttgaaattttcgaggaggagattgcgttgcgccagaaggtagccgcggagtatgacctatcactgaaacaggtcggtatcggcacgccgtttattgaagtgaataacatcagtgtttatgcccagtatacggtgcgtatggataatcgagagtctgttcaggcttctttgaaagctgccggggttccaactgctgtgcattaccctattccgcttaataagcagcctgctgttgcggatgagaaagcgaaactaccagtgggtgacaaggctgctactcaagtaatgagcctacccatgcatccctatctggatacggcatccatcaaaatcatctgtgctgcgttgacgaattga

SEQ ID NO: 42936 - protein, 359 aa, Pseudomonas aeruginosa PAO1
MIEFIDLKNQQARIKDKIDAGIQRVLRHGQYILGPEVTELEDRLADFVGAKYCISCANGTDALQIVQMALGVGPGDEVITPGFTYVATAETVALLGAKPVYVDIDPRTYNLDPQLLEAAITPRTKAIIPVSLYGQCADFDAINAIASKYGIPVIEDAAQSFGASYKGKRSCNLSTVACTSFFPSKPLGCYGDGGAIFTNDDELATAIRQIARHGQDRRYHHIRVGVNSRLDTLQAAILLPKLEIFEEEIALRQKVAAEYDLSLKQVGIGTPFIEVNNISVYAQYTVRMDNRESVQASLKAAGVPTAVHYPIPLNKQPAVADEKAKLPVGDKAATQVMSLPMHPYLDTASIKIICAALTN

SEQ ID NO: 42937 - DNA, 1149 bp, Pseudomonas aeruginosa PAO1
  CDS (1)..(1149)
atgtcactggactttctgccattctcccggccaagcatcggcgaggacgaaatcgccgccgtggagcaggtcctgcgttccggctggatcaccaccgggccgaagaaccaggagctcgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagtgccctcgccgaacgggtccgccgcctcaagttccacggcctcggggtcgatgcctacgaccgcctgagccatggacgcaagccgcaggcggaagttatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggtctgcggcctgggccgcgacgccttcatggaagccctgaaggcgcgcggcatcggtagcggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggagatcctggagaaacgtcgatga

SEQ ID NO: 42938 - protein, 382 aa, Pseudomonas aeruginosa PAO1
MSLDFLPFSRPSIGEDEIAAVEQVLRSGWITTGPKNQELEQRFAERLGCRHAVALSSATGALHVTLLALGIGPGDEVITPSLTWVSTANVITLLGATPVFVDVDRDTLMCSAQAVEAAIGPRTRAIVPVHYAGSTLDLEGLRTVAGRHGIALVEDAAHAVGSEYRGRPVGSRGTAIFSFHAIKNLTCAEGAMFVSDDSALAERVRRLKFHGLGVDAYDRLSHGRKPQAEVIEPGFKYNLADLNAALALVQLKRLDALNARRQALAERYLERLAGLPLAPLGLPAHKQRHAWHLFILRIDAEVCGLGRDAFMEALKARGIGSGIHFIASHLHHYYRQRQPRLSLPNSEWNSARLCSIPLFPDMRDDDIERVARAIEEILEKRR

SEQ ID NO: 42939 - DNA, 1176 bp, Neisseria meningitidis MC58
  CDS (1)..(1176)
atgctgaacactttcctttccccgtggccctgcttcacccaagaagaagccgatgccgtttccaaagtcctgctgtccaacaaagtcaactactggacgggcaacgaatgccgcgaatttgaaaaagaatttgccgcctttgccggcacgcggtacgccgtcgcccttgccaacggcacgctggcactcgatgtcgcgctcaaagcaatgggcataggcgcgggcgacgatgtgattgttacctcgcgcaccttcctcgcttccgcgtcctgcattgtgaacgcgggcgcaaaccccgtgtttgccgatgtggatttgaacagccaaaacatcagcgcggaaaccgtcaaagccgcgctgacaccgactaccaaagccgtcatcgtcgtccacctcgccggtatgcccgccgaaatggacggcattatggctttggcaaaagaacataatctttgggtaatcgaagactgcgcccaagcgcacggcgcaaaatacaaaggcaaatccgtcggctctatcggacacgtcggcgcgtggtcgttctgccaagacaaaatcatgaccaccggcggcgaaggcggtatggttacgaccaacgacaaaaccctgtgggaaaaaatgtggtcgtacaaagaccacggcaaaagctacgatgccgtgtacaaccacgaacacgcgcccggtttccgctggctgcacgaaagtttcggcacaaactggcgtatgatggaaatgcaggcggtcatcggacgcatccagctcaaacgcctgcccgaatggacggcgcgccgccgagaaaacgccgccaagctggcggaaagtttgggcaaattcagcagcatccgcttggttgaagtcgccgactacatcggacacgcgcaatataagttctacgccttcgtcaaacccgaacacctcaaagacggctggacgcgcgaccgcatcgtcggcgaactgaacgcgcgcaaagtcccctgctatcaaggcagctgctccgaagtctatttggaaaaagccttcgacaacacgccgtggcgaccgaaagagcgtttgacaaatgctgtcgagttgggcgacaccagcctgatgttcttggtgcacccgacgctgaccgacgacgaaattgcgttttgcaaaaaacacatcgaagccgtcttgaccgaagccgcacgataa

SEQ ID NO: 42940 - protein, 391 aa, Neisseria meningitidis MC58
MLNTFLSPWPCFTQEEADAVSKVLLSNKVNYWTGNECREFEKEFAAFAGTRYAVALANGTLALDVALKAMGIGAGDDVIVTSRTFLASASCIVNAGANPVFADVDLNSQNISAETVKAALTPTTKAVIVVHLAGMPAEMDGIMALAKEHNLWVIEDCAQAHGAKYKGKSVGSIGHVGAWSFCQDKIMTTGGEGGMVTTNDKTLWEKMWSYKDHGKSYDAVYNHEHAPGFRWLHESFGTNWRMMEMQAVIGRIQLKRLPEWTARRRENAAKLAESLGKFSSIRLVEVADYIGHAQYKFYAFVKPEHLKDGWTRDRIVGELNARKVPCYQGSCSEVYLEKAFDNTPWRPKERLTNAVELGDTSLMFLVHPTLTDDEIAFCKKHIEAVLTEAAR

SEQ ID NO: 42941 - DNA, 1092 bp, Methanothermobacter thermautotrophicus str. Delta H
  CDS (1)..(1092)
atgatacctattctagaaccatctattggaaatgaagagttagaaaatgtcctggaagctctaaagagcggatggataagttcgaggggagaatttataactaaattcgaggaaaaatttgcaagatatcatggcatgggctttgggataagcacatcaaatgggacaacagcacttcaccttgcccttaaatcagttgggataaaaaaaggagatgaggttattgtaccatctttaacctttgcagccacagcaaatgcagtcatatactgtaatgcaaaacctgtacttgtagattcacatcctgattactggtgcattgatccatcaaggattgaggaaaaaataaataagaacacacgtgcgataatacctgtccatctttatggtcatccatgtgatatgggctggattggggatattgccgatgaacatggattgattattatagaggatgctgcggaggcccacggagcagaatacagagggaaaaagatcggcaccttcggggacgtgtcttgtttttcattttatggtaacaaaataataaccactggtgaaggtggaatgtgtcttactaatgatgaggagcttgctgagagaatggcagtgttaagggatcatggtatgagaccggaaaagagatactggcacgaggaggttggattcaattataggatgactaatttacaggctgcggtgggtgttgctcaattagaaaaaattgatggttttattaatagaaaacgggaaatagctgagatatacaatagaggtcttgctgaattacatgaaaatgaagaattaatgttgcacccagagatgttatgggccagatctgtatactgggtttattcgattgtccttaaaaaaaggaagaacatggatttaataaggtaccttaattcttgtggggtggatacaagaccatttttttatcctcttaatttaatgcctccctataaagatgattccagctatcctgtggcagaaaacctctcttatggtggtctgagtcttccatcaagtgttgaaattggagatgaagccatagaatacgttgttgatagagtaagggagttttttgaatga

SEQ ID NO: 42942 - protein, 363 aa, Methanothermobacter thermautotrophicus str. Delta H
MIPILEPSIGNEELENVLEALKSGWISSRGEFITKFEEKFARYHGMGFGISTSNGTTALHLALKSVGIKKGDEVIVPSLTFAATANAVIYCNAKPVLVDSHPDYWCIDPSRIEEKINKNTRAIIPVHLYGHPCDMGWIGDIADEHGLIIIEDAAEAHGAEYRGKKIGTFGDVSCFSFYGNKIITTGEGGMCLTNDEELAERMAVLRDHGMRPEKRYWHEEVGFNYRMTNLQAAVGVAQLEKIDGFINRKREIAEIYNRGLAELHENEELMLHPEMLWARSVYWVYSIVLKKRKNMDLIRYLNSCGVDTRPFFYPLNLMPPYKDDSSYPVAENLSYGGLSLPSSVEIGDEAIEYVVDRVREFFE

SEQ ID NO: 42943 - DNA, 1083 bp, Methanothermobacter thermautotrophicus str. Delta H
  CDS (1)..(1083)
atgataccggttgctactccaataatcgatgaagaggaaattcaggaagtcataaaggtacttaaatcgggttttatcgcgcagggacccagggtggctgaattcgaggagaaatttgcggcctatgtgggaacagagcatgcagttgcaacgagttcagggacaacagcccttcatctggccctcctcgccgctggagttggaaagggggatgaggtaataacaacccccttcagtttcgctgcaacagcaaacgcagccctctacgtcggagccacaccagtattcgcagatatagaccccctgacatataatatagatcctgagaggatagaggaactcataacacccagcacaagggcgataataccggtccacctctatggccagcccgcagacatggaccccataatggaccttgcagctgaccatgacatcctggtcattgaggatgctgcacaggcccacggagcagagtatcatggaaggaaagtcggttccatgggcgatgccgcctgtttcagcttctaccccacaaagaacatcacaacaggtgagggcggaatcataacaactgatgacgatgagatagctgagatggcacgtatactcagggcccatggggagacagaacgctacaggcacacatacctgggatacaacttccgcatgactgacatctcagccgccatcgggatagcccagctcggaaaactcgaggagttcaacagcaggcgaattgaaaatgcagcttacctcacatcccagctgggggaccttgagggagtatcaacaccccacattgcagctggggtcaggcacgtctttcaccagtacaccctgcgggttccaggctcaagggatgaactcatgggcttcctcaatgagaggggtgtgggtacaggcatccactatcccagaccaatctacaggcaggaactgtaccagagactgggctttgatgccagatgcccggtgagtgaggcggctgcagcggaggtcctctcaataccggtacaccctgccctaaccggtgaggagcttgagagggtcgcaggcacggtcagggaattttttgagtaa

SEQ ID NO: 42944 - protein, 360 aa, Methanothermobacter thermautotrophicus str. Delta H
MIPVATPIIDEEEIQEVIKVLKSGFIAQGPRVAEFEEKFAAYVGTEHAVATSSGTTALHLALLAAGVGKGDEVITTPFSFAATANAALYVGATPVFADIDPLTYNIDPERIEELITPSTRAIIPVHLYGQPADMDPIMDLAADHDILVIEDAAQAHGAEYHGRKVGSMGDAACFSFYPTKNITTGEGGIITTDDDEIAEMARILRAHGETERYRHTYLGYNFRMTDISAAIGIAQLGKLEEFNSRRIENAAYLTSQLGDLEGVSTPHIAAGVRHVFHQYTLRVPGSRDELMGFLNERGVGTGIHYPRPIYRQELYQRLGFDARCPVSEAAAAEVLSIPVHPALTGEELERVAGTVREFFE

SEQ ID NO: 42945 - DNA, 1074 bp, Campylobacter jejuni subsp. jejuni NCTC 11168
  CDS (1)..(1074)
atgaattttatcaatcttcaagcccaatatctcgcatacaaagatgaaatcaatgctgaaattgaaagcgttttatcaagctcttctttcataggcggtgcaaagcttaacgaatttgagcaaaatttagctcatttcttaggtgttaaacacgctataggttgctcaagtggaactagtgctttataccttgccttaagagtcttagatattggtaaagatgatgaagttatagtgcctagttttactttcatagcaacagctgaagttgtggccttggtaggtgcaaaacctgtttttgcagatataaatttatcaaattacaatcttgattttaaagcagtgcaaaaagcaataacttcaaaaactaaagctgttatagcagtgagtatgtttggacaaatgagtgatttaagggctttagaagaaattttaaaagataaaaatatcactttgatcgaagatggtgcacaaagttttggcgcaagtttcaaaggagaaaaatcctgctctatagctaaaatttcatgcacaagcttttttccttcgaagcctttgggagcttatggcgatggcggggctattttttgccatgatgatgaaattgctaaaaaaataagaattttactcaatcacggacaaactcagcgttataaacatgaatttataggtataaatggacgccttgacaccttacaagcagcgattttaaatgttaagttaaaatacctagaaaaagaattagacaaaagacaaaaattagcacaaatttataatgcaaatttaaaaaactgtcaaattccacaaattaatccaaatgcttttagcgcttatgcacaatacagtgttttagttgaagatagagctagtgtattgcgaaaatttgaaaaagctaatataccttatgctatacactatccaacccctttgcataaacaaccttgctttagtgagttttcaaatttagaacttaaaaattcagaatacgcaagcgaacacatcttatctttgcctttttcaccttttttaagtgaagaagagcaagagcaagttatttgtatttttaaagattaa

SEQ ID NO: 42946 - protein, 357 aa, Campylobacter jejuni subsp. jejuni NCTC 11168
MNFINLQAQYLAYKDEINAEIESVLSSSSFIGGAKLNEFEQNLAHFLGVKHAIGCSSGTSALYLALRVLDIGKDDEVIVPSFTFIATAEVVALVGAKPVFADINLSNYNLDFKAVQKAITSKTKAVIAVSMFGQMSDLRALEEILKDKNITLIEDGAQSFGASFKGEKSCSIAKISCTSFFPSKPLGAYGDGGAIFCHDDEIAKKIRILLNHGQTQRYKHEFIGINGRLDTLQAAILNVKLKYLEKELDKRQKLAQIYNANLKNCQIPQINPNAFSAYAQYSVLVEDRASVLRKFEKANIPYAIHYPTPLHKQPCFSEFSNLELKNSEYASEHILSLPFSPFLSEEEQEQVICIFKD

SEQ ID NO: 42947 - DNA, 1161 bp, Campylobacter jejuni subsp. jejuni NCTC 11168
  CDS (1)..(1161)
atgagattttttctttctcctccgcatatgggtggtaatgaattaaaatacatagaagaagttttcaaaagcaattatatagcacctttgggtgaatttgtaaatcgctttgaacaaagtgtcaaggcttacagtaaaagtgaaaatgccttagctttaaattcagccacagcggctttgcatttagctttaagggtggcaggggtaaaacaagatgatattgttttggcttcttcttttacttttatcgcttcagtagcacctatttgttatcttaaagcaaaacctgtatttatagattgtgatgaaacttataatatcgatgtagatttattaaagcttgctattaaagaatgtgaaaaaaaaccaaaagcattgattttaactcatctttatggcaatgcggctaaaatggatgaaattgttgaaatttgcaaagaaaatgaaattgttttaatcgaagatgctgctgaagctttaggaagtttttataagaataaagctttaggaacttttggagaatttggagcttattcttataatggcaataaaattatcaccacttcaggtggaggtatgcttataggaaaaaataaagaaaagattgaaaaagcaagattttatagcactcaagctagggaaaattgtttgcattatgaacatttagattatggttataattaccgcttaagcaatgttttaggagctattggcgtagcgcaaatggaggttttagaacaaagagtgcttaaaaaaagagaaatttatgagtggtataaagaatttttaggagagtgttttagctttttagatgaattagaaaattcaagaagcaatcgctggttaagtacagctttgattgattttgataaaaatgaacttaattcttgtcaaaaagatataaatatcagtcaaaaaaatattactttgcatccaaaaatttcaaaactcatagaagatttgaaaaatgaacaaatagaaacaagaccattatggaaagctatgcacgctcaagaagtatttaaaggagctaaggcttatcttaatggcaatagtgagttatttttccaaaaaggaatttgtttgccaagtggcacggcgatgagtaaagatgatgtttatgaaatttcaaaactgatcttaaagagcataaaggcttaa

SEQ ID NO: 42948 - protein, 386 aa, Campylobacter jejuni subsp. jejuni NCTC 11168
MRFFLSPPHMGGNELKYIEEVFKSNYIAPLGEFVNRFEQSVKAYSKSENALALNSATAALHLALRVAGVKQDDIVLASSFTFIASVAPICYLKAKPVFIDCDETYNIDVDLLKLAIKECEKKPKALILTHLYGNAAKMDEIVEICKENEIVLIEDAAEALGSFYKNKALGTFGEFGAYSYNGNKIITTSGGGMLIGKNKEKIEKARFYSTQARENCLHYEHLDYGYNYRLSNVLGAIGVAQMEVLEQRVLKKREIYEWYKEFLGECFSFLDELENSRSNRWLSTALIDFDKNELNSCQKDINISQKNITLHPKISKLIEDLKNEQIETRPLWKAMHAQEVFKGAKAYLNGNSELFFQKGICLPSGTAMSKDDVYEISKLILKSIKA

SEQ ID NO: 42949 - DNA, 1131 bp, Campylobacter jejuni subsp. jejuni NCTC 11168
  CDS (1)..(1131)
atgcttacttattctcatcaaaacatcgatcaaagcgatatagatacgcttacaaaagctttaaaagatgaaattttaacagggggtaaaaaggtaaatgaatttgaagaagccctttgtgaatatatgggcgtaaaacacgcttgtgtattaaactcagccacttcagcccttcatcttgcctacacagcactaggtgtccaagaaaaaatcgttttaactacccctttaacctttgccgctacagctaatgcggccttaatggctggagctaaggtagagtttatcgacattaaaaacgatggcaatattgatgaaaaaaaactagaagcaagacttttaaaagagagtgaaaatataggagctattagcgtggtagattttgcgggcaatagcgttgaaatggatgaaatttcaaaccttactaaaaaatacaatatccctttaatcgatgatgcaagccatgctttaggtgctttgtataaaagtgaaaaagtaggaaaaaaagccgatctttctatattttcttttcaccctgttaagcctatcactacttttgaaggtggggctgtggtgagtgataatgaagagcttatcgataaaatcaagcttttaagaagccatggtattgttaaaaaaaggctttgggatagcgatatggtagaacttggctataattaccgcttaagtgatgttgcttgtgctttagggataaaccagcttaaaaaactcgatcacaatcttgaaaaacgcgaagaaatcgcaaatttttacgataaagaatttgaaaaaaatccttatttttccacgataaaaatcaaagactataaaaaaagttcaagacatttatatcctattttgctttttcctgaattttattgtcaaaaagaagaactttttgaaagcttacttcatgcaggaattggcgtacaggtacattataaaccaacttatgagtttagtttttataaaaaactcttgggggaaatcaaactccaaaatgcagataatttttacaaagctgaacttagtataccttgtcatcaagaaatgaatctaaaagatgcaaaatttgtcaaagatactttatttagcattcttgaaaaagttaaaaagggatattgtggataa

SEQ ID NO: 42950 - protein, 376 aa, Campylobacter jejuni subsp. jejuni NCTC 11168
MLTYSHQNIDQSDIDTLTKALKDEILTGGKKVNEFEEALCEYMGVKHACVLNSATSALHLAYTALGVQEKIVLTTPLTFAATANAALMAGAKVEFIDIKNDGNIDEKKLEARLLKESENIGAISVVDFAGNSVEMDEISNLTKKYNIPLIDDASHALGALYKSEKVGKKADLSIFSFHPVKPITTFEGGAVVSDNEELIDKIKLLRSHGIVKKRLWDSDMVELGYNYRLSDVACALGINQLKKLDHNLEKREEIANFYDKEFEKNPYFSTIKIKDYKKSSRHLYPILLFPEFYCQKEELFESLLHAGIGVQVHYKPTYEFSFYKKLLGEIKLQNADNFYKAELSIPCHQEMNLKDAKFVKDTLFSILEKVKKGYCG

SEQ ID NO: 42951 - DNA, 1155 bp, Campylobacter jejuni subsp. jejuni NCTC 11168
  CDS (1)..(1155)
atgtttaaaaaagaaatttcttttataaaaagtctttttaataaagaaaatatcgccctacatgagccttgctttataggcaatgagaaaaaatatctcttagaatgtatcgatagcggttttgtttcaagcgtaggagaatttgtaacgcgttttgaagaagctttaaaagaaaaaaccaaagcacgctttgtcatcgctacaaatacaggcacagcagcccttcatatcgctttactagctaatggtatcgatgaaaactgcgaagtcatcactcaaagcataagctttgtcgctacggccaatgctatcgcttatacaggtgcaaaacccgtttttttagatatagatgaaaacactctaagtttaagtcctaaggctttagagcattttttagaaaatcaaacttatcaaaaagataatcttagctataacaaaaccacacacaaactcatcaaagcttgtgttattatgcacacctttggtttaagcgctcatataaaagccatcaaagagctttgtgaaaaataccacatccttttaattgaagatgctgcagaagccttaggaagcacctatgaaaacaaggccttaggcacttttggaaagtgtggaattttaagctttaatggcaataaaatcatcacaggtggatgcggtggggcgatattaagcgatgatgaaaatttagccaaacttgcaagacaccttagcaccacagctaaaatcccccatccttacgaatacgatcatgataggatagcttataattaccgtctttgcaatataaacgcagcaatcttgtttgcaggacttgaaaatttagaactttttttagaaaacaaaagagaacttgctaaaatttacaaggatttttttaaaaatcacgataaatgtaaatttatcgatgaaaaaagcaatgaaaaaagcaatttttggctcaataccttgctttttaaaaatgaaaatttaagaaatatttttttagaagaatgcttgaaaaataatattttcgtccgtcctgtatggaaaagcttaccgagtttaaaagcttttcaaaactgtcaaagcaatgagcttatgaacactaaaaaattagaaaaacgcttgattaatttacctagtagcgttagaatagcaaataaaaaggaatga

SEQ ID NO: 42952 - protein, 384 aa, Campylobacter jejuni subsp. jejuni NCTC 11168
MFKKEISFIKSLFNKENIALHEPCFIGNEKKYLLECIDSGFVSSVGEFVTRFEEALKEKTKARFVIATNTGTAALHIALLANGIDENCEVITQSISFVATANAIAYTGAKPVFLDIDENTLSLSPKALEHFLENQTYQKDNLSYNKTTHKLIKACVIMHTFGLSAHIKAIKELCEKYHILLIEDAAEALGSTYENKALGTFGKCGILSFNGNKIITGGCGGAILSDDENLAKLARHLSTTAKIPHPYEYDHDRIAYNYRLCNINAAILFAGLENLELFLENKRELAKIYKDFFKNHDKCKFIDEKSNEKSNFWLNTLLFKNENLRNIFLEECLKNNIFVRPVWKSLPSLKAFQNCQSNELMNTKKLEKRLINLPSSVRIANKKE

SEQ ID NO: 42953 - DNA, 1215 bp, Neisseria meningitidis Z2491
  CDS (1)..(1215)
atgaggaaatgccgtctgaaaaccgacggaccaaacaccatgttgaacacttccctttccccgtggccctgcttcatccaagaagaagccgatgccgtttccaaagtcctgctgtccaacaaagtcaactactggacgggcagcgaatgccgcgaatttgaaaaagaatttgctgctttcgccggcacgcggtacgccgtcgccctttccaacggcacgctggcactcgatgtcgcgctcaaagcaatgggcataggcgcgggcgacgatgtgattgttacttcgcgcaccttcctcgcctccgcctcctgcatcgtgaacgcaggcgcaaaccccgtgtttgccgacgtggatttgaacagccaaaacatcagcgcggaaaccgtcaaggctgtgctgaccccgaataccaaagcgattatcgtggttcaccttgccggtatgcctgccgaaatggacggcattatggctttggcaaaagaacatgatttgtgggtgattgaagactgcgcccaagcgcacggcgcaaaatacaaaggcaaatccgtcggctctatcggacacgtcggcgcgtggtcgttctgccaagacaaaatcatgaccaccggtggcgaaggcggtatggttacgaccaacgacaaaaccctgtgggaaaaaatgtggtcgtacaaagaccacggcaaaagctacgatgccgtgtaccaccgcgaacacgcgcccggtttccgctggctgcacgaaagtttcggcacaaactggcgcatgatggaaatgcaggcggtcatcggccgcatccagctcaaacgtatgcccgaatggacggcgcgccgccaagaaaacgccgccaagctggcggaaagcctaggcaaattcaaaagcatccgcttggttgaagtcgccgactacatcgaacacgcgcaatacaagttctacgtcttcgtcaaacccgaacacctcaaagaaggctggacgcgcgaccgcatcgtgaacgaactgaacgcgcgcaaagtcccctgctatcaaggcagctgctcagaagtgtatttggaaaaagccttcgacaacacgccgtggcggcccaaagagcggctgaaaaacgccgtcgagttgggcgataccagcctgatgttcttggtgcacccgacgctgaccgacggcgaaatcgcattctgcaaaaaacacatcgaagccgtattgaccgaagccgcacgataa

SEQ ID NO: 42954 - protein, 404 aa, Neisseria meningitidis Z2491
MRKCRLKTDGPNTMLNTSLSPWPCFIQEEADAVSKVLLSNKVNYWTGSECREFEKEFAAFAGTRYAVALSNGTLALDVALKAMGIGAGDDVIVTSRTFLASASCIVNAGANPVFADVDLNSQNISAETVKAVLTPNTKAIIVVHLAGMPAEMDGIMALAKEHDLWVIEDCAQAHGAKYKGKSVGSIGHVGAWSFCQDKIMTTGGEGGMVTTNDKTLWEKMWSYKDHGKSYDAVYHREHAPGFRWLHESFGTNWRMMEMQAVIGRIQLKRMPEWTARRQENAAKLAESLGKFKSIRLVEVADYIEHAQYKFYVFVKPEHLKEGWTRDRIVNELNARKVPCYQGSCSEVYLEKAFDNTPWRPKERLKNAVELGDTSLMFLVHPTLTDGEIAFCKKHIEAVLTEAAR

SEQ ID NO: 42955 - DNA, 1227 bp, Streptococcus pneumoniae TIGR4
  CDS (1)..(1227)
atgccaaattacaatattccattttcaccgcctgatatcacagaagcagaaattactgaagtagtggataccctgcgttctggttggatcacaacaggtcctaaaacaaaagaactggagcgccgcttgtctctttacacacagacacctaagactgtttgtctcaactctgcgacagccgctctggagttgattttacgcgttttggaagtgggacctggtgatgaagtcatcgttccagccatgacctatacggcttcatgtagtgtcattacgcacgtgggagcaacccctgtcatggtggatatccaagcagatacgtttgagatggactatgacctgcttgagcaagctatcactgagaaaactaaggtgattattccagtagagctcgcagggattgtttgcgattatgaccgtttgttccaagtcgtggagaaaaaacgtgacttctttaccgcttcaagcaagtggcaaaaggcctttaaccgtattgtcattgtctctgatagtgcccacgctttgggatctatttataaaggacaaccttctggttctatcgctgactttacttccttctcattccatgcagttaagaactttacaacggcagaaggtggaagtgcgacttggaaagccaatccagtgattgatgacgaagagatgtacaaggaattccaaatcctttcccttcacgggcaaactaaggatgctcttgccaagatgcaactggggtcatgggaatacgatatcgttacaccagcctataagtgcaacatgaccgatatcatggcttcacttggtttggtacaattggaccgctatccaagtttgttgcaacgccgtaaggacattgtggaccgctatgatagtggttttgcaggttctcgcatccatcctttggcacacaagactgaaactgtcgaatcttcacgccacctctacatcacccgtgtagaaggagcaagcctagaagaacgcaacctcatcatccaagaattggctaaagcaggaattgcaagtaatgttcactacaaaccgcttcctctcttgacagcctataagaatcttggatttgatatgacgaactatcctaaggcctatgccttctttgagaatgaaattaccctccctcttcatactaaattaagcgatgaagaagtagactatatcattgagactttcaaaacagtttctgaaaaagtgctaactttatcaaaaaaatga

SEQ ID NO: 42956 - protein, 408 aa, Streptococcus pneumoniae TIGR4
MPNYNIPFSPPDITEAEITEVVDTLRSGWITTGPKTKELERRLSLYTQTPKTVCLNSATAALELILRVLEVGPGDEVIVPAMTYTASCSVITHVGATPVMVDIQADTFEMDYDLLEQAITEKTKVIIPVELAGIVCDYDRLFQVVEKKRDFFTASSKWQKAFNRIVIVSDSAHALGSIYKGQPSGSIADFTSFSFHAVKNFTTAEGGSATWKANPVIDDEEMYKEFQILSLHGQTKDALAKMQLGSWEYDIVTPAYKCNMTDIMASLGLVQLDRYPSLLQRRKDIVDRYDSGFAGSRIHPLAHKTETVESSRHLYITRVEGASLEERNLIIQELAKAGIASNVHYKPLPLLTAYKNLGFDMTNYPKAYAFFENEITLPLHTKLSDEEVDYIIETFKTVSEKVLTLSKK

SEQ ID NO: 42957 - DNA, 1185 bp, Clostridium acetobutylicum ATCC 824
  CDS (1)..(1185)
atgaaaaaatataacatacccttctcaccaccagatcttactgaaaaagaaattgaaaatgttattgaagttttaaaatctggatggattacctcaggacctaaggtttttgaatttgaaaaaaaggtagcagaatattgcgaatgtgaaaaagcagttgctgtttcaagtgcgacctcagcgcttgatttaataatgaaagttttaaatttcgctcctcctgatgaaataataacaacaacttatacctacgcatctacttcaaacaccatatgtcatagaggaataaaaccaatatttgtagatcttgaaaaagattcttttttaatagatataaataaaataaaggatgctataaccgaaaaaacaaaagcaatagtaactgttgatattgcaggaataccactagattacgatgctattagaaatcttttaaaagaaatacatagagaagatatcatacttatatccgattcttcacatgccttcggagctacctacaaaggaagaaaagttggatgccaggctgattttcatgtgttttcatttcacgcagtgaaaaatcttactacagctgaaggtggagctataacctttaacaataaccactttaatggtaaagaagatttatataaagaattcaaatacacagctttaaatggtcaaaccaaagatgccctcacaaaatcaaaagctggtggctggcagtatgatattttaactgatggcctaaaatgtaatatgacagatatccatgcagccattggtctagttcagcttacacgttatgaggatatgttaaagaaaagagcataccttacagaaatctacactgctgcattgaaggataaatcttgggctattataccttttactaaagatactgaaaaagaaacctcctatcacttatatccattaagaataaaagattttactgaattgcagcgtaatgaagtaataaatatacttgcagaaattggtatacctacaaatgtacactttactcctctaccaatgttcacttattacaagactcttggatattctataaaagattatcctaatgcctataatcaatatgcaaacgaactaactcttccactatattcatctctttcagtagatgatgcaaaatgtatagttaatgaagttattaatgcaattgagaaagttaagtcaaaataa

SEQ ID NO: 42958 - protein, 394 aa, Clostridium acetobutylicum ATCC 824
MKKYNIPFSPPDLTEKEIENVIEVLKSGWITSGPKVFEFEKKVAEYCECEKAVAVSSATSALDLIMKVLNFAPPDEIITTTYTYASTSNTICHRGIKPIFVDLEKDSFLIDINKIKDAITEKTKAIVTVDIAGIPLDYDAIRNLLKEIHREDIILISDSSHAFGATYKGRKVGCQADFHVFSFHAVKNLTTAEGGAITFNNNHFNGKEDLYKEFKYTALNGQTKDALTKSKAGGWQYDILTDGLKCNMTDIHAAIGLVQLTRYEDMLKKRAYLTEIYTAALKDKSWAIIPFTKDTEKETSYHLYPLRIKDFTELQRNEVINILAEIGIPTNVHFTPLPMFTYYKTLGYSIKDYPNAYNQYANELTLPLYSSLSVDDAKCIVNEVINAIEKVKSK

SEQ ID NO: 42959 - DNA, 1095 bp, Clostridium acetobutylicum ATCC 824
  CDS (1)..(1095)
atgataaatgtaacgaaaacttacctccctccatttgataagtatagtgattatgttagaaagatatttaattcaggaattgtaactaataatggtgagatggtaagaaaattaaaaaagagtcttgaagaatatcttggggttaaaaatatagtacttgttcaaaatggaacattagctcttcaaattgcatataaaattttaaatttaaaaaaggatatagtaacaacaccgttttcctttgtggcaacaacaagcagtcaagtttgggaaggacttaatccagtatttgttgatatagataagaaaagccttaatatagatacaaagcttatagaaaaaaatattacaaaaaggacgtcagctatagtgccagttcatgtttttggaaatagttgtaacattgaggaaatagataagttagccaagaggtataatttaaaagtaatttatgatgcggctcatactttcggggttaaatataaagataaaaatatattgtcctatggagatatatcaataataagttttcatgcaactaaaatatttcataccatagagggaggagctcttgtaataaacgatgataagctctatgagaaagctattttatcaaggaattttggtatagagagcgcggatagtataaaagatttgggaataaatgcaaaaatgaatgaatttgaagcagccatgggtctctgccttttagatgatatagataagatatttgaaagaagaaaaaaagtgtatgagaactatatgaactatataaaaggcgatatatactttcaaagtcgtagtagagactgtacttgcaattatggttatttccctataatttttaaaaatgagaatatccttaaaagagttatgaaagagcttataaatgaaggtgtacgcccaagaagatatttttatccatgcttaaatgatttatcttatataaaagattacagaaaagttcctgtggcacaagatatttcaaaaaggatattgtgtttacctctttatgactctttaaatataacagaacaaaataaaataataaatatagtaaatagtgttttgaatttaggtgataaatgtgaataa

SEQ ID NO: 42960 - protein, 364 aa, Clostridium acetobutylicum ATCC 824
MINVTKTYLPPFDKYSDYVRKIFNSGIVTNNGEMVRKLKKSLEEYLGVKNIVLVQNGTLALQIAYKILNLKKDIVTTPFSFVATTSSQVWEGLNPVFVDIDKKSLNIDTKLIEKNITKRTSAIVPVHVFGNSCNIEEIDKLAKRYNLKVIYDAAHTFGVKYKDKNILSYGDISIISFHATKIFHTIEGGALVINDDKLYEKAILSRNFGIESADSIKDLGINAKMNEFEAAMGLCLLDDIDKIFERRKKVYENYMNYIKGDIYFQSRSRDCTCNYGYFPIIFKNENILKRVMKELINEGVRPRRYFYPCLNDLSYIKDYRKVPVAQDISKRILCLPLYDSLNITEQNKIINIVNSVLNLGDKCE

SEQ ID NO: 42961 - DNA, 1254 bp, Streptococcus pneumoniae R6
  CDS (1)..(1254)
atgagtacagataaaaggagcaaatcaatgccaaattacaatattccattttcaccgcctgatatcacagaagcagaaattgctgaagtagcggataccctgcgttctggttggatcacaacaggtcctaaaacaaaagaactggagcgccgcttgtctctttacacacagacacctaagactgtttgtctcaactctgcgacagccgctctggagttgattttacgcgttttggaagtgggacctggtgatgaagtcatcgttccagccatgacctatacggcttcatgtagtgtcattacgcacgtgggagcaacccctgtcatggtggatatccaagcagatacgtttgagatggactatgacctgcttgagcaagctatcactgagaaaactaaggtgattatcccagtagagctcgcagggattgtttgcgattatgaccgtttgttccaagtcgtggagaaaaaacgtgacttctttaccgcttcaagcaagtggcaaaaggcctttaaccgtattgtcattgtctctgatagtgcccacgctttgggatctacttataaaggacaaccttctggttctatcgctgattttacttccttctcattccatgctgttaagaactttacaacggcagaaggtggaagtgcgacttggaaagccaatccagtgattgatgacgaagagatgtacaaggaattccaaatcctttcccttcacgggcaaactaaggatgctcttgccaagatgcaactggggtcatgggaatacgatatcgttacaccagcctataagtgcaacatgaccgatatcatggcttcacttggtttggtacaattggaccgctatccaagtttgttgcaacgccgtaaggacattgtggaccgctatgatagtggttttgcaggttctcgcatccatcctttggcacacaagactgaaactgtcgaatcttcacgccacctctacatcacccgtgtagaaggagtaagcctagaagaacgcaacctcatcatccaagaattggctaaagcaggaattgcaagtaatgttcactacaaaccgcttcctctcttgacagcctataagaatcttggatttgatatgacgaactatcctaaggcctatgccttctttgagaatgaaattaccctccctcttcatactaaattaagcgatgaagaagtagactatatcattgagactttcaaaacagtttctgaaaaagtgctaactttatcaaaaaaatga

SEQ ID NO: 42962 - protein, 417 aa, Streptococcus pneumoniae R6
MSTDKRSKSMPNYNIPFSPPDITEAEIAEVADTLRSGWITTGPKTKELERRLSLYTQTPKTVCLNSATAALELILRVLEVGPGDEVIVPAMTYTASCSVITHVGATPVMVDIQADTFEMDYDLLEQAITEKTKVIIPVELAGIVCDYDRLFQVVEKKRDFFTASSKWQKAFNRIVIVSDSAHALGSTYKGQPSGSIADFTSFSFHAVKNFTTAEGGSATWKANPVIDDEEMYKEFQILSLHGQTKDALAKMQLGSWEYDIVTPAYKCNMTDIMASLGLVQLDRYPSLLQRRKDIVDRYDSGFAGSRIHPLAHKTETVESSRHLYITRVEGVSLEERNLIIQELAKAGIASNVHYKPLPLLTAYKNLGFDMTNYPKAYAFFENEITLPLHTKLSDEEVDYIIETFKTVSEKVLTLSKK

SEQ ID NO: 42963 - DNA, 1326 bp, Bacillus subtilis subsp. subtilis str. 168
  CDS (1)..(1326)
atgcaaaaacaggttaagatttcaggtaaaagcaaagaaaacatgtcactattaaaacacttaaaaggtgacgtacaaggaaaagaacttgttattgaagacagtattgtaaacgagcggtggaaacaagtattaaaagaaaagatagatattgaacatgaccttttcaactatcaaaaaaatcgtgaaatcagtaaagtcccttttttgcctgtagacagattaataaccaatgatgaagtggaagatatcttaaatacattaactgaagttttgccaactggaaaatttacgagtggtccctatttagagcaattcgaaaaagttttatctacatatttacataaaaggtatgtaattgcaaccagcagtggaaccgatgctattatgataggtttattggctttagggttaaacccaggggatgaagttatcatgccggctaatagcttttcagctactgaaaatgctgtgttagcttcgggaggcgttcctatctatgtagatattaacccacaaacattctgcatcgatcctgacaaaattgaagaagcaataactccttatacaaagtttattctacctgtgcatttatacggaaaacattcagacatgcagcatatccgtcaaatcgcaaatcgttataaattaaaagtaattgaagatgcctgccaaggaattggactgacagacttaggaaagtatgcagacatcactacattaagttttaatccctataagaattttggtgtatgtggcaaggctggggcaatagcaactgataatgaagaactcgctaaaaaatgcattcaatttagttatcacggttttgaagtaaatgtaaaaaataagaaagtcatcaattttggatttaattcaaaaatggacaatttacaggcagcaattggtttagagagaatgaagtacctttcattaaacaacttcaaaagattgttcttggcggatagatacattacccaattagcagagttgcagaataaaggctatattgaattaccagaattaagtgaagatcatgtatggcatctgtttcctattaaggtaagaacagaagatagggcagatatcatgactaaattaaatgaagattttggtgttcaaacagatgtatattatccaatactttctcatatgcaaaaaactcctttagtacaggacaagtatgcaggactccaattggttcatacggaaaaggctcatagtcaggtactgcatttgcctttatatccgtcatttactttagaagaacaagacagagtaatggagggactgtttcatgttattaagcaagaaatcggagtataa

SEQ ID NO: 42964 - protein, 441 aa, Bacillus subtilis subsp. subtilis str. 168
MQKQVKISGKSKENMSLLKHLKGDVQGKELVIEDSIVNERWKQVLKEKIDIEHDLFNYQKNREISKVPFLPVDRLITNDEVEDILNTLTEVLPTGKFTSGPYLEQFEKVLSTYLHKRYVIATSSGTDAIMIGLLALGLNPGDEVIMPANSFSATENAVLASGGVPIYVDINPQTFCIDPDKIEEAITPYTKFILPVHLYGKHSDMQHIRQIANRYKLKVIEDACQGIGLTDLGKYADITTLSFNPYKNFGVCGKAGAIATDNEELAKKCIQFSYHGFEVNVKNKKVINFGFNSKMDNLQAAIGLERMKYLSLNNFKRLFLADRYITQLAELQNKGYIELPELSEDHVWHLFPIKVRTEDRADIMTKLNEDFGVQTDVYYPILSHMQKTPLVQDKYAGLQLVHTEKAHSQVLHLPLYPSFTLEEQDRVMEGLFHVIKQEIGV

SEQ ID NO: 42965 - DNA, 1167 bp, Bacillus subtilis subsp. subtilis str. 168
  CDS (1)..(1167)
atgcataaaaaaatctacttatctccccctcatatgagcggcagggagcagcactatatttcagaagcctttcgctcaaactggattgcgccgcttgggccgctcgtgaattcatttgaagaacagctggcagaacgagtcggtgtaaaagcagcagctgcggtcggctcaggaacggcggcgattcatctcgcgctgcgtttgcttgaggtaaaagaaggtgacagcgtgttttgccagtccttcacatttgtagcaaccgccaatccgattctatatgaaaaagcggtgcccgtctttattgattctgagcctgatacgtggaatatgtcgccgacagcccttgaaagagcattggaggaagcgaaaagaaacggaacactgccaaaagcggtaattgccgtcaatctatatgggcagagcgcgaaaatggatgaaatcgtaagcctgtgtgatgcatacggagttcctgtcattgaggacgcagccgaatctctcggcacagtctataaagggaagcaaagcggaacattcgggcgcttcggcattttttcatttaacgggaacaaaatcatcaccacatcagggggagggatgctcgtttcaaatgatgaagccgcaattgaaaaagcaagatttctcgcttcgcaggcacgagagccggctgttcattatcagcacagtgaaattggacataattacaggctgagcaatatcttagccggcgtcggcattgcccagcttgaggtgctggatgagcgagtggagaaaagaaggaccattttcacgagatacaaaaatgcgctcggtcacttagacggcgtccgctttatgccagagtacgcagcaggcgtatccaatcgctggctcaccacgctcacacttgataacgggctcagcccatatgacatagttcaacgtcttgctgaagaaaacattgaagcccgtccgctgtggaagccgctccatacccagccgctgttcgatccggctttattttattctcatgaagatacaggaagcgtatgcgaagatttgttcaagcgaggaatctgtctcccatcggggtccaatatgacagaagatgagcaaggccgggtcattgaagtgctactgcacttattccatactgtcgaggtgaagaaatggacagcaagcattcgatga

SEQ ID NO: 42966 - protein, 388 aa, Bacillus subtilis subsp. subtilis str. 168
MHKKIYLSPPHMSGREQHYISEAFRSNWIAPLGPLVNSFEEQLAERVGVKAAAAVGSGTAAIHLALRLLEVKEGDSVFCQSFTFVATANPILYEKAVPVFIDSEPDTWNMSPTALERALEEAKRNGTLPKAVIAVNLYGQSAKMDEIVSLCDAYGVPVIEDAAESLGTVYKGKQSGTFGRFGIFSFNGNKIITTSGGGMLVSNDEAAIEKARFLASQAREPAVHYQHSEIGHNYRLSNILAGVGIAQLEVLDERVEKRRTIFTRYKNALGHLDGVRFMPEYAAGVSNRWLTTLTLDNGLSPYDIVQRLAEENIEARPLWKPLHTQPLFDPALFYSHEDTGSVCEDLFKRGICLPSGSNMTEDEQGRVIEVLLHLFHTVEVKKWTASIR

SEQ ID NO: 42967 - DNA, 1314 bp, Yersinia pestis CO92
  CDS (1)..(1314)
atgagtcaagaagaattacgtcaacagattgctgagctggttgctcagtacgctgaaacggctatggcccctaagccatttgaagcaggtaagagtgtcgttccaccttcaggtaaagttattggtaccaaagaactccagttaatggttgaagcttctttagacggttggctaacaacgggccgttttaatgacgcttttgagaaaaaactaggcgagtatttgggcgttccttatgttctgactacaacttctggctcttcagccaacttattggctttgaccgcgctgacctcacctaaattaggtgtacgggcgttgaaaccaggtgacgaagttattactgttgccgcaggttttccaaccacagtaaacccaactattcagaatgggttaattcctgtctttgttgatgttgatattccaacttacaatgtaaatgctagcctgattgaagcggcggttagtgataaaaccaaagctattatgattgcccacacattaggtaatctattcgatctagctgaagttcgccgagtagctgataaatataacctgtggttaattgaagactgctgcgatgcgttgggatccacctacgatggaaaaatggctggtacgttcggcgatattggtaccgttagcttctatcccgctcatcatatcaccatgggtgaaggtggggcggtatttacccaatcggcggaactgaagagtatcatcgaatctttccgtgattggggtcgtgattgttattgtgctccaggctgtgacaacacatgtaaaaagcgtttcggccagcaacttggctctttaccattcggttatgatcataaatatacttattcccatttaggttataacttaaaaatcacagatatgcaggctgcctgtggtttggcgcaactagagcgcatagaagagtttgttgaaaaacgtaaagctaactttaaataccttaaagacgcactccaatcttgcgctgactttattgaattaccagaagcgactgaaaattcagatccatcatggtttggtttccctatcactctgaaagaagatagcggagttagccgcattgatctggttaaattccttgatgaagctaaagtgggaactcgcctactctttgccggtaatttaactcgccagccgtatttccatgatgtgaaataccgtgttgttggtgaattgacaaacaccgatagaattatgaatcaaactttctggattggtatttacccaggcctgacacatgatcatttggattatgttgtgagtaagtttgaagagttctttggtttgaatttttaa

SEQ ID NO: 42968 - protein, 437 aa, Yersinia pestis CO92
MSQEELRQQIAELVAQYAETAMAPKPFEAGKSVVPPSGKVIGTKELQLMVEASLDGWLTTGRFNDAFEKKLGEYLGVPYVLTTTSGSSANLLALTALTSPKLGVRALKPGDEVITVAAGFPTTVNPTIQNGLIPVFVDVDIPTYNVNASLIEAAVSDKTKAIMIAHTLGNLFDLAEVRRVADKYNLWLIEDCCDALGSTYDGKMAGTFGDIGTVSFYPAHHITMGEGGAVFTQSAELKSIIESFRDWGRDCYCAPGCDNTCKKRFGQQLGSLPFGYDHKYTYSHLGYNLKITDMQAACGLAQLERIEEFVEKRKANFKYLKDALQSCADFIELPEATENSDPSWFGFPITLKEDSGVSRIDLVKFLDEAKVGTRLLFAGNLTRQPYFHDVKYRVVGELTNTDRIMNQTFWIGIYPGLTHDHLDYVVSKFEEFFGLNF

SEQ ID NO: 42969 - DNA, 1131 bp, Yersinia pestis CO92
  CDS (1)..(1131)
atgattccatttaacactccaccgatagtgggcactgaactgggttatatgcaggctgcgatgagcagtggcaagttatgcggtgatggtggttttacccgtcgctgccagcagtggatggagaaacgttttaactgcccaaaagtgttactgacgccatcttgtaccgcctcgttggaaatggccgcgttattgctggatatcaagcccggtgatgaagtgatcatgccaagttttacctttgtttctaccgccaatgcctttgtgctgcgcggggccaaaatggtgtttgtcgatatccgtccagacaccatgaatatcgatgaaaccaagattgaagcggcgatcaccgataaaacccgggttattgtgccagtccactacgcaggggttgcctgtgagatggataccatcatggcactggcgaaaaagcataatttgtttgtggtagaagatgcggctcaaggcgtgatgtcaacctacaaaggtaaagctctgggtaccattggccatattggctgcttcagcttccatgaaaccaaaaattacactgcgggcggtgaaggtggggcgacgttgatcaatgatccttcattgattgatcgtgcagaaattatccgtgaaaagggcaccaaccgtagccaattcttccgtggtcaggtggataaatacacctggcgtgacatcggctccagctacttgatgtctgatttacaggccgcttacctgtggggccagttagaggcagcagagcagatcaacgaacgccgtctggcgctatggcatggttattataatgctttcaaaccgttggccgatgctgggcgcattgatttaccggtgatcccaggcaacgtggtgcaaaatgcccacatgttttatattaaactgcgtgatattgaggagcgctctgcatttatcagctatttaaaagaagcggatattatggcggtattccactacatcccattacatgcgtgtccagcaggtgaggcgtttggccgtatggctggcgaagaccgctttacctccaaggagagtgagcgtctggtgcgcttacctattttctacaacctgactgatgttaatcagagcacggttattaatactgtgctgagtttcttcgtctga

SEQ ID NO: 42970 - protein, 376 aa, Yersinia pestis CO92
MIPFNTPPIVGTELGYMQAAMSSGKLCGDGGFTRRCQQWMEKRFNCPKVLLTPSCTASLEMAALLLDIKPGDEVIMPSFTFVSTANAFVLRGAKMVFVDIRPDTMNIDETKIEAAITDKTRVIVPVHYAGVACEMDTIMALAKKHNLFVVEDAAQGVMSTYKGKALGTIGHIGCFSFHETKNYTAGGEGGATLINDPSLIDRAEIIREKGTNRSQFFRGQVDKYTWRDIGSSYLMSDLQAAYLWGQLEAAEQINERRLALWHGYYNAFKPLADAGRIDLPVIPGNVVQNAHMFYIKLRDIEERSAFISYLKEADIMAVFHYIPLHACPAGEAFGRMAGEDRFTSKESERLVRLPIFYNLTDVNQSTVINTVLSFFV

SEQ ID NO: 42971 - DNA, 1209 bp, Caulobacter crescentus CB15
  CDS (1)..(1209)
ttggctcagccccgagggtctgctggccatgctggaggagaaggccacgtgacgggcggctttctcccctacggccggcagacgatcgaggaggacgatatcgccgccgtggcggaggccctgcgtggcgatttcctgaccaccggtccgacggtcgaggccttcgagaccgccttcgccgccaaggtcggcgccgatcacgcgatcgccgtttccaacggtacggcgaccctgcatctggcgatgatggcgctgggcataggagagggggatgtctgcgtcgccccgtccgtcacctttctggccaccgccaattgcgcccggtatgtgggcgccgaggtcgtcttcgccgacgtcgatcccgacagtggcctgatgacgcccgacacgctggctcgggccctggccggcgcgcgcgacaagcgcgtcaaggcggtgctgccggtgcacctgcgtggcgacgtctgcgatctgcccgcgctcaaggccatggccagcgcctcgggcgcggtgctcgtcgaggacgccccgcacgccctgggctcgatcgccaccttcgacggtgtcgcccacccggtcggcgacggcgcctattccagcttcgccagcttctcgtttcacccggtcaagacgctcgccacgggtgagggcggcatgctgaccaccaacgatcccgccctggccgccaaggcgcgcttgctgcgctcacatggcatggtgcgccagccgggcggcgacccgtggtggtacgagatgccggagctgggcttcaactaccgcatccccgacgtgctctgcgcgctgggcctgtcgcagcttgcgaaactggaccggttcgttgcgcgacgtcgcgacctgacggcgctttatgcgcgcctgctggcggagcgcgcgccgcgcgcgcggctggcgaccagccccgaccattcggacgccgcgctgcacctgttgaccgtgctgatcgatttcgaggccgagggaatctcgcggcgcaccgttgtcgagagcctcaagacccagggcgtcgggacccaggtccactacattccggtccatcgccagccctactacgcccaacgctatggcgtcgcggacctgcccggcgcggacgcctggtacgcgcgctgcctgacgctgccgctctatccggccatgaccaacggcgacgtcgagcgcgtggtgggcgccctggccacagttctcggttaa

SEQ ID NO: 42972 - protein, 402 aa, Caulobacter crescentus CB15
MAQPRGSAGHAGGEGHVTGGFLPYGRQTIEEDDIAAVAEALRGDFLTTGPTVEAFETAFAAKVGADHAIAVSNGTATLHLAMMALGIGEGDVCVAPSVTFLATANCARYVGAEVVFADVDPDSGLMTPDTLARALAGARDKRVKAVLPVHLRGDVCDLPALKAMASASGAVLVEDAPHALGSIATFDGVAHPVGDGAYSSFASFSFHPVKTLATGEGGMLTTNDPALAAKARLLRSHGMVRQPGGDPWWYEMPELGFNYRIPDVLCALGLSQLAKLDRFVARRRDLTALYARLLAERAPRARLATSPDHSDAALHLLTVLIDFEAEGISRRTVVESLKTQGVGTQVHYIPVHRQPYYAQRYGVADLPGADAWYARCLTLPLYPAMTNGDVERVVGALATVLG

SEQ ID NO: 42973 - DNA, 1116 bp, Caulobacter crescentus CB15
  CDS (1)..(1116)
gtgagtgacctgccgcgcatttccgtcgccgcgccgcgcctcgacggcaacgaacgtgactatgtactcgaatgcatggacacgacctggatctcgtcggtcggacgcttcatcgttgagttcgaaaaggccttcgccgactactgtggcgtcaagcacgcgatcgcctgcaacaacggtacgaccgccttgcacctggccctggtggcgatggggatcggacccggcgacgaggtgatcgttccgagcctgacctatatcgcctcggccaattcagtcacctattgcggcgcgacgcctgtgctggtcgacaacgatccgcggaccttcaacctggacgccgcgaagttggaggcgctgataacgccgcgcacgaaggcgatcatgcccgtgcacctctacggtcagatttgcgacatggatccgatcctcgaagttgctcgcaggcataacctgctcgtgatcgaggatgcggccgaggcggtgggcgcgacctaccggggcaagaagtcaggctcgctgggcgactgcgccaccttcagcttcttcggcaacaagatcatcaccaccggcgagggcgggatgatcaccaccaatgatgatgacctggcggccaagatgcgcttgctgcgaggccagggcatggatcccaaccgccgctactggtttccgatcgtcggcttcaattaccggatgaccaacatccaggccgcgatcggtctggcgcagctggagcgggtcgacgaacacctggccgcgcgcgaaagggtcgtgggctggtacgagcagaagctggcgcgcctgggcaatcgggtcaccaagccccatgtcgcgctgaccggtcgccacgtgttctggatgtacactgtgcgcctgggcgagggcctttccaccacgcgcgatcaggtgatcaaggatctcgacgcgttgggcattgagagccgtccggtgttccacccgatgcacatcatgccgccctatgcgcatctggccacggatgatctgaagatcgccgaggcctgcggggtcgacggcttgaacctgccgacccacgcggggctgactgaagccgatatcgaccgtgtcatcgcggcgctcgatcaggtgttggtctag

SEQ ID NO: 42974 - protein, 371 aa, Caulobacter crescentus CB15
MSDLPRISVAAPRLDGNERDYVLECMDTTWISSVGRFIVEFEKAFADYCGVKHAIACNNGTTALHLALVAMGIGPGDEVIVPSLTYIASANSVTYCGATPVLVDNDPRTFNLDAAKLEALITPRTKAIMPVHLYGQICDMDPILEVARRHNLLVIEDAAEAVGATYRGKKSGSLGDCATFSFFGNKIITTGEGGMITTNDDDLAAKMRLLRGQGMDPNRRYWFPIVGFNYRMTNIQAAIGLAQLERVDEHLAARERVVGWYEQKLARLGNRVTKPHVALTGRHVFWMYTVRLGEGLSTTRDQVIKDLDALGIESRPVFHPMHIMPPYAHLATDDLKIAEACGVDGLNLPTHAGLTEADIDRVIAALDQVLV

SEQ ID NO: 42975 - DNA, 1161 bp, Caulobacter crescentus CB15
  CDS (1)..(1161)
atgagcatgcccttcatcgacctcggcgcgcagcagcgccggatccgcgacaagatcgacacggccatcgccaaggtgctggacagcggcgcctatgtgatgggccctcaggtgcgcgagttcgaggcccagctggccgcgttcggtcaggccaagctggccttgtcgtgcgccaacggcaccgacgccatcgccctgccgctgatggcctgggggatcggcaagggcgatgcggtgttctgcccgtccttcaccttcgccgcgacgccggaagtcgtgccatgggtcgacgcgacgccggtgttcgtcgacgtgttgcccgacacctacaatctcgacccggccaagctggaggcggccatcgccggcgtgaaggctgagggccagctgacgcccaaggtggtgatcgccgtcgacctgttcggccagcccgccgactatccggcgatcaaggccatctgcgaccgcgagggcctgaagctgatcgccgacagcgcccagggctttggctgcgcgctgaacggccatcacccgctgcactgggccgatgtggccaccaccagcttcttcccggccaagccgctgggctgctacggcgacggcggcgcggtgctgaccaatgacgcgacgctgtgggacctgatggacagctaccgcgtccacggcaaggcggtcggcccggacctagccggcaagaccttcgatcacgatcccaagtacctgaacacccgcatcggcatgaattcgcgcctcgacacgatccaggcggcgatcctgatcgagaagctggcgatcttcgccgaggagatcgcgctgcgtcaggtcgtggccgaccgctacgctgcgggcctgaagggcgcggtgctgtcgaccccggccgtcatcgacggcggggtgtcggtctgggcccaatatgtgatcgagcacgaaaaccgtgacggcctggccgcccacctgaaggcgcaaggcgtgccgacggcggtctattatcccgtcccgatgcacgttcaggcgccctacgcccagttcccgcgcggtgcgggcggtctgccggtcaccgaagccaaggccgagacggttctggccttgccgatgcacccgtatctgggcgctgaggaccagcagaagatcatcgacgcgatccgcagcttcggcggctga

SEQ ID NO: 42976 - protein, 386 aa, Caulobacter crescentus CB15
MSMPFIDLGAQQRRIRDKIDTAIAKVLDSGAYVMGPQVREFEAQLAAFGQAKLALSCANGTDAIALPLMAWGIGKGDAVFCPSFTFAATPEVVPWVDATPVFVDVLPDTYNLDPAKLEAAIAGVKAEGQLTPKVVIAVDLFGQPADYPAIKAICDREGLKLIADSAQGFGCALNGHHPLHWADVATTSFFPAKPLGCYGDGGAVLTNDATLWDLMDSYRVHGKAVGPDLAGKTFDHDPKYLNTRIGMNSRLDTIQAAILIEKLAIFAEEIALRQVVADRYAAGLKGAVLSTPAVIDGGVSVWAQYVIEHENRDGLAAHLKAQGVPTAVYYPVPMHVQAPYAQFPRGAGGLPVTEAKAETVLALPMHPYLGAEDQQKIIDAIRSFGG

SEQ ID NO: 42977 - DNA, 1191 bp, Sinorhizobium meliloti 1021
  CDS (1)..(1191)
atgggacgctggccggtttacgacgaggagcagatcgaggatgtcgtgtcggtcctcagatctggcgaggtgaatgcctggacgggaccgcacgtccgcaacttcgaggctgcctatgagcgctttctcggcgtaaaacatgcggtggctctcgccaacggaacggtggcgctggacctcgcgctcttcgcgctcggacttgagccgggcgatgaggtcatcgtgacgccgcgcagtttcattgcctcggcctcaacggtgccgatggcgggtggagttgcggttttcgccgacgtcgatcgcgacagccaaaacatcaccgcggaaaccataagggcgaagctgacgccgaggaccaagggcgtcatcgtcgtgcatctggccggctggccctgcgacatgcccgccataatggcgcttgcccgcgaaaaggggctgtgggtgatagaggattgcgctcaggcgcacggcgccgaaatcgacggccggccggtcggcagtttcggtgacatcgcggctttttccttctgtcaggacaagatcatcaccactggaggcgagggcgggctcgtggcgatgaacgacgacgagctctggaagaaggcctggagccgcaaggaccatggcaagtcgtatgacgccgtctatcacaaggagcaccctccgggtttccgctggctgcatgagtccatcggcaccaactggcgcatgatgtcgatccaggcggtcatgggatcgcgtcagttgcagcgcctgacggaatggcgcagcataagagcgcacaatgcggctattatcgccagagcggccgaggagatcgaggctttgcgcacgcccctgccgccccgtgggattcagcacgcgtggtacaggttctatacgtttcttcggccggagcgcctgcggcccgactggagccgggaccggatcatcgccgaaatcaacggcgccggcgtcgcatgcttcagcggcagttgctcggaaatctacctggaaaaggcctttacggacatcggcatggccccggcacagccattgcccgacgcgcgcgagctcggcgagacgagtcttgccttcctggtcgaccccgcgctcgataccgcggcaatggagaaggcggcgcatgtcctgcgggaggtgtttgcaagggccagcatcggcaggccagccctcgatgccgcgcggcgttag

SEQ ID NO: 42978 - protein, 396 aa, Sinorhizobium meliloti 1021
MGRWPVYDEEQIEDVVSVLRSGEVNAWTGPHVRNFEAAYERFLGVKHAVALANGTVALDLALFALGLEPGDEVIVTPRSFIASASTVPMAGGVAVFADVDRDSQNITAETIRAKLTPRTKGVIVVHLAGWPCDMPAIMALAREKGLWVIEDCAQAHGAEIDGRPVGSFGDIAAFSFCQDKIITTGGEGGLVAMNDDELWKKAWSRKDHGKSYDAVYHKEHPPGFRWLHESIGTNWRMMSIQAVMGSRQLQRLTEWRSIRAHNAAIIARAAEEIEALRTPLPPRGIQHAWYRFYTFLRPERLRPDWSRDRIIAEINGAGVACFSGSCSEIYLEKAFTDIGMAPAQPLPDARELGETSLAFLVDPALDTAAMEKAAHVLREVFARASIGRPALDAARR

SEQ ID NO: 42979 - DNA, 1137 bp, Synechocystis sp. PCC 6803
  CDS (1)..(1137)
atggctaaatcccgcatttactacactaagccctcaataactgagctggaagtcgagtatgctactgatgccgctcgcaatggctggggcgatcgctgttatgaatatattgtgcgttttgaagaagtatttaaaaaatatttaggggtcgaatatagcattgcaacttctagctgtacgggggctttgcacatggggatggcggctctggggattggccctggtgatgaggtgattttagcggatacgaattggattgctacggtggctcccattgtccatctgggggccaagccggtatttgtggatattttgccagatagttggtgtattgatcccgttttggcggagcaagcgattacgccacggacgaaggcgattgtggcgactcatatttacggcaatctctgtgatatggaggctttattggcgatcgagcaacgccatggcattccgattattgaggatgcggcagaggcgatcggctcggtttaccatggcaagcgggctggctcgatgggtaagtttggcagtttttctttccacggtacgaagacgttgacaactggggaaggggggatgttcgtgaccaatgatcctgatttatacgagacggtgttaacgctctcgaatcatggccgggctagggggcaaacgaagcagttttgggcggatatggtgggctttaaatataagatgtccaatatccaagcggcgatcggctgtgctcaaatggagcgcattgaagagttggttagccgtaaacgggaaatccttagttactataaagaaaatttggagtctttaccggggataacaatgaatcctgagccaaagggtatggttaatggtggatggatgccaacggcggtatttagccctgaatctggtattactcgggaaaagttacaagtcctttttaaggaggcgaatgtggatgcccgtgttttcttttggccgttatcgagtttatcgatgtttgatgataagcccacaaataagttggcatgggatattccaacaagggcaataaatttgcctagttatcatgatttgagtggcaaggatattaaacaggttattgattctatgacagacaatctttatccgaaaaacgcaaatagatcaaaaaaatga

SEQ ID NO: 42980 - protein, 378 aa, Synechocystis sp. PCC 6803
MAKSRIYYTKPSITELEVEYATDAARNGWGDRCYEYIVRFEEVFKKYLGVEYSIATSSCTGALHMGMAALGIGPGDEVILADTNWIATVAPIVHLGAKPVFVDILPDSWCIDPVLAEQAITPRTKAIVATHIYGNLCDMEALLAIEQRHGIPIIEDAAEAIGSVYHGKRAGSMGKFGSFSFHGTKTLTTGEGGMFVTNDPDLYETVLTLSNHGRARGQTKQFWADMVGFKYKMSNIQAAIGCAQMERIEELVSRKREILSYYKENLESLPGITMNPEPKGMVNGGWMPTAVFSPESGITREKLQVLFKEANVDARVFFWPLSSLSMFDDKPTNKLAWDIPTRAINLPSYHDLSGKDIKQVIDSMTDNLYPKNANRSKK

SEQ ID NO: 42981 - DNA, 1038 bp, Synechocystis sp. PCC 6803
  CDS (1)..(1038)
atgaaattatccgttcttactgtggcgtttagcgtctcagctttatttgaaactactatatttgctgaattttgcggaacaaaatatgcagtagcagttagcagtggtactgccgcgttgcatttggctctcctcgccttaaatattggtgccggtgatgaggtaattgttccaacgttaagttttatcgctacggctaatgcagttacttacacaggagctaaacccatttttgtggatagtgaatgggaaacatggaatattaaccctgatttaattgaagctgccattactcctcgcaccaaagccatcatgcccgttcatctctatggacatcctgcgaaaatggacaaaattctcgatattgctcaacgctatcatttagctgtgattgaagatgcagcagaagctcacggcgcaacttatcagggaaaaaccgttggaagcttaggagatttggggatttttagcttttatggtaataaaattgtaaccacaggggaaggcggcatgatagttactgatgacgaagaattagcacaaaaaattcgtattctcaaagaccatggaatgtcgaaaaaacaaagatactggcatcctattttaggatataactaccgcataactaatattcaggcagctttaggagttgctcaaatggagcgaattaataaaatacctgaggctaaacgacgcattgcccaactgtatgaacaagaattgttacaaattcaaggcttaactttacctccgcgtcaaccctgggcagaaagcgtcttttggttatacacgattttaattaatcaggacaaactggaattaaatcgagatcaattaatgtcgaggttgcaagaaaaaggaattgaaaccagacctttgtttattcctattcatcgtcagcccatttataacactcatcagtcattacctgtagctgaatcattaagcaagaatgggttaagtttacctagttttgttaccttgtctaatgaaaatctttatcaaattatagactcgattaaaaaagttatcagttaa

SEQ ID NO: 42982 - protein, 345 aa, Synechocystis sp. PCC 6803
MKLSVLTVAFSVSALFETTIFAEFCGTKYAVAVSSGTAALHLALLALNIGAGDEVIVPTLSFIATANAVTYTGAKPIFVDSEWETWNINPDLIEAAITPRTKAIMPVHLYGHPAKMDKILDIAQRYHLAVIEDAAEAHGATYQGKTVGSLGDLGIFSFYGNKIVTTGEGGMIVTDDEELAQKIRILKDHGMSKKQRYWHPILGYNYRITNIQAALGVAQMERINKIPEAKRRIAQLYEQELLQIQGLTLPPRQPWAESVFWLYTILINQDKLELNRDQLMSRLQEKGIETRPLFIPIHRQPIYNTHQSLPVAESLSKNGLSLPSFVTLSNENLYQIIDSIKKVIS

SEQ ID NO: 42983 - DNA, 1158 bp, Synechocystis sp. PCC 6803
  CDS (1)..(1158)
atgaacatccccatccttgaccttaagccccagtaccaaaggatcaaagccgaaattcaacaggcggtgaatggtgtcttggaatcgggacaattcattttgggcaaaaccgttgcagattttgagcaagccgccgccgattatctgggggtgaaatatgccattggggttaattccggcaccgatgccctgatgattggcctaagggcattgggcattggcccgggggacgaagtaattaccacccccttttccttttttgccacggcggaatccattagtaatgtgggggctaaaccggtttttgtagatgtggcgatcaccgattttaaccttgatcccgacaaaatcaaggcggccatcaccccccgcaccaaggcgattatgccagtgcatttattcggtcagccggcagccatggcccaaattaaagcccttgccgatgcccatggtttgaaaattattgaagattgtgcccagtcctttggggctatctatgccggtgattgcttgggttgtgaccagggctgtgatgaccaagttagacaagccctagtgggtcaatacactggggccatgggggatgtgggcgcattttccttttttcccactaaaaatctgggagcctatggtgacggtggtttgatcaccactaacgatccggcgatcgccgatttggcccgctgtctgagggtgcatggttctaaacaacgctatcaaaacgaaatgctgggctataactcccgcttagatgcgttgcaagcggccattttgaacgtcaaactatcccatttaaaggaatggagcctgggccgtcgtcgggtggctcagacctataatgatctgttccaaggggtggaaggcattattacccccaccatcactgctggccatgtgtttcaccaatacaccctgcggattttgaacggtcaaagggacgccctcgctaacgcaatgcaaggcatggggattagtaccatgatctattaccctgtgccccaggatcaattgccggtgtaccggggtcagtatgcccccaaccccatcagcgatcgcctggccacggaggtgttgagtttacccatctggccggaaatggaaaccgaaacggtgcaaacggtggctgaaaaaattagccaggttttacctagtttgtaa

SEQ ID NO: 42984 - protein, 385 aa, Synechocystis sp. PCC 6803
MNIPILDLKPQYQRIKAEIQQAVNGVLESGQFILGKTVADFEQAAADYLGVKYAIGVNSGTDALMIGLRALGIGPGDEVITTPFSFFATAESISNVGAKPVFVDVAITDFNLDPDKIKAAITPRTKAIMPVHLFGQPAAMAQIKALADAHGLKIIEDCAQSFGAIYAGDCLGCDQGCDDQVRQALVGQYTGAMGDVGAFSFFPTKNLGAYGDGGLITTNDPAIADLARCLRVHGSKQRYQNEMLGYNSRLDALQAAILNVKLSHLKEWSLGRRRVAQTYNDLFQGVEGIITPTITAGHVFHQYTLRILNGQRDALANAMQGMGISTMIYYPVPQDQLPVYRGQYAPNPISDRLATEVLSLPIWPEMETETVQTVAEKISQVLPSL

SEQ ID NO: 42985 - DNA, 1131 bp, Salmonella typhimurium LT2
  CDS (1)..(1131)
atgattccttttaatgcgccgccggtggtgggaaccgaactcgaatacatgcagtctgcaatgagcagcggcaaactgtgcggcgacggcggctttacgcgtcgttgccagcagtggctggagcaacatttcggcagcgcgaaggtgttgctaacgccttcctgtaccgcatcgctggagatggcggctctgttgttggatattcagcccggcgatgaagtgatcatgccgagctttacgtttgtctccaccgctaacgcttttgtcctgcgcggcgcgaaaattgtgtttgtcgatattcgtccggatacgatgaatattgacgaaacgctgattgaggcggcgattactgataaaacccgcgctatcgtgccggtacactacgctggcgtcgcttgtgaaatggacgtcatcatggcgctggcggataagtataatctgttcgttgtcgaggatgccgcccagggtgtgatgtccacgtacaaagggcgcgcattagggacgatcggtcacatcggctgttttagcttccatgaaaccaaaaattacaccgctggcggcgaaggcggcgcgacgctgatcaacgatcgtacgctaattgaacgcgcggagatcatccgcgaaaaaggcaccaaccgtagccagttcttccgtggtcaggtggataaatacacctggcgggatatcggctccagttatttgatgtccgatctgcaggctgcctatctgtgggcgcaactggaggccgccgatcgtatcaatcaacagcgtctgtcgctgtggcagacttactacgatgcgttaacgccgctggcgcgcgccgggcgtttcgagctgccttctattccggaaaactgcgggcataatgcccatatgttttacatcaaactgcgggatatcgccgatcgcagcgcgctgattaatttcctgaaagaggcggaaatcatggcggtattccattacattccgctgcatgattgtccggcgggcgataaattcggcgagtttatcggggacgatgtctacaccacaaaagagagcgaacgtttgttgcgtctgccgctgttttataaccttgcgcccgtcgatcaacgaacggtgattactaccttgctaaattatttctcctga

SEQ ID NO: 42986 - protein, 376 aa, Salmonella typhimurium LT2
MIPFNAPPVVGTELEYMQSAMSSGKLCGDGGFTRRCQQWLEQHFGSAKVLLTPSCTASLEMAALLLDIQPGDEVIMPSFTFVSTANAFVLRGAKIVFVDIRPDTMNIDETLIEAAITDKTRAIVPVHYAGVACEMDVIMALADKYNLFVVEDAAQGVMSTYKGRALGTIGHIGCFSFHETKNYTAGGEGGATLINDRTLIERAEIIREKGTNRSQFFRGQVDKYTWRDIGSSYLMSDLQAAYLWAQLEAADRINQQRLSLWQTYYDALTPLARAGRFELPSIPENCGHNAHMFYIKLRDIADRSALINFLKEAEIMAVFHYIPLHDCPAGDKFGEFIGDDVYTTKESERLLRLPLFYNLAPVDQRTVITTLLNYFS

SEQ ID NO: 42987 - DNA, 1188 bp, Nostoc sp. PCC 7120
  CDS (1)..(1188)
atgagtaaaatgactataaaaattccttttgtcgatttgcagttacaacaccagccaatcgaaaatcagatacagcaggcgattcagaaagtattgcaacagggagactttatattaggcaaagcagtttccgaatttgaatccgcctttgccgccacctcaggagtgggttatggggtgggtgtagcttcgggaactgatgcgatcgccttgggtttaaaagcttgtaatataggccctggtgatgaagtaattttacctgctaatacttttgtcgccacactaattggtgttctccaagttggagctaaacccattctcgtagactgcgaccccctaacggccttaattgacttagaagcagcagccaaagcagtcaccacaaatactaaagcgattattccggtgcatctgtatggacagatggtatcaccccaacagttaatagattttgctcaaactcacaaggttttaatctttgaagacgcagcccaggcgcacctagcccatagggaaggatataaagctggttctgtaggcacagcagccgcttttagcttttatcccagtaagaatttaggtgcattgggtgatgggggaatattactaactagcgatgcagatatagccagtaaagttgccagcatacgcaattatggttcatcccagaagtatgttcatgtcgaactgggtacaaacagccgtctagacaccttacaagcagcagtattactagaaaaactacctcatttaccgcaatggaatagcgatcgcctcaccatcgcccaaacatacgatctagaattagcaccactagcatctgctggcattatccctatgcaaaaccaaagtggcacaggtcatgtttatcatctttacgtaattaaaattgatgattcctgtccagtagaacgccagcatatccaagaacaactgacagccgtagggattcaaaccggcatccactacccgattccttgtcatttacagccagcatttaccgatttaggctataaaccaggagattttccccaatcagaaaaactagccaagcaaatattatccttaccgatgtatcccggtttgaaccaaagccaaattagagaagttgtagcagccatagccaaagcagtaggagattttcctgcaaaaccagcatccactacccaggaaagtaaagtagcataa

SEQ ID NO: 42988 - protein, 395 aa, Nostoc sp. PCC 7120
MSKMTIKIPFVDLQLQHQPIENQIQQAIQKVLQQGDFILGKAVSEFESAFAATSGVGYGVGVASGTDAIALGLKACNIGPGDEVILPANTFVATLIGVLQVGAKPILVDCDPLTALIDLEAAAKAVTTNTKAIIPVHLYGQMVSPQQLIDFAQTHKVLIFEDAAQAHLAHREGYKAGSVGTAAAFSFYPSKNLGALGDGGILLTSDADIASKVASIRNYGSSQKYVHVELGTNSRLDTLQAAVLLEKLPHLPQWNSDRLTIAQTYDLELAPLASAGIIPMQNQSGTGHVYHLYVIKIDDSCPVERQHIQEQLTAVGIQTGIHYPIPCHLQPAFTDLGYKPGDFPQSEKLAKQILSLPMYPGLNQSQIREVVAAIAKAVGDFPAKPASTTQESKVA

SEQ ID NO: 42989 - DNA, 1221 bp, Nostoc sp. PCC 7120
  CDS (1)..(1221)
atgaaaaaaaaattgaatgatttagctatatttggtggaacgccaacatttgttgataaattacacgttggtcgtccgaacattggcaaccgtgaaaatttattatcacgcatcaatgatattttggatagaaaatggctaaccaacaatggtatttatgtacaggaatttgagcgacaaattgctgaatttgttggagtaaaacactgtatcgctacgtgtaatgcaacagtagccttagaaatagccattcgtgctgtaggtttcactggtgaagtaattattccttctttcacatttattgctactgcacacgctctcaaatggcaagaaatcatacctgttttctgtgatattgacccccatactcataatatagatcccaacaaaatagttcaaagcataacccctcgcactactggtattatcggcgttcatttgtggggtcgcccttgtaatgtagaggctttaagtgaaattgctgatactcataatttgaaattaatgtttgatgctgctcatgcttttggctgttcacatcaagggcgtatgataggtagctttggtgatgctgaagtttttagctttcatgctactaaatttttaaacacatttgaaggaggagcgatcgttacaaatagtgatgaattggcagagaaaattcgcttaatgactaactttgggtttgctggttatgaccgagttatatatatcggtaccaatggcaaaatgaatgaagtttcggcagcaatgggtttaacaggactcgataatttagatgaatttatttttattaattgtcgtaattataagtattatgagagggcattaaaagatattcccggtattaaattgattaattatgacgaggttgaaaaatctaattaccaatatattattttggagattgatgaggtattgatgggcattagtagggataaattattagaaatactacaagccgaaaatgtgatggcacgaagatatttttatcctggttgtcataacatggagccatatcgttcttattttccatattctaaattattgttaccagaaacagaaaatcttactaaaagaataatgtctttacctacgggaacatcggtcagtcttgaagatattactaaaattgtagaaatcataaaactagttgtagaaaacaacaattttttacaagataaattaagaaatttacaacaaatatcaaacgttatttaa

SEQ ID NO: 42990 - protein, 406 aa, Nostoc sp. PCC 7120
MKKKLNDLAIFGGTPTFVDKLHVGRPNIGNRENLLSRINDILDRKWLTNNGIYVQEFERQIAEFVGVKHCIATCNATVALEIAIRAVGFTGEVIIPSFTFIATAHALKWQEIIPVFCDIDPHTHNIDPNKIVQSITPRTTGIIGVHLWGRPCNVEALSEIADTHNLKLMFDAAHAFGCSHQGRMIGSFGDAEVFSFHATKFLNTFEGGAIVTNSDELAEKIRLMTNFGFAGYDRVIYIGTNGKMNEVSAAMGLTGLDNLDEFIFINCRNYKYYERALKDIPGIKLINYDEVEKSNYQYIILEIDEVLMGISRDKLLEILQAENVMARRYFYPGCHNMEPYRSYFPYSKLLLPETENLTKRIMSLPTGTSVSLEDITKIVEIIKLVVENNNFLQDKLRNLQQISNVI

SEQ ID NO: 42991 - DNA, 1149 bp, Nostoc sp. PCC 7120
  CDS (1)..(1149)
atgatccaaagcctaagttcgattcccgcctttgatatcaagcagcaatatgcttccatagaagccgaagtcagcagagccgttgtcgatgcgctggcttccgggcgttatattggtggccctccagtcgaaagttttgagcaacagtttgctgcttatcatggcgttactgattgtgtagcttgtaattctggtacagatgccctatttctagctttacgcgccttaggaatcggtgcaggcgatgaagtaattactacacccttcacctttgtcgctacggctgaagtgatcagcgctgtaggtgcaaagccggtatttgttgacatcgatgagataagttttaacctcgatttacaacaagtagcggcggcgattacacccaaaaccaaagcgattatcccagtgcatttatttggacagcctgtggatatgacaaagctcatggcgatcgctcaagctcacaatgtcgcagtaattgaagattgcgctcaatctacaggcgcaagttgggacggcaaaaaggtcggtagtattggacatattggttgttttagcttctaccccaccaagaatttaggtgcttgcggcgatggtggcgcgattacaaccaatgatccagaaattgctgccaaggtgcggatcatcaaggaacatggacagagacatcgttatcaatatgaagaaataggtgttaatagccgcttagatgccattcaagcagtaattttgcagattaaactaccatatcttgatatgtggaatcggcaaagacaagcgatcgctgcctattatcaaaaattcctcagtcaaattcccggtatcattcccccgcaagaactagctggtggcgtgagtgtgtggaatcaatatactattcgcgtcatcaccgcaggacggaatggcaatagcgccacacatcgggagacggtaaaaaatagcttgcaagaaaagaaagtaggctcaatggtttactacccctaccctttacatttgcagccagtttatcaatatctcggttatcaaccaggacaattaccagttgcagaacaagcgtgcaatgaagtcttatccttacccatgtttcccgaattaacaaccgaacagcaagatcaagtgatttatgctctgaaggatattcttttgtag

SEQ ID NO: 42992 - protein, 382 aa, Nostoc sp. PCC 7120
MIQSLSSIPAFDIKQQYASIEAEVSRAVVDALASGRYIGGPPVESFEQQFAAYHGVTDCVACNSGTDALFLALRALGIGAGDEVITTPFTFVATAEVISAVGAKPVFVDIDEISFNLDLQQVAAAITPKTKAIIPVHLFGQPVDMTKLMAIAQAHNVAVIEDCAQSTGASWDGKKVGSIGHIGCFSFYPTKNLGACGDGGAITTNDPEIAAKVRIIKEHGQRHRYQYEEIGVNSRLDAIQAVILQIKLPYLDMWNRQRQAIAAYYQKFLSQIPGIIPPQELAGGVSVWNQYTIRVITAGRNGNSATHRETVKNSLQEKKVGSMVYYPYPLHLQPVYQYLGYQPGQLPVAEQACNEVLSLPMFPELTTEQQDQVIYALKDILL

SEQ ID NO: 42993 - DNA, 1161 bp, Ralstonia solanacearum GMI1000
  CDS (1)..(1161)
atgacccaaaccaacgccgtcgccgaacaaccgttcctgcccttcgtgcgccccaccatcgacgaggcgaccatcgccgccgtggccgatgtgctgcgctcgggctggatcacctcgggccccaaggtcgccgcgttcgaagccgcgctgtcggaatacttcggcggccgcccggtgcgcaccttcgccaacggcaccgccacgatggaagtggcgctgcgcgtcgcgggcatcggccccggcgacgaggtcatcaccacgcccatctcgtgggtggccacctccaacgtggtgctgacggtcggcgccaggcccgtcttcgtcgacatcgacccagtcacccgcaacatcgacctggacaagatcgaggccgccatcacgccgcgcacgcgcgcgatcatcccggtctacctgtcgggcctgccggtggacatggaccgcctgtacgacatcgcccgccgccacaagctgcgcgtggtggaagacgccgcgcaggccatcggctcgcgctggggcgaccagcgcatcggccagctcggcgacctggtcagcttcagcttccaggccaacaagaacatcaccaccatcgagggcggcgcgctcgtgctgaacacgcccgaagaagccgtgctggccgagaaataccgcctgcagggcgtggtccgcaccggcttcgacggcatggaagtcgacgtggtgggcggcaagttcaacctgaccgacgtcaacgccgccatcggcctcggccagttcgcccagctggaggccatcaccgcgcgccgcgccgcgctggcccgccgctacttcgccgccatgcgcgcggccaacatcgaatcgttcggcatcgagctgccggtcgaagatttcgcgcacaccaactggcacatgttccagatcgtgctgccgctcgatcgcctcaaggtcgatcgcgccggcttcatggccgggctgaaggccatgggcatcggcaccggcgtgcactatccgcccatccacctgttcaagctgtaccgcgagctcggctggggcccgggcatgttcccggtggccgagcgcatcgggcgcgccatcgtgacgctgccgatgttcgccgccatggaagattccgacgtggaccgcgtagtcaatgcggtccgccaactctgcatccaacaccaataa

SEQ ID NO: 42994 - protein, 386 aa, Ralstonia solanacearum GMI1000
MTQTNAVAEQPFLPFVRPTIDEATIAAVADVLRSGWITSGPKVAAFEAALSEYFGGRPVRTFANGTATMEVALRVAGIGPGDEVITTPISWVATSNVVLTVGARPVFVDIDPVTRNIDLDKIEAAITPRTRAIIPVYLSGLPVDMDRLYDIARRHKLRVVEDAAQAIGSRWGDQRIGQLGDLVSFSFQANKNITTIEGGALVLNTPEEAVLAEKYRLQGVVRTGFDGMEVDVVGGKFNLTDVNAAIGLGQFAQLEAITARRAALARRYFAAMRAANIESFGIELPVEDFAHTNWHMFQIVLPLDRLKVDRAGFMAGLKAMGIGTGVHYPPIHLFKLYRELGWGPGMFPVAERIGRAIVTLPMFAAMEDSDVDRVVNAVRQLCIQHQ

SEQ ID NO: 42995 - DNA, 1152 bp, Brucella melitensis 16M
  CDS (1)..(1152)
gtgcgggccagatatattggagccaacatgcagttcattgatcttggagcgcagcgcgcgcgtatcgaaaatcgtctcaatgccgccatttccaaggttgttgcggaaggccgttatattcttgggccggaagtggctgaatttgaaaaaaagcttggcgaatatctgggtgtggagcatgtcatcgcctgtgccaatggcactgacgccttgcagatgcccctgatgacacgcggcatcgggccgggccatgcggtttttgttccgtccttcacctttgcagcgaccgctgaggttgttgcgctcgtcggtgcagagccggtattcgttgatgtcgatccagatagctacaacatgaatgtcgagcagctcgaagctgccattgccgccaccatcaaggaaggtcgtctggagccgaaggcgatcattccggtcgatctttttggccttgccgcctcttacaatcgcatcaccgccattgccgagcgcgaaggcctgttcatcatcgaggatgcggcccagtccatcggcggcaagcgcgacaatgtcatgtgcggcgctttcggccatgtgggcgcaaccagcttctatcccgccaagccgcttggctgctacggtgacggtggcgccatgttcaccaatgatgcagaattggcagatatactgcgctccgtgctgttccacggcaagggcgagacgcagtatgacaatgtccgcatcggcatcaattctcgcctggatacgatacaggcggctgttcttctggaaaagcttgccattctcgaagatgagatggaagcccgcgaccgcattgcaaggcgctataatgaggcgctgaaggatgtggtgaaggtgccggaacttccagccggcaaccgctcggcctgggcgcaatattctatcgaaagcgagaaccgcgacggcttgaaggcacaacttcaggcagaaggtattccgtccgtcatctattatgtgaagcctctgcacttgcagacggcctataagcactattccgttgcccccggtggcctgccggtttcggaaagcctgccatcacgcattctgagcctgccgatgcatccttacctttcggaagctgaccaggacaagattatcggcgtgatccgtggcttccacggcaagaaggcctga

SEQ ID NO: 42996 - protein, 383 aa, Brucella melitensis 16M
MRARYIGANMQFIDLGAQRARIENRLNAAISKVVAEGRYILGPEVAEFEKKLGEYLGVEHVIACANGTDALQMPLMTRGIGPGHAVFVPSFTFAATAEVVALVGAEPVFVDVDPDSYNMNVEQLEAAIAATIKEGRLEPKAIIPVDLFGLAASYNRITAIAEREGLFIIEDAAQSIGGKRDNVMCGAFGHVGATSFYPAKPLGCYGDGGAMFTNDAELADILRSVLFHGKGETQYDNVRIGINSRLDTIQAAVLLEKLAILEDEMEARDRIARRYNEALKDVVKVPELPAGNRSAWAQYSIESENRDGLKAQLQAEGIPSVIYYVKPLHLQTAYKHYSVAPGGLPVSESLPSRILSLPMHPYLSEADQDKIIGVIRGFHGKKA

SEQ ID NO: 42997 - DNA, 1143 bp, Brucella melitensis 16M
  CDS (1)..(1143)
atggtcaccaatttttcgcccctaaggaatgatccatacatggatataccagtttactctccctatctctgtgggaatttcaaaaagtatgtgaacgaatgccttgatacagggtggatctcgtcgaggggtgaattcatatctcgctttgaagatgcatttgcacaatatgtcgatgttccgtctgcggcttcagttgcaaacggaacggtggcactacatctcgctctagatgctctgggcatcggggcgggcgatgaagtcattgtaccgacctttacctatatcgcttcagttaacactatcttgcaaaccggggcaacaccggtttatgtggactctctcgaaaatacattgcagatagatccagagggggtgcgactggcgattacagagcgcactaaggctgtaatggttgttcatctctatgggcatccatgtgacatggattcgatccgagagatttgtgacgaaaaatcgctactgctcgtcgaagactgtgctgaaggattcggaactaaatggaaaaacagtcacgtcggcacgtttggcgacgtggcgacgtttagtttctttgggaacaagacaattacgaccggtgaaggcgggatggtgctagcgcgcaatcctcaagtcatggaaaaatgccgacatctcaaaagtcaaggtacttcgcctacacgagaatactggcatgatgcgcttgcgtataattacagaatgacaaatattcaagcagcaatcggcctgtcgcaaattgaaatggcagatgaaatactctcccttaaagccaggacagctgcctcttatgccagcaagttagctggattgccgcttcgtatgcacacccctgtgggagacgttaaacattcatattggatgtgctctattgtacttgataactcggaacacagagagccgctgcgccaacatttaagggagaatggtgtagatacacgaccgtttttcccgccagcccatcgtatgcctcacagcgcttccacaggatcttaccctgttgctgatagcttatccgctcgtgggttgaacctgccaagcttcccacacattactgatgtagaaatcagttttgtttgtgatttggtcaggagttatttttctaatcattccaaccacatttag

SEQ ID NO: 42998 - protein, 380 aa, Brucella melitensis 16M
MVTNFSPLRNDPYMDIPVYSPYLCGNFKKYVNECLDTGWISSRGEFISRFEDAFAQYVDVPSAASVANGTVALHLALDALGIGAGDEVIVPTFTYIASVNTILQTGATPVYVDSLENTLQIDPEGVRLAITERTKAVMVVHLYGHPCDMDSIREICDEKSLLLVEDCAEGFGTKWKNSHVGTFGDVATFSFFGNKTITTGEGGMVLARNPQVMEKCRHLKSQGTSPTREYWHDALAYNYRMTNIQAAIGLSQIEMADEILSLKARTAASYASKLAGLPLRMHTPVGDVKHSYWMCSIVLDNSEHREPLRQHLRENGVDTRPFFPPAHRMPHSASTGSYPVADSLSARGLNLPSFPHITDVEISFVCDLVRSYFSNHSNHI

SEQ ID NO: 42999 - DNA, 1215 bp, Pyrobaculum aerophilum str. IM2
  CDS (1)..(1215)
atgctggcaatagagggaggaaagcctgttagggaaacgcccattgtggcgaggcctgcggtgtacagcgaggaggtgttgcaagccattgccgaggtgttgaaatccggcgtcttaactgcgcaacacggcaagtgggtaaaggcgtttgaggccgagctggcctcttacctcggggtgaggtatgcggcggcggtttccaacggcactactgccctacacacagcgcttaaagcaataggcgtggggcccggggacgaggtgataacaacgccttttaccttcgccgcgtctgcgacagcggtgttacacgccaacgccgtgcctgtattcgccgatatagacagggagactctaaacctagaccccgcctcggtggaggagaggattactgacaagaccaaggcggtggtggtcgtccacctcgccgggatgccggctgagatggaccagttcatgaagctggcggagaggtacggggttaagattatagaagacgcggcccaagccctcggcgctgagtacagaggaaggagggctggctctatcggccacgtgtctgccttcagtttctacgcgactaaacacataacgtcgggagaaggcggcgcagtcgccacagacattgccgcgtatgcagagagggcgaagctcattagggcgcacggcgaggtggggaagtacagctacgaactcctcggctataactaccgcatgactgaaatccaaggcgttttggcctactaccagctgaaacagttgccggagatggagaggcgtagggaggcctacgttaaggcgttgttagaagagctggcgccgctcgagggggacttaatcacagtgccgaggcccaggccgtatatgaaacacgcctggcatttagtccaaatactactcgcagtggagaagctgaaaaagcccagggactacgtggtggaggccctaagggctgagggggtgggaaacgcctttgtggcctacccagtccccctctacaaaacgcccctgttccagaggcaagagggccacggcctcggctgtccctggacgtgtccctattataaaaggagagttgagtacaaaccgcttccaaacgccgaatgggccgccgagagagtagtttcgttgctggtaatgcccaatctcacagaacaagacgcgttagacacggcggcggcgtttaaaaaagtcctaagccacttaaggcggtga

SEQ ID NO: 43000 - protein, 404 aa, Pyrobaculum aerophilum str. IM2
MLAIEGGKPVRETPIVARPAVYSEEVLQAIAEVLKSGVLTAQHGKWVKAFEAELASYLGVRYAAAVSNGTTALHTALKAIGVGPGDEVITTPFTFAASATAVLHANAVPVFADIDRETLNLDPASVEERITDKTKAVVVVHLAGMPAEMDQFMKLAERYGVKIIEDAAQALGAEYRGRRAGSIGHVSAFSFYATKHITSGEGGAVATDIAAYAERAKLIRAHGEVGKYSYELLGYNYRMTEIQGVLAYYQLKQLPEMERRREAYVKALLEELAPLEGDLITVPRPRPYMKHAWHLVQILLAVEKLKKPRDYVVEALRAEGVGNAFVAYPVPLYKTPLFQRQEGHGLGCPWTCPYYKRRVEYKPLPNAEWAAERVVSLLVMPNLTEQDALDTAAAFKKVLSHLRR

SEQ ID NO: 43001 - DNA, 1095 bp, Pyrococcus furiosus DSM 3638
  CDS (1)..(1095)
atgattccaattgcaaagcccttaatcggagaagaggagattaatgccgtaattgaagtcctaaagagcgggatgctcgcccatggaaaggaagtagaagccttcgaaagggaatttgccagctacataggagtaaaacacggaattgcggtggtgaatggaacggcagctttggatatagctttaaaagcactgaagataaagccaggagatgaaattataacaactcccttcacgttcatagcttcagcaaatgctattcttttccagggagccaaaccggtttttgcagatatagatcccaagacgtacaacctcgatccggacgaggttctcgaaaagataaacgagaagacaaaagctataatcgttgttcacctctacggacaacctgcagacatgaaggcctttaaggaaatagctgaggactacaaactatatctcatcgaggactgcgcacaagctcacggagctgagtttgaaggtcagaaggttggaaccttcggagacatagccgccttcagcttttatccaacgaagaacatgacaaccggagagggtggaatggttctaactaacgacgatgaactcgctcgtagagctaggctcataaggaaccatgggcagacagagaaataccttcatgaggagctcggctacaaccttagaatgaccaatatcgccgcagcgctcggaagagtccagctcagaaagcttgacaaatggaacgagattagaattgaaaacgcggaactattaacaaagggaataaagaggattaaggggttgacgccgccttacgttgataagagggttaagcacgtctttcaccagtatgttataagggttgaagacgattttccattaacgagagatgagctcagggaaaagttaatggaaaaaggaataggaactgccgtgcactatcccatgccagttcaccaccagcccctctaccaaaggctcggctactccaaggattgctgtcccaatgcgatagaggccagcaagagagttctaagcttgccagtgcatccagctgtcagtaaggaggacataaattacataattaggacgcttgaagagcttgggtga

SEQ ID NO: 43002 - protein, 364 aa, Pyrococcus furiosus DSM 3638
MIPIAKPLIGEEEINAVIEVLKSGMLAHGKEVEAFEREFASYIGVKHGIAVVNGTAALDIALKALKIKPGDEIITTPFTFIASANAILFQGAKPVFADIDPKTYNLDPDEVLEKINEKTKAIIVVHLYGQPADMKAFKEIAEDYKLYLIEDCAQAHGAEFEGQKVGTFGDIAAFSFYPTKNMTTGEGGMVLTNDDELARRARLIRNHGQTEKYLHEELGYNLRMTNIAAALGRVQLRKLDKWNEIRIENAELLTKGIKRIKGLTPPYVDKRVKHVFHQYVIRVEDDFPLTRDELREKLMEKGIGTAVHYPMPVHHQPLYQRLGYSKDCCPNAIEASKRVLSLPVHPAVSKEDINYIIRTLEELG

SEQ ID NO: 43003 - DNA, 1158 bp, Corynebacterium glutamicum ATCC 13032
  CDS (1)..(1158)
atgactaatgaacgaatttttctatcatcgccagatgtaacacagttagaggaagacgcattggtacgcgcaatccgatcaggatggattgcaccgcttggtccagaagttgatgcgtttgagcaagaacttgctgagtattgtggccgcaaatatgttgttgcactttcatcgggtactgcagccctccacttaggtctattagcactaggcgttggagaaggagacttggttcttacatcatcaatgacttttgcagcgaccaccaacgcaattgtttatacgggtgctgagccaattttcgtggactgcgatgaatctggaaatatggatccagatcttttagaaaaagcctttgctgagctaaagagtgaaggaaaggaagtaaaggctgtagtacctgtcgatctacttggcaaagttgttcagcacgagaagattaaaaagattgctgatgaatacggggcagtagtgctttctgatgccgctgaatccttgggcgccattcgcaatggaaagtctgctgcagcatatggagtggcggcagcggtttccttcaacggaaacaaaattatgactaccagcggtggtggagctttgttaactgatgacaaggatattgcagacaacgtccgctatcttgcgacacaagctcgccaacctgtagttcattacgaacacaccgatgttgggtataactatcgcctttcaaatatcctcgctgcactgggacgagctcaactttcccgactcgacaagatgattgagcgtcgacgtcaacaccgtgcgttctatcgagaattgtttgcaggtgtttctggagtagagatctttggcgagccatcaggggtcgatggtggcgacactattgataatttctggctcacttctattcttattgataaagaagttgcgggatttagctctgaagatcttcgatcagttctaaatcaggcgaatattgagtctcgtcccttgtggaaaccaatgcatctccagccagtatttaagaagtatcgtagcttcaccaatgaagaaggacagaggctatttgattcagggctttctctcccaagcggttcagtacttgataatgcgtcaatgaatcgtgttgagactacaattggccagtttttggagagtcagcatgcgatctaa

SEQ ID NO: 43004 - protein, 385 aa, Corynebacterium glutamicum ATCC 13032
MTNERIFLSSPDVTQLEEDALVRAIRSGWIAPLGPEVDAFEQELAEYCGRKYVVALSSGTAALHLGLLALGVGEGDLVLTSSMTFAATTNAIVYTGAEPIFVDCDESGNMDPDLLEKAFAELKSEGKEVKAVVPVDLLGKVVQHEKIKKIADEYGAVVLSDAAESLGAIRNGKSAAAYGVAAAVSFNGNKIMTTSGGGALLTDDKDIADNVRYLATQARQPVVHYEHTDVGYNYRLSNILAALGRAQLSRLDKMIERRRQHRAFYRELFAGVSGVEIFGEPSGVDGGDTIDNFWLTSILIDKEVAGFSSEDLRSVLNQANIESRPLWKPMHLQPVFKKYRSFTNEEGQRLFDSGLSLPSGSVLDNASMNRVETTIGQFLESQHAI

SEQ ID NO: 43005 - DNA, 1185 bp, Methanopyrus kandleri AV19
  CDS (1)..(1185)
ttgtccaagctcgccatcgagggaggcagaccgattagggaggaccctataccgatcgctcaacctatcctgggtgacgaggaggcccgtgccgtcacggaggtccttcggtcgggccagctcgctcagggaccacgcgttgaggagttcgagcgtgagttcgcccagttcgtcggatgtgaacactgcgtcgcgacgagctcgggcacgaccgcactgcagctcgccctggagtccgccgggctcgggccgggcgacctcgcgatcgtgccgtcttttacgtttatcgctactgcgaacgccgccttacacgtgggcgccgacgtcgcgttcgtggacatcgatctggaaacgtactgtatggatccacgctccctggaggaggtcgtgaagctcctgaaagaccgcgtgctacgtccccgcaccgtagcagtgatccctgtgcacctctacggccaccccgctgacatggacccgatcctagagatcgcggaggaacacgatctcatcgtgatcgaggacgcggcacaggcccacggagccgagtacaaaggtaggaggataggatccttgggagacgccgcctgcttcagcttctatccgaccaagaacatgaccacgggagagggcggggcgatcaccacggacgacggggaactggccgagcgggccagaatgctccgctcacacggcgagcgcgaacgctacgatcacgtggagctagggtacaactttcggatgacggacatcgccgcggctatcgggatcgtccagcttcggaggctggaggagttcaacgagcggaggagggagaacgctcgctactacctcaaggaactggccgatttagaacccctcatcgaactaccgaccgagaagccctgggcgaaacacgtttaccatcagttcacgattaggatcaacgtggaagagttgtcctgtacgagagacgagttcgcggaggcgctccgtgccgagggagtggactgtgccgtacactacccgactccgctacaccgacaacccgtatacctcaggcgcggttatcacgccacggagctcccgaaatcggagcgtgcggccgagaccgtactatccattccggtacatccgggtttgtcggaggaggaccgtcaggacgttgtggaagccgttgagaaggtcgtttccgcgttttcccgatag

SEQ ID NO: 43006 - protein, 394 aa, Methanopyrus kandleri AV19
MSKLAIEGGRPIREDPIPIAQPILGDEEARAVTEVLRSGQLAQGPRVEEFEREFAQFVGCEHCVATSSGTTALQLALESAGLGPGDLAIVPSFTFIATANAALHVGADVAFVDIDLETYCMDPRSLEEVVKLLKDRVLRPRTVAVIPVHLYGHPADMDPILEIAEEHDLIVIEDAAQAHGAEYKGRRIGSLGDAACFSFYPTKNMTTGEGGAITTDDGELAERARMLRSHGERERYDHVELGYNFRMTDIAAAIGIVQLRRLEEFNERRRENARYYLKELADLEPLIELPTEKPWAKHVYHQFTIRINVEELSCTRDEFAEALRAEGVDCAVHYPTPLHRQPVYLRRGYHATELPKSERAAETVLSIPVHPGLSEEDRQDVVEAVEKVVSAFSR

SEQ ID NO: 43007 - DNA, 1116 bp, Thermoanaerobacter tengcongensis MB4
  CDS (1)..(1116)
atggagatagaattaattaatttaaaacgccagtataaaaatttaagggacgaaataaataaggcaatagaaaaagttttagaaaatggacaatatatcctaggtccagaagtaaaagcttttgaaaaagaaatagcagaatatttgggtataagatacgcaataggtgtagcaaatgggactgatgctttggtgctttcattaagagctctcaatataggaccaggagatgaagttataacaactccttttaccttttttgcaacagcagaagcagtttctcaggtaggtgctacaccagtttttgtcgacatagacccagatacgtacaatataaatccggatttgatagaagaaaaaattactaaaaaaacaaaagctattataccagtacatatttttggacaaccctgtgatatggacaaaatcatggaaattgccaagaaacacaatttatacgtaatcgaggatgcatgtcaagcaataggatcagagtataaaggccaaaaagtaggtacttttggagatgtcgcctgcttctcattctttcccacaaaaaacttaggcggttatggcgatggaggaatggtggtaactaataatccagagatagctgaaaaagtagacatactcagaaaacatggcagtaaaaagaaatattataatgaagaaattggatataacagtagactcgatgaattgcaggctgcaattttaagagtaaaattaaaatatcttgatgtgtggaatagtcaaaggattagtgcagctaataaatataacgaactattaaaagatttatcagatgttataaaaagtccatataaattaccagaagttaaacacatatatcatttgtactgcatacaaagtgaaaaaagagaatttttaatggaaaaattaaaagaaaatggcattgcaacagggatatactatcctgtgccattacatcttcaaaaggcgtatgctaatttaggctacaaagaaggcgacttgccagttgctgaagaagtatgtagaaaaatttttgctataccgatgtatcctgaaattactgatgaagagattagctatatcagtaaggtactgcacaaaattgtaaacgaaggagattga

SEQ ID NO: 43008 - protein, 371 aa, Thermoanaerobacter tengcongensis MB4
MEIELINLKRQYKNLRDEINKAIEKVLENGQYILGPEVKAFEKEIAEYLGIRYAIGVANGTDALVLSLRALNIGPGDEVITTPFTFFATAEAVSQVGATPVFVDIDPDTYNINPDLIEEKITKKTKAIIPVHIFGQPCDMDKIMEIAKKHNLYVIEDACQAIGSEYKGQKVGTFGDVACFSFFPTKNLGGYGDGGMVVTNNPEIAEKVDILRKHGSKKKYYNEEIGYNSRLDELQAAILRVKLKYLDVWNSQRISAANKYNELLKDLSDVIKSPYKLPEVKHIYHLYCIQSEKREFLMEKLKENGIATGIYYPVPLHLQKAYANLGYKEGDLPVAEEVCRKIFAIPMYPEITDEEISYISKVLHKIVNEGD

SEQ ID NO: 43009 - DNA, 1119 bp, Thermoanaerobacter tengcongensis MB4
  CDS (1)..(1119)
atgaaggttcctttatcaagaccagatattacccaaaaagaaatcgacgcagttgtagaagttttaaggtcggatattttaagcattggacccaagatagaagaatttgaaagaaagatagctgattacgtagggaaaaaatatgcgattgcagtgaatagtgggacaagcgccttgcatttaatagtaagggcattgggtataaaagatggagatgaagttataactacaccttttacttttatagcatctgtaaactgttttttatttgaaagggcaaagcctgtttttgtggatatagatccagacacactgaacatggatattaacaaaatagaagaaaaaataacagaaaaaaccaaagcaattttaacagtagatgtttttggacaaccaatggacatggagaaggtaaatgagatagctaaaaaatatggacttaaagttattgaagattcttgcgaggcgttaggttcagaatacaaaggtattaaagcgggaacattgtgtgatgcaggtgcttttgctttttatcctaataaacagattacaactgctgaaggaggggtaattgtcacagatgatgaagaaatcgcacaattgtgtagaagcatgagaagtcagggaaggcccattacaggattgtggctagaacatgagaggttggggtttaattatcgtttgagtgagttacatgctgctcttggaatagtgcagttagaaaggatagaagagataattaaaaggcgtttagaaatagctgaaaaatataatgaacgattgaaagatgtcaagggagttaaaataccatacattgctcctgaagtaaataaaatgagttggttcgtctatgtgataagagtagatgaaaacatagacagagataaggttatgcagtatttaattgacaatggtataggttgtagaccttattttacgccagtacatttacaatcttacataaaggaattaactggccataaagaaggagattttcctataacagagaaagtggcaagatctacaatagctttaccttttttcaataaaataacagatgaacaaattgattatgtagtcgataagttaaaagaggcaataaagatatatagtaggtaa

SEQ ID NO: 43010 - protein, 372 aa, Thermoanaerobacter tengcongensis MB4
MKVPLSRPDITQKEIDAVVEVLRSDILSIGPKIEEFERKIADYVGKKYAIAVNSGTSALHLIVRALGIKDGDEVITTPFTFIASVNCFLFERAKPVFVDIDPDTLNMDINKIEEKITEKTKAILTVDVFGQPMDMEKVNEIAKKYGLKVIEDSCEALGSEYKGIKAGTLCDAGAFAFYPNKQITTAEGGVIVTDDEEIAQLCRSMRSQGRPITGLWLEHERLGFNYRLSELHAALGIVQLERIEEIIKRRLEIAEKYNERLKDVKGVKIPYIAPEVNKMSWFVYVIRVDENIDRDKVMQYLIDNGIGCRPYFTPVHLQSYIKELTGHKEGDFPITEKVARSTIALPFFNKITDEQIDYVVDKLKEAIKIYSR

SEQ ID NO: 43011 - DNA, 1083 bp, Methanosarcina mazei Go1
  CDS (1)..(1083)
atgatcccaatcgccaggcccctgctgggcaaggaagagattgatgcagtaacagaggtcctgagttcaggaatgatcgcacagggaccaaaagtagaagaatttgagcttgctttttccgagtacacaggctgcgaatatgcagcggccgtaaattccggcactgcagctcttcatattgcacttcttgcccacgatatcggaaaagaagatgaagtaatcacaagtcccttcacatttattgccactgcaaacagcatcctctataccggagcaaaacctgtttttgcagacattgagcctgatacatacaatatagacccggaaaaaataaaggaaaagataaattcaaaaacgaaagccattatgcccgtccacctttacgggcagtctgctgacatgaaagccataatggaaatcgctgaagactacaaacttgttgtgatagaagatgcctgccaggcacatggtgcagagtgcctggggaagaaagcaggcagtttcgggacaggagcattcagcttttacccgaccaaaaacatgacaacaagcgaaggcggaataattacaaccagcgaccgggaaattgcagaaaaatcaaaaatgatcagggctcacggctccagagtacgctacctgcatgaaatgctgggctttaacttgcgcatgactgacattgcagccgcaataggacttgctcagcttgaaaaactggacgggtttaatgcctccaggcagaaaaatgcagccatgctttcagaagggcttaaaagcatttcaggaattgtacccgcaactacaaggaaaggttatacccacgtttttcaccagtacacaataagggcacaaaacagagataaactggcagattttttgaaggaaaaaggcataggcacaggagttcactacccgatacctatccataaacagccttattatatggagcttggatacaaagactctctgcctatctcagataaagcagcagaagaggttctttcccttcctgtacatcctgccctgtccagagacgatgttctgaaagtaataaaggaagtcaaagaattttatgcaagtgcctga

SEQ ID NO: 43012 - protein, 360 aa, Methanosarcina mazei Go1
MIPIARPLLGKEEIDAVTEVLSSGMIAQGPKVEEFELAFSEYTGCEYAAAVNSGTAALHIALLAHDIGKEDEVITSPFTFIATANSILYTGAKPVFADIEPDTYNIDPEKIKEKINSKTKAIMPVHLYGQSADMKAIMEIAEDYKLVVIEDACQAHGAECLGKKAGSFGTGAFSFYPTKNMTTSEGGIITTSDREIAEKSKMIRAHGSRVRYLHEMLGFNLRMTDIAAAIGLAQLEKLDGFNASRQKNAAMLSEGLKSISGIVPATTRKGYTHVFHQYTIRAQNRDKLADFLKEKGIGTGVHYPIPIHKQPYYMELGYKDSLPISDKAAEEVLSLPVHPALSRDDVLKVIKEVKEFYASA

SEQ ID NO: 43013 - DNA, 1104 bp, Xanthomonas campestris pv. campestris str. ATCC 33913
  CDS (1)..(1104)
atggacgctctgattcctgtcaactcgctttcccgccacatcgctcccttgcaggacaagctgtcccagatcgccggcgacatcatcgccagcggctactacgtcctcggcccgaacgtgaaggccttcgagcaggagttcgccggctactgtggcgcccgccactgcgtcagcgtcgccaacggcaccgacgccctggaactctcgctgaaggcactgggcattggccagggcgatcgggtcgccgtggtggccaatgccgccatgtacggcaccagcgccgttctggcctgtggtgcggcgccgatcttcgtcgataccggtgcaggcacgggattgatgtccgtcgccgcactggaggctgcgctcgcgggcaagaccacgcccaaggccgtgatcgtgacccatctgtacggtcagttggccgagatcgaggccatcgtcgcgctctgccacgcacgcggcatcaaggtggtggaagattgcgcacaggcgcatggcgcagagcgcaatggccgacgcgccggcagcttcggcgatattgcctctttcagtttctacccgaccaagaatctgggcgcactgggcgatggcggcgcgatcgtgaccggcgatgatgccctggccacccgtgcagcacagcttcgccagtacggatggacggccaagtacaccaacagcctgcgcggcggtcgcaacagccgcctcgacgagctgcaggccgcaatgctgcggcatatgctcacctcgctggatggctggaaccaacgccgccgcgacatcgccaaccgctacgcgcgggggttgtccaacccgaagattgcatccgctggcgtggtcggtgccgacaatgtggcccatctgtacgtcgtgcgctgcgaccagcgcgatgcactgcgcgcccacctgcaggctgccggcgtgcagaccgaggtccactacccgctgtgcgatcatcgccagccctgtcatgagggcgcttttgattctgtggcgctccccaataccgaggccgatgcgatctgcgtgatgacgctgccgtgcttcccggagctgaccgacgaagaagtcgaccaggtcatcgacgcatgcaaccgtttctga

SEQ ID NO: 43014 - protein, 367 aa, Xanthomonas campestris pv. campestris str. ATCC 33913
MDALIPVNSLSRHIAPLQDKLSQIAGDIIASGYYVLGPNVKAFEQEFAGYCGARHCVSVANGTDALELSLKALGIGQGDRVAVVANAAMYGTSAVLACGAAPIFVDTGAGTGLMSVAALEAALAGKTTPKAVIVTHLYGQLAEIEAIVALCHARGIKVVEDCAQAHGAERNGRRAGSFGDIASFSFYPTKNLGALGDGGAIVTGDDALATRAAQLRQYGWTAKYTNSLRGGRNSRLDELQAAMLRHMLTSLDGWNQRRRDIANRYARGLSNPKIASAGVVGADNVAHLYVVRCDQRDALRAHLQAAGVQTEVHYPLCDHRQPCHEGAFDSVALPNTEADAICVMTLPCFPELTDEEVDQVIDACNRF

SEQ ID NO: 43015 - DNA, 1143 bp, Xanthomonas campestris pv. campestris str. ATCC 33913
  CDS (1)..(1143)
atgcgttggaacattcagtcaatgacgctccctgaaattccctttctggatttgcgtgccgtcaacgcgcgttacgcggatgcgctcaaggccgccgctgcgcgggtgatcgattcgggctggtatgtgcttggccaggagttggcggcgttcgaagaggagttcgccagctactgcggcgtgcagcaggcggtgggggtggggaacgggctggacgcgttgtcgctgatcctgcgcgcctaccgcgaattgggcgtgttgcgcgagggcgatgaggtgatcgtgccggccaatacgttcattgcgacgttcctggcgatcagccacaaccatctggtgctggtgccggtggagccggatccgcagaccttcaacgtggacccgtgcagggtggagcgcgccatcgggccgcgcacacgcgccattctggccgtgcatctgtacggacagcttgccgacatgccggcactgcagacgttggcgcaccgctatggcttgctgctcatcgaagacgccgcgcaagcgcatggcgcaagccgcgacggtgtgcgtgcgggcgcgttcggcgatgcggcggcgttcagtttttttcccaccaagaaccttggtgcgctgggcgacggcggtgcggtagtgacctccgacccgcgcctggccgagcgcgtgcgcgcgctgcgcaactatggctcggaggtgaaataccagcatctgttccagggggtcaattcgcgcctggatgagctgcaggcggccttcttgcgggtcaagttgggctatctggatgaggaggctgcacagcgccgcgcagtggcccagcgttacctgcaagagatcgatcacccctggatcacgttgcccccggtggcgcatgccgagcagcatgtctggcatctgttcgtggtgcgtagccagcgccgcgatgccttgcaaagccatctgcagcacctcggtatccagacccagatccattacccggtgccgccgcatctgcagccggcctatgccatgctgggcgatacctgcctgccgatcagcgagcagctgcatcgcgaagtgctgagcctgccgatgagcccggcgctggacgacgcggcagtcagccgcgtcatcaccgcctgccaagtgttcggtagcgcaccgtga

SEQ ID NO: 43016 - protein, 380 aa, Xanthomonas campestris pv. campestris str. ATCC 33913
MRWNIQSMTLPEIPFLDLRAVNARYADALKAAAARVIDSGWYVLGQELAAFEEEFASYCGVQQAVGVGNGLDALSLILRAYRELGVLREGDEVIVPANTFIATFLAISHNHLVLVPVEPDPQTFNVDPCRVERAIGPRTRAILAVHLYGQLADMPALQTLAHRYGLLLIEDAAQAHGASRDGVRAGAFGDAAAFSFFPTKNLGALGDGGAVVTSDPRLAERVRALRNYGSEVKYQHLFQGVNSRLDELQAAFLRVKLGYLDEEAAQRRAVAQRYLQEIDHPWITLPPVAHAEQHVWHLFVVRSQRRDALQSHLQHLGIQTQIHYPVPPHLQPAYAMLGDTCLPISEQLHREVLSLPMSPALDDAAVSRVITACQVFGSAP

SEQ ID NO: 43017 - DNA, 1290 bp, Xanthomonas campestris pv. campestris str. ATCC 33913
  CDS (1)..(1290)
ttgcacagccggctcctgccggctcagccggagacagccgtgtatcgagcgctcgaccatcgccccgtatcgcacgagcctgcggccgccggctcgcactacacggaggcgtcgtctccggtagccgggaccaacggggaagggccagccacgctgtcaccgccggcctgcgacccgcaggccggccgggatccgatcttcgtcacccagccctatcttccgccgctgcatgagttcctgccttatctggaaggcatctgggagcgcaaggtgctcaccaacaacggtccctgtcatcaggaactggaacgttgcctgggcgattacctggggctgaagcacgtctccctgtttgcgaacggtaccctagcgctgatgaccgggctgcaggcgctagaccttgccggcgaggtcatcacgacgccctacagcttcgtcgcgacatcgcactccctgctgtggaaccggctacagccggtatttgtagatatcgatcctgagacgctgaatctgcacccggaccggatcgaggcagcgatcacctcgcgcaccaccgcgatcctgccgatgcactgctatggcaatccctgcgacgtggcggcgatcaaggccattgccgattgtcatgggctgaaggtgatctacgacgcggcgcatgccttcggagtgaccgactccggcggcagcatcctgcgtcacggcgacctatcggtgctgagctttcatgccaccaaggtcttcaacacgttcgagggtggcgccatagtcagcccggacgcagagaccaagcagcgcatcgaccatctcaagaacttcggcttcgtcgacgagaccacggtggtggaaccaggcatcaacggcaagatgtcggagatcaacgccgccttcggcctgctccagctcaagcacatcgacgaggtactggccgagcgtcgccgcatcgcggctttttacaggcagcacctgacgcaggtgtgcggcattacctgcctgaccagcagtgccaaacgccacaatgcatcctatttccccatctttgtcgaggccggctacccgctcgatcgcgatgcgctgtacgcactgttcaagcgcaagaatatccatacacgtcgctacttttacccgccgatcaccagctttccaatgtatagcgcgttgcaatcggcctgcccggccgggctcccaaatacctacagcgccgcagaccgggtgatctgcctgccgatctatcctggccttcctgacgaggtggtccagacggtggtggacacgatcgccaatgcgtcctga

SEQ ID NO: 43018 - protein, 429 aa, Xanthomonas campestris pv. campestris str. ATCC 33913
MHSRLLPAQPETAVYRALDHRPVSHEPAAAGSHYTEASSPVAGTNGEGPATLSPPACDPQAGRDPIFVTQPYLPPLHEFLPYLEGIWERKVLTNNGPCHQELERCLGDYLGLKHVSLFANGTLALMTGLQALDLAGEVITTPYSFVATSHSLLWNRLQPVFVDIDPETLNLHPDRIEAAITSRTTAILPMHCYGNPCDVAAIKAIADCHGLKVIYDAAHAFGVTDSGGSILRHGDLSVLSFHATKVFNTFEGGAIVSPDAETKQRIDHLKNFGFVDETTVVEPGINGKMSEINAAFGLLQLKHIDEVLAERRRIAAFYRQHLTQVCGITCLTSSAKRHNASYFPIFVEAGYPLDRDALYALFKRKNIHTRRYFYPPITSFPMYSALQSACPAGLPNTYSAADRVICLPIYPGLPDEVVQTVVDTIANAS

SEQ ID NO: 43019 - DNA, 1113 bp, Xanthomonas axonopodis pv. citri str. 306
  CDS (1)..(1113)
atggatgtgcctttcctggatttgcgtgcagtcaatgcacgctatgcggatgagctcaaaaccgcagcggcacgtgtgatcgatgccggctggtatgtgctcggtcaagagctggccgcattcgaagaagaattcgccagttattgcggcaccacgcatgcagtcggcgtgggcaacgggctggatgcgttggggttgatcctgcgcggctaccgtgagctgggggtgttgcgcgaaggcgacgaaatcatcgtgccggccaacaccttcatcgcgacatttctggcgatcagccagaaccatctggtgctggtgccggtcgagccggacccggtcactttcaacatcgacccggcaagggtggaaaagtcgatcgggccacgcacacgcgccatcatggcagtgcacctgtatgggcaattggccgagatgcaggccctgcagaccctggcccatcgctacggcctgctgctgatcgaggatgccgcgcaagcgcacggggcaagcgcacgggggcagcgtgccggtgccttcggcgatgcggcggccttcagtttcttcccgaccaagaatctgggcgcattgggcgatggcggcgcagtcacgacgtcggatgcgcgtctggccgagcgcattcgcgcgctgcgtaactacggctcggaagtgaagtatcaccatctctgccagggggtgaactcgcgtctggatgaaatgcaggctgctttcctgcgcgtcaagctgggctatctggaggacgagatcgcgctgcggcgtgcagtggcacggcgatatctgcacggtatctgcaacccgctgatcgtgctgcccgcgccggtggccgagcaacagcacgtctggcatctgttcgtggtacgcagcctgcagcgcgatgccttgcaggcacatctgttgcggcagggcatccacacgcagattcattacccggtgccgccgcaccggcagccggcatacgccactttgggcgaggcctgcctgccgctgagcgaacagctgcatcgggaagtcctgagcctgccgatggggccggcgctggacgatgcagcagttgcgcatgtgatcgcggcctgtcaatcgttcggcagcaacatatga

SEQ ID NO: 43020 - protein, 370 aa, Xanthomonas axonopodis pv. citri str. 306
MDVPFLDLRAVNARYADELKTAAARVIDAGWYVLGQELAAFEEEFASYCGTTHAVGVGNGLDALGLILRGYRELGVLREGDEIIVPANTFIATFLAISQNHLVLVPVEPDPVTFNIDPARVEKSIGPRTRAIMAVHLYGQLAEMQALQTLAHRYGLLLIEDAAQAHGASARGQRAGAFGDAAAFSFFPTKNLGALGDGGAVTTSDARLAERIRALRNYGSEVKYHHLCQGVNSRLDEMQAAFLRVKLGYLEDEIALRRAVARRYLHGICNPLIVLPAPVAEQQHVWHLFVVRSLQRDALQAHLLRQGIHTQIHYPVPPHRQPAYATLGEACLPLSEQLHREVLSLPMGPALDDAAVAHVIAACQSFGSNI

SEQ ID NO: 43021 - DNA, 1116 bp, Chlorobium tepidum TLS
  CDS (1)..(1116)
atgcagttcatcgacctcataacccagaaaaaccgcatccgcgagaacctcatgaagcgtatcgagcggatcatcgacagcgcccagttcgtcatgggtcccgaagtgctcgaagccgagaaaaagcttgccgagtacgtcggcacgaagcactgtgtttcgtgcgcctccggcaccgacgcgctgctcattccgcttatggccaagggcatcggccccggagacgcggtgctcaccacgccgttcaccttcgtggccaccgctgaggtcgtcagccttgtgggcgcgacgccggtgttcgtcgatgtgctgcccggtaccttcaacatcaaccctgatggcgtcgccccggcggtcgaagaggcgcgcaaaaaggggttaaatccgaaagccctgattccagtcgatttgttcggcttgcccgccgagtacgaccgcctcgaaaaggtggcagccgagcagggactctggattctcgaagacgccgcgcagggcttcggcggcacggtcggcggcaggagggcgggcagcttcggccttgtcggcgcgacctcattcttcccggccaagccgctcggctgctacggcgatggcggcgcgattttcaccaacgacgacgagctgcttgaactgctgatctccgtgcgcgtgcacggcggcggttcggacaaatacaacaacgagcgcatcggcctcaacggccgcttcgacgccatccaggcggcagtcatcaacgaaaaactcaccatcttcgacgacgaacttgacctgcgcaacaaggtcgccgctgcctacagcgcccgcctgaaggatcgcgtcgtcgttcccgaagtcccggaaggttacacctcctgctgggcgcaatactccgtgctcgccaactccaccgacgaccgcacgaagctcatggccgcgctgaaggacgcgggcatcccctcggcgatctactatccgatcccgctgcacctccagaaagcctacgaaaatctcggctacaaacccggcgacttcccggtctcggaagatttcagcgcgagggtttttgctctgccgatgcatccgtatctgaaggaagaggagatcgagcagatttgcagggtgattacgagggcgtga

SEQ ID NO: 43022 - protein, 371 aa, Chlorobium tepidum TLS
MQFIDLITQKNRIRENLMKRIERIIDSAQFVMGPEVLEAEKKLAEYVGTKHCVSCASGTDALLIPLMAKGIGPGDAVLTTPFTFVATAEVVSLVGATPVFVDVLPGTFNINPDGVAPAVEEARKKGLNPKALIPVDLFGLPAEYDRLEKVAAEQGLWILEDAAQGFGGTVGGRRAGSFGLVGATSFFPAKPLGCYGDGGAIFTNDDELLELLISVRVHGGGSDKYNNERIGLNGRFDAIQAAVINEKLTIFDDELDLRNKVAAAYSARLKDRVVVPEVPEGYTSCWAQYSVLANSTDDRTKLMAALKDAGIPSAIYYPIPLHLQKAYENLGYKPGDFPVSEDFSARVFALPMHPYLKEEEIEQICRVITRA

SEQ ID NO: 43023 - DNA, 1314 bp, Yersinia pestis KIM
  CDS (1)..(1314)
atgagtcaagaagaattacgtcaacagattgctgagctggttgctcagtacgctgaaacggctatggcccctaagccatttgaagcaggtaagagtgtcgttccaccttcaggtaaagttattggtaccaaagaactccagttaatggttgaagcttctttagacggttggctaacaacgggccgttttaatgacgcttttgagaaaaaactaggcgagtatttgggcgttccttatgttctgactacaacttttggctcttcagccaacttattggctttgaccgcgctgacctcacctaaattaggtgtacgggcgttgaaaccaggtgacgaagttattactgttgccgcaggttttccaaccacagtaaacccaactattcagaatgggttaattcctgtctttgttgatgttgatattccaacttacaatgtaaatgctagcctgattgaagcggcggttagtgataaaaccaaagctattatgattgcccacacattaggtaatctattcgatctagctgaagttcgccgagtagctgataaatataacctgtggttaattgaagactgctgcgatgcgttgggctccacctacgatggaaaaatggctggtacgttcggcgatattggtaccgttagcttctatcccgctcatcatatcaccatgggtgaaggtggggcggtatttacccaatcggcggaactgaagagtatcatcgaatctttccgtgattgggggcgtgattgttattgtgctccaggctgtgacaacacatgtaaaaagcgtttcggccagcaacttggctctttaccattcggttatgatcataaatatacttattcccatttaggttataacttaaaaatcacagatatgcaggctgcctgtggtttggcgcaactagagcgcatagaagagtttgttgaaaaacgtaaagctaactttaaataccttaaagacgcactccaatcctgcgctgactttattgagttaccagaagcgactgaaaattcagatccatcatggtttggtttccctatcactctgaaagaagatagcggagttagccgcattgatctggttaaattccttgatgaagctaaagtgggaactcgcctactatttgccggtaatttaactcgccagccgtatttccatgatgtgaaataccgtgttgttggtgaattgacaaacaccgatagaattatgaatcaaactttctggattggtatttacccaggcctgacacatgatcatttggattatgttgtgagtaagtttgaagagttctttggtttgaatttttaa

SEQ ID NO: 43024 - protein, 437 aa, Yersinia pestis KIM
MSQEELRQQIAELVAQYAETAMAPKPFEAGKSVVPPSGKVIGTKELQLMVEASLDGWLTTGRFNDAFEKKLGEYLGVPYVLTTTFGSSANLLALTALTSPKLGVRALKPGDEVITVAAGFPTTVNPTIQNGLIPVFVDVDIPTYNVNASLIEAAVSDKTKAIMIAHTLGNLFDLAEVRRVADKYNLWLIEDCCDALGSTYDGKMAGTFGDIGTVSFYPAHHITMGEGGAVFTQSAELKSIIESFRDWGRDCYCAPGCDNTCKKRFGQQLGSLPFGYDHKYTYSHLGYNLKITDMQAACGLAQLERIEEFVEKRKANFKYLKDALQSCADFIELPEATENSDPSWFGFPITLKEDSGVSRIDLVKFLDEAKVGTRLLFAGNLTRQPYFHDVKYRVVGELTNTDRIMNQTFWIGIYPGLTHDHLDYVVSKFEEFFGLNF

SEQ ID NO: 43025 - DNA, 1155 bp, Yersinia pestis KIM
  CDS (1)..(1155)
atgcagagttttttgcctttttctaggccagcaataggtagtgaagaaattaatgctgttgctaatgtattaggctctggttggattactaccggtccccagaatcatcaattggaaactgatttctgtcaaatttttggttgcaaacatgcgatcgctgtatgttctgcaacagcaggaatgcacattacattgctggcgttgggcattggccctggtgatgaggttattacgccatcacagacgtgggtttctacgattaacatgatcgtgttgctgggtgcagaacccgtaatggtcgatgttgatcgcgatacattgatggtaaatgcggctgctattgaagcggcgattacacccaacaccaaagccattattcccgtccactatgctggcgcgccctgcgaccttgacgcattgcgtcagatctcccaacggcatggtatcccactgattgaagatgctgcacatgccgttggcactcgttatcgagatcaatggattggtgagcaggggaccgctattttctctttccatgccatcaagaatatcacttgtgctgagggggggttagttgccaccgatgatgatgaattggcggccagagtccgtcggcttaagttccatggcctgggtgtggatgcctttgaccgacaaatacaggggcgtagcccacaggctgaagttgtggaaccggggtataaatataacttatctgatatccacgccgctattgcggtggtgcagcttagacgtttgcccgaaattaacgcccgtcggcaggcgctggttgcttcctatcataaggcattagcgcatttgcctttgcagccgttggccttgcctcactattctcatcaacatgcctggcaccttttcatggtgcgtgttgatgaagaacgctgtggtattagccgggatcaactgatggcgtgtttgaaagatatgggtattggcagtgggctacattttcgtgcggtacatagccaaaaatattatcgcgaacgttatccgcatttgtgtttgcccaacacggaatggaactcagccagattgtgcacgttaccgcttttccccgatatgctagacagtgatattgaacgagtggctaatgcattaacaacaattatagggtcacaccgtgtcactaaatga

SEQ ID NO: 43026 - protein, 384 aa, Yersinia pestis KIM
MQSFLPFSRPAIGSEEINAVANVLGSGWITTGPQNHQLETDFCQIFGCKHAIAVCSATAGMHITLLALGIGPGDEVITPSQTWVSTINMIVLLGAEPVMVDVDRDTLMVNAAAIEAAITPNTKAIIPVHYAGAPCDLDALRQISQRHGIPLIEDAAHAVGTRYRDQWIGEQGTAIFSFHAIKNITCAEGGLVATDDDELAARVRRLKFHGLGVDAFDRQIQGRSPQAEVVEPGYKYNLSDIHAAIAVVQLRRLPEINARRQALVASYHKALAHLPLQPLALPHYSHQHAWHLFMVRVDEERCGISRDQLMACLKDMGIGSGLHFRAVHSQKYYRERYPHLCLPNTEWNSARLCTLPLFPDMLDSDIERVANALTTIIGSHRVTK

SEQ ID NO: 43027 - DNA, 1203 bp, Thermosynechococcus elongatus BP-1
  CDS (1)..(1203)
gtgacctatggcagactcatgatggaaacctctgcgcccgatgctgttatggacatcattcccattctggacctcaaagcccaatatcaatccctccaaccagacatcgatcgcgcagttgcccgggtactcgcatcaggtcagttcattctagggccagaggtacaggcctttgaggaagaggtggccgcctatttaggggtgcgccatgcggtagcagttaattcaggaacagatgcactggtgatttccctgcgcagtttgggggtggggcctggggatgaggtgattacaacccccttttcgttttttgccacagcggaggcaattagtttggtgggtgcccgccccgtttttgtagatgtggaattggactcctttaaccttgatcccagtaaagttgctgcagcgattacccctcgcactaaggtgattttgcctgtgcatttatttggccgaccggcagcgatgggaggaatgatggaacttgctcaggcccatgggttagcgatccttgaggattgtgcccagtcctttggggcccgctattgcccgccctgtaaaaattgtccctgtgaaagggcaactcaagaagccttggcccatcggttcacgggcgcgatcggtaccatgggtgccttttcctttttccccaccaagaatttgggtgcctatggtgatggcggtctaattaccaccaatgatgaggagttagcagagcgatcgcggatgctgcgggttcacggctcccgtcaacgctaccaccacgaaatgattggctataattcccgtttggatagcctccaggcagcaattctacgggtgaagctgccccatatcgatcgctggaatcaacagcgacggcgagttgcccaaacctataaccaagccttggcgggtcttgaggcagtggtgaccccagccgtgtctgcggggcatgtgtttcaccaatatacgattcgggtgctcaatggccagcgggatgcgctggcggcttacctaaaggaggctggcattagttccatgatttactacccgattccccaagatcactgtccaatgtacaaggggcaatctcctcccaatcctgtgagcgatcgccttgccagcgaggttcttagcctacccatttggcctgaattaagcgatgccaccattgagtatattgcggcaaccattcgtcagttttttcaccggtcctga

SEQ ID NO: 43028 - protein, 400 aa, Thermosynechococcus elongatus BP-1
MTYGRLMMETSAPDAVMDIIPILDLKAQYQSLQPDIDRAVARVLASGQFILGPEVQAFEEEVAAYLGVRHAVAVNSGTDALVISLRSLGVGPGDEVITTPFSFFATAEAISLVGARPVFVDVELDSFNLDPSKVAAAITPRTKVILPVHLFGRPAAMGGMMELAQAHGLAILEDCAQSFGARYCPPCKNCPCERATQEALAHRFTGAIGTMGAFSFFPTKNLGAYGDGGLITTNDEELAERSRMLRVHGSRQRYHHEMIGYNSRLDSLQAAILRVKLPHIDRWNQQRRRVAQTYNQALAGLEAVVTPAVSAGHVFHQYTIRVLNGQRDALAAYLKEAGISSMIYYPIPQDHCPMYKGQSPPNPVSDRLASEVLSLPIWPELSDATIEYIAATIRQFFHRS

SEQ ID NO: 43029 - DNA, 1098 bp, Thermosynechococcus elongatus BP-1
  CDS (1)..(1098)
atgagcgtagttccttttcttgatttgcgtgctgcttatcttgagctcaaagcggagatcgatgctgctgtggcccgcgtgctggatagcggctggtatatcctcgggcaagagctcgaagcgtttgaggctgaatatgcagcctattgtggcgcgcagcattgcgtcggggttgccaatggtttggatgcacttcacctggctttgctggcgatggaggtcgggcctggagatgaagtcatcgttccctccaacacctacatcgccacatggctggcggtgagtcagtgtggtgcagtgccagtgccggtggagccagatctggctacctacaatatcgacccgcagcggatcgaagccgcgattactccgcgtaccaaggtcattttgccggtgcatttatacgggcagccggtagacctcgaccccattcttgcgatcgcgcaacgccacgggttgcgtgtgctggaggatgctgcacaggcgcatggggcgcgctacaagggccagcgtattggtgcgcatggcgatgcagtagcctggagtttctaccctggcaagaatctcggtgctatgggcgatgcgggtgcggtcacgacgaacgacccagagcttgcggatcgcatacgtgtgctgcgtaactacggctcccgcgtgaaatacgtcaacgaactacaaggctggaacagccggttggacccacttcaagccgctattctgcgcgttaagctcacccatctggacgaatggaacgagcggcgtagaaaactcgctgcgttatacctgcgggagttgagcaattccggcttggggttaccccacgtgccagattgggcggagcccgtttggcacttgttcgtggtgcggcatccgcgccgcgatgacttccagcagcggcttgcgcaggcgggtatccagacgttgatccactatcctatcccgccgcacgggcaggcagcctatgccggtcttgggattgcgccggggacgcttcccatcgccgagcgcctggctgctgaagtgttgagcttgccaatcgggccgcatttgtcagattcggatgcgctgactatcgtcggggctgtcaagaaatgttga

SEQ ID NO: 43030 - protein, 365 aa, Thermosynechococcus elongatus BP-1
MSVVPFLDLRAAYLELKAEIDAAVARVLDSGWYILGQELEAFEAEYAAYCGAQHCVGVANGLDALHLALLAMEVGPGDEVIVPSNTYIATWLAVSQCGAVPVPVEPDLATYNIDPQRIEAAITPRTKVILPVHLYGQPVDLDPILAIAQRHGLRVLEDAAQAHGARYKGQRIGAHGDAVAWSFYPGKNLGAMGDAGAVTTNDPELADRIRVLRNYGSRVKYVNELQGWNSRLDPLQAAILRVKLTHLDEWNERRRKLAALYLRELSNSGLGLPHVPDWAEPVWHLFVVRHPRRDDFQQRLAQAGIQTLIHYPIPPHGQAAYAGLGIAPGTLPIAERLAAEVLSLPIGPHLSDSDALTIVGAVKKC

SEQ ID NO: 43031 - DNA, 1131 bp, Oceanobacillus iheyensis HTE831
  CDS (1)..(1131)
ttgataccatttaatataccttgtcatttaggtcaagaagaagaagcaatcgctgaagcaattaaagagcaaaagttatctgggaatggccgttttagtcgatattgtacgacatggttggagaatcagttagacgcaaaaaaagcaatattaactccgtcctgtacggccgctttggaaatgtctgccattttgacagatgtgtcagaaggagacgaagttattatgccatcctatacatttgtgtctaccgctaatgcatttgcattgcgaggagcacatattcggtttgtagatgtggaaccaacgacaatgaatattgatccgaaggctattgaagcagcaattaatcatcgaactaaagcaatcgtagtggttcactatgggggtgtggcttgtgatatgattcctatcatgaacttggcaaacgaacatcaattatgggtaattgaagatgcggcacaaggattaaagagtcagtataatggacgtccattaggaactattggtcatcttgggacatttagttttcatgaaacaaaaaattatacatgtggagaaggcggagctcttataataaatgacgatgcttttatcgaacgtgcagagatcatacaggaaaaaggcacagaccgttctaaatttgttcgcggggaagtagacaaatatacatggcgagatatcggatcttcttatttaacgagtgaattaaatgcagcctatttatctgttcaattggatcaagcagaagtcattaaccaagatcgtcttgctacttggtatttgtatcaaaaaggattaaagccattagaagaaaaaggaattttagatttaccaaccataccaaatggatataagcataatgcacatatgttttacattaaaacaaaaacagaagaagacagaaatgaacttattaaatacttaaaggaacaagaaattatggctgtaacccattatgttccattacaccaatctgaagctggtagatattatggatccttctcaggagaagacatgtatacaacatctcatagtaacaggattctacgcttaccactttattacggaataacaaaaagggatgtcgcatatgtcatacaaacaattcagcaatattattcaacataa

SEQ ID NO: 43032 - protein, 376 aa, Oceanobacillus iheyensis HTE831
MIPFNIPCHLGQEEEAIAEAIKEQKLSGNGRFSRYCTTWLENQLDAKKAILTPSCTAALEMSAILTDVSEGDEVIMPSYTFVSTANAFALRGAHIRFVDVEPTTMNIDPKAIEAAINHRTKAIVVVHYGGVACDMIPIMNLANEHQLWVIEDAAQGLKSQYNGRPLGTIGHLGTFSFHETKNYTCGEGGALIINDDAFIERAEIIQEKGTDRSKFVRGEVDKYTWRDIGSSYLTSELNAAYLSVQLDQAEVINQDRLATWYLYQKGLKPLEEKGILDLPTIPNGYKHNAHMFYIKTKTEEDRNELIKYLKEQEIMAVTHYVPLHQSEAGRYYGSFSGEDMYTTSHSNRILRLPLYYGITKRDVAYVIQTIQQYYST

SEQ ID NO: 43033 - DNA, 1116 bp, Oceanobacillus iheyensis HTE831
  CDS (1)..(1116)
atgagagagcggatatttttatcatcacctcatatgagtgatgaaggatatgaacaagaatatgtgaaagaagcttttgatacaaattggattgctccacttggagaaaacgttaatcaatttgaaatagaacttgcaaataaagtaggaataaaatctgctgcagccctttcttctggaactgcagcaattcacttggccttgaaagctgcaggggtgggtgaaggagatattgttttttgtactacacttactttttcagcaagtgccaatccaattatttatcaaaacgcaacacctgtatttattgatagtgatgaaaaatcatggaatatggaccctgaagcattagaagaagcttttagaaaatatccaggagttaaagcagttattgttgttcatttgtatggcttatctgctgatatggatagagttatggaagtttgtaataagcataatgtagctgtaatagaagatgctgcagagtctttaggtacttactataaaggtaagcatacagggacttttggcgattacggcatcttctcatttaatggaaataagattatcaccacttctggtggtgggatgcttgtttctaacaatcgagaaaaaattgcgaaaacgcgtttttgggctacacaatctcgagaccaagcacgtcattatcagcacagtgagttaggttataattatagaatgagtaatatatctgcaggaattggaagaggacaactcaaagtattagataaacgagtagaaaagaaaaagtacatatatgatttttataaaagtgagttaggacaattggaaggtattaaatttatgccagaaaatgagtgggataacccaaattactggctgagttctatacaattaactggaagtgttagaccgattgatatatttaatgcattggaatttgaaaatattgagtcaagaccggtttggaaacccatgcatatgcaaccattctttgaaaaatatgattttattggagaaggggtctcagagaaattgttcgagaatggtgtttgcttgccaagcgatactaagatgacggatgaagaactaggtaaagtggttgatataattaaaggggggtgggggaaataa

SEQ ID NO: 43034 - protein, 371 aa, Oceanobacillus iheyensis HTE831
MRERIFLSSPHMSDEGYEQEYVKEAFDTNWIAPLGENVNQFEIELANKVGIKSAAALSSGTAAIHLALKAAGVGEGDIVFCTTLTFSASANPIIYQNATPVFIDSDEKSWNMDPEALEEAFRKYPGVKAVIVVHLYGLSADMDRVMEVCNKHNVAVIEDAAESLGTYYKGKHTGTFGDYGIFSFNGNKIITTSGGGMLVSNNREKIAKTRFWATQSRDQARHYQHSELGYNYRMSNISAGIGRGQLKVLDKRVEKKKYIYDFYKSELGQLEGIKFMPENEWDNPNYWLSSIQLTGSVRPIDIFNALEFENIESRPVWKPMHMQPFFEKYDFIGEGVSEKLFENGVCLPSDTKMTDEELGKVVDIIKGGWGK

SEQ ID NO: 43035 - DNA, 1104 bp, Brucella suis 1330
  CDS (1)..(1104)
atggatataccagtttactctccctatctctgtgggaatttcaaaaagtatgtgaacgaatgccttgatacagggtggatctcgtcgaggggtgaattcatatctcgctttgaagatgcatttgcacaatatgtcgatgttccgtctgcgacttcagttgcaaacggaacggtggcactacatctcgctctagatgctctgggcatcggggcgggcgatgaagtcattgtaccgacctttacctatatcgcttcagttaacactatcttgcaaaccggggcaacaccggtttatgtggactctctcgaaaatacattgcagatagatccagagggggtgcgactggcgattacagagcgcactaaggctgtaatggttgttcatctctatgggcatccatgtgacatggattcgatccgagagatttgtgacgaaaaatcgctactgctcgtcgaagactgtgctgaaggattcggaactaaatggaaaaacagtcacgtcggcacgtttggcgacgtggcgacgtttagtttctttgggaacaagacaattacgaccggtgaaggcgggatggtgctagcgcgcaatcctcaagtcatggaaaaatgccgacatctcaaaagtcaaggtacttcgcctacacgagaatactggcatgatgcgcttgcgtataattacagaatgacaaatattcaagcagcaatcggcctgtcgcaaattgaaatggcagatgaaatactctcccttaaagccaggacagctgcctcttatgccagcaagttagctggattgccgcttcgtatgcacacccctgtgggagacgttaaacattcatattggatgtgctctattgtacttgataactcggaacacagagagccgctgcgccaacatttaagggagaatggtgtagatacacgaccgtttttcccgccagcccatcgtatgcctcacagcgcttccacaggatcttaccctgttgctgatagcttatccgctcgtgggttgaacctgccaagcctcccacacattactgatgtagaaatcagttttgtttgtgatttggtcaggagttatttttctaatcattccaaccacatttag

SEQ ID NO: 43036 - protein, 367 aa, Brucella suis 1330
MDIPVYSPYLCGNFKKYVNECLDTGWISSRGEFISRFEDAFAQYVDVPSATSVANGTVALHLALDALGIGAGDEVIVPTFTYIASVNTILQTGATPVYVDSLENTLQIDPEGVRLAITERTKAVMVVHLYGHPCDMDSIREICDEKSLLLVEDCAEGFGTKWKNSHVGTFGDVATFSFFGNKTITTGEGGMVLARNPQVMEKCRHLKSQGTSPTREYWHDALAYNYRMTNIQAAIGLSQIEMADEILSLKARTAASYASKLAGLPLRMHTPVGDVKHSYWMCSIVLDNSEHREPLRQHLRENGVDTRPFFPPAHRMPHSASTGSYPVADSLSARGLNLPSLPHITDVEISFVCDLVRSYFSNHSNHI

SEQ ID NO: 43037 - DNA, 1125 bp, Brucella suis 1330
  CDS (1)..(1125)
atgcagttcattgatcttggagcgcagcgcgcgcgtatcgaaaatcgtctcaatgccgccatttccaaggttgttgcggaaggccgttatattcttgggccggaagtggctgaatttgaaaaaaagcttggcgaatatctgggtgtggagcatgtcatcgcctgtgccaatggcactgacgccttgcagatgcccctgatgacacgcggcatcgggccgggccatgcggtttttgttccgtccttcacctttgcagcgaccgctgaggttgttgcgctcgtcggtgcagagccggtattcgttgatgtcgatccagatagctacaacatgaatgtcgagcagctcgaagctgccattgccgccaccatcaaggaaggtcgtctggagccgaaggcgatcattccggtcgatctttttggccttgccgcctcttacaatcgcatcaccgccattgccgagcgcgaaggcctgttcatcatcgaggatgcggcccagtccatcggcggcaagcgcgacaatgtcatgtgcggcgctttcggccatgtgggcgcaaccagcttctatcccgccaagccgcttggctgctacggtgacggtggcgccatgttcaccaatgatgcagaattggcagatacactgcgctccgtgctgttccacggcaagggcgagacgcagtatgacaatgtccgcatcggcatcaattctcgcctggatacgatacaggcggctgttcttctggaaaagcttgccattctcgaagatgagatggaagcccgcgaccgcattgcaaggcgctataatgaggcgctgaaggatgtggtgaaggtgccggaacttccagccggcaaccgctcggcctgggcgcaatattctatcgaaagcgagaaccgcgacggcttgaaggcacaacttcaggcagaaggtattccgtccgtcatctattatgtgaagcctctgcacttgcagacggcctataagcactattccgttgcccccggtggcctgccggtttcggaaagcctgccatcacgcattctgagcctgccgatgcatccttacctttcggaagctgaccaggacaagattatcggcgtgatccgtggcttccacggcaagaaggcctga

SEQ ID NO: 43038 - protein, 374 aa, Brucella suis 1330
MQFIDLGAQRARIENRLNAAISKVVAEGRYILGPEVAEFEKKLGEYLGVEHVIACANGTDALQMPLMTRGIGPGHAVFVPSFTFAATAEVVALVGAEPVFVDVDPDSYNMNVEQLEAAIAATIKEGRLEPKAIIPVDLFGLAASYNRITAIAEREGLFIIEDAAQSIGGKRDNVMCGAFGHVGATSFYPAKPLGCYGDGGAMFTNDAELADTLRSVLFHGKGETQYDNVRIGINSRLDTIQAAVLLEKLAILEDEMEARDRIARRYNEALKDVVKVPELPAGNRSAWAQYSIESENRDGLKAQLQAEGIPSVIYYVKPLHLQTAYKHYSVAPGGLPVSESLPSRILSLPMHPYLSEADQDKIIGVIRGFHGKKA

SEQ ID NO: 43039 - DNA, 1107 bp, Shigella flexneri 2a str. 301
  CDS (1)..(1107)
atgggcgtggaggaactcgctgcagttaaagaggttctcgaatccggttggatcacaaccggtccgaagaatcaggcgcttgagcaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaatcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttcgttgccgctgttcccggatatgactaccgccgatgccgaccgcgtcatcacagcccttcagcaactcgcaggacaataa

SEQ ID NO: 43040 - protein, 368 aa, Shigella flexneri 2a str. 301
MGVEELAAVKEVLESGWITTGPKNQALEQAFCQLTGNQHAIAVSSATAGMHITLMALEIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADRVITALQQLAGQ

SEQ ID NO: 43041 - DNA, 1077 bp, Leptospira interrogans serovar Lai str. 56601
  CDS (1)..(1077)
atgatccattggtggcaaactacttttggagaagaagaaatcaatcgagttgttgaatctttcagaaatcaaaatatcagtcaaggtaaggttacgtctgagtttgaagataatattgctcaatatttaggagttaaatatgtagtggcaacttctagtgggagcaccgctttacttctttcgttaatggcaattggtgttaaaccaggtgatgaagtaattataccgaatcgcacttggatagcaacggctcatgcggcttatttattaggcgcaaagattgtccttgtagatgttgaattaaatagacctatattagatgtatctaaagtagaggagcaaataaattctaagactaaagcgattattccagtccatatgaacggtcgatctgttcatatggaacagctgaataaaattgctaagaaaaataacttatttgttatagaagacgcggcgcaagcaataggctctaagaattctttaggctatctcggaactcaatcagatgtaggatgtttttctctttctgtagcaaaaacaattgcaacaggacaaggtggttttgcagttacaaataattcagatcttgcttttaaacttcgggctattagaacgcatggagtggaaaatgttaaggatcccaaaacatgggctatgccagggtttaattttagatttactgatatacttgcttctataggtattgagcagcttaaaaaattaccagaacgtcttgaatatcttaaggaaatatatcgaacttatttagaaggcttaaaagatcttccaattaattgtatacctgtcaatattgaagctggagaagttccagtatataccgagtatctagtaaatagtagggaagattttatcgactgtcttgctaaagctgaaatagattcgagaccattctatcctgatttggataaagcgtcttattttccacaaggaaatagagattttccaaattctagaaaatacggtcttaagggaatttacttacctagtggcccatcccaaaaaattgatagtataaaatttgttattgaacaaattaaaaatatttatggatga

SEQ ID NO: 43042 - protein, 358 aa, Leptospira interrogans serovar Lai str. 56601
MIHWWQTTFGEEEINRVVESFRNQNISQGKVTSEFEDNIAQYLGVKYVVATSSGSTALLLSLMAIGVKPGDEVIIPNRTWIATAHAAYLLGAKIVLVDVELNRPILDVSKVEEQINSKTKAIIPVHMNGRSVHMEQLNKIAKKNNLFVIEDAAQAIGSKNSLGYLGTQSDVGCFSLSVAKTIATGQGGFAVTNNSDLAFKLRAIRTHGVENVKDPKTWAMPGFNFRFTDILASIGIEQLKKLPERLEYLKEIYRTYLEGLKDLPINCIPVNIEAGEVPVYTEYLVNSREDFIDCLAKAEIDSRPFYPDLDKASYFPQGNRDFPNSRKYGLKGIYLPSGPSQKIDSIKFVIEQIKNIYG

SEQ ID NO: 43043 - DNA, 1164 bp, Leptospira interrogans serovar Lai str. 56601
  CDS (1)..(1164)
atgttaagtgaacaaattgtatccgttttaagatcggtgatcactgataaaaatgatgtcgttccattgcatgagccgattttccaagggaacgagtgggcctatgtaaaagagtgtttggatacaacttttgtatcttcggtaggtaagttcgtagatcgatttgagaaagatctggtggagtttacgggagccggatatgcagttgcggttacaaatggaaccgccgcattacagatcgctcttaaacttgcaggagttcaagcccaagacgaagtattagttccttccctaacttttattgcaaccgcaaatgcggttagttatttaggagcatttccccaccttattgacagtgaggaaaatactttgggggtatcagcgacttctctcaaggagcatttgaattttattggagaaattcgatcagggcagtgttttaataaaaaaacgggtaatcgaattagtgcaatcgttcctatgcatacctttggccatcccgtcgatatcgacggattgttcgcagtggctaaagattaccatcttgtagttgttgaggacgctgcagaatctcttggaagttattaccatggaaaacataccggaacgttcggcttattaggaactctgagttttaatggtaataaaacgattactacgggaggcggaggggctattcttacaaatgatagaaatttagctactctggctaaacatattacgaccactgccaaacttcctcatgcttgggaatacactcatgatatgatcggttataatttcagattaccgaatatcaatgcggctcttggttgtgctcaattagaaatgctacctcagtttttaaccgctaaaagagcactttatgaaagttataagaatgctttttcagttgtgaaaaatgcgaaactacaatcggaaccgaaaggctgcaagagtaattattggcttcaaactctaatactagactcttctgtaatgaacgaaagagattcgattcttaagacaaccaatgattgcggtcttatgacaagaccagcttggactttacttcacaaactgaagccataccaaagttgctttcgagcggaacttcccgtagctgaatcgttggaaaaaaggcttattaatattccaagtagtgcgaatattattgatgggtaa

SEQ ID NO: 43044 - protein, 387 aa, Leptospira interrogans serovar Lai str. 56601
MLSEQIVSVLRSVITDKNDVVPLHEPIFQGNEWAYVKECLDTTFVSSVGKFVDRFEKDLVEFTGAGYAVAVTNGTAALQIALKLAGVQAQDEVLVPSLTFIATANAVSYLGAFPHLIDSEENTLGVSATSLKEHLNFIGEIRSGQCFNKKTGNRISAIVPMHTFGHPVDIDGLFAVAKDYHLVVVEDAAESLGSYYHGKHTGTFGLLGTLSFNGNKTITTGGGGAILTNDRNLATLAKHITTTAKLPHAWEYTHDMIGYNFRLPNINAALGCAQLEMLPQFLTAKRALYESYKNAFSVVKNAKLQSEPKGCKSNYWLQTLILDSSVMNERDSILKTTNDCGLMTRPAWTLLHKLKPYQSCFRAELPVAESLEKRLINIPSSANIIDG

SEQ ID NO: 43045 - DNA, 1185 bp, Leptospira interrogans serovar Lai str. 56601
  CDS (1)..(1185)
gtggattttaaaattaaatggtcaggtagatcgattgattatacccaagaagagatcgatactgttgtagaagttatgaagaccgcagatcctcagacccagggtaagtatttgcaacaatttgaaagtgatttttcaaactatttagatggtcagccttgcttcggagtcaccaatgctacacatgctctggagttaattgcggatttaaccggtttaaaatccggtgatgaagtaattattcccggccatacttactgtgcatctgccattccttttggaagaacaggagctactttggtatgggctgatattgatcctgaaacttttttaatctcgttggaatcaatccaaaagttagtcacaaataaaacaaaagctatcgtggtagtgcatttatatgggatgatcattccggatatattggaaatcgctaaatttgcaaaatctaaaaatattctattaattgaagattgtgcacaatcgttaggggcggtattaaacggcaagtcttgcggtacatttggagattttgccgcatttagttttcatggtcaaaaaaatattacaaccatgggtgaaggaggaattcttactttaaagaatgtttctcttgctgataaagttcccggcttaagacataacgggcacgcaccctttctaaataaaaccgattattggaaaccggctatgtctaatgtggatttagatttggatggaatttggcctcataattttagtctaacggaagttcaggctgctttaggatccgttttattaaaacgaattgctttattaacggaagaaaggaggaaaagagcacagaaatttataaattcatttaatgaatttgaggaattatcttttcaaaaacaaaacgattccaaagctcatagctatcatcttttagtagccaaatacaaagctgtaaagaatgggaaaaacagagacgatttaatttctattttgagtaagaaatataagattcaagtcatcgttcaatactatcctttgtacagatatgatttatttaaaaaaatgggttatgctaaagctgtttgcccggcaagcgatgatttttttgataatatgatttcctttccgtttcatatttggatgaatgaaaatgattttgattatatgattgcgtcgataaaacaagctctaatagaattgcgaagttaa

SEQ ID NO: 43046 - protein, 394 aa, Leptospira interrogans serovar Lai str. 56601
MDFKIKWSGRSIDYTQEEIDTVVEVMKTADPQTQGKYLQQFESDFSNYLDGQPCFGVTNATHALELIADLTGLKSGDEVIIPGHTYCASAIPFGRTGATLVWADIDPETFLISLESIQKLVTNKTKAIVVVHLYGMIIPDILEIAKFAKSKNILLIEDCAQSLGAVLNGKSCGTFGDFAAFSFHGQKNITTMGEGGILTLKNVSLADKVPGLRHNGHAPFLNKTDYWKPAMSNVDLDLDGIWPHNFSLTEVQAALGSVLLKRIALLTEERRKRAQKFINSFNEFEELSFQKQNDSKAHSYHLLVAKYKAVKNGKNRDDLISILSKKYKIQVIVQYYPLYRYDLFKKMGYAKAVCPASDDFFDNMISFPFHIWMNENDFDYMIASIKQALIELRS

SEQ ID NO: 43047 - DNA, 1092 bp, Leptospira interrogans serovar Lai str. 56601
  CDS (1)..(1092)
atgattgaatatgaaaatttacgtttagcgaatgaacgcttttttgacgagtataaaactaaacttttagaaaccatagaaagcggatggtatatattaggaaaagaagtttctaactttgaaagtcaatttgcagaatacaatggaaatagatattgtattggggtaggaaatggtctagatgcgttgatactcgccttaaaggcgttaggtctagaaaagaattctgaaattatagttccttcaaatacgtatatagcttctatattagcaattttgcatgcaggtttgaaacccgttttagttgaaccagatattcggacctataacattgatccccaaaagatagaggaaaaaataaattttaaaacaaaagggattttgatcgtacatctgtatggtaaaccttgtgaaatggattctattttaaagataaaagaaaaaaataatctgtttctagtggaagattgtgcgcagtctcatggggccttgtataagaataaaaaaacgggaacgtttggagaaatgagtggattcagtttttatcccactaaaaatttaggagctcttggggatgcgggtgcggttgtaactgataatgatttatatcacgatgagattcggaaattaagaaattatggttcttcaatcaagtataaaaatgatttggtcggatataactctcgtttagatgaattacaagcaacaatcttaagtatcaagctgaaacatttggatgtaatgaacgagcataaaagaagtttggcgaaaatttatctagaaaatctaaaagaagattttataaaaccaatagtcgacgaagaagtttacgacgtatatcatatctttaatattcgtcatacaaaacgtgacgatttgcgagactatctgttaaaaaatggcgtaaaaacagaagttcattacccaattcctcctcataaacaaatagcgatgaaggacgtaatcttatacgcagagggcgagtttgcgatctcagaagagattcatcgtacaactcttagtcttcctatttcaacttttcatacagaagaagatatttataaaattgtagaaattatgaatagattttaa

SEQ ID NO: 43048 - protein, 363 aa, Leptospira interrogans serovar Lai str. 56601
MIEYENLRLANERFFDEYKTKLLETIESGWYILGKEVSNFESQFAEYNGNRYCIGVGNGLDALILALKALGLEKNSEIIVPSNTYIASILAILHAGLKPVLVEPDIRTYNIDPQKIEEKINFKTKGILIVHLYGKPCEMDSILKIKEKNNLFLVEDCAQSHGALYKNKKTGTFGEMSGFSFYPTKNLGALGDAGAVVTDNDLYHDEIRKLRNYGSSIKYKNDLVGYNSRLDELQATILSIKLKHLDVMNEHKRSLAKIYLENLKEDFIKPIVDEEVYDVYHIFNIRHTKRDDLRDYLLKNGVKTEVHYPIPPHKQIAMKDVILYAEGEFAISEEIHRTTLSLPISTFHTEEDIYKIVEIMNRF

SEQ ID NO: 43049 - DNA, 1209 bp, Leptospira interrogans serovar Lai str. 56601
  CDS (1)..(1209)
atgtccgatatgatcacagcacgcaaaacctttctcccgttcgctctaccttgtatctccgaaagagccatcgaagaagtatcttccgtactacgttccggatggatcacttcggggcctaaagtaaaagaatttgaagaggaatttgctcgttataccggggctgattatgcacttgctctcaactcagctacggccggacttcacttggcgcttgaggcgatcggaatgagccgtgaagatgcggctatttgtcctgcggttacatttaccgctaccgcagaagtgatctgctattttgacgcggagccgattctcacggacgtggacccgatcttcaatcttatgactcccgaaacccttcgtgatacgatcgaaagggaatgtatttatctgaacggaactctctttcacaaaacaacaggaaagaccgtaagggcgatcttgccggttcatctcgccggagtaatctgtgatatggaaggtatattagaaattgctaaagaatacaacctctatgtgatagaagatgcagctcatgcttttcctgcggttcgcaatggaagaaagatcgggacttttggagattttaccgttttcagtttttatgccaccaagggaattactaccggagaaggtggaatggttacgactaaacattctcattttgccgaaagaatcaaattgatgcgtttgcatggaattaatcgagagacctacgatcgaccaggttggtattacgaagtggtatcacccggttttaaatacaacatgacggacgtggctgcggctcttggaatcgttcaactttctgaagcagacgaactttggaaacgaagaattttaatcgccgaaaactataagagggaatttgccgatctaccatttttgcatcttcctctttctgccccaaacggtgaacattcttggcatttgtttcgtgtagaagtagattgtgcttcttgcaaaatggatagagatatttttgcatccgaattaaaaaaacgtaatataggttcaagtcttcattttataccactttatgaacatccattttattcttctcgtttcagatttaaaaaggaacattttccgaatgcgaacgcgatgtatgcaagatctctttctattcctctttttccggggatgaaggatgaagacgttcaggatgtgatcagagcggttaaagaaatttttagcgcgctttaa

SEQ ID NO: 43050 - protein, 402 aa, Leptospira interrogans serovar Lai str. 56601
MSDMITARKTFLPFALPCISERAIEEVSSVLRSGWITSGPKVKEFEEEFARYTGADYALALNSATAGLHLALEAIGMSREDAAICPAVTFTATAEVICYFDAEPILTDVDPIFNLMTPETLRDTIERECIYLNGTLFHKTTGKTVRAILPVHLAGVICDMEGILEIAKEYNLYVIEDAAHAFPAVRNGRKIGTFGDFTVFSFYATKGITTGEGGMVTTKHSHFAERIKLMRLHGINRETYDRPGWYYEVVSPGFKYNMTDVAAALGIVQLSEADELWKRRILIAENYKREFADLPFLHLPLSAPNGEHSWHLFRVEVDCASCKMDRDIFASELKKRNIGSSLHFIPLYEHPFYSSRFRFKKEHFPNANAMYARSLSIPLFPGMKDEDVQDVIRAVKEIFSAL

SEQ ID NO: 43051 - DNA, 1188 bp, Shewanella oneidensis MR-1
  CDS (1)..(1188)
atgcccggttttgaattatttggtccagaagaaaaacaagaagtcgccgatgtgatggagcacggctttaccttccgttataacttcgaccatatgcgtaatgatcgctggaagactcgcgatatggagcaactgctctgcgagaaaatgaatgttaagcatgcccatctgttatcaagcggtacagccgcgctgcaaacggcaatgatggccgcgggcattggcgctggcgatgaagttatcgtgccaccatttacctttgttgcgtcagtagaagccatcttcatggcgggtgcagtaccgatttttgccgaaatcgacgaaaccctgtgtttatcacctgaaggcattgaagccgtaatcactccacgcacaaaagcgattaacttagtgcacatgtgcggctcgatggccaaaatggacgaaatcaaagccatctgcaaaaagcacaacctcgtattacttgaagatgcttgccaagccatcggcggcagctataaaggtcaagccctcggcactatcggtgatgtaggttgttactctttcgattcagttaaaaccatcacctgtggtgaaggcggcgcagttattaccaataacactgaaatctacgataacgcccatatgttctccgatcatggccatgaccatattggtaaagaccgtggtgcagagtcacacccgattatgggtctgaacttccgtatttctgaaatgaatgcggctttaggtttagcccagttacgtaaactcgataccattatcgacattcaacgtaaaaacaaaaaagccattaaagatgctatggccagcattcctgaagttagcttccgtgaaatccccgatcctgaaggtgattcagccggcttcttaagctttatgttacctaccgaagcgcgtacccaagagatcagcaaaaaattagctgccaatggtgtagacggctgcttctactggtacgtaaacaactggcattatctgaaaaactggaaacacattcaggagcttaaggcccctgctgcgttaccaatcacattaatcgccgaccgacctgactatactcaaatttctgtgccgaaatctgatgccattatgagccgtactatttctatgctcattaaattgtcttggaccgatgctcagattgccgagcgtattgaaaacattaagaaagcatttgcccaataa

SEQ ID NO: 43052 - protein, 395 aa, Shewanella oneidensis MR-1
MPGFELFGPEEKQEVADVMEHGFTFRYNFDHMRNDRWKTRDMEQLLCEKMNVKHAHLLSSGTAALQTAMMAAGIGAGDEVIVPPFTFVASVEAIFMAGAVPIFAEIDETLCLSPEGIEAVITPRTKAINLVHMCGSMAKMDEIKAICKKHNLVLLEDACQAIGGSYKGQALGTIGDVGCYSFDSVKTITCGEGGAVITNNTEIYDNAHMFSDHGHDHIGKDRGAESHPIMGLNFRISEMNAALGLAQLRKLDTIIDIQRKNKKAIKDAMASIPEVSFREIPDPEGDSAGFLSFMLPTEARTQEISKKLAANGVDGCFYWYVNNWHYLKNWKHIQELKAPAALPITLIADRPDYTQISVPKSDAIMSRTISMLIKLSWTDAQIAERIENIKKAFAQ

SEQ ID NO: 43053 - DNA, 1146 bp, Shewanella oneidensis MR-1
  CDS (1)..(1146)
atgatcccctatggccgacaagacatcaatcaggcagatgttgatgctgtgattgaagtgcttaattctgattatttgactcaagggcctaaggttccggcatttgagtcagcagttgcttcctattgttcagctcgctatggcgtagcagtaaatagtgcgacttctgccttgcatattgcatgtctcgctcttggggttgggccaaacgatatagtatggacttctccaattacctttgtcgcctcggcaaactgcgcgctttactgtggagctgagattgattttgtcgatgtggatcctctaacgggtaatctttgtccacatgcattggcaatgaaattagaacaagcggctcggatagggaagctccctaaggttgttatccctgtacatttatgtggtcatagttgtgatatggcagcgatcgctgctcttgctgaacaatatagctttcacatcattgaagatgcctcacatgggattggcgggagctatcatggataccctttgggtagctgccaatactctgatattaccgtttttagctttcaccccgtcaaaattatcaccagcgccgaaggcggtatggccatgacaaacagctcagaattagctgaaaaaatggccctttaccgcagccacggtatcactaaagcccccgataaaatgttaagacctgatgaaggggactggtattacgaacaacacgccttgggatttaactataggatgacggagttgcaggcagcgcttggtttgtcgcaaattagcaggcttaatgcctttgttttgaaacgcaatgaactagccgctatatatcgtaaagaactcattggattacccttttgctgggttgagcctttgtcaaatactcaaagtgctagacatttacaaattatccgcctaaatgacgcatcaagaagaaaacagctattcaacgatatgagagctgcaaatgtacaagtgcatgttcattatttccccgtacatcttcaaccttactatttaaaacaaggatttaaagaaggtgatttcccacaagcagaggcattttatcaacagatattgaccttgccactctatcctttgatgactgataaggaacaagcttgcgttattaacaccttgttagctgtactgtaa

SEQ ID NO: 43054 - protein, 381 aa, Shewanella oneidensis MR-1
MIPYGRQDINQADVDAVIEVLNSDYLTQGPKVPAFESAVASYCSARYGVAVNSATSALHIACLALGVGPNDIVWTSPITFVASANCALYCGAEIDFVDVDPLTGNLCPHALAMKLEQAARIGKLPKVVIPVHLCGHSCDMAAIAALAEQYSFHIIEDASHGIGGSYHGYPLGSCQYSDITVFSFHPVKIITSAEGGMAMTNSSELAEKMALYRSHGITKAPDKMLRPDEGDWYYEQHALGFNYRMTELQAALGLSQISRLNAFVLKRNELAAIYRKELIGLPFCWVEPLSNTQSARHLQIIRLNDASRRKQLFNDMRAANVQVHVHYFPVHLQPYYLKQGFKEGDFPQAEAFYQQILTLPLYPLMTDKEQACVINTLLAVL

SEQ ID NO: 43055 - DNA, 1143 bp, Vibrio vulnificus CMCP6
  CDS (1)..(1143)
atgaacgcacagttactggttgagtttgtacgcgaccaataccaaacccaagattttattccgttgcatgcccctacttttgcgggcaatgagaaagcgtatgtgatggaaaccattgacagcacctttgtctccagcgtcggtaagtttgtcgatgagtttgaacgtaaaatggaagcgtttactggtactccaaaggcggtggcgacggtcaatggtaccgcagccttgcacgcagccctctacatggcaggggttgaacgtggtgatttggtgatcacacaagcgctgacgtttgttgctacttgtaatgcgctttatcacatgggcgccgagccgatttttgtggatgtttcccctgtaagcttggggctttgccctaaagcgatgagtgctttcttagaagataatgcacaagtcactgaggcaggttgcatccataagcaaacgggcagaagaatcaaagccgtggtgccaatgcacacttttggtcatccggtagaattggatgaactggttgctgtttgtttgaaatggaatatttcgttagtcgaggatgctgcggaaagcctaggctcgttttacaagggtaagcacacggggacaatcggtgattttggtgcggtgagtttcaacggcaacaaaatcattaccacaggtggtggcggtatggtgctttgcgggagtgaagaagcgggcagacgcactaagcatgtgactacgacggcgaaagtgccgcacccgtatgagttcttccatgatgagccagggtttaactaccgcatgccgaacttaaatgcggcgctgggttgtgcgcagatggaagtacttgaacactatctggctcaaaaacgccaactggcacatcaataccaagcgtttttcgccagcagcgatgtgacctttgtggtcgagccagaatacgcgcaatctaactactggctcaatgccatcatttgcgcggatgcacagcagcgcaatgaactgcttgagcaaactaatgccgctggcgtaatgactcgcccaatttggcagttaatgcatcgtttgccaatgttcgaacaagccctgcgcggggatttgacccattcagagtttattgaagcacacctgattaacttaccgagtacgccggttgcgtaa

SEQ ID NO: 43056 - protein, 380 aa, Vibrio vulnificus CMCP6
MNAQLLVEFVRDQYQTQDFIPLHAPTFAGNEKAYVMETIDSTFVSSVGKFVDEFERKMEAFTGTPKAVATVNGTAALHAALYMAGVERGDLVITQALTFVATCNALYHMGAEPIFVDVSPVSLGLCPKAMSAFLEDNAQVTEAGCIHKQTGRRIKAVVPMHTFGHPVELDELVAVCLKWNISLVEDAAESLGSFYKGKHTGTIGDFGAVSFNGNKIITTGGGGMVLCGSEEAGRRTKHVTTTAKVPHPYEFFHDEPGFNYRMPNLNAALGCAQMEVLEHYLAQKRQLAHQYQAFFASSDVTFVVEPEYAQSNYWLNAIICADAQQRNELLEQTNAAGVMTRPIWQLMHRLPMFEQALRGDLTHSEFIEAHLINLPSTPVA

SEQ ID NO: 43057 - DNA, 1143 bp, Bradyrhizobium japonicum USDA 110
  CDS (1)..(1143)
atgaatgagaaaggcattatcagcacgccgatgtcgcagcccgatatcaccgagggcgatatcgatctcgtcgcacaggtgctgcgaagcggccggctcagcatcggagcctatatcgaagagttcgagaagcgcgtacgcgactatgttggcacgcgatatgccgtcgcggtcgccagcggcacggctggcctgcacctgtgcatgcggcttgccggcgtgaaggagggctcggaagtcgtcacgtcacccttcagcttcgtcgcctcagccaattgcatcctctacgagcacggaacgccggtgtttgtcgacatcgacgaagacagtttcaatatcgatgcggatgcgatcgacgcggcggtgaacgaccggacggtcgcaatccttccgattcatgtcttcggccgtcccgcgcgcatggaccagatctgccgcaccgccgaccggcgcgggcttgccgtgattgaagacgcctgcgaagcgatcggcgcggagttcgacggccgcaaggtcggcgcgtttgggcgcgcatccgtcttcgctttctatcccaacaagcagatgaccaccggcgagggcggcatcgtaaccaccgacgatccgcaatgggatcgcgagctgcgagccttgcgcaatcacggacgcgccggcgacgaatggctgcaacatcatcagttggggttcaactaccgcctcaatgaactcagtgccgcgctgggtctctcgcagatctcgcgcctcgacgacctcttggaccggcgagctgcggtggcagcggcttacaacgatcgcctggcgcgcatcgtgagcgtcaagccactcagtgcggctgcgaacaccacgcggatgagttggttcgtgtacatcgtgcggttggatgctcgcctgtcgcgcgacaatatcgcgtcgcggcttgcggaacgcgggattccgacgcgaaattatttcccgccgatccatcttcagccgtacttcgccgagcgttacggctaccaacgcggccagtttcctgtgaccgagcgggtcgccgccagcacgctggctctccccttccacaccaacatgccggagcaggcggtcgaccacgtctgtcgcgcgcttcaaatggcgatcgaccaggaaacccgtcgttcagcctag

SEQ ID NO: 43058 - protein, 380 aa, Bradyrhizobium japonicum USDA 110
MNEKGIISTPMSQPDITEGDIDLVAQVLRSGRLSIGAYIEEFEKRVRDYVGTRYAVAVASGTAGLHLCMRLAGVKEGSEVVTSPFSFVASANCILYEHGTPVFVDIDEDSFNIDADAIDAAVNDRTVAILPIHVFGRPARMDQICRTADRRGLAVIEDACEAIGAEFDGRKVGAFGRASVFAFYPNKQMTTGEGGIVTTDDPQWDRELRALRNHGRAGDEWLQHHQLGFNYRLNELSAALGLSQISRLDDLLDRRAAVAAAYNDRLARIVSVKPLSAAANTTRMSWFVYIVRLDARLSRDNIASRLAERGIPTRNYFPPIHLQPYFAERYGYQRGQFPVTERVAASTLALPFHTNMPEQAVDHVCRALQMAIDQETRRSA

SEQ ID NO: 43059 - DNA, 1107 bp, Bradyrhizobium japonicum USDA 110
  CDS (1)..(1107)
atgtacgacgttcgatattcctatctgctcgagcaattctccgatcctgcccccatcctggccgagatcggccggctggtcgcgaccggggacttcacccttggcaagcccgtcgccgaattcgagaagcgctttgccgagctgatcggcgtgcgccacgccatcggcgttggatcgggcaccgacgcgctcaagctgccgctcaaggcgctcggcattggccatggcgatgaagtcatcaccgccgccaatacgttcatcgcgaccgtcggcgccatcgcggagaccggggcgaagcccgtgctggtcgactgcgacgattcgttctgcatgaacgtcgactatgtcgaagccgcgatcacggcgaagactaaggcgatcatgccggttcagttgaccggcgaggtcaccgacatgggcaagctgatggcgatcgcgcagcgccacaacatccccgtcgtcgaggacgcctgccagggcatcctgtctgagttcgcgggaaagcgctccggcacccacggcatcgcggccggcttttccctgcacccgctcaagaacctgaacgtctggggcgatgccggcgtcgtcgtcaccaatgacgacggcatgaacgagaagctccggctcatccgcaaccacggcatgaagaaccgcgacgagatcgcgatcctcggctgcaactcgcggctcgattccttgcaggccgtcgtcggcaactggctgatcggccagaccagcgagatcacgcggcgccggatcgagaacgcggcctattacgacgcaggcctcgccggcctgcccggcctgcgcgtcccgccgcgccggcccaacgtgaagcacgtctatcacctctacatggtgttcgccgaacgccgcgacgagctttacaagtactgcctggacaacggcatcgaagccaagatccactatccgatcccgctgtatcagcaggaaggcctcaagcatctcggttacgcccccggaacgttcccggttaccgaccgtcatgccaaggaagtcatcagcttcccggtggaccagcacctgacgcgcgcgcagcaggaccgcgtcatcgagactgtcaggaagttctgccatggacgctga

SEQ ID NO: 43060 - protein, 368 aa, Bradyrhizobium japonicum USDA 110
MYDVRYSYLLEQFSDPAPILAEIGRLVATGDFTLGKPVAEFEKRFAELIGVRHAIGVGSGTDALKLPLKALGIGHGDEVITAANTFIATVGAIAETGAKPVLVDCDDSFCMNVDYVEAAITAKTKAIMPVQLTGEVTDMGKLMAIAQRHNIPVVEDACQGILSEFAGKRSGTHGIAAGFSLHPLKNLNVWGDAGVVVTNDDGMNEKLRLIRNHGMKNRDEIAILGCNSRLDSLQAVVGNWLIGQTSEITRRRIENAAYYDAGLAGLPGLRVPPRRPNVKHVYHLYMVFAERRDELYKYCLDNGIEAKIHYPIPLYQQEGLKHLGYAPGTFPVTDRHAKEVISFPVDQHLTRAQQDRVIETVRKFCHGR

SEQ ID NO: 43061 - DNA, 1119 bp, Bradyrhizobium japonicum USDA 110
  CDS (1)..(1119)
atggacgctgacaccggccgtcggcgcatcggttacgtcaaccttccggcgcaattcgaggaagagcgcgccgagatcatgcaggcggtcgagggcgtgttccagcgcggcgatttcatcggcggtgcggcggtcggaaagctcgaagaggaattgtccgcctatctcggctcgccgcatgtcgtgacgctgaattccggcaccgatgcgctgatcctcgcgatgagggcgctcgacatcggtcccggcgacgaggtcatcaccccgccgaattcgttcgtggcatcgaccgccgcgatcatcgcagtcggcgcctcgccggtctttgcggacgtgctgccggaccagaacatcgatccggccgcggtcgaggccgccgtcacgccgcggaccaaggcgatcatgccggtgcacctgactgggcgcatggccgacatgaacccgctgatggcgatcgcaagcaagcacgccctcgccgtgatcgaggatagcgcgcaggccgtcggctcgacctatgacgggcgaatgagcggcaccatcggaaccttcggctgcttctccgcgcatccgctgaagaacctcaatgccgcgggcgatgccggcttcctcgtcaccgccgacgccgagcttgccgcacgaattcgccgcctgcgtaatcacggtctgatcaaccgcagcgacgtccaggaatggggcatcgtatcgcggctcgacacgctgcaggccgagctgcttcgcattcgcctgcgcaacctgccctcggtgatcgagcgccggcggcgcaacgccgcgcaataccgcgccgagctcgcaggcctgccgctgttcattccgccctgccgcaacatcgagttcaacacgttccacaccttcgtggtgcagaccgaccgccgcaacgacttccagaaatatcttgccgacaacggcatcgagaccgcgatccattatccggtcccgatccacctgcagccggcggcagcgcatctgggtcatggtcgcggcgcatttccggtgaccgagcagcaggccgaccagatcctcacccttcccatcaaccagttcctctcggccgccgatatcagctatatctgcgcgaccgcccgggagtacttcgcatga

SEQ ID NO: 43062 - protein, 372 aa, Bradyrhizobium japonicum USDA 110
MDADTGRRRIGYVNLPAQFEEERAEIMQAVEGVFQRGDFIGGAAVGKLEEELSAYLGSPHVVTLNSGTDALILAMRALDIGPGDEVITPPNSFVASTAAIIAVGASPVFADVLPDQNIDPAAVEAAVTPRTKAIMPVHLTGRMADMNPLMAIASKHALAVIEDSAQAVGSTYDGRMSGTIGTFGCFSAHPLKNLNAAGDAGFLVTADAELAARIRRLRNHGLINRSDVQEWGIVSRLDTLQAELLRIRLRNLPSVIERRRRNAAQYRAELAGLPLFIPPCRNIEFNTFHTFVVQTDRRNDFQKYLADNGIETAIHYPVPIHLQPAAAHLGHGRGAFPVTEQQADQILTLPINQFLSAADISYICATAREYFA

SEQ ID NO: 43063 - DNA, 1194 bp, Bradyrhizobium japonicum USDA 110
  CDS (1)..(1194)
atgtcggcttcccaaacttcgcaagacaatcagcaaggcgccatgaaccagcatctgcggtccgaacccattcccttcatcgacgtcggctcgcagcgccgccggctcggcgcctcgctcgatgcggccgtcaagcgcgtgctcgaccattgccagttcgtcaacggccctgaggtcgccgagctcgagaagcagctcgcggcctattgcggcgccaagcacgtcatcggctgcgccagcggcaccgacgcgatcctgatggtgatgatggcgaagaatgtcgggcccggcgatgccgtgctgtgtccgtccttcaccttcatcgcgaccgcctcgccggtggcgcggaccggcgcgacgccggtctatgtcgacgtggacgaggcgaccttcaacatgagcccggaatcgctcaagcgcggcatcgcgtccgcccgcaaggccggcctcaagccggcagcggtcattccggtcgacctgttcggccagcccgccgatcacgacgccatcgccgagatcgcaaaggccgaaggcctgttcgtgctcgacgacgccgcccaggggtttggcgcgagctacaagggccgcaagctcggcaccctggcgcttgctaccgccaccagcttcttcccggcaaaaccgctcggctgctttggcgacggcggcgcgatcttcaccgatgacgacgagctcgcggcgacgctgcgcagcatccgcgtgcacgggcagggcatcgacaaatacgacaacgtccgtcttggcctcaccggccggctcgacaccatgcaggctgcggtcctgatcgagaagctgaagatttttgacgacgagatcgctgcccgcaaccgggttgccgaacgctatgagcgcgggctcagcaacgtggtcaccgtgccgcgccttagccccggcaacacctcggtctgggcgcagtacaccatccgcctgcccgaggggaccgaccgtgacggctttgccgcggcgctgaaggcccagggcgtgccgaccgcgatctattacggcaagtcgatgcatcagcagaccgcctacaagcagtatccggtcgccgagggcgggttgccgggttgcgagagcctgtcgcaggacgtcatcagcctgccgatgcacgcctacctgaccgaagccgaccaggagcgaatcatcgccgccgtgcgcggggcgattgcgggttga

SEQ ID NO: 43064 - protein, 397 aa, Bradyrhizobium japonicum USDA 110
MSASQTSQDNQQGAMNQHLRSEPIPFIDVGSQRRRLGASLDAAVKRVLDHCQFVNGPEVAELEKQLAAYCGAKHVIGCASGTDAILMVMMAKNVGPGDAVLCPSFTFIATASPVARTGATPVYVDVDEATFNMSPESLKRGIASARKAGLKPAAVIPVDLFGQPADHDAIAEIAKAEGLFVLDDAAQGFGASYKGRKLGTLALATATSFFPAKPLGCFGDGGAIFTDDDELAATLRSIRVHGQGIDKYDNVRLGLTGRLDTMQAAVLIEKLKIFDDEIAARNRVAERYERGLSNVVTVPRLSPGNTSVWAQYTIRLPEGTDRDGFAAALKAQGVPTAIYYGKSMHQQTAYKQYPVAEGGLPGCESLSQDVISLPMHAYLTEADQERIIAAVRGAIAG

SEQ ID NO: 43065 - DNA, 1221 bp, Bradyrhizobium japonicum USDA 110
  CDS (1)..(1221)
atgtctgaggcaccggtgggcactgctgtaaccggatccgacgcgcgcgcgttcgatcccaaggccgtggtcgacgccgtcaggcgcgcggcgggcacgcccaatggcgtcctcggcctgcacgagcctgtgttcgcgggcaacgaggtcgcctatctggaagagtgcatcaagagcaccttcgtctcctcggtcggcccgttcgtcgaccgtttcgagcgcatgctggaggaagtgacgggcgccaggcgcgccgtcgccgtcgtcaacggcaccgcggcgctgcacgcctgcttcaggctcgccggcgtcgagcccggcgacgaagtcatgtcgcccgctctgaccttcatcgcgaccacgaacgcgatcgcttattgcggggcagtgccacatttcgtcgacagctcgctcgtcacgctcggcatggatgcgcacgccctcgccacgcggctcgaggcgatcgccgagcggaccagcaggggcgcgatcaatcgcgagacaggacgccgcatcgccgcgatctcgccgatgcatacgttcgggcaccccgtcgagctcgacgagatcgccgcgatcgcacgcgagtggggcattgcgttggtggaggacgccgcggaatcgctgggctcgacctacaagggccacgccgtcggatcgcaggcccggctcgcggcgctgagcttcaacggcaacaagatcgtcaccaccggcggcggcggcgccatcctcaccaatgacgaggagctcggacgccgcgccaagcatctcaccaccaccgcgaagctgccgcacaaatgggccttcgtgcatgacgagatcggcttcaactaccgcctgcccaacctgaacgccgcgctcggctgtgcgcagctcgagcagctcgacggattcctggcgagcaagcgccggctggccgctgcctacgagcgcgtctttgcaaacgtgcccggcgtgcgcttctcgcgcgagccggcgggcaccacgagcaattactggctgaacgccatcctgctcgacgaggcgtatgcacagcggcgcgacgacgtgctcacggcgctgaacgaagccggcttcggcgcgcgtcccgcctggaccctgatgcaccgcctgccgatgttcgcgcaaagcccgcgcggcgatcttgccacggccgaatccatcgagcggaggctgatcaacctgccctcgagcgccagcatccgggcccgcgatgaatag

SEQ ID NO: 43066 - protein, 406 aa, Bradyrhizobium japonicum USDA 110
MSEAPVGTAVTGSDARAFDPKAVVDAVRRAAGTPNGVLGLHEPVFAGNEVAYLEECIKSTFVSSVGPFVDRFERMLEEVTGARRAVAVVNGTAALHACFRLAGVEPGDEVMSPALTFIATTNAIAYCGAVPHFVDSSLVTLGMDAHALATRLEAIAERTSRGAINRETGRRIAAISPMHTFGHPVELDEIAAIAREWGIALVEDAAESLGSTYKGHAVGSQARLAALSFNGNKIVTTGGGGAILTNDEELGRRAKHLTTTAKLPHKWAFVHDEIGFNYRLPNLNAALGCAQLEQLDGFLASKRRLAAAYERVFANVPGVRFSREPAGTTSNYWLNAILLDEAYAQRRDDVLTALNEAGFGARPAWTLMHRLPMFAQSPRGDLATAESIERRLINLPSSASIRARDE

SEQ ID NO: 43067 - DNA, 1122 bp, Clostridium tetani E88
  CDS (1)..(1122)
atgaaagttggcttttacacatcacaaagagaatataatgaaaagaaggaagaatttcaacaggctataaatagtgttgtagaaaatggtattagcaccctagggccagaagttaaaaaatttgaaggagaagtggcaaattatacaggagcgaagcatgctataggggtagcttctggaacagatgctttagttataggctctgatatattaggatataaaaaaggaaaagaaattataacttccccatttacattccttgcttcaacttcttgtatagctaagcatgaagggaaacctgtatttgtagacattgacgaagaaactttcaatatggatactactaaaatagaagaaaaaataactaagaatacagcaggaatacttcctatacatttattttgtcaaatggtaaatatggacgatgtgatggatatatcaaaaaggcataacctaacagtatttgaagatgctgcagaagcttttggtatgaaatggaaaggtaaaggagagacttatagacatgctggaactataggagatatgggtatattttctttcttcccaactaaaacattaggtggttatggagacggaggaatggttataactaatgatgataaactagctgaacttatgagaatttatagagttcatggtgctggagtcaaatatcattatgattatataggatataattcaagacttgatactatgcaagcagctattttatcagtaaaattaaaatatatagatgagtccatagcgaaaagagaaactataaatggttggtatagagaaaggttaaagggtgttgagcaaattaaatttacaaagataaaaggggaacaaaaaccagtatactatgtatttaacattctttgcgaaaagagagatgaattaaatcaatacttaagagaaaatgaaataggaactagtatatattatccaattccattacatttacaaaaatgttttagttatttaggacacaaagaaggagacttcccagtagcggaaagggtaagtaaagaaatattagcccttccaatatatccagaaataactgaagatgaagtagattacgtatgtgaaaaaataaaagagttttataagaaatag

SEQ ID NO: 43068 - protein, 373 aa, Clostridium tetani E88
MKVGFYTSQREYNEKKEEFQQAINSVVENGISTLGPEVKKFEGEVANYTGAKHAIGVASGTDALVIGSDILGYKKGKEIITSPFTFLASTSCIAKHEGKPVFVDIDEETFNMDTTKIEEKITKNTAGILPIHLFCQMVNMDDVMDISKRHNLTVFEDAAEAFGMKWKGKGETYRHAGTIGDMGIFSFFPTKTLGGYGDGGMVITNDDKLAELMRIYRVHGAGVKYHYDYIGYNSRLDTMQAAILSVKLKYIDESIAKRETINGWYRERLKGVEQIKFTKIKGEQKPVYYVFNILCEKRDELNQYLRENEIGTSIYYPIPLHLQKCFSYLGHKEGDFPVAERVSKEILALPIYPEITEDEVDYVCEKIKEFYKK

SEQ ID NO: 43069 - DNA, 1176 bp, Clostridium tetani E88
  CDS (1)..(1176)
atgaataaaaagataccattttcaccaccagatataactagagaggaaatagatgaagtagttaaagttctagagtcaggatggattacttcagggccaaaggttacagaatttgaaaatattatggcaaattactgcaatacaaaccattctgtagctatagctagtgctacttcaggaatggaacttatattaaaagtttttgatataaaaaaaggagatgaagtaataacaacaccgtatacctatacttcaacatctaatataattttacacagaggaattaaacctacctttgtagatgttaaaaaggatagttttttaattgatatagataaattagaaaaagcaattaactctaaaactaaggctataataactgtagattttgcaggagtacctgtagattatgataaagttcgtgaagttttgaaaaaattaggaagagaggatataatattaatatctgattcagctcattcctatggagcatcttataaaggaaagaaagtaggaggtcaatttgattttcatgtattctctttccatgctgttaaaaatctaactacggcagagggtggaggaataacatataataataacaatttcaaaggtagagaagatttaacaaaggaatttaaatatacttctcttaatggtcaatctaaagatgctctttcaaaaatgaaagcaggagcttggagatatgatgtattaacagatggacttaaatgtaatatgacagatatgcaagcagccattggagtagtccaaatgaaaagatatgagagtcttttagaaaaaagaaaagctatatttaatgtatattcaaataaattaaaggataaggattgggcaataactccttttgataaaaatgaagaaatggaaacttcttatcacttatatcctttaagaataaaaggttttgaagaagaagatagaggtgctgttattgaggagttagcaaataagaatatagcaaccaatgttcactttatacctttacctatgcttacagtttataaaaacttaggatataaaatagaggactatcctaatgcttataatcaatataaaaatgaaataagtgtaccagtatattccaccttaaccctagaggatgcagaatacgttatagatgagcttattaaatcagtagaaaaaagattataa

SEQ ID NO: 43070 - protein, 391 aa, Clostridium tetani E88
MNKKIPFSPPDITREEIDEVVKVLESGWITSGPKVTEFENIMANYCNTNHSVAIASATSGMELILKVFDIKKGDEVITTPYTYTSTSNIILHRGIKPTFVDVKKDSFLIDIDKLEKAINSKTKAIITVDFAGVPVDYDKVREVLKKLGREDIILISDSAHSYGASYKGKKVGGQFDFHVFSFHAVKNLTTAEGGGITYNNNNFKGREDLTKEFKYTSLNGQSKDALSKMKAGAWRYDVLTDGLKCNMTDMQAAIGVVQMKRYESLLEKRKAIFNVYSNKLKDKDWAITPFDKNEEMETSYHLYPLRIKGFEEEDRGAVIEELANKNIATNVHFIPLPMLTVYKNLGYKIEDYPNAYNQYKNEISVPVYSTLTLEDAEYVIDELIKSVEKRL

SEQ ID NO: 43071 - DNA, 1320 bp, Lactobacillus plantarum WCFS1
  CDS (1)..(1320)
atgaaatctgactttaatgactttttcttgggaatgccagttgaacatgctgaggatacaaatttagctattgacggtggtaatccagtaataactaaactaggacgtcgaaccacatttcctaatattactaaagaagatgtttttcaattaatgacctcaattcagggtgaacctgaagctgtagttaacgaattttgtgaaaagtatcgaaaatatgttggtgcaaactatgcaattgccactgctagcggaacttgtagtttacagttagccttgattggtgctggtgtaaagccaggcgatgaggtgattattcctgctttcacgtttattgcaactgcgcaagccgtggttgctgctaaagcaattccggtatttgcagatattgatcctgataccttcgatttagatccggctgctgtagaagcaaagattacggacaagacagcagcgattatgccagtccatgtacatggactacctgcggcaatggatgaattatctgatatttgtcaaagacaccatctgttactactagaagatgcatctcatgcgcattccgcaacatatcatggaaaaatgtgtggttcaatcggtgatgcagcaggacagagcctaatggcggataaaaattttccagcaggtggggaaggcggaattgctttttttaaaactgaagaatcttatcaacgagcattaaagtttttggatgattctggtcttgattttagaatgtcttggcttgcagcagcgtttggaattagtcaattggatcgcctgccatattatgatcagattagacaacgtaatgcccatcatttaattgcttttttaaataatgaaacgcgattgtttaatggaccttatattccggatggcgaaaagcatagtttcaatatgtttcgaattaagttgaatgtagatttacctgaatttaagggaattgaagattacaagattaaacaagtggtacaaaatgcagtactggaagaaggcgtcttcgcacgggaatggcaaaatgtaccaattccgtggcacctaccttttaaaaataaaattggctttggacattcctatccattcagcttagatgaagggactccagattattcaaataccaagtacccgaatgtattagatatgctaaatacaacgctggttttatgtcgggaattacgctcgccagttgaatatgaaaagttaagtcattatgaagtcgcattcaaaaaactggataatcatattggggaaattgctgagatggctaaagctttgaatgttaaaaaaccatacgaaagggatgctagattaggttga

SEQ ID NO: 43072 - protein, 439 aa, Lactobacillus plantarum WCFS1
MKSDFNDFFLGMPVEHAEDTNLAIDGGNPVITKLGRRTTFPNITKEDVFQLMTSIQGEPEAVVNEFCEKYRKYVGANYAIATASGTCSLQLALIGAGVKPGDEVIIPAFTFIATAQAVVAAKAIPVFADIDPDTFDLDPAAVEAKITDKTAAIMPVHVHGLPAAMDELSDICQRHHLLLLEDASHAHSATYHGKMCGSIGDAAGQSLMADKNFPAGGEGGIAFFKTEESYQRALKFLDDSGLDFRMSWLAAAFGISQLDRLPYYDQIRQRNAHHLIAFLNNETRLFNGPYIPDGEKHSFNMFRIKLNVDLPEFKGIEDYKIKQVVQNAVLEEGVFAREWQNVPIPWHLPFKNKIGFGHSYPFSLDEGTPDYSNTKYPNVLDMLNTTLVLCRELRSPVEYEKLSHYEVAFKKLDNHIGEIAEMAKALNVKKPYERDARLG

SEQ ID NO: 43073 - DNA, 1116 bp, Pseudomonas syringae pv. tomato str. DC3000
  CDS (1)..(1116)
atggaaatcccaatggaaaatattccgcttttctcggccatcaaagctaacgctggacttgatttcgcaacgccgctgaaggccgtgctgaacagccactggtacgttttaggtaacgaagtaaagctgtttgaagaagagtttgctgcctatgtaggcgtacaacattgcatcagcgtggcgaacggttccgacgcactggaacttgcccttaaaggtctgggcattgtggtgggtgatcgtgtggtcgccgtggcaaacgcaggtttctacggcagcactgctattcacgcggtgggcgcgactcctgtgtatgcggatgtcgacccagcaacgttgaccctgtgcaaaaactctctggaagcagtgattgccaaggaaaagccggcagccatcattgttacgcacctgtacggccaactggctaacatcgaagagatcgttaagatcgcttccgccgctggcattccggttcttgaagattgcgcgcaatcccacggtgctcgacgcaacggcaagcaagcaggcagctttggcaccatcgcttgctttagcttctacccgactaaaaacctgggtgctctcggtgacggcggcgcagtggttaccggtgatgacgctctggcagcacgcattcggcagcttcgccagtacggctgggaccagaagtaccgcattgccatcccgggcggtcgtaacagccggctcgacgagatgcaagccgcaatcctgcgcatcaagttgccgcatctggacacctggaacgagcagcgtcgctcgatcgccaaacgctacaatgaagtgtttgccgggctggatatccaactgccttcctcggtgtcggacgactacgttgcacacctgtatgtgattcgcgttaaagatcgggcagctctggctgctgcgctcaaagagaagtcagtcagcactgatatccattacccgattgccgaccacaaacagccagcctatgcagccgcgccgtccgtggctctggacgttaccgagcgtacatgcgataccgtcatctccctgccctgcttccctggcttgagcgacgacgaagttgatcgtgtcatcgaggccgtgaccgcgcatttttccaaggagatatga

SEQ ID NO: 43074 - protein, 371 aa, Pseudomonas syringae pv. tomato str. DC3000
MEIPMENIPLFSAIKANAGLDFATPLKAVLNSHWYVLGNEVKLFEEEFAAYVGVQHCISVANGSDALELALKGLGIVVGDRVVAVANAGFYGSTAIHAVGATPVYADVDPATLTLCKNSLEAVIAKEKPAAIIVTHLYGQLANIEEIVKIASAAGIPVLEDCAQSHGARRNGKQAGSFGTIACFSFYPTKNLGALGDGGAVVTGDDALAARIRQLRQYGWDQKYRIAIPGGRNSRLDEMQAAILRIKLPHLDTWNEQRRSIAKRYNEVFAGLDIQLPSSVSDDYVAHLYVIRVKDRAALAAALKEKSVSTDIHYPIADHKQPAYAAAPSVALDVTERTCDTVISLPCFPGLSDDEVDRVIEAVTAHFSKEI

SEQ ID NO: 43075 - DNA, 1119 bp, Pseudomonas syringae pv. tomato str. DC3000
  CDS (1)..(1119)
atgagcgcaccgatccccgtcactcgtcctctgttaccgcctctggaggagttcattccctaccttgaacacatatgggaaagccgtcagctcaccaacggcggcccgtttcaccaacagctcgaacatgaactggccgagtatctgggcgtgcagcacctctcgctgttctccaacggcaccctggcattgatgaccgcgattcaggcgctgcgcatcaagggcgaagtcatcaccacgccctactccttcgtcgccacagcgcattcgctgctctggaacagcctgacaccggtattcgtcgacatcgaccccggcacctacaacctcgacccggaccgcatcgaagaagccatcaccccggcgaccacggcaatcatgccggtgcactgctacggcatcccgtgcgacgtggatcgcattcagcagattgccgaccgctacggcctgaaggtcatctacgacgccgcccatgcgttcggtgtccagcaccgtggccagagcctgctcaatcatggcgacctgtcggtgctgagcttccatgccaccaaggttttcaatacgttcgagggcggcgccatcatcagtccggacgccaagaccaagcagcgcatcgactacctgaagaatttcgggttcgccgatgaagtcacggtggtggcaccgggcatcaacggcaagatgagcgagatcaacgccgcatttggcctgctgcaactgaaatacatcgatgaagcgctgctcaagcgccagcgcatcgacgaacgctaccgtgacgtactggcggcgattccggggctgaaaatcctctggaagaccaccgaaaagcacaactactcgtattttccggtactggtcaccgaagacttcgccatttcccgcgatgacctctatcagcgctttcgcgaccacaacatccttgcccgccgctacttctacccattgatctcgacgttcccgatgtaccggggcctggactcggcaaaacccgatcgcctgcaggttgcgaccagcctgtccagccagatcctctgcctgcccattttcgacagcctgaccgatgaagctttcgacagcatcatcgatgtgatcgtcgctgccagtaaagagaaccgctaa

SEQ ID NO: 43076 - protein, 372 aa, Pseudomonas syringae pv. tomato str. DC3000
MSAPIPVTRPLLPPLEEFIPYLEHIWESRQLTNGGPFHQQLEHELAEYLGVQHLSLFSNGTLALMTAIQALRIKGEVITTPYSFVATAHSLLWNSLTPVFVDIDPGTYNLDPDRIEEAITPATTAIMPVHCYGIPCDVDRIQQIADRYGLKVIYDAAHAFGVQHRGQSLLNHGDLSVLSFHATKVFNTFEGGAIISPDAKTKQRIDYLKNFGFADEVTVVAPGINGKMSEINAAFGLLQLKYIDEALLKRQRIDERYRDVLAAIPGLKILWKTTEKHNYSYFPVLVTEDFAISRDDLYQRFRDHNILARRYFYPLISTFPMYRGLDSAKPDRLQVATSLSSQILCLPIFDSLTDEAFDSIIDVIVAASKENR

SEQ ID NO: 43077 - DNA, 1164 bp, Vibrio parahaemolyticus RIMD 2210633
  CDS (1)..(1164)
gtggggcaagtaatgaaagcgacatctattgttgattttgttagagatacatacaaaaccaacgagtttattccgttgcacgctccagcgtttgctggcaacgaaaaagcatacgtaatggaaacgattgagagtacctttgtttctagcgtaggtaagtttgttgatgactttgaaagaaaaattgaagtttacaccgggacggctaaagcggtagcaacagttaatggaacagcggcattgcatgccgcattgtacatggctgatgttcagagaggagatcttgtaattacgcaagctttgacttttgtggcaacctgtaatgctctgtaccatatgggggcggagccgatttttttggatgtctctccagttagtttaggtctttgtcctaaagtagtggatgaattcttaaatgagtacgctgaggtaactgagactggttgtattcataaaacaaccggtaaacgaattaaagctgttgtacctatgcacacatttggtcacccagtagaactcgatgagttggttgccatttgtctcaagtggaaaattactttagttgaagatgcagctgaaagccttggttctttctataagggcaaacatacaggtactatcggtgactttggcgcggttagctttaatgggaataagatcattaccactggtggtggtggtatggttctatgtaaaactcaagagttaggtgcaagaactaagcatgttacaacgacagcgaaagttcatcatccttatgagtttttccatgacgagcctggctttaattaccgtatgcctaacctgaatgcggctctaggttgtgctcagatggaagtcatcgaacagtatttgaagcaaaagagagaacttgcagagtgctatagtgagtttttcaaaggaactgactttaaatttgtcactgagccagattacgcacagtcaaactactggttgaatgcaatcatttgtccagacaaggaaagcagagaagaagttcttactagcacaaatagttcaggtgttatgactcgtccaatttggcaactcatgcatagattaccaatgtttgagaatgcaatacgtgacgatcttgcacattctgaatttatcgaggcccacttgattaaccttccaagtaccccagtggacatccaacgctaa

SEQ ID NO: 43078 - protein, 387 aa, Vibrio parahaemolyticus RIMD 2210633
MGQVMKATSIVDFVRDTYKTNEFIPLHAPAFAGNEKAYVMETIESTFVSSVGKFVDDFERKIEVYTGTAKAVATVNGTAALHAALYMADVQRGDLVITQALTFVATCNALYHMGAEPIFLDVSPVSLGLCPKVVDEFLNEYAEVTETGCIHKTTGKRIKAVVPMHTFGHPVELDELVAICLKWKITLVEDAAESLGSFYKGKHTGTIGDFGAVSFNGNKIITTGGGGMVLCKTQELGARTKHVTTTAKVHHPYEFFHDEPGFNYRMPNLNAALGCAQMEVIEQYLKQKRELAECYSEFFKGTDFKFVTEPDYAQSNYWLNAIICPDKESREEVLTSTNSSGVMTRPIWQLMHRLPMFENAIRDDLAHSEFIEAHLINLPSTPVDIQR

SEQ ID NO: 43079 - DNA, 1176 bp, Vibrio parahaemolyticus RIMD 2210633
  CDS (1)..(1176)
atgttaaatacacaattttctccatggccttctttcactaaagaagaggctgatgctgtgagccgtgtgctactgtcaaacaaagtgaattactggactggtaatgagtgtcgcgagttcgaaaaggagtttgcgacatgggtgggttgtgaatacgcgattgcccttggtaacggaactctcgcactagatgttgcgttgaaagctctgggtgttggtgagggggatgaagtgattaccaccccaagaacgttccttgcttctgcttcgtcaattgtgacttccggtgctgcaccagtttttgctgatgttgacctaaacagccaagcgattacggcggaatcgatacacgcagtactgacaccaaaaacaaaagcggtgattgtggtgcaccttgctggtatgccagcggagatggatgccattatggctctgtcagagcaacatggtttttatgtgattgaagattgtgcccaagcccatggtgcgaagtacaaaggccgtagtgtcgggactattggtcacattggtgcgtggtctttctgccaagataagatcatgacgactggtggcgaaggcggtatggtgacaaccaatgataagacattgtggtcaaccatgtggtcgtacaaagatcacggtaaaagctttgatgctatctacaatcgcgagcatccaccaggcttccgttggttacacgattctttcggaactaactggcgcatgacagagctgcaagctgttatcggtcgtatccagcttactcgtatgccagtatggacagcgcagcgacgagcaaattctacacaaatcgatgaagcggttgcagaccttagtgtggttcgccgagttgaagtgccggaatactgtgagcatgcagcctacaaacactatctgtttgtagagtctcagaaccttgctgaagggtggacacgagatcgcatcgtagaagctatagttgagcgaggtgtgcctgcttaccaaggcagttgctcagaagtatatctggaaaaggcatttgacggtacgaggtggcgtccgacggagcgtttgaaaaatgccgttactttgggtgaaaccagtttgatgttcttagttcacccaaccctaacaaaaccagaggtggtcaaaacctgccaagtgttacgggaagtattgttgttagctcaaaagtaa

SEQ ID NO: 43080 - protein, 391 aa, Vibrio parahaemolyticus RIMD 2210633
MLNTQFSPWPSFTKEEADAVSRVLLSNKVNYWTGNECREFEKEFATWVGCEYAIALGNGTLALDVALKALGVGEGDEVITTPRTFLASASSIVTSGAAPVFADVDLNSQAITAESIHAVLTPKTKAVIVVHLAGMPAEMDAIMALSEQHGFYVIEDCAQAHGAKYKGRSVGTIGHIGAWSFCQDKIMTTGGEGGMVTTNDKTLWSTMWSYKDHGKSFDAIYNREHPPGFRWLHDSFGTNWRMTELQAVIGRIQLTRMPVWTAQRRANSTQIDEAVADLSVVRRVEVPEYCEHAAYKHYLFVESQNLAEGWTRDRIVEAIVERGVPAYQGSCSEVYLEKAFDGTRWRPTERLKNAVTLGETSLMFLVHPTLTKPEVVKTCQVLREVLLLAQK

SEQ ID NO: 43081 - DNA, 1158 bp, Salmonella enterica subsp. enterica serovar Typhi Ty2
  CDS (1)..(1158)
atggctgaaggaaaaatgatgtcggactttttgcctttctcccgtccggcgatgggcgcggaagagctcgctgccgttaagaccgtactggactcaggttggataacaaccggcccgaaaaatcaggaactggaagcggcgttttgtcggctaacaggcaatcaatatgccgttgccgtcagttcagccactgccggtatgcacatcgcgttgatggcgctgggtattggtgaaggcgacgaggtcattacaccgtcaatgacgtgggtttctacgctaaatatgatcgttttactcggcgcgacccccgtcatggtcgatgtcgatcgcgatacgctgatggtcacgcctgaacatatcgaagccgcgattacgccacaaaccaaagcaattatccccgtccactacgctggcgcgcccgccgatctggacgctatttacgctcttggcgcgcgttatggcattccggtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcggaggacgcgcgccacaagcggaagtcctggcgccgggctacaaatataatttgcccgacttcaacgccgctatcgcgcttgcccagttacagaaactggatgcgcttaacgctcgccgcgccgccatcgcagcgcagtaccatcaggcaatggcagaccttccttttcagcctctgagccttccgccgtgggagcatattcacgcctggcatttattcattatccgggtcgatgaagcccgctgcggtattacccgggatgctctgatggcatcgctgaaaacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgggtcattaccgcccttcatcagatagcaggacaataa

SEQ ID NO: 43082 - protein, 385 aa, Salmonella enterica subsp. enterica serovar Typhi Ty2
MAEGKMMSDFLPFSRPAMGAEELAAVKTVLDSGWITTGPKNQELEAAFCRLTGNQYAVAVSSATAGMHIALMALGIGEGDEVITPSMTWVSTLNMIVLLGATPVMVDVDRDTLMVTPEHIEAAITPQTKAIIPVHYAGAPADLDAIYALGARYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDFNAAIALAQLQKLDALNARRAAIAAQYHQAMADLPFQPLSLPPWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 43083 - DNA, 1314 bp, Salmonella enterica subsp. enterica serovar Typhi Ty2
  CDS (1)..(1314)
atgacagcaaataacctgcgtgagcaaatctctcagcttgtcgctcagtatgcgaatgaggcattgagcccgaaaccttttgttgcaggtgcaagcgttgtacctccttccgggaaggttattggtgccaaagagttacaattgatggttgaggcgtctcttgatggatggctaactactggtcgtttcaatgatgcctttgagaaaaaacttggggaatttattggagttcctcatgttttaacgactacatctggctcttcggcaaacttgctggcactgactgcgctgacttccccaaaattaggcgagcgtgctctcaaacctggtgatgaggttattactgtcgctgctggcttcccgactacagttaacccggcgatccagaatggtttaataccggtattcgtggatgttgatatcccgacatataatatcgatgcctctctcattgaagctgcagttactgagaaatcaaaagcgataatgatcgctcatacactcggtaatgcatttaacctgagtgaagttcgtcggattgccgataaatataacttatggttgattgaagactgctgtgatgcccttgggacgacttatgaaggccggatggtaggtacctttggtgacatcggaaccgttagtttttatccggctcaccatatcacaatgggtgaaggcggtgctgtattcaccaagtcaggtgaactgaagaaaattattgagtcgttccgtgactggggccgggattgttattgtgcgccaggatgcgataacacctgcggtaaacgttttggtcagcaattggggtcacttcctcaaggctatgatcacaaatatacttattcccacctcggatataatctcaaaatcacggacatgcaggcagcatgtggtctggctcagttagaacgcgtggaagagtttgtagagcagcgtaaagctaatttttcctatttgaaacaaggtttgcaatcttgcactgaattcctcgaattaccagaagcaacagagaaatcagatccatcctggtttggcttccctatcaccctgaaagaaactagcggtgttaaccgtgtcgaactggtgaaattccttgatgaagcaaaaatcggtacacgtttactgtttgctggaaatctgattcgccaaccgtattttgctaatgtgaaatatcgtgtagtgggtgagttgacaaataccgaccgtataatgaatcaaacgttctggattggtatttatccaggcttgactacagagcatttagattatgtagttagcaagtttgaagagttctttggtttgaatttctaa

SEQ ID NO: 43084 - protein, 437 aa, Salmonella enterica subsp. enterica serovar Typhi Ty2
MTANNLREQISQLVAQYANEALSPKPFVAGASVVPPSGKVIGAKELQLMVEASLDGWLTTGRFNDAFEKKLGEFIGVPHVLTTTSGSSANLLALTALTSPKLGERALKPGDEVITVAAGFPTTVNPAIQNGLIPVFVDVDIPTYNIDASLIEAAVTEKSKAIMIAHTLGNAFNLSEVRRIADKYNLWLIEDCCDALGTTYEGRMVGTFGDIGTVSFYPAHHITMGEGGAVFTKSGELKKIIESFRDWGRDCYCAPGCDNTCGKRFGQQLGSLPQGYDHKYTYSHLGYNLKITDMQAACGLAQLERVEEFVEQRKANFSYLKQGLQSCTEFLELPEATEKSDPSWFGFPITLKETSGVNRVELVKFLDEAKIGTRLLFAGNLIRQPYFANVKYRVVGELTNTDRIMNQTFWIGIYPGLTTEHLDYVVSKFEEFFGLNF

SEQ ID NO: 43085 - DNA, 1275 bp, Bacteroides thetaiotaomicron VPI-5482
  CDS (1)..(1275)
atgagtactgattttaaaaaaaggaacgtgtttttcagtcctccagatatgacggaaactgaaacgagattggtagtagaggctatcatgagtggttggattactactggtcctaagacaaaagaatttgagaagaagatttcggcatacgtacatactgataagactgtatgtctgaattctgcaacagctgctatggaacttgcgcttcgtctgattggagtggggcctgaggatgaggtaattgtgcctgcatatacttatacggctagtgcaagtgtgactcagcatgtggggtgccacttagtgatggtagatagcaacgaggaaaaccagcagatggatctacaaaagttggctgaggctatcacagaacgtactaaggtgattgtgcctgttgatctaggtggtgtggtatgtgagtatgacaagattttggagatccttgagcagaagaagggtttgttccgtcctactaatgaattacagaagaagattgggcgtgtgataatcagttcggattgtgctcacgcttttggtagcgagtggaaaggtaagatggctggtgagattggagacttctcttccttcagtttccatgctgttaagaatttgactacggcagaaggtggcgcacttacttggcatctaccatttggaaacgaacctataataatggatatagatactactattcctgtcttcgagggagagacatggaatgaatttctgtaccgcaagtgccagttgttcagtctccatggacagaacaaggatgctttggcaaaaactaagctcggatcatgggagtatgatgtgattggcccttggtataaatgtaatatgaccgacatcatggcttcgcttggtttggctcagatggagcgttacgatacaatgcttcagaaacgtcaaaagtatgtagagcgtttcaatgaggcttttaaggaactgaatgtggctgttctcgaccataaaggggctgagcattgttcaagtcatcacctttacatcatccgtttgttaggcaagactcgtgagcaggtgaacgatgttatcactaagatggcagaacgtggcatcgctaccaacgtgcactacaagccgctacctatgatgactgcctataagactctcggtttcgacattaagaactttcccaatgcctacaagatgttcgagaatacaatgacacttccacttaacactaagatgacagaggaggatgtagagtatgttatcgagaacttcgtagatatcgtaaagtccctctaa

SEQ ID NO: 43086 - protein, 424 aa, Bacteroides thetaiotaomicron VPI-5482
MSTDFKKRNVFFSPPDMTETETRLVVEAIMSGWITTGPKTKEFEKKISAYVHTDKTVCLNSATAAMELALRLIGVGPEDEVIVPAYTYTASASVTQHVGCHLVMVDSNEENQQMDLQKLAEAITERTKVIVPVDLGGVVCEYDKILEILEQKKGLFRPTNELQKKIGRVIISSDCAHAFGSEWKGKMAGEIGDFSSFSFHAVKNLTTAEGGALTWHLPFGNEPIIMDIDTTIPVFEGETWNEFLYRKCQLFSLHGQNKDALAKTKLGSWEYDVIGPWYKCNMTDIMASLGLAQMERYDTMLQKRQKYVERFNEAFKELNVAVLDHKGAEHCSSHHLYIIRLLGKTREQVNDVITKMAERGIATNVHYKPLPMMTAYKTLGFDIKNFPNAYKMFENTMTLPLNTKMTEEDVEYVIENFVDIVKSL

SEQ ID NO: 43087 - DNA, 1149 bp, Coxiella burnetii RSA 493
  CDS (1)..(1149)
atgcgtgtgccctattcttatttagaacgtcagtttgctgatattgaaccttatctcaatgaccttcgtgaattcattaaaaccgctgactttacattaggcgcagaattagaaaaattcgagaaacgatttgctgcattgcacaacgcgccacacgccatcggcgttggcacaggcactgacgcattagcgatgtcttttaagatgttaaatattggtgcgggtgatgaagtcatcacttgtgcgaacactttcattgcatccgtaggtgctattgtccaagcaggtgctactcctgtattggttgacagtgaaaatggttatgtgattgatcctgaaaaaattgaagcagcgattaccgataaaactaaagcgattatgccagttcattacacaggaaatattgccgatatgccagcccttgccaagatcgctaaaaagcacaatcttcatatcgtcgaagatgcctgccaaacgatcttgggacgaattaatgataaatttgtaggaagctggggacaatttgcttgttttagtttacatccccttaaaaacctgaatgtctggtccgatgcgggagtgattatcacgcactccgatgaatatgcagaaaaactaagactttatcgaaatcatggcctaattaaccgtgatgtttgtgtcgaatatggtattaattgccgcatggatacgattcaggcggttattgccaatcgactgatgaatcagcttgaaacaattaccgaaaaacgtcgaggcattgcgcacttatatgatcaatcatttgttgatttatcagaattcatagacgtgcccgtacgtcgcgaaggcgtttatcatgttttccatatttatgtactgcgagtaaaataccgcgatcaattatttcaatacttgaaagacaacggcattgaagtaaaaatacactacccgattgcaatgcatctccaacccgctgccaaaagcttgggttatcaacaaggtgattttcctatggcagaaaaacatggagaagcagtgataaccctccctgcgcatccttatttaacggaggaggaaattaattatatcattaaaaaagttagggagttttatcttgagaaacattacaatagcgcaactttatcgcaagctcaaataaatgcgtaa

SEQ ID NO: 43088 - protein, 382 aa, Coxiella burnetii RSA 493
MRVPYSYLERQFADIEPYLNDLREFIKTADFTLGAELEKFEKRFAALHNAPHAIGVGTGTDALAMSFKMLNIGAGDEVITCANTFIASVGAIVQAGATPVLVDSENGYVIDPEKIEAAITDKTKAIMPVHYTGNIADMPALAKIAKKHNLHIVEDACQTILGRINDKFVGSWGQFACFSLHPLKNLNVWSDAGVIITHSDEYAEKLRLYRNHGLINRDVCVEYGINCRMDTIQAVIANRLMNQLETITEKRRGIAHLYDQSFVDLSEFIDVPVRREGVYHVFHIYVLRVKYRDQLFQYLKDNGIEVKIHYPIAMHLQPAAKSLGYQQGDFPMAEKHGEAVITLPAHPYLTEEEINYIIKKVREFYLEKHYNSATLSQAQINA

SEQ ID NO: 43089 - DNA, 1161 bp, Coxiella burnetii RSA 493
  CDS (1)..(1161)
atgaacgtaccattctcagcccttgataaacaacacactggattactcccagaaatatttacttcacttgaagcaacctttcaaacggctcattttattttaggccaccctgttgtcgaatttgaaaaaaaatttgctgattatcataagaagtcattcgctatcggcgttaactcgggtaccgatgcactcattctttcattacgagctttaaacattggcgaaggtgacgaagtgattaccacagccaatacgtttatcaccacggtaagcagtattgcactggtcggcgctacaccagtgatggttgacatcggaactgacgataacatcgatgttaatcaaattgagaaacagattactgaaaaaacaaaagcaatattggcagtgcattggacaggcagaccttgcaatatggaacgtatttgccgacttgcggaaaaatataacttagacattattgaggattgtgcgcaagcggtttcagcaaaatataaaggccaattagtgggaacgttcggtaagatgggttgttttagtttacacccttacaaaacattaaacgcctgcggagatggcggcatcattattactgatgacccaatgcttaacgatcgcattcacgctctccggcaaaatggactctctagcgacggctcttgccattattggagcaacaattctcgtctggatactatccaagcggctattttaaatataaaactcaagcacttcgaagaatggacaaaacgacggattgaaattgctactcattattcagaacaattaaaagatgtgccgcaaattgtaacgccacctatctccaatgacgaatatcattccgtttttcatacctatattataaaggcagaaaagaggaatgagttaaaagaatatctacaaacccaagggattgaaactcgcattcactatcaagtgccgatctataggcaacctattgcgataaaaactttacaatgtagtccaaaagacttcccaaacatggagcacacctcccaacacgctctatccttacccatttatccggaacttaatctcaagcaacaagattatattatcaacaaaattaaaacgttttattcttcgcccatcgtagagaagaaagaaaatcactcgtcacactcactttcacgagcgtga

SEQ ID NO: 43090 - protein, 386 aa, Coxiella burnetii RSA 493
MNVPFSALDKQHTGLLPEIFTSLEATFQTAHFILGHPVVEFEKKFADYHKKSFAIGVNSGTDALILSLRALNIGEGDEVITTANTFITTVSSIALVGATPVMVDIGTDDNIDVNQIEKQITEKTKAILAVHWTGRPCNMERICRLAEKYNLDIIEDCAQAVSAKYKGQLVGTFGKMGCFSLHPYKTLNACGDGGIIITDDPMLNDRIHALRQNGLSSDGSCHYWSNNSRLDTIQAAILNIKLKHFEEWTKRRIEIATHYSEQLKDVPQIVTPPISNDEYHSVFHTYIIKAEKRNELKEYLQTQGIETRIHYQVPIYRQPIAIKTLQCSPKDFPNMEHTSQHALSLPIYPELNLKQQDYIINKIKTFYSSPIVEKKENHSSHSLSRA

SEQ ID NO: 43091 - DNA, 1110 bp, Coxiella burnetii RSA 493
  CDS (1)..(1110)
atgaaatttatcgacttaaatgagcaatacctgaagataaaacaagcggttgatggaaggatgcaagccgtgctggatcacggccaattcattatgggcccggaagtgaaagaattggaggcccggttggcggagtgggtaggggtccgccactgtatcacagtttctagtgggacgatggctttgttgatcgccttgatggccttaggcgtaggcccgggggatgaggtaatcacctcttcctttagtttttttgcaacggctgaaacgattgtttttttgggtgctacacccgttttcgttgatatcgaccctaaaacgtacaatatagacgtttcacgtatcgaagcagcgattactaatcgaacaaaggcgattgtgccagtgagtttgtatggccagtgtgccgatttagtggcgattaatgccattgctgaacgacatggtttaccggtgattgaagatggggctcagagcttaggtgcgacccatcatggccgccagtcttgtggcttcaccaccatcggctgcacgagcttttttccttccaagccgttaggttgctatggggacgggggggcttgttttacgaatgataacgaactggcgcaaacgatgcgtttgattcgtaaccacggccaagaaaagcgctatcatcatgttcgggtcggcttgaacgcgcggttcaatactttacaagcggctgttttgttggcaaaactggaattatttgctgatgagttagagcagcgacagcgggtggctgagtggtattctgaaattttaggggcagattttgttaccccttatattgctccgaataacatgagcgcttttgcccaatacaccctccgtgttgaacaaagagagcgcgttcaagttgctttgacggaagctggcattccaacagccattcattatccgaagtcgttgcatgaacagcctgcgatccaagcttatttgaaaaccgatgaccattacccgcaagcgcaagcagccagtcagcaagtgttgagtttaccttttcatccctatttgacaaaagagacagtaagaaacgtttgtgacgaattattaagcattgtgagctgtaagagtgtcaacggatag

SEQ ID NO: 43092 - protein, 369 aa, Coxiella burnetii RSA 493
MKFIDLNEQYLKIKQAVDGRMQAVLDHGQFIMGPEVKELEARLAEWVGVRHCITVSSGTMALLIALMALGVGPGDEVITSSFSFFATAETIVFLGATPVFVDIDPKTYNIDVSRIEAAITNRTKAIVPVSLYGQCADLVAINAIAERHGLPVIEDGAQSLGATHHGRQSCGFTTIGCTSFFPSKPLGCYGDGGACFTNDNELAQTMRLIRNHGQEKRYHHVRVGLNARFNTLQAAVLLAKLELFADELEQRQRVAEWYSEILGADFVTPYIAPNNMSAFAQYTLRVEQRERVQVALTEAGIPTAIHYPKSLHEQPAIQAYLKTDDHYPQAQAASQQVLSLPFHPYLTKETVRNVCDELLSIVSCKSVNG

SEQ ID NO: 43093 - DNA, 1155 bp, Coxiella burnetii RSA 493
  CDS (1)..(1155)
atgacgatgataaaacaaaaacgaaaaatccctattgcgataccttccataggcgatgaagaatggcaagcgctgaaagtgccattggactcaggatggttaacccaaggcccaaaagttgccgaatttgaacgcctttttgctgttcgacaccaagcgcaaaaggcgctagcaaccacttcgtgtaccactgcattgcatttggcgctggcagctatgggggtaggacccggtgatgaagtgattgtgcctgcatttacatggattgccacagccaatgcggtcttatattgtggggcaacgccggtatttgcggacgttgatagagacacttttaatattaacgtggaagacatctctcggaaaatcaccgataaaacgaaagcaattattcccgtgcatttatttggtgcttgtgcggatatagacgccatacgcaaagttattcccaatcaggtaatgattttggaggacgcggcgtgcgctgcaggagctgcttataaaggaaaacccgcaggtattttaggcgatatgggtgctttttcttttcatccgcgtaaatcgattactaccggcgaaggagggatgttaacgacgaacaacaccgagcttgcacatcgagctgaaattatgcgtaatcacggcgctgaaattcctgaagaagtgcggcatttgagtgataaaccttatcttctgcctgattttaaattgttaggttttaattatcgtatgacggatttacaggctgctgttggcattgtgcaattagctaaattggatgcttttattaatgaacgtgatcaatgggctaattattattacacccatttaaaagatctcacttggttgcgtgcgcagcgattattagctgattgcaaacatgcttggcaagcttgtgttttttacgtagatccggagcgcgcgccaatgcctcgcaatacattgatggaatacttaaaagaagctggtattgccacgcggccgggcactcatgctgtgcatctgttaagtttctaccaagaaaaatatggaatttattcggatgatttccctggtgcgcgtgattgtgatcacaacacgatggcgattcctcttcataatcgtatgactaaagatgattacgattacgtcattgaaactttaagaagtatttaa

SEQ ID NO: 43094 - protein, 384 aa, Coxiella burnetii RSA 493
MTMIKQKRKIPIAIPSIGDEEWQALKVPLDSGWLTQGPKVAEFERLFAVRHQAQKALATTSCTTALHLALAAMGVGPGDEVIVPAFTWIATANAVLYCGATPVFADVDRDTFNINVEDISRKITDKTKAIIPVHLFGACADIDAIRKVIPNQVMILEDAACAAGAAYKGKPAGILGDMGAFSFHPRKSITTGEGGMLTTNNTELAHRAEIMRNHGAEIPEEVRHLSDKPYLLPDFKLLGFNYRMTDLQAAVGIVQLAKLDAFINERDQWANYYYTHLKDLTWLRAQRLLADCKHAWQACVFYVDPERAPMPRNTLMEYLKEAGIATRPGTHAVHLLSFYQEKYGIYSDDFPGARDCDHNTMAIPLHNRMTKDDYDYVIETLRSI

SEQ ID NO: 43095 - DNA, 1350 bp, Streptomyces avermitilis MA-4680
  CDS (1)..(1350)
atgaccaccttcctgaacgactccttcaccggcgacagcacaagcatccaccggttggtcggggaagtgcggcggcacgaggtcccggtgtaccggtgctcccggagcctcgccaaccgagccctgtccgattccctggccgaggacgtcgggcggctcgatccgtccggccccgactccgtcttcgccgtggatccccgtcgtgcggccggcgatccggtgccctttctgcccaagtcgcggctgtggacgcgggacgaacaacgcatcgccgtcgaacatttcgcccgcgtggtggccgacggcgaactgacgagcggatccgcgataggcgagttcgaggacgccctggcggagttcctcgcagtgccgcatgcggtggcgaccagcagcggcacggatgccctgatcatcgccctgcgagcggtcggcgtcagccacggcgacgaggtcatcatgcccgcgaacagcttcgcggccaccgagaacgccgtatgggcctgtggcgccaccccggtcctcgtcgacatcgaccccgtgcgccacactctggacccggctctcgtcgagaccgccatcactcccagaaccagggccatcctccccgtccatctctacggccgcttcgccgacgtcccgggccttgcggagatcgcccgtcgccacggcctgggtcttgtggaggacgcgtgccaggccatcggcgtcaccggagtcggacaacactcggacgcagctgcgctcagcttcaatccgtacaaaaacttcggactgaccggcaaggccggcgccgtggtgacccgtgacgctgaagtcggcgtatcggcacggaggttcgcctaccacggcttcgacccggagcggaagaatgtcaaggaggatgccttcggtctgaacgccaagatcgacaactcgaccgccgcagtcgccctcgggcttcttccacgcctgaccctgaacagctaccgcagggccttcctggccaagcgctatctcgacgccttggaggagctcgcggcagatggcacggctgtcctgcccgccttcacacccgaccacgcgtggcatctgtttggcgtgcaggtagccgccggacgggaggcgagggacgcaatccaagcacgtatgcggacggctgacgcagtggagacggacatctactaccccgtactcacccaccgtcagcagacaccgttgcaccgcaagcatttcgcacacgtcgccctgcccttgacggagcaggtccacgcgagggttctccacctgccactgcacaacaatctgtccctctccgaacaggaccgagtgatcgaagccctgcatgccgcattccgtgccaccgctcactga

SEQ ID NO: 43096 - protein, 449 aa, Streptomyces avermitilis MA-4680
MTTFLNDSFTGDSTSIHRLVGEVRRHEVPVYRCSRSLANRALSDSLAEDVGRLDPSGPDSVFAVDPRRAAGDPVPFLPKSRLWTRDEQRIAVEHFARVVADGELTSGSAIGEFEDALAEFLAVPHAVATSSGTDALIIALRAVGVSHGDEVIMPANSFAATENAVWACGATPVLVDIDPVRHTLDPALVETAITPRTRAILPVHLYGRFADVPGLAEIARRHGLGLVEDACQAIGVTGVGQHSDAAALSFNPYKNFGLTGKAGAVVTRDAEVGVSARRFAYHGFDPERKNVKEDAFGLNAKIDNSTAAVALGLLPRLTLNSYRRAFLAKRYLDALEELAADGTAVLPAFTPDHAWHLFGVQVAAGREARDAIQARMRTADAVETDIYYPVLTHRQQTPLHRKHFAHVALPLTEQVHARVLHLPLHNNLSLSEQDRVIEALHAAFRATAH

SEQ ID NO: 43097 - DNA, 1218 bp, Bacillus cereus ATCC 14579
  CDS (1)..(1218)
atgattaataatacaataagaaatatcccgttttctccaccagacattacagaagtagaaatagaagaagtaataaaagcgatgaagtcgggttggattacaacaggtcctagaacaaaggaacttgaaaagaaaatagctgaatatgttgggacaaataaagcggtttgcttaaactcagctacggctgctatggagttaacacttcgaattttaggtgtaggacccggagatgaggttattacttcagcttatacttatacagcttctgcatcaattatagagcacgtaggagcaaaaattgttttagttgatacagctcctgattcttttgaaatggattatgaaaagcttgctgatgcaattactgaaaagactaaggtaattattccagttgatattgcgggtaaaatgtgtgattacgatacaatatatagcgtagtagaaagcaaaaaagatttattcaaacctaataataaaactcaagagttatttgaaagaataattgtaatgaccgatgcagcgcatgcatttggtgctgaacgaaagggaaagagatgtggacaagttgctgattttacttgctattctttccatgctgtgaagaatttaacaacggcagaaggtgggggcgttgtatggcgcaatgatttaggtttagacgatgagtgggtatatcaacaatttatgttatacagccttcatggacaatctaaggatgccctagcaaagactcaaaaaggcgcatgggagtatgatattgtttacccagcttataaatgtaatatgacagatataatggcagcaattggattagtccagttggatagatatgaatctcttatgggtagacgtagagagattattgaaatgtatgacaaagaattgttgccatatggaattcaaagtctgaaacattatggggaggatttctcttcatcgggacatctttatttagcaagaatacctgggattgaagagtctgaaagaaataaaattattattgagttagccgagatgggaattgcaagcaatgtacattataaaccattgcctatgtttacagcgtataaaaacttaggatttgatataaagaattatcctaatgcatttaatatgtataaaaatgaaatcacgttacctttgcatacaagattaacaaatgaagagataaaatatattactgatacttttaaagagattttaaacaatagataa

SEQ ID NO: 43098 - protein, 405 aa, Bacillus cereus ATCC 14579
MINNTIRNIPFSPPDITEVEIEEVIKAMKSGWITTGPRTKELEKKIAEYVGTNKAVCLNSATAAMELTLRILGVGPGDEVITSAYTYTASASIIEHVGAKIVLVDTAPDSFEMDYEKLADAITEKTKVIIPVDIAGKMCDYDTIYSVVESKKDLFKPNNKTQELFERIIVMTDAAHAFGAERKGKRCGQVADFTCYSFHAVKNLTTAEGGGVVWRNDLGLDDEWVYQQFMLYSLHGQSKDALAKTQKGAWEYDIVYPAYKCNMTDIMAAIGLVQLDRYESLMGRRREIIEMYDKELLPYGIQSLKHYGEDFSSSGHLYLARIPGIEESERNKIIIELAEMGIASNVHYKPLPMFTAYKNLGFDIKNYPNAFNMYKNEITLPLHTRLTNEEIKYITDTFKEILNNR

SEQ ID NO: 43099 - DNA, 1146 bp, Nitrosomonas europaea ATCC 19718
  CDS (1)..(1146)
gtgaaaaatacaaatcaccgcatcccgttcaactggcctcacatgacaggcaaggagttgtactacatcgctgaagcgcacttcaatggtagcttggcaggcgatgggcctttcaccaagcgctgtcatgcatggctggaggagcggactggatgtaataagggtctgcttactcactcttgcacggcggcactcgagatggctgctttattgctggatattcagcccggtgacgaggtcatcatgccgtcgtacacctttgtatctaccgccaatgcctttgtgctacgtggtggggttcctgtgtttgtcgatatcagagaagacactctgaatttggacgaacggctgattgagtccgccattacgccgcgtacccgtgccattgctcccgtgcattacgcgggagtggcgtgcgagatggatacgattatggccatcgcccagaagcatgaattgaaggtcgttgaggatgcagcgcagggggtgatgtcaacctacaaagggcgggccctcggcagcattggtgatcttggagcctacagtttccacgaaacaaaaaatgtgatctcgggagaaggcggtgcgctactcgttaatacacctgatctgagccttcgtgcagagatcatccgcgaaaaagggaccgatcgcagtcagttcttcaggggcgaagtggacaagtacacctggcaggaggtgggctcgtcattcttaccgggtgagctgatcgctgccttcctgtgggcgcagcttgaagaagcagaccgtataactaacgagcggctggcaagctggcaacgatatcatgagttgcttgggccacttgaagctaaagagattctgcgtcgtccaatcgttccggaagagtgtcagcataatgcccacatgtattatgtattattggcatcaaaaattgataggcaagaagtacttgacgaatttaagagaaacgatatttggtctgtgttccattatgtgccccttcattcctccccggctggtttacggtacggacgtatacatggcaacctgaaaattactactcaacaatctgagagattggttcggttacccctctgggttggtttatcagtagagcagcaagaccgggtcgttgaggttttgtgtaaagctgttagctga

SEQ ID NO: 43100 - protein, 381 aa, Nitrosomonas europaea ATCC 19718
MKNTNHRIPFNWPHMTGKELYYIAEAHFNGSLAGDGPFTKRCHAWLEERTGCNKGLLTHSCTAALEMAALLLDIQPGDEVIMPSYTFVSTANAFVLRGGVPVFVDIREDTLNLDERLIESAITPRTRAIAPVHYAGVACEMDTIMAIAQKHELKVVEDAAQGVMSTYKGRALGSIGDLGAYSFHETKNVISGEGGALLVNTPDLSLRAEIIREKGTDRSQFFRGEVDKYTWQEVGSSFLPGELIAAFLWAQLEEADRITNERLASWQRYHELLGPLEAKEILRRPIVPEECQHNAHMYYVLLASKIDRQEVLDEFKRNDIWSVFHYVPLHSSPAGLRYGRIHGNLKITTQQSERLVRLPLWVGLSVEQQDRVVEVLCKAVS

SEQ ID NO: 43101 - DNA, 1149 bp, Mycobacterium bovis AF2122/97
  CDS (1)..(1149)
gtgtcagatcacaaagttccattcaatcggccgtacatgaccggccgggagctcgcgtacatcgccgaagcgcattcttgcggccacctggccggcgatggtcccttcacccggcgtagccatgcatggctcgaacagcagaccggttgtcgcaaggcactactcaccccctcatgcaccgccgcgctggaaatgatggcgctgcttctggacatagaggagggggacgaagtcatactgccgtcatacacctttgtctctaccgccaacgccttcgtgttgcgcggtggtgtgccagtctttgtcgatattcggcccgacacgctcaacattgatgaaactcgcatcgtagacgccatcaccccgcgaaccaaggccatcgtccccgttcactatgccggcgtggcctgcgagatggacgcgatcatgaagatcgccacgcaccacaacctggcggtggtcgaagacgcggcccaaggcgcgatggcgtcgtatcgtgggcgggcgctcggcagcatcggcgacctgggagcgctctcatttcacgagaccaagaatgtgatttccggcgaaggcggcgccctgcttgtcaactcagaagacttcctgctccgggcagagattctcagggaaaagggcaccaatcgcagccgcttccttcgcaacgaggtcgacaaatatacgtggcaggacaaagggtcttcctatttgcccagcgaattagtcgctgcctttctatgggctcagttcgaggaagccgagcggatcacgcgtatccgattggacctatggaaccggtatcatgaaagcttcgaatcattggaacagcgggggctcctgcgccgtccgatcatcccacagggctgctctcacaacgcccacatgtactacgtgttactagcgcccagcgccgatcgggaggaggtgctggcgcgtctgacgagcaaaggtataggcgcggtctttcattacgtgccgcttcacgattcgccggccgggcgtcgctacggccgcaccaatggcaacctgaccgtcaccaacgacgtggcttcccgcctaatccgtctgccgatgtgggttggacttcaggaggtagatcagagccgcgttgtcgaggcgctcacgcgcatcctgacgttgcgcgcatga

SEQ ID NO: 43102 - protein, 382 aa, Mycobacterium bovis AF2122/97
MSDHKVPFNRPYMTGRELAYIAEAHSCGHLAGDGPFTRRSHAWLEQQTGCRKALLTPSCTAALEMMALLLDIEEGDEVILPSYTFVSTANAFVLRGGVPVFVDIRPDTLNIDETRIVDAITPRTKAIVPVHYAGVACEMDAIMKIATHHNLAVVEDAAQGAMASYRGRALGSIGDLGALSFHETKNVISGEGGALLVNSEDFLLRAEILREKGTNRSRFLRNEVDKYTWQDKGSSYLPSELVAAFLWAQFEEAERITRIRLDLWNRYHESFESLEQRGLLRRPIIPQGCSHNAHMYYVLLAPSADREEVLARLTSKGIGAVFHYVPLHDSPAGRRYGRTNGNLTVTNDVASRLIRLPMWVGLQEVDQSRVVEALTRILTLRA

SEQ ID NO: 43103 - DNA, 1098 bp, Helicobacter hepaticus ATCC 51449
  CDS (1)..(1098)
ttgcaaatggttccctttcttgatgtcaaagcgataaatcaaagattgagtgcagagatggaatctgctttttgcgaagtgctagagagtggttggtatgttttgggcgagcaaggcaaagcctttgagcgtgagtttagcgcgtattgtgggacaaattattgtgtaggttgtgcaaatggtttagacgctttgcgacttagcattaaagcatttggatttggcgtgggtgatgagattatcgtccctgcaaatacctatatcgcttccattttggcaatcactgataatggctgcacacctgtgcttgtagagccaagcttaaagacttataatattgatgtggatttgattgaggagcgtatcacaccaaaaactaaagcaattcttgtcgtgcatttgtatggacaggcggtggaaatgcagaaagtttgggatttagcacaaaaatatgatttaaaaatcatagaagattccgcacaagcgcacggcgcaatctatcaaggcaagagagtagggagtttgggcgatgtaagtggattctcattttttccgggtaagaatttaggtgcattaggcgatggtggctgtgtggttacaaatgatgaagctttggcacagagaatccgcgcattagggaattatggctcacatatcaaatatgaaaacctctatgcagggctaaattctaggcttgatgaagtccaagcggcatttttgcgcctcaaacttaaaatccttgatgaggataataagcggcgacaagagattgcgagagtttatagagagcagattcaaaacgagcgtattatcctcccgcaggttcaaagcgaggagggggcggtgtggcatctctttgtcgtgcgcacgaaaaatcgcgcgcgtttgcaagagcatttgagtcagagtggaatccaaacgcttatccattatcctatcccaccgcacaagcagcaggcttacaagcaatataatcatttgaatctgcccattaccgagcgtattcacaaagaagtgctatccttgcctataagtcctgtgatgagcgatgagcaagtaggcatagtgatagatgctgtgaatgcgtttaaagaatag

SEQ ID NO: 43104 - protein, 365 aa, Helicobacter hepaticus ATCC 51449
MQMVPFLDVKAINQRLSAEMESAFCEVLESGWYVLGEQGKAFEREFSAYCGTNYCVGCANGLDALRLSIKAFGFGVGDEIIVPANTYIASILAITDNGCTPVLVEPSLKTYNIDVDLIEERITPKTKAILVVHLYGQAVEMQKVWDLAQKYDLKIIEDSAQAHGAIYQGKRVGSLGDVSGFSFFPGKNLGALGDGGCVVTNDEALAQRIRALGNYGSHIKYENLYAGLNSRLDEVQAAFLRLKLKILDEDNKRRQEIARVYREQIQNERIILPQVQSEEGAVWHLFVVRTKNRARLQEHLSQSGIQTLIHYPIPPHKQQAYKQYNHLNLPITERIHKEVLSLPISPVMSDEQVGIVIDAVNAFKE

SEQ ID NO: 43105 - DNA, 1095 bp, Helicobacter hepaticus ATCC 51449
  CDS (1)..(1095)
atggaatttatcaatctcaaagcgcagtatgaacatcataaaagcgaaattgatagtgcaatacaagatgtgttgcactcttcacaatttattatgggaaaggctgttgaggaattagaatcacatcttgcttcatatataggtgctaaaaatgctattgcgtgcagtagcgggacagatgctttgattttagctttaatggcacttgatataaaaaatggtgatgaggtaattacatctccatttagttttattgcaagtgtagaggcaattatgctacttggagcgaagccgatatttgtagatattgatgagaaaacttataatcttgatagcacaaagctcgaaagtgccatcacaaagcatacaaaagcaattattcctgtggctatttttggacaaatggctgatatgggagctataaatgctattgcatcaaagcacaatattcctgtcattgaagatgcagctcaaagctttggggctagtcaaaggtgtgataataagattcttaaatcttgcaatgcaagtattctcgctactactagcttttttccaagtaagccgctaggttgttatggtgatggaggagcagtttttacaagcgataatgaattagcgcaaaaaatacgttatttacttaaccatgggcaaactaaacgttatgaacatagctttattggattgaatgcacgacttgatgcacttcaagcagcagttcttaatgtgaagattaaatatttagattttgaaattgccaagcgccaagaaattgcacagatttatgatgaaaatctccaaaatgttattactccttttattcaagagggcaatgtgagtgcttatgcgcaatattcaattcgcattcaaaaccgagctcaaatgatagaaaagctcactcaagctcatatcccttatgcagtgcattatcccattccattgcacttacaagaggttgtaagcaaggtttatgcacataaaaagggcgattttcctataagtgaggcggtatgcaatgagatactttctttgccttttagcccattttttacaagtcaagagcaagatgaagtgataaaggctgtaaatggataa

SEQ ID NO: 43106 - protein, 364 aa, Helicobacter hepaticus ATCC 51449
MEFINLKAQYEHHKSEIDSAIQDVLHSSQFIMGKAVEELESHLASYIGAKNAIACSSGTDALILALMALDIKNGDEVITSPFSFIASVEAIMLLGAKPIFVDIDEKTYNLDSTKLESAITKHTKAIIPVAIFGQMADMGAINAIASKHNIPVIEDAAQSFGASQRCDNKILKSCNASILATTSFFPSKPLGCYGDGGAVFTSDNELAQKIRYLLNHGQTKRYEHSFIGLNARLDALQAAVLNVKIKYLDFEIAKRQEIAQIYDENLQNVITPFIQEGNVSAYAQYSIRIQNRAQMIEKLTQAHIPYAVHYPIPLHLQEVVSKVYAHKKGDFPISEAVCNEILSLPFSPFFTSQEQDEVIKAVNG

SEQ ID NO: 43107 - DNA, 1254 bp, Rhodopirellula baltica SH 1
  CDS (1)..(1254)
ttgaagcagaagtgtttgaacgcgtcagtgcgtcaacacggtcgaaaatggactttcgactatcccgcatatatttcacggatgagtctcgccatgactgatagcacccccggcgtccctctgttggatgtcaatcgcgacaacgccccgcaccgcgacgaattcctcgaagcactcaccgaagtgctcgacagtggacgtttcctgtttggtccggacgtgaccgaattggaaaacgaagtcgccgcctacacccaaacgcccaacgcggtcggttgtgcgtccggaagtgacgcgttgctgttggctttgatggcattggacatcaaagcgggcgacgaagtcatcgtgccgagcttcaccttctttgcgtcggtcagctgcatcacccgcttgggtgcgactcccgtctttgcggacatttgccccgacacatacaacgtcgatcctgaatcgatcgcgtcactgatcaccgaaaagacagccgcgattattccggttcacttgttcggccaatgtgcccaaatcgatcggatttgcgaaattgcatccgagcatgacattcccgtcatcgaagatgctgcccaagccatcggtgcggcgtacaaagatcgcccggctggcaattggggaacggcaggttgcttcagcttttatccgaccaagaacctgggcggaatgggcgacggcggaatcttgaccgccaccgacgctggttttgctgatcgtctgcgattgttcgccggtcacgggatgcgaccgcgctactaccaccaagtcgttggcatcaatagccgactggacacgttccaagccgccgtgctccgcgtcaaattgcgtcaccttgatgccgccgtggaagctcgcacgatcaacgcgaatcgctacacccgattgttgaccgaagccggtttggttggcgatgaccaactcggcacgccataccacgacagcaacgctcgacacgtttggaaccaatacacgctgcgagttcccggcggtcgacgcgacgcactgcgagcccatttgtccgaacgcaagatcggatcggaaatctactatccggttccaatgcaccaacaagaatgcttccaagatgttccattccgtcacgacggtttgaagcacaccgaagcggccagtgccgaagtgttgaacttgccgatcttcccatcgttgaccgaagcggaacaaattcgcgtcgtcgactcggtggcatcgttctttcaacaagccaaccgcgcggcggcttga

SEQ ID NO: 43108 - protein, 417 aa, Rhodopirellula baltica SH 1
MKQKCLNASVRQHGRKWTFDYPAYISRMSLAMTDSTPGVPLLDVNRDNAPHRDEFLEALTEVLDSGRFLFGPDVTELENEVAAYTQTPNAVGCASGSDALLLALMALDIKAGDEVIVPSFTFFASVSCITRLGATPVFADICPDTYNVDPESIASLITEKTAAIIPVHLFGQCAQIDRICEIASEHDIPVIEDAAQAIGAAYKDRPAGNWGTAGCFSFYPTKNLGGMGDGGILTATDAGFADRLRLFAGHGMRPRYYHQVVGINSRLDTFQAAVLRVKLRHLDAAVEARTINANRYTRLLTEAGLVGDDQLGTPYHDSNARHVWNQYTLRVPGGRRDALRAHLSERKIGSEIYYPVPMHQQECFQDVPFRHDGLKHTEAASAEVLNLPIFPSLTEAEQIRVVDSVASFFQQANRAAA

SEQ ID NO: 43109 - DNA, 1149 bp, Wigglesworthia glossinidia endosymbiont of Glossina brevipalpis
  CDS (1)..(1149)
atgaaaaaaaaaaataaaattattccttttaatttacctgtttattcaggaaaagaattaaaatatatagattttgcaataagaaataaaaccttttcaggagaagggtatttttcaaatttatgcacgttatggatagaaaataaattaaatattaaaaaagtttttttgacaccttcttgtacttcctctttagaaatggctgctttattattaaaaataaataaagacgacgaaattatcatgccaagttatacttttgtgtcaactgctaatccttttgtattacgtggagcaaaaatagtattcgttgacattagatcggataatttaaatattaatgaaaatttaattgaatctgcaatcacaaaaaagacaaaagcaatagtagttatgcactatgctggaatttcttgtgaaatggattttataaaaaatatttctaataagtataaattatggctaatagaagatagtgctcaaagtatgatgtctaaatataaaaatttatatttaggaagcttaggtcatataggatgttttagttttcatgaaacaaaaaattatacctctggaggagagggaggagcaattcttataaatgatgagtctttaatcaaaagagcaagcataattaaagaaaaaggaacaaatcgttccctttttattaaaggaaaaacaaataaatatgtttggaaagacataggatctagttatactatatcagatattcaagcagcatatttatggtctcagttaaaaatatcagaaaagattcaaaaaaaaagagaaatgttgtggaaaaattattttttgtctttagaaaatataaaattgttcaggataccgtttttcaacaaaaattgcaagcataatgcaaatacattttatttaatttttaatgataaaaaaacttgtaatttgtttattgaatacatgaaaaataataaaattacaactttaagacactatgttcctttgcacattagtccagcaggaaaaaaatttggaaaatttcatggaaatgatataaatactattaaaacaagtaataatcttgttcgtcttccattattttttaatttaaaaaataaagaccaaaaatatattataagtaatatttataatttcatagataaatattcttaa

SEQ ID NO: 43110 - protein, 382 aa, Wigglesworthia glossinidia endosymbiont of Glossina brevipalpis
MKKKNKIIPFNLPVYSGKELKYIDFAIRNKTFSGEGYFSNLCTLWIENKLNIKKVFLTPSCTSSLEMAALLLKINKDDEIIMPSYTFVSTANPFVLRGAKIVFVDIRSDNLNINENLIESAITKKTKAIVVMHYAGISCEMDFIKNISNKYKLWLIEDSAQSMMSKYKNLYLGSLGHIGCFSFHETKNYTSGGEGGAILINDESLIKRASIIKEKGTNRSLFIKGKTNKYVWKDIGSSYTISDIQAAYLWSQLKISEKIQKKREMLWKNYFLSLENIKLFRIPFFNKNCKHNANTFYLIFNDKKTCNLFIEYMKNNKITTLRHYVPLHISPAGKKFGKFHGNDINTIKTSNNLVRLPLFFNLKNKDQKYIISNIYNFIDKYS

SEQ ID NO: 43111 - DNA, 1131 bp, Haemophilus ducreyi 35000HP
  CDS (1)..(1131)
atgattccttttaataaaccaccattggtgggcaatgaattagcctatattcaacaggcgttacagcaagataaattatcaggtgatggttattataaccagcaagcggaacaatggttagaaaagcaattttcgacagtgaaagcgttattaacaccatcttgtactgccgcattagaaatggcggcgattctgttagatattcaagctggcgatgaagtgattatgcctagctatacttttgtgtcgactgcaaatgcatttgtgttgcgtggcgctaaaattgtgtttgttgatattcgcccggatactatgaatattgatgaacagaaaattgaagcgacaattacggatagaactaaagtgattgttccagtgcattacgcgggcgtagcttgtgagatggatacaattatggcattagcggctaaatatcagctatatgtggttgaagatgctgcacaggcaatgatagcaagctataaaaatcgcccattaggcacgattggacatttggggtgttatagttttcacgaaactaaaaattatagttcggcaggtgaaggtggagcgctgttaattaatgatgcgacattagttagtcgcgcagaaattattcgcgagaaaggcactgatcgaagtcagttttttcgaggacaagttgataaatatacgtggcgagatattggatcaagttatctcatgtcggagttacaagcggcttatttatatgcacaatttacggtggcagaacagattaatcaaacacgtttagcaatgtggcaacgttattatcaagcgttattgccttttgctaatagcgggcggatagcattagcccaattaccgcccgaatgccaacataatgcgcatttattttatttaaaattaacagattcagccgatcggaacgcgttattaacttggcttaaacaacacgatattttagcggtgtttcattatattccattgcattccagcccagcaggtaaacaatttgggcgctttgtcggtgaagatcaatttacaacacaagaaagtgagcgcttgctaaggttacccttgttttataatttgcatctaacagagcaacaacgtgtgattgaggttgtgacggattattttcagtaa

SEQ ID NO: 43112 - protein, 376 aa, Haemophilus ducreyi 35000HP
MIPFNKPPLVGNELAYIQQALQQDKLSGDGYYNQQAEQWLEKQFSTVKALLTPSCTAALEMAAILLDIQAGDEVIMPSYTFVSTANAFVLRGAKIVFVDIRPDTMNIDEQKIEATITDRTKVIVPVHYAGVACEMDTIMALAAKYQLYVVEDAAQAMIASYKNRPLGTIGHLGCYSFHETKNYSSAGEGGALLINDATLVSRAEIIREKGTDRSQFFRGQVDKYTWRDIGSSYLMSELQAAYLYAQFTVAEQINQTRLAMWQRYYQALLPFANSGRIALAQLPPECQHNAHLFYLKLTDSADRNALLTWLKQHDILAVFHYIPLHSSPAGKQFGRFVGEDQFTTQESERLLRLPLFYNLHLTEQQRVIEVVTDYFQ

SEQ ID NO: 43113 - DNA, 1188 bp, Prochlorococcus marinus subsp. marinus str. CCMP1375
  CDS (1)..(1188)
atgcaagtccccccttttactcttgaaaaacaactgtctgaaatagggcaggatctggatgaagctgtttcgagggttgttaagagtggaatttatataggaggttcagaagtacttaaatttgaacaatctttcgcagatgctgttggggttagctttgccattggttgcaatagtggaacagatgcattggtgcttgctttacgagcattgaatattggaccaatggatgaagtaattactccctcttttagtttttttgctacagctgaggcaataagtaatgttggtgctacacctgtgtttgtggatgttgatccaactaattatttattagatattgaattaattgaagcagctataacccctttgacaaaagccattttgcctgtgcatctttttggctgtcctgtaaatatgacgaaaatagtctctttggctaagaaaaatgggataaaagtgattgaagattgcgcacaagctgttgggactcaatgggatgggaagccagtgggaagtattggcgatataggctgttttagctttttccctacaaagaacttaggggcagctggagacgctggtgctgtaactactaatgatcctgagttggcagaacgtattagagaacttgctatacatggaatgccgcgtagatattttcatactgaactgggatataacagtcgattggatgcagttcaagcagccattctaaatgtgaagttgccgatacttgataaatggataacccaaaggaaagaaattgctaaacgttatataaacttattaaaggggttgtctgacttagctttgccaagcttttgcgaaaaaaataatgacattcattcatggaatcaatttgtaattagagttaaagactgctctaaagaagaaaaagttaagggaataaaaaaaatagaaaatatctgcaaagacttacctgaaagtgatgctagagataccctgaaggatcgacttctacatgatggcgttaatacaataatctattatccaatccctatacatttgcaacctgcatataaaaaacttggttacaaagtaaataatttgccaaatacagaaagcctttgtagccaagttcttagtcttcctattttccctgagttgacattagaagagcaagaatatgtcgtaaattcaattaagaagtctttgaaagattga

SEQ ID NO: 43114 - protein, 395 aa, Prochlorococcus marinus subsp. marinus str. CCMP1375
MQVPPFTLEKQLSEIGQDLDEAVSRVVKSGIYIGGSEVLKFEQSFADAVGVSFAIGCNSGTDALVLALRALNIGPMDEVITPSFSFFATAEAISNVGATPVFVDVDPTNYLLDIELIEAAITPLTKAILPVHLFGCPVNMTKIVSLAKKNGIKVIEDCAQAVGTQWDGKPVGSIGDIGCFSFFPTKNLGAAGDAGAVTTNDPELAERIRELAIHGMPRRYFHTELGYNSRLDAVQAAILNVKLPILDKWITQRKEIAKRYINLLKGLSDLALPSFCEKNNDIHSWNQFVIRVKDCSKEEKVKGIKKIENICKDLPESDARDTLKDRLLHDGVNTIIYYPIPIHLQPAYKKLGYKVNNLPNTESLCSQVLSLPIFPELTLEEQEYVVNSIKKSLKD

SEQ ID NO: 43115 - DNA, 1161 bp, Bordetella parapertussis 12822
  CDS (1)..(1161)
gtgagcggcgccgcggcgaaacgcagcattgcaatctctttgcccatgacgggcgaagaggagtggcaggcggtacgcgaacccctgatgagcgggtggctgacgcagggccccaaggtggcggctttcgagaaggcattcgcgcaacggcacgaggtcgcccatgcgctggccgtgacctcttgcacgacgggcctgcatctggcgttggccggattgggcatcgggccaggcgacgaggtcatcgtgccctcgttcacctgggtcgccacggccaacgcgatactgtattgcggcggcacgccggtgttggtagacgtcgaccgggaaaccttcaacatcgacatcgcccaggtggcgggcaaggtcactccacgcacgcgtgcggtgattgcggtgcacctgttcggcctgtgcgccgacatcgacgccttgcgggcggcgttgccggcgtcggtggccatcgtcgaagatgccgcctgtgccgctggcgccagctggaatggccggccggccggcagcctgggagaggtgggggtcttctcgttccacccgcgcaaatcggtcacgaccggcgaggggggcatggtcaccacgaatgaccccgagctggccgagcgtatgaaccagatgcgcaatcatggcgccagcatttccgaagagcagcggcaccacggcccgcgcccgtggatcctggcggatttcgatctgctgggctacaactaccggatgaccgatctccagggggctgtgggccaggtccaactcgccaagctggacggtttcatcgacgagcgcgcccgctgggcgcagttctatcgagaacaactgggtgatctgaagtggctgcgcctgccggcggagccggccggcgcgcgacatggttggcagtcgttcgtgacgtgggtggatccggcgcatgcgcccatgccgcgcaacgacatgatgcaacgactgcaggagcagggcatcgcgacgcggccgggcacccacgcggtgcacatgctgggctactaccgggaacaatacggctatcgccccgaggattttcccgccgcgcgggattgcaacgattgcacaatggcaatccccctgcacaaccgcatgacggaggatgactatcgttatgtggtggcggcgattcgggcattcggcggctga

SEQ ID NO: 43116 - protein, 386 aa, Bordetella parapertussis 12822
MSGAAAKRSIAISLPMTGEEEWQAVREPLMSGWLTQGPKVAAFEKAFAQRHEVAHALAVTSCTTGLHLALAGLGIGPGDEVIVPSFTWVATANAILYCGGTPVLVDVDRETFNIDIAQVAGKVTPRTRAVIAVHLFGLCADIDALRAALPASVAIVEDAACAAGASWNGRPAGSLGEVGVFSFHPRKSVTTGEGGMVTTNDPELAERMNQMRNHGASISEEQRHHGPRPWILADFDLLGYNYRMTDLQGAVGQVQLAKLDGFIDERARWAQFYREQLGDLKWLRLPAEPAGARHGWQSFVTWVDPAHAPMPRNDMMQRLQEQGIATRPGTHAVHMLGYYREQYGYRPEDFPAARDCNDCTMAIPLHNRMTEDDYRYVVAAIRAFGG

SEQ ID NO: 43117 - DNA, 1233 bp, Bordetella parapertussis 12822
  CDS (1)..(1233)
gtgccgccggcggcgcgcctctcacttctacagcgatccagcaccatgagcgacttcctgccctttgccctgcccgatatcggcgaggccgaaatccaagcggtcaccgaatccatgcgttcgggctggctgaccaccggccccaacgcccgcgagttcgaacgcgaattcgcggcctacatgggcgccgacgtggaggccgtggccgtcaattcggccaccgccggcctgcacctggccctggaagccataggggtcggcccgggcgacgaagtcatcaccaccacccacacattcaccgccagcgccgaagtcgcccgctacctgggcgccgaaccggtcctggtcgatatcgacccggccacgctgtgcatctcgcccgccgccatcgaacgcgccatcacgccgcgcacccgcgcaatcgtgccggtgcactacggcggcctgtcctgcgacatggacagcatcctggagatcgcccgcaagcacggcctgaaagtcatcgaggacgccgcccacgcgctgcccgcctcctggcaaggccggcgtatcggcagcctggaaagcgacctgaccgtctacagcttttacgccaccaagacgctggccaccggcgaagggggcatggtggtcacgcgcgaccccgccctcgccaagcgctgccgtgtcatgcggctgcatggcatcgaccgcgacgccttcgatcgcttcacctcgaagaagccggcgtggtactacgaaatcgtcgcccccggcttcaagtacaacatgaccgacacggccgccgcgatgggccgcgtccagttgcaacgcgtgcagcaaatgcgcgaccggcgcgcacagatcgccgcggcctatgaccaggccttcgccgatctgccgctgacactgccccccagccctggccgcacgccgggcgtcgaacgcgcggcccaccgcgacgacgacgagcattcctggcacctgtacgccatccgcatccatccgcaggcgccgctcaagcgcgacgacttcatcgtgcgcatgaccgagaacggcatcggctgcagcgtgcactacgtgccgttgcacctgcagccctattggcgcgaccgatatggcctgacgcctgacatgtacccccattcccaggccgcattcgaaggcatggccagcctgccgatctactcgcgcatgaccgatgccgatgtacagcgcgtcatcgcatcggtacggcaactgctgcacccatga

SEQ ID NO: 43118 - protein, 410 aa, Bordetella parapertussis 12822
MPPAARLSLLQRSSTMSDFLPFALPDIGEAEIQAVTESMRSGWLTTGPNAREFEREFAAYMGADVEAVAVNSATAGLHLALEAIGVGPGDEVITTTHTFTASAEVARYLGAEPVLVDIDPATLCISPAAIERAITPRTRAIVPVHYGGLSCDMDSILEIARKHGLKVIEDAAHALPASWQGRRIGSLESDLTVYSFYATKTLATGEGGMVVTRDPALAKRCRVMRLHGIDRDAFDRFTSKKPAWYYEIVAPGFKYNMTDTAAAMGRVQLQRVQQMRDRRAQIAAAYDQAFADLPLTLPPSPGRTPGVERAAHRDDDEHSWHLYAIRIHPQAPLKRDDFIVRMTENGIGCSVHYVPLHLQPYWRDRYGLTPDMYPHSQAAFEGMASLPIYSRMTDADVQRVIASVRQLLHP

SEQ ID NO: 43119 - DNA, 1161 bp, Bordetella bronchiseptica RB50
  CDS (1)..(1161)
gtgagcggcgccgcggcgaaacgcagcattgcaatctctttgcccatgacgggcgaagaggagtggcaggcggtacgcgaacccctgatgagcgggtggctgacgcagggccccaaggtggcggctttcgagcaggcattcgcgcaacggcacgaggtcgcccatgcgttggccgtgacctcttgcacgacgggcctgcatctggcgttggctggattgggcatcgggccaggcgacgaggtcatcgtgccctcgttcacctgggtcgccacggccaacgccatactgtattgcggcggcacgccggtgttggtagacgtcgaccgggaaaccttcaacatcgacatcgcccaggtggcgagcaaggtcactccacgcacgcgtgcggtgattgcggtgcacctgttcggcctgtgcgccgacatcgacgccttgcgggcggcgttgccggcgtcggtggccatcgtcgaagatgccgcctgtgccgctggcgccagctggaatggccggccggccggcagcctgggagaggtgggggtcttctcgttccacccgcgcaaatcggtcacgaccggcgaggggggcatggtcaccacgaatgaccccgagctggccgagcgcatgaaccagatgcgcaatcatggcgccagcatttccgaagagcagcggcaccacggcccgcgcccgtggatcctggcggatttcgatctgctgggctacaactaccggatgaccgatctccagggggctgtgggccaggtccaactcgccaagctggacggtttcatcgacgagcgtgcccgctgggcgcagttctatcgagaacagctgggtgatctgaagtggctgcgcctgccggcggagccggccggcgcgcgacatggttggcagtcgttcgtgacgtgggtggatccggcgcatgcgcccatgccgcgcaacgacatgatgcaacgactgcaggagcagggcatcgccacgcggccgggcacccacgcggtgcacatgctgggctactaccgggaacaatacggctatcgccccgaggattttcccgccgcgcgggattgcaacgattgcacaatggcaatccccctgcacaaccgcatgacggaggatgactatcgttatgtggtggcggcgattcgggcattcggcggctga

SEQ ID NO: 43120 - protein, 386 aa, Bordetella bronchiseptica RB50
MSGAAAKRSIAISLPMTGEEEWQAVREPLMSGWLTQGPKVAAFEQAFAQRHEVAHALAVTSCTTGLHLALAGLGIGPGDEVIVPSFTWVATANAILYCGGTPVLVDVDRETFNIDIAQVASKVTPRTRAVIAVHLFGLCADIDALRAALPASVAIVEDAACAAGASWNGRPAGSLGEVGVFSFHPRKSVTTGEGGMVTTNDPELAERMNQMRNHGASISEEQRHHGPRPWILADFDLLGYNYRMTDLQGAVGQVQLAKLDGFIDERARWAQFYREQLGDLKWLRLPAEPAGARHGWQSFVTWVDPAHAPMPRNDMMQRLQEQGIATRPGTHAVHMLGYYREQYGYRPEDFPAARDCNDCTMAIPLHNRMTEDDYRYVVAAIRAFGG

SEQ ID NO: 43121 - DNA, 1101 bp, Bordetella bronchiseptica RB50
  CDS (1)..(1101)
atgcaattcattgacctgaaaacccaataccaagcgctgcgcgacaccatcaacccgcgcatccaggccgtgctggaccacggccagttcatcatgggcccggaagtcaaggaactggaggccgccctgtgcgcctacaccggcgccaagcactgcatcaccgtggcctcgggcaccgaggcgctgctgatctcgctgatggcgctgggcgtgaaggccggcgacgaagtcatcaccacctcgttcaccttcgtggccaccgctgaagtcatcgcgctgctgggcgccaagcccgtgttcgtcgacgtcgaaccggatacctgcaacatcaaggtgtccgagatcgaagcgaagatcaccccgcgcaccaaggccatcatcccggtgtcgctgtacggccaatgcggcgacatggacgaagtcaacgccgtcgcggccaggcacggcctgccggtcatcgaagacgccgcgcagagcttcggcgccacctacaagggccgcaagagctgcaacctgtcgaccatcggctgcaccagcttcttcccgagcaagccgctgggctgctacggcgacggcggcgcgctgttcaccaacgacgacgagctggcgcaagccatgcgcgaaatccgcgtgcacggccaatcgggccgctactaccacacccgcatcggcgtgggcggccgcatggacacgctgcaatgcgccgtggtgctgggcaagctggagcgtttcgattgggaaatcgcccaacgcatcaagatcggcgcgcgctaccagcaactgctggccgatttgcccggcggcgcatgtaccgtaaccgtgcgccccgaccgcgacagcgtctgggcccagttcaccgtcatggtgcccaaccgcgaagccgtcatcgcccagctgaaggaggccggcattcccaccgccgtgcactatccgcgccccatccacgcgcagccggcctatgagcaatacgccgagggcgccggcgccacgccggtttccgacgacctggccgcgcgcgtcatgagcctgccgatgcacccggatctggacgaagccacccaggacaagatcgtcgccgcgttgcgccaggccctgaactga

SEQ ID NO: 43122 - protein, 366 aa, Bordetella bronchiseptica RB50
MQFIDLKTQYQALRDTINPRIQAVLDHGQFIMGPEVKELEAALCAYTGAKHCITVASGTEALLISLMALGVKAGDEVITTSFTFVATAEVIALLGAKPVFVDVEPDTCNIKVSEIEAKITPRTKAIIPVSLYGQCGDMDEVNAVAARHGLPVIEDAAQSFGATYKGRKSCNLSTIGCTSFFPSKPLGCYGDGGALFTNDDELAQAMREIRVHGQSGRYYHTRIGVGGRMDTLQCAVVLGKLERFDWEIAQRIKIGARYQQLLADLPGGACTVTVRPDRDSVWAQFTVMVPNREAVIAQLKEAGIPTAVHYPRPIHAQPAYEQYAEGAGATPVSDDLAARVMSLPMHPDLDEATQDKIVAALRQALN

SEQ ID NO: 43123 - DNA, 1206 bp, Prochlorococcus marinus subsp. pastoris str. CCMP1986
  CDS (1)..(1206)
atgcagatacctccatttactttaaataggcagtaccaagaaattggctcagaaattgagagcgaggtttctaaagttttaaaaggggggcagtatattggaggacaagaaattgccaaatttgaggagagtttttctagtctgattggtgttgaaaatactattggatgtaatagtggaactgatgctttagtattagctttgcgcgcattagatattggtgtgggtgatgaagttattacctcatcttttagcttttttgcgactgcagaggctattagtgcagttggtgctaatcctgttttggtagatatagatccagaaacttatctcattaatactgaactaatagaacaagaaataaattctaataccaaggcaattatgccagttcatttatttgggaatgcagtgaatatgaccttaataaaatctttggccaacaaatatgacttaaaagtaatcgaagattgtgcccaggcaacatgcacaatgtgggataattctaaagttggtagtatcggtgatataggttgttttagcttttttcctactaaaaatttaggagctgctggagatggtggagcagtaacaacttcagatcagaatattgccaataaaattagagaactggctgttcatggcagcccaataagatatcaccatacccaaattggatataacagcagacttgataccattcaagctgccatattaaacattaaaattaaatatatttctaagtggattaataatcgccaaataattgctaataattaccttgatttattaggaaaaaatccatttattagttttccaaaaattagctctgatttaatttcccattcttggaatcaatttgtcatcaaattaagaaacgataaatattttttaaatgaagatttttcaaatttatttgatactgattgcaaaaaatactattccttaaggaatttggtcaaacaacaactttttgaaaaaggtattaattcaattatttattatccaattccaatacatgcacaaatagcttacaaaaataaaaatttttctagaataaaacttataaatacagagagaatttgtacagaggttctaagtctcccaatgtttcctgaaatttcttatgaagagcaagtttatatagcagaaaatttaaataaagttttaaagtattgtatagatgaaattcaaatttcagcataa

SEQ ID NO: 43124 - protein, 401 aa, Prochlorococcus marinus subsp. pastoris str. CCMP1986
MQIPPFTLNRQYQEIGSEIESEVSKVLKGGQYIGGQEIAKFEESFSSLIGVENTIGCNSGTDALVLALRALDIGVGDEVITSSFSFFATAEAISAVGANPVLVDIDPETYLINTELIEQEINSNTKAIMPVHLFGNAVNMTLIKSLANKYDLKVIEDCAQATCTMWDNSKVGSIGDIGCFSFFPTKNLGAAGDGGAVTTSDQNIANKIRELAVHGSPIRYHHTQIGYNSRLDTIQAAILNIKIKYISKWINNRQIIANNYLDLLGKNPFISFPKISSDLISHSWNQFVIKLRNDKYFLNEDFSNLFDTDCKKYYSLRNLVKQQLFEKGINSIIYYPIPIHAQIAYKNKNFSRIKLINTERICTEVLSLPMFPEISYEEQVYIAENLNKVLKYCIDEIQISA

SEQ ID NO: 43125 - DNA, 1149 bp, Prochlorococcus marinus subsp. pastoris str. CCMP1986
  CDS (1)..(1149)
atgaagaatttttatcctcaacaatatcaaacagattcagaatttaatattaaccacaactatttaaaggaacaattttcagactataaagaaatttttaatgaaattgagaaagttgttagagacggagatttcactttaggtcaatctgttaacgacgtagaagaactcatagctaaagaagcttcgacaaaatatgctataggtgtaggaagtggaactgatgctatttttttaagtcttaaagcattaggtatcgggcctggtgatgaagtaattacaacaacttacactttttatgccactattggtgcgatagttacagctggagcaagacctgttttctgcgatattaaagacgactttaatataaatacagaagagatagtttccaaaattaattcaaaaacgaaagcaattattcctgttcactgggcaggcagatcttgtgaaatggaaaaaataaataaaattgcttttgataataacttatatgttattgaagatgcttgtcatgccattcaaggtgaatataaatctaagagatgcggttctttaggggacttgggatgtttcagttttcatcctcttaaaaatctcaatgtatggggagatggaggaataataaccacctcaaatgaagatcttgctaataaattaaaactaattagaaaccatggtcttataaatagaaatacatgtgtagagtttgcttacaactctcgcctcgattctattcaggctgtcattgctcgttatttaataaaaaataaacttcaaaatataacacatacaagaatcacgaatgctcatcttctagatcaaatgctaaaagatataccacaggtaaatcaccctaaaagattttcagaattaaaagaagttttccatctatatgtatttaaagtagaaaatagggatgggctttatcaatatttaagagaaaatggtatagatgcaaaaattcattatccagtacctatgcatttacagcctgctgctaaaacctttggttataaaattggggatttccctatagcagaaattgcagcaaatcaaacaatctctttgccagttcacgaattcataagtttcgagcagattgaaaaaatgtctactatcatccataagtattactccagtatttaa

SEQ ID NO: 43126 - protein, 382 aa, Prochlorococcus marinus subsp. pastoris str. CCMP1986
MKNFYPQQYQTDSEFNINHNYLKEQFSDYKEIFNEIEKVVRDGDFTLGQSVNDVEELIAKEASTKYAIGVGSGTDAIFLSLKALGIGPGDEVITTTYTFYATIGAIVTAGARPVFCDIKDDFNINTEEIVSKINSKTKAIIPVHWAGRSCEMEKINKIAFDNNLYVIEDACHAIQGEYKSKRCGSLGDLGCFSFHPLKNLNVWGDGGIITTSNEDLANKLKLIRNHGLINRNTCVEFAYNSRLDSIQAVIARYLIKNKLQNITHTRITNAHLLDQMLKDIPQVNHPKRFSELKEVFHLYVFKVENRDGLYQYLRENGIDAKIHYPVPMHLQPAAKTFGYKIGDFPIAEIAANQTISLPVHEFISFEQIEKMSTIIHKYYSSI

SEQ ID NO: 43127 - DNA, 1167 bp, Prochlorococcus marinus subsp. pastoris str. CCMP1986
  CDS (1)..(1167)
ttgaaaaaatgtctactatcatccataagtattactccagtatttaaagataataatatgaatattcctttcgttaatttatctagagaagcagattattttcttccattacttcttcaaaaaactgaaaaagttctaaaatccggaatctatataaatggaccaaatgtcaaagaattagaaaagaaagtcgcaatttatctaaatgtaaaatatgttgtttctgttggtaatggatcagatgcacttacttttatattgaggtctctaaacttaagctctagtgatgaaattatttgccctgccaattcttttattgcaactgcatggtcaattattgcatcaggagcaaaaccagttttttgtgatgttgataaaaactttcttctagatattgatgatttcaaaaagaaagtcaacaataatacaagagcagtaattccagtacacttaactggcaaagttttccctactgagcaaattttagatttttgttctgccaaaagtattaagataattgaagatgccgcccagtcatttggggctggtaaaaataacgaatataaaaccggagctataagtgatgcagcggcttttagtttgcatcctctcaaaaatttcgctatctatggggacggaggattaatttcaacaaatgatccagaaatagctgataattgcaacctgctgagaaatcatgggttaaaaaatagagacgaagcgaaaatctggggatataactctaggcttgatgagttacaagcagcttatgctttaacaaaattggcagagatagataatttaaacaatagatatatcgagatcgcaaaaagatacgataatgggatctctccaattgcaaaaaaaccagaattaagaaaagaatataaggacgtttttcataattatgttattctcgttccagaaataagaagaaactctataatgagtaatctttatcaaaaagggatcgagacaaaaattcattaccccattcctttacacttacaggaatgttccaaaaatttaaattataaaattggtgatataccaagatgtgaacaatacgcaaactcaatgataagtcttccaatatatccaacactttctaacgaagaagttgattatataattgatactcttaataatgaattaatgtcaatttga

SEQ ID NO: 43128 - protein, 388 aa, Prochlorococcus marinus subsp. pastoris str. CCMP1986
MKKCLLSSISITPVFKDNNMNIPFVNLSREADYFLPLLLQKTEKVLKSGIYINGPNVKELEKKVAIYLNVKYVVSVGNGSDALTFILRSLNLSSSDEIICPANSFIATAWSIIASGAKPVFCDVDKNFLLDIDDFKKKVNNNTRAVIPVHLTGKVFPTEQILDFCSAKSIKIIEDAAQSFGAGKNNEYKTGAISDAAAFSLHPLKNFAIYGDGGLISTNDPEIADNCNLLRNHGLKNRDEAKIWGYNSRLDELQAAYALTKLAEIDNLNNRYIEIAKRYDNGISPIAKKPELRKEYKDVFHNYVILVPEIRRNSIMSNLYQKGIETKIHYPIPLHLQECSKNLNYKIGDIPRCEQYANSMISLPIYPTLSNEEVDYIIDTLNNELMSI

SEQ ID NO: 43129 - DNA, 1167 bp, Prochlorococcus marinus str. MIT 9313
  CDS (1)..(1167)
atgagtaatcttgacccacttccttacggtaagcaatcaataacgcctgatgatgttgcagcagttacagaagttcttcaaagcccttttttaacgcaaggaccagttcttcctgtcttcgagcaggcattatctaattacacaaaatcgcaatattctatagctgttaattcagcaacaagtgcacttcacattgcctgtctagctcttggtgtggagcctggtgatcgtatctggacctctccaattacatttgtcgcttcagccaattgtggtcgatattgtggagcaaaagttgaatttgtagatatcgatcctcgtactgctcttctcgatactgatctattaaagaagaaattaatagctgctgatcgagatggagcactcccaaaagttattattccggtacatctcactggaactagttgtgatatggctttgatcggtgaattagctgatttatttggcgttcatattattgaagatgctagtcatgctattggtgcttattatatggatatgccagttggaaattgtcgttttagttccatttctgtatttagctttcatcctgtgaaaataattactacggctgaaggaggtctggctacaacgaatgatcctatattggctgaacgaatgtatcttttacgcagtcatggtattgagcgaaatcctgaaaagttcgagctgcaaagtcctggtccttggtattatgagcagcatggtcttggttttaattatcgtttaacggaattgcaggcagcgcttggattaagtcaattaaagcgtcttgatttaattgttgatgaacgcaatcgtctgctcgataactataaatgtctcttaaaagaccttcccataacgtttttagaaataccttcttcttgtaggtcaagtgtacatttggctgtgattcttcttgaaaccataaatccccttaatcacagacgtgtttttgagggactccgttctgcaagtataggtgttcagcttcattatagcccagttcatttgcagccttattatagaagtcttggctggaaaatggacgacttcccttttgctgagagttatgcatctagagctattagccttcctttgttcccaggtctcacagaggatgatcagcaaagagttgctgatgccttgagaactttgttatga

SEQ ID NO: 43130 - protein, 388 aa, Prochlorococcus marinus str. MIT 9313
MSNLDPLPYGKQSITPDDVAAVTEVLQSPFLTQGPVLPVFEQALSNYTKSQYSIAVNSATSALHIACLALGVEPGDRIWTSPITFVASANCGRYCGAKVEFVDIDPRTALLDTDLLKKKLIAADRDGALPKVIIPVHLTGTSCDMALIGELADLFGVHIIEDASHAIGAYYMDMPVGNCRFSSISVFSFHPVKIITTAEGGLATTNDPILAERMYLLRSHGIERNPEKFELQSPGPWYYEQHGLGFNYRLTELQAALGLSQLKRLDLIVDERNRLLDNYKCLLKDLPITFLEIPSSCRSSVHLAVILLETINPLNHRRVFEGLRSASIGVQLHYSPVHLQPYYRSLGWKMDDFPFAESYASRAISLPLFPGLTEDDQQRVADALRTLL

SEQ ID NO: 43131 - DNA, 1227 bp, Prochlorococcus marinus str. MIT 9313
  CDS (1)..(1227)
atgcaggtgcccccttttagccttactcaacagctagccgaactggggcctgaccttgatgaggcggtcttgcgcgtgctgcgcagtggccaatacatcggcggcaccgaaattgaatcttttgaacaagcctttgctaactcccttggcgtgccttttgtcgttggttgcaacagcggcaccgatgctttggtcctggccctgagggcactggatatcggagcaggagatgaggtgatcagctgttctttcagcttttttgccactgccgaggcaatcagttcggtaggcgccacacctgtcttcgtggacgtcgaagcggacacttatctcatcaacctggaacaaatcgaagcagcaataaccccagacacccgtgctcttttaccagttcaccttttcggccgccccgtcaacatggagcagctgatggccatcgccaacaaacatgggctgaaagtgatcgaagattgtgcccaagccagtggtgcagcgtggaacggacggtccgtaggcagttggggcgatgtgggctgcttcagcttctttcccaccaaaaaccttggcggcgctggcgatggtggagccgtcagcacacatgacgcaaagcttgctcagcgaatgcgagaactcgctgttcacggaatgccgcgtcgatatttgcatacagaacttggctacaacagccgactggatgccctgcaagccgccgttttaaacgtgaaactaccaaggctttcttgctgggttgaaaagcgacaagccatcgcgacccgttatcaaacgttgctcacaaaccttccttgcctcgagcttccagatcaaacaaaagcaagccatctgcaacatgcatggaaccaattcgtggtgcgggtaacgagctgcccaatgaaccaaagcaactctgagagccttggcaaaccgtcaaaaaacaatggcagcaataccctgccggatagcagttgccgtgattggctcaaacaaagtcttttagaacatggcattaacaccatcatttactacccaatcccgatccatctccaaccggcctatgaaggcctaagccaaggcccaggcagcctgccggtcactgaacagctttgcagtcaagtgctgagcttgccgatcttcccagaattgcgcgaagagcagcagcaacaggttgtctctatgttgcagaagctgctgagtccagcaaccacaactcacatgagcaaggttgcttaa

SEQ ID NO: 43132 - protein, 408 aa, Prochlorococcus marinus str. MIT 9313
MQVPPFSLTQQLAELGPDLDEAVLRVLRSGQYIGGTEIESFEQAFANSLGVPFVVGCNSGTDALVLALRALDIGAGDEVISCSFSFFATAEAISSVGATPVFVDVEADTYLINLEQIEAAITPDTRALLPVHLFGRPVNMEQLMAIANKHGLKVIEDCAQASGAAWNGRSVGSWGDVGCFSFFPTKNLGGAGDGGAVSTHDAKLAQRMRELAVHGMPRRYLHTELGYNSRLDALQAAVLNVKLPRLSCWVEKRQAIATRYQTLLTNLPCLELPDQTKASHLQHAWNQFVVRVTSCPMNQSNSESLGKPSKNNGSNTLPDSSCRDWLKQSLLEHGINTIIYYPIPIHLQPAYEGLSQGPGSLPVTEQLCSQVLSLPIFPELREEQQQQVVSMLQKLLSPATTTHMSKVA

SEQ ID NO: 43133 - DNA, 1236 bp, Synechococcus sp. WH 8102
  CDS (1)..(1236)
atgcaggtgcctcctttcagcctcagccagcagatcagcgatctgggccaggacctcgaggaggcggtactgaacgtgttgcgcagcggtcaatacatcggcggaccgcagatcaagcagtttgaagactcctttgccgccagcgtcggctgccgccatgcagtgggctgcaacagcggcaccgatgccctgatccttgctctgagagccctcggcattggtgccggggatgaagtgatcacctgctccttcagtttttttgccacggctgaagccatcagcgccgtcggtgccacgccggtgttcgtggatgtggacccggccacgtacctgatcgatctcgatcagatcgaaacggtgatcaccccggcgacgaaggccttgatgccggtgcatctgttcggccggccagtcgacatgggccgactgatggccatcgccgaaacccacaacctcaaagtggttgaagactgtgctcaggccacaggagcccagtggaacggccagcccgtgggaagttttggtgatgtgggctgcttcagctttttccccaccaagaatcttggtgcggctggggatggcggtgcagccaccagcaacgacgatgccctcgcacaaatcatgcgggagctggcggtgcacggtatgccgaagcgctacctgcacacggcgctgggatacaacagccgcctcgatgcgattcaggcagctgtgctgaaagtgaagctgcccaagctgaagggctggattgagcgccgcacagcaatcgcagagcgctatcgcacgcacttgaccgacttgcccggactgaccctgccgaacccagaggagggtcacagctggaatcagtttgtggtgcgcatcggcagctgccccacgggtcagcccctctgcaacgcccgctgctcaccatcggcgaccagtgcgagtcatggactgccggaaagctgctgccgggactggctgaagcagaccctgatggagcgtggcgtgaacacgatcatttactaccccatcccgatccaccgtcagccggcctacgccgacctggagctcgaacagggctcccttcccgtgacagatcagctctgcagccaggtgctgagcctgccgatcttcccggaactggaccaagagcaccagcaaaccgtgatcgacaccgtgacgcagttgctggagcgatccaaacccacacccttgccggtggcgggcgatcaggagcggatggtggcgtaa

SEQ ID NO: 43134 - protein, 411 aa, Synechococcus sp. WH 8102
MQVPPFSLSQQISDLGQDLEEAVLNVLRSGQYIGGPQIKQFEDSFAASVGCRHAVGCNSGTDALILALRALGIGAGDEVITCSFSFFATAEAISAVGATPVFVDVDPATYLIDLDQIETVITPATKALMPVHLFGRPVDMGRLMAIAETHNLKVVEDCAQATGAQWNGQPVGSFGDVGCFSFFPTKNLGAAGDGGAATSNDDALAQIMRELAVHGMPKRYLHTALGYNSRLDAIQAAVLKVKLPKLKGWIERRTAIAERYRTHLTDLPGLTLPNPEEGHSWNQFVVRIGSCPTGQPLCNARCSPSATSASHGLPESCCRDWLKQTLMERGVNTIIYYPIPIHRQPAYADLELEQGSLPVTDQLCSQVLSLPIFPELDQEHQQTVIDTVTQLLERSKPTPLPVAGDQERMVA

SEQ ID NO: 43135 - DNA, 1212 bp, Synechococcus sp. WH 8102
  CDS (1)..(1212)
atgacaactcttggagctgccaacgtggattctgttcttgaggccattcaacaggtggtgggtcccagctcaaaggagcatcccatcagcttgcatgaacctgattttactggcacccaggcctgggcctacgttaaggagtgccttgattccggctgggtgagcacagcaggcagctgggtgagtcgttttgaggaagagctgtgcacctttactggtgcaagccatgcggtggttgtcagcaatggcactgtcgcgctgcgcttggctctgcatctggtgggggttggttacagcgatgaagtgttgttacctccgttgagttttgttgctacggccaatgccgttgctcatctgggggcttttcctcattttgttgacgtcgcgcctaacgcgctagggatgtgtcccatttccttggctgctcgtctggagaccattgcggagcgacgcgaagacattctggtgaatagagaaacagggcgtcgtatagctgcggtgttgcctgtgcatgtgttcggccacccggctgaggtagatcagctcctggcagtgtctgactcctgggggctaccactggttgaagatgctgctgaagccctcgcgagctggcgaggaagcactcattgcggtctctttggggcggtgggcacactcagcttcaacggaaacaagttgattacaactggaggtggtggtgctctgctcaccaatgacgccgacttagccaagcgtgcacgtcacttgtccactaccgcaaagcagcctcacccttgggcttttgaccacgacgccatcggctggaatgaccgactgcccaacctcaatgccgcacttggtgtagcccagctagaggatttggatcgtcggcttgatgccaaacgtcagcttgctcagcgctatgcagatgcctttgctgatttggagggtgtggagttggtggccgaaccaacagattgcatcagtaaccattggttggtgagcttacgctttacggcagaagatccacgagctgtacaagctgagcggttgcagctactcgaacgtgcacactcagtaggtctgttgctgcgcccaatctggaccccattgcatcagctccccatttacgaggcttgccctgcaggatcacttgttgtgtccgagaacctggcaccgcgtctcgtcaacctgccaagtagccctcagctcctggacggatgtgcggcatga

SEQ ID NO: 43136 - protein, 403 aa, Synechococcus sp. WH 8102
MTTLGAANVDSVLEAIQQVVGPSSKEHPISLHEPDFTGTQAWAYVKECLDSGWVSTAGSWVSRFEEELCTFTGASHAVVVSNGTVALRLALHLVGVGYSDEVLLPPLSFVATANAVAHLGAFPHFVDVAPNALGMCPISLAARLETIAERREDILVNRETGRRIAAVLPVHVFGHPAEVDQLLAVSDSWGLPLVEDAAEALASWRGSTHCGLFGAVGTLSFNGNKLITTGGGGALLTNDADLAKRARHLSTTAKQPHPWAFDHDAIGWNDRLPNLNAALGVAQLEDLDRRLDAKRQLAQRYADAFADLEGVELVAEPTDCISNHWLVSLRFTAEDPRAVQAERLQLLERAHSVGLLLRPIWTPLHQLPIYEACPAGSLVVSENLAPRLVNLPSSPQLLDGCAA

SEQ ID NO: 43137 - DNA, 1125 bp, Chromobacterium violaceum ATCC 12472
  CDS (1)..(1125)
atggattttctgccgtttacccgtccgtccatcgacgaggacaccatcgccgccgtcggcgaagtgctgcgctccggctggatcaccaccggcccgcgctgccagcagctggaggccgaattgtccgccttctgcggcggccgcccggtccgcttggtctcctccgccaccgccgcgctggagatggcgctgcagatcgccggcgtcggtcccggcgacgaagtgatcacctgcccgctgagctggatcgccaccgccaacgtcatcatgaaggtgggcgcgacgccggtgttcgtcgacgccgatccggccacccgcaacatcgacctggacaagatcgaagccgcgatcacgccgcgcacccgcgccatcattccggtggacctggccggcctgccggtggaccgcgaccgactgtacgacatcgcgggccgccaccggctgcgcgtggtcgaggatgccgcccaatccatgggcgccagttggaacggccagtccatcggcagcttcggcgacctggtgtcgttcagcttccacgccaacaagaacatgaccagcggcgaaggcggctgcctggtgctgaacgacgcggaagaggccaggctgttcgagaaactgcgcctgcaaggcgtcacccgcttcccggacggcaccatggatgtagacgtgctgggcggcaaggccaacctcaccgacatcgccgccgccatcggcctgggccagttgaagcggctggacggcttcaacgcccgccgccgcgagctggcccggctgtacttccagcatttcgagcgcgcgctcggctgcgaactgccgccggccgacttccagcacggcaactggcacatgttccagccgctgctgccgctggaccgcatgcgcgtcacccgcggcgaattcatcgcccggatgaaggcggagaacatcggcgtcggcatccactatccggccatgcacctgttcacgctgttccgcgacaaaggctacgccgaaggccgcttcccggtggccgaggacatcggcgcgcgcaccgtcaccctgccgctgttccccggcatgcgcgacgaggacgtgctccgcgtctgccaaaccttcagcgccgtcctgcgcgccgttttacactga

SEQ ID NO: 43138 - protein, 374 aa, Chromobacterium violaceum ATCC 12472
MDFLPFTRPSIDEDTIAAVGEVLRSGWITTGPRCQQLEAELSAFCGGRPVRLVSSATAALEMALQIAGVGPGDEVITCPLSWIATANVIMKVGATPVFVDADPATRNIDLDKIEAAITPRTRAIIPVDLAGLPVDRDRLYDIAGRHRLRVVEDAAQSMGASWNGQSIGSFGDLVSFSFHANKNMTSGEGGCLVLNDAEEARLFEKLRLQGVTRFPDGTMDVDVLGGKANLTDIAAAIGLGQLKRLDGFNARRRELARLYFQHFERALGCELPPADFQHGNWHMFQPLLPLDRMRVTRGEFIARMKAENIGVGIHYPAMHLFTLFRDKGYAEGRFPVAEDIGARTVTLPLFPGMRDEDVLRVCQTFSAVLRAVLH

SEQ ID NO: 43139 - DNA, 1314 bp, Chromobacterium violaceum ATCC 12472
  CDS (1)..(1314)
atgactgacacaagccgagaggccattctcgccctggtgcgtcaatacgccgaagcgcgcctggcccaggccgaattcattcccggccagaccgccgtgccgccgtccggcaaggtggtgggcgccgccgaagtggcgaacatggtggacgccgcgctggacgcctggctgaccaccggccgcttcaacgcgtcctttgaaacccggctgggcgaattcatcggcctgccgcacgtgctgaccgtcaattccggctcgtcggccaatctggtggccttcaccgcgctgacctcgcccaagcttggcgagcgcgcgatcaagcccggcgacgaagtgatcaccgtggcggcgggcttccccaccacggtcaatcccatcatccagaacggcgcggtgccggtgttcgtcgacgtgcagctaccgacctacaatatcgacgccgatctgctggaggccgcgctgtcgccgcgcaccaaggccatcatgatcgcccacacgctgggcaacccgttcgatctggacaaggtggccgctttcgcccgcaagcacggcctgtggctggtggaggattgctgcgacgcgctgggctccaccttcaacggccagaaggtcggcacctttggcgacatcggcacgctcagcttctatccggcccaccacatcaccatgggcgagggcggcgcggtgttcacccgcgacccgcaactgcggctgatcatggagtcggtgcgcgactggggccgcgactgctattgcgcgccgggcaaggacaatacctgcggcaagcgcttttcctggcagctgggccaactgccctgcggctacgaccacaagtacacctattcccacatggggtacaacctgaagatcagcgacatgcaggcggcctgcgggctggcccagctggaccggctggagggcttcatcgcggcgcgcaagcagaacttcgcctatttgagcgagcggctgcaaagctgcgccgaattcctggtgctgccgcaggcgacgccgggttcggacccgtcctggttcggcttcccgctgacgctgaagccggaggcgcagctcagccgggtcgacctgctgcactacctggaccagcaccgcatcggcacccggctgctgttcgccggcaacctgacccggcagccctatatgcaaggccggaactaccgctgcgcgacgccgctgccggtgaccgaccgcatcatgaacgacaccttctggatcggcctctatccgggcttgagccgggagatgctggatttcaccgtcgagaagctggaaaccttcctcggcgccaacttcgactag

SEQ ID NO: 43140 - protein, 437 aa, Chromobacterium violaceum ATCC 12472
MTDTSREAILALVRQYAEARLAQAEFIPGQTAVPPSGKVVGAAEVANMVDAALDAWLTTGRFNASFETRLGEFIGLPHVLTVNSGSSANLVAFTALTSPKLGERAIKPGDEVITVAAGFPTTVNPIIQNGAVPVFVDVQLPTYNIDADLLEAALSPRTKAIMIAHTLGNPFDLDKVAAFARKHGLWLVEDCCDALGSTFNGQKVGTFGDIGTLSFYPAHHITMGEGGAVFTRDPQLRLIMESVRDWGRDCYCAPGKDNTCGKRFSWQLGQLPCGYDHKYTYSHMGYNLKISDMQAACGLAQLDRLEGFIAARKQNFAYLSERLQSCAEFLVLPQATPGSDPSWFGFPLTLKPEAQLSRVDLLHYLDQHRIGTRLLFAGNLTRQPYMQGRNYRCATPLPVTDRIMNDTFWIGLYPGLSREMLDFTVEKLETFLGANFD

SEQ ID NO: 43141 - DNA, 1152 bp, Chromobacterium violaceum ATCC 12472
  CDS (1)..(1152)
atgaatttcgacgctctgattggatttgtacgagaacagtaccgcaccgatgaatttattcccctgcatgcgccgattttctcgggaaatgagaagcgctatgtggaagaaacgatagactcgaccttcgtctccagcgtaggcgcttttgtcgatcgtttcgagaacgaaatggcgagctacaccggcagcccgaaagcggtggctgcggtcaacggaacggcggcgcttcacatggctctgaagttggtgggtgtgcagccgaacgatcttgtgattacacagcccttgagcttcatcgccacctgcaatgcgatcagttattgcggcgcctcgccggtgttcatcgatgtggatcgtcgcacgctgggcttgtcgcccgtcgcgctggagcaatggctgcaagagaacgcgtttgtcgcagacgatctggtgtgccgccatcgcgcggaccagcgcgcaatccgcgcttgcgtgcccatgcatacctttggccacccggcggatctggatggcttaagtgaggtgtgccagcgttggcatatccctttgatcgaagacgcggcggagtccctgggcagcttctacaagggacgccataccgggacgctaggtgttgtcggcaccttgagcttcaacggcaacaagattatcaccaccggtggaggcggcatgatcctcaccaatgcggaactgggcaagcgcgccaagcatctgacgacgacggcgaagattccccacccatacgagtttatccatgacgaggtgggctacaactaccgtctgcctaacctgaacgcggcgcttggttgcgcgcagcttgaacagctggagactttcgtccaggccaagcgcgccttggcgaagtcgtaccaggaactgttggctggtagttccttgcagtttgtggccgagcccgacgactgccgctccaactattggctgaacgccgtgatctgcgttgatcgcgcgcaacgagacgctttgctgcaggccaccaacgagaacggcgtgatgacccgcccaatctgggaattgatgagccggctcccgctgtaccagcattgcctgcatggcgaattgctcaatgcagaatggctagcggaccgcgtggtcaatctgcccagtagcgtgacggggagcgtccattga

SEQ ID NO: 43142 - protein, 383 aa, Chromobacterium violaceum ATCC 12472
MNFDALIGFVREQYRTDEFIPLHAPIFSGNEKRYVEETIDSTFVSSVGAFVDRFENEMASYTGSPKAVAAVNGTAALHMALKLVGVQPNDLVITQPLSFIATCNAISYCGASPVFIDVDRRTLGLSPVALEQWLQENAFVADDLVCRHRADQRAIRACVPMHTFGHPADLDGLSEVCQRWHIPLIEDAAESLGSFYKGRHTGTLGVVGTLSFNGNKIITTGGGGMILTNAELGKRAKHLTTTAKIPHPYEFIHDEVGYNYRLPNLNAALGCAQLEQLETFVQAKRALAKSYQELLAGSSLQFVAEPDDCRSNYWLNAVICVDRAQRDALLQATNENGVMTRPIWELMSRLPLYQHCLHGELLNAEWLADRVVNLPSSVTGSVH

SEQ ID NO: 43143 - DNA, 1215 bp, Chromobacterium violaceum ATCC 12472
  CDS (1)..(1215)
atggacatggaggcggccgagcgcggccgcgcaaagacgagagaccgagaaatgagcgaaacaaagttcctgccgttcgccttgccggatatcggcgaggaagagatcaacgaagtggtcgatgctttgaggtcgggctgggtgaccaccggtcccaagaccaagcagttcgaggccgatttcgccgccttcctcggcggcgaggtcgaggcgatcgcggtcaactccgccaccgccggcctgcatttggcgctggaggcgatcggcatccgtgagggggacgaagtgatcgtgccgtcctacaccttcaccgccaccgccgaggtggtgcgctatctgggcgcgcacccggtgtgcgtggacgtggacggcgccaccttcaacatccgcccggatgcgatccgcgccgcgatcactgataagacccgcgccatcatcccggtgcatttcgccggcctggcctgcgacatggacgagatcatcgccatcgcccgcgagcatgggctgaagatcgtcgaggacgccgcccacgccatgcccacctactacaagggcaagctggtgggcacgctggattcagacgtcaccgtgttcagcttctacgccaacaagaccatgaccaccggcgagggcggcatggtggtgtccaggaacaaggacatcatcgcccgctgcaaggtgatgcgcctgcatggcatcagccgcgacgccttcgaccgctacgtgtccaagaccccggcctggttctacgaagtggtcgcgcctggctacaagtacaatatgccggacaccgccgcggcgatgggcatccaccagttgaagaagatccgtggcttctatgaaaagcgcgaagtcatggcccagcgcttcgaccgcgagctggccgatctgccgctgatcctgccggcgcgcgccaaggacgagggcagcaaccacgcctggcacctgtacccggtgcggatcaagccggaagccggcatcagccgcgacgacttcatcgccaggatggcggaaaagggcatcggctgctcggtgcatttcatcccgctgcaccgccagccggtatggcgcgacggctaccagctggcgcgcgagcaattcccggtggccgacgccgctttcgaggccgaagtgacgctgccgctctacacccggatgacggacgacgaccagacccgcgtcatcgccgcggtgcgcgagattctgggcgcatga

SEQ ID NO: 43144 - protein, 404 aa, Chromobacterium violaceum ATCC 12472
MDMEAAERGRAKTRDREMSETKFLPFALPDIGEEEINEVVDALRSGWVTTGPKTKQFEADFAAFLGGEVEAIAVNSATAGLHLALEAIGIREGDEVIVPSYTFTATAEVVRYLGAHPVCVDVDGATFNIRPDAIRAAITDKTRAIIPVHFAGLACDMDEIIAIAREHGLKIVEDAAHAMPTYYKGKLVGTLDSDVTVFSFYANKTMTTGEGGMVVSRNKDIIARCKVMRLHGISRDAFDRYVSKTPAWFYEVVAPGYKYNMPDTAAAMGIHQLKKIRGFYEKREVMAQRFDRELADLPLILPARAKDEGSNHAWHLYPVRIKPEAGISRDDFIARMAEKGIGCSVHFIPLHRQPVWRDGYQLAREQFPVADAAFEAEVTLPLYTRMTDDDQTRVIAAVREILGA

SEQ ID NO: 43145 - DNA, 1098 bp, Chromobacterium violaceum ATCC 12472
  CDS (1)..(1098)
atgtccatccagttcatcgatctgaaagcgcaataccagcatctgaaagccgacatcgacgcccgcatccacgcggtgctggaccacggccagtacatcatggggccggaagtgaaggaggtggaggaacagctggcggcctacaccggcgccaagcacgccatcggcgtttgcgatggcaccaaggcgctgctgatcgcgatgatggcgctgggcatcggccccggcgacgaggtgatcaccaccccgttcaccttcatcgccaccggcgagatgatcgccctcctgggcgccaagccggtgttcgtcgacatcgaccccgtcagctacaacctggacccgaaccggctggaagcggcgatcacggccaggacccgcgccatcatgccggtcagcctgtacggccaggcggcggatttcaccgcgatcaacgccatcgccgacaagcacggcatcccggtgatcgaggacggcgcgcaaagcttcggcgccagccagcacggcaagaaatccggcaacctgtccaccatcggctgcaccagcttcttccccagcaagccgctgggttgctacggcgacggcggcgcggtgttcaccagcgacgacgcgctggccaagaagatccgcgagatccgcgtccacggccaggaccgccgctaccatcacccgatcatcggcctgaacggccgcctggacaccatccaggccgcggtgctgctggccaagctgcccagcttcgccgacgaagtggccgcccgcgagcgcatcggcgcgcgctacagcgcgttgctgaaggatgtggcgcgcgtgccggtgatcggcgcgggcaacacccacgtctacgcgcagtacaccatcgaggtggacgagcgcgaggcggtgcaggccaggttgaaagagctgggcgtgcccaccgccgtccattacccgatcccgctgcacctgcagccggccttcgcccacctgggccagggcgagggcagcttcccgctgtccgaggccgccggcaagcgcgtgatgagcctgccgatgcatcccttcctgacggaagacgcgcaggacgccatcgtcgccgcggtgaagaaggcgctgggctga

SEQ ID NO: 43146 - protein, 365 aa, Chromobacterium violaceum ATCC 12472
MSIQFIDLKAQYQHLKADIDARIHAVLDHGQYIMGPEVKEVEEQLAAYTGAKHAIGVCDGTKALLIAMMALGIGPGDEVITTPFTFIATGEMIALLGAKPVFVDIDPVSYNLDPNRLEAAITARTRAIMPVSLYGQAADFTAINAIADKHGIPVIEDGAQSFGASQHGKKSGNLSTIGCTSFFPSKPLGCYGDGGAVFTSDDALAKKIREIRVHGQDRRYHHPIIGLNGRLDTIQAAVLLAKLPSFADEVAARERIGARYSALLKDVARVPVIGAGNTHVYAQYTIEVDEREAVQARLKELGVPTAVHYPIPLHLQPAFAHLGQGEGSFPLSEAAGKRVMSLPMHPFLTEDAQDAIVAAVKKALG

SEQ ID NO: 43147 - DNA, 1155 bp, Porphyromonas gingivalis W83
  CDS (1)..(1155)
atgcctacttccatttcccagccaattgtgatggtggatctgaaaaagcagtatctgcagatgaaaaaacagatcgatgaagccatccatacagttatcgatagtacagcttttatcaacggaaaagaagtacatgcttttgcggaagatttggcagcctatttgggtgtaaagcatgtaatcccttgcgccaatggtacagacgcattgcaaatcagtctgatggctttgggattgaaagtcggagatgagatcattgtgcccgatttcacttatgcagcaagtgccgaagctataggtttgttaggattaacacctgttttcgctgatgtagaccctattacatttaatcttacatctaagggctgcgaaaaagttctgtccgacaagacgaaagcaatcataccagtacacctctttgggcagtcctgcgatatggagccgcttttggcctttgccaagcgaaacgatttgtttgttatcgaagacaatgctcaggcaatgggagggggatatactatctccgatggatctatccgaaaaacaggaacaatggggcatataggctgtgcttccttctttccatcgaagaatttgggttgttatggagacggtggtgctgtcacaacaaatgatgacgaattggcaaagcgagtgcgaatgatagcgaaccatggccaaaagatcaaatacaaacatgacattatcggatgcaattcccgactcgatactattcaagcggccatcctcagagtaaaattgcaatatttggaccgcttcaatgcacttcggaatgaggtcgcctcacactatacctctctgctcgaaggtattgaatggctacaaacaccgacctccttgcagcagtcttcgcatgtttatcatcaatatactcttaagctcttggatcagaacactcgcgatggactgcgagagcatctgacgaatcataagatcgcttcgatgatatactacccgataccactccacaggcaaccggcattcgtcggtattgctcattggggtgaatctttggatgtgtccgactctttgtcgcgaactgttctctccatccccatctatccggaaatggagatagagcaaatccatgctgtggtatcagcaatcaaaacattcgaaccgtctttacaatga

SEQ ID NO: 43148 - protein, 384 aa, Porphyromonas gingivalis W83
MPTSISQPIVMVDLKKQYLQMKKQIDEAIHTVIDSTAFINGKEVHAFAEDLAAYLGVKHVIPCANGTDALQISLMALGLKVGDEIIVPDFTYAASAEAIGLLGLTPVFADVDPITFNLTSKGCEKVLSDKTKAIIPVHLFGQSCDMEPLLAFAKRNDLFVIEDNAQAMGGGYTISDGSIRKTGTMGHIGCASFFPSKNLGCYGDGGAVTTNDDELAKRVRMIANHGQKIKYKHDIIGCNSRLDTIQAAILRVKLQYLDRFNALRNEVASHYTSLLEGIEWLQTPTSLQQSSHVYHQYTLKLLDQNTRDGLREHLTNHKIASMIYYPIPLHRQPAFVGIAHWGESLDVSDSLSRTVLSIPIYPEMEIEQIHAVVSAIKTFEPSLQ

SEQ ID NO: 43149 - DNA, 1104 bp, Wolinella succinogenes DSM 1740
  CDS (1)..(1104)
atgaacgaatctagaatcttcctctctcctccccatatgggcggaaatgaactcgcctatgtccaaaaggtatttgagagtaactatatcgctcccttaggggcctttgtgaacgcctttgaggatagcatcaagcgctacacccaagcgccaagcgctcttgcgctctctagcggtactgcagcgattcatctagcgctcagggttggcggagtggggcagggggattatgtgctcgctagctctttcaccttcatcggctccatcgcggcgattctctacgaaaaggcaattcccgtctttattgatagcgatgaggagagttggaatctctccccctctcttcttaaaaaagcgattgcctccctagagaagaagcccaaagcgctcatcctcacgcatctctatggccaatgcgccaagatcgaagagattgccaccctttgccaagaggagggaatcctcctcattgaagatgccgccgaatcgcttggtgccacctacaaaggtcgccaaacaggcacctttggtgattttggcatctactctttcaatggcaacaagatcatcaccacaagcggcggcgggatgcttgtgggaaaagagaacaaggcgatggagaaggcgcgttactacagcacccaggcgcgcgaaccccttcctcactacgaacactacgactttggctacaactatcgcatgagcaatgtggtcgccgccattggcgcgggacagatggaagttttggaggagcgcgtgcagaagcggcgtgagatttttagttggtatcaggagctcttatctccagatgaggtggaattcatgccagagattcctcactctagagggaatcgatggctcaccacgcttctttttaaaaaggctgaccctcttagggtgatgaaacacctcgaaacgcatcaagtcgaatcgcgccccttgtggaagccgatgcatctccagcccctctttaaaggatccaaagccttcgtcgatggcacaagcgagcgattctttgctcgcggactctgcctccctagcggcacagcgatggataggacgaccgtagagaagatcgcccattgggtgagcgaggccctatga

SEQ ID NO: 43150 - protein, 367 aa, Wolinella succinogenes DSM 1740
MNESRIFLSPPHMGGNELAYVQKVFESNYIAPLGAFVNAFEDSIKRYTQAPSALALSSGTAAIHLALRVGGVGQGDYVLASSFTFIGSIAAILYEKAIPVFIDSDEESWNLSPSLLKKAIASLEKKPKALILTHLYGQCAKIEEIATLCQEEGILLIEDAAESLGATYKGRQTGTFGDFGIYSFNGNKIITTSGGGMLVGKENKAMEKARYYSTQAREPLPHYEHYDFGYNYRMSNVVAAIGAGQMEVLEERVQKRREIFSWYQELLSPDEVEFMPEIPHSRGNRWLTTLLFKKADPLRVMKHLETHQVESRPLWKPMHLQPLFKGSKAFVDGTSERFFARGLCLPSGTAMDRTTVEKIAHWVSEAL

SEQ ID NO: 43151 - DNA, 1131 bp, Wolinella succinogenes DSM 1740
  CDS (1)..(1131)
ttgcttccttatagccgtcaatccatttcgcctgaagatattcaggtggtcattgaagccctaaatagctccttcctcacccaaggtccaagggttgaggcctttgaagaggcgctcgcagattgcacgggcgctaagtatgcactagcgctcaactccgccacctcagccctctactgcgcctacgctgcggcaggaatcaaagagggagacgaggtaatcaccactcccattagctttgttgcgacctccaatatgctccttgcacttggggctaagcctatcttttgtgatgtgaaagaagatggaaacatcgatgaatcgcttatcccctcgctcatcacccccaagactagagcgattgtttccgtcgattattcggggaatcctgtggcgtttgatcgtatcgcctctattgccaagactcacgggcttgcctttatctcagatagctcccatgcgattggagcagaatttggcggcaaaagagtgggggtttgggcggatgcgactgtttttagcttccatgcgatcaagcccatcaccacgggtgagggcggggcgctagtcactgatgatgaagcgatctatgagcgagccaaacttttaagaagccatggagtggaaaaaaagcgactttggaatagcgatgttcactcttgggggtttaattttagaatgagtgactttgctgccgcgcttggcacttcgcagctcaaacggctctctagctttattaaaaggcgtgaagagattgctcttttttatgacgattcctttaaagaatctccctattttacgactctttcacgctccaaagaggggaagagctcccatcatctctatccaatttttctaaagcaggagttttggtgccccaaagaggagattttcactgctttgcaagagcacggcttgggcgttcaggtccactacaagcccatccacaccttctctctttatgatacgcctagagattctctctttttgcccaaggcagagtccttttatctctctgaaatctccattccctgccatcaagagatgggacttaaagaggccaaagaggtagtagagacgctctctaaggtctttcaagaggcctctaaacgctccttgtgtggggcataa

SEQ ID NO: 43152 - protein, 376 aa, Wolinella succinogenes DSM 1740
MLPYSRQSISPEDIQVVIEALNSSFLTQGPRVEAFEEALADCTGAKYALALNSATSALYCAYAAAGIKEGDEVITTPISFVATSNMLLALGAKPIFCDVKEDGNIDESLIPSLITPKTRAIVSVDYSGNPVAFDRIASIAKTHGLAFISDSSHAIGAEFGGKRVGVWADATVFSFHAIKPITTGEGGALVTDDEAIYERAKLLRSHGVEKKRLWNSDVHSWGFNFRMSDFAAALGTSQLKRLSSFIKRREEIALFYDDSFKESPYFTTLSRSKEGKSSHHLYPIFLKQEFWCPKEEIFTALQEHGLGVQVHYKPIHTFSLYDTPRDSLFLPKAESFYLSEISIPCHQEMGLKEAKEVVETLSKVFQEASKRSLCGA

SEQ ID NO: 43153 - DNA, 1089 bp, Wolinella succinogenes DSM 1740
  CDS (1)..(1089)
atgaaaatagactttgccaatttagctctgcagcaccagctctacaaagaggagatcgaatcggccatccatgaggtgatctcaaagtgcaatttcatcatgggagaggaggtcgaactcctagagagggagctagaagccttcacgggtgcaaagcatgccatcacctgcgctagcggaacagatgccctccttttggctctcatggccttaggaatcaaagcaggagatgaggtgattaccactcccttcaccttcattgccaccgcagagatgattgctcttttaggagccaagcctctgtttgtggatattgaagaggagagctacaatcttgatgtcactcaattagagaagaagatcacccctaagaccaaagcgattcttcctgtccatctctatggtcagccaagcgacttaaaagagatcatggaggtcgctaaagcgcatgatcttagggtggttattgatggagcccaaagctttgggagcacctatgagggggtgagcgatagtgctttgggagatatctcctgcacgagctttttccccgccaaaccccttggatgttatggagatgggggggcgctcttcacctccaatgaagagcttgccgccaaaatcaagagcctaagaatccatggtcaaacccaaaggtatcatcaccaatatattggaattggggggaggctagatacgattcaagccgccgtgctaagggtgaaattgcgtcactactctaaagatcttgcccaaagggtggaggtggccaaacgctactctttggctctctcttctaaagagggaatcatcctcccccaaattaagccaaatcgcacctcagcctttgcccaatactccataagggttaaagagcgccctagagtgcaggctagactcaaggaggcgggagtccccacggcagtgcactatcctatgcccttgcatcttcaagggtgctttgcctatttggggcatcaaaagggggatttccctgtggcggagcaagtgagtgaggagatattgagtctgcccatgaatccctatgtgagcgaggaagagatggagtatataggggggtgtttttag

SEQ ID NO: 43154 - protein, 362 aa, Wolinella succinogenes DSM 1740
MKIDFANLALQHQLYKEEIESAIHEVISKCNFIMGEEVELLERELEAFTGAKHAITCASGTDALLLALMALGIKAGDEVITTPFTFIATAEMIALLGAKPLFVDIEEESYNLDVTQLEKKITPKTKAILPVHLYGQPSDLKEIMEVAKAHDLRVVIDGAQSFGSTYEGVSDSALGDISCTSFFPAKPLGCYGDGGALFTSNEELAAKIKSLRIHGQTQRYHHQYIGIGGRLDTIQAAVLRVKLRHYSKDLAQRVEVAKRYSLALSSKEGIILPQIKPNRTSAFAQYSIRVKERPRVQARLKEAGVPTAVHYPMPLHLQGCFAYLGHQKGDFPVAEQVSEEILSLPMNPYVSEEEMEYIGGCF

SEQ ID NO: 43155 - DNA, 1149 bp, Gloeobacter violaceus PCC 7421
  CDS (1)..(1149)
gtggtatggtaccgacccagatttggcggagatcctcgcttgataccgatgctcgacctgtcgctacagacagcccgactgcttcctgaaatcgaaaagaccctgcacgaaatttgcaccggcggcagttttatcctcggtcgccatggccgcgccctcgaagcggagatcgcggctttgagcggggcgagtttcggcctcggcgtcgcctcgggcaccgacgcgctgcacctggtactcagggccctggacatcgggccgggggacgaggtgatcacttcgccctttacgttcatcgccaccgccgaggcgatctcctactgcggggcgacgccggtcttcgtcgacatcgacccggagactttcaacatcgaccctgcccagatcgaagcgcgtatcaccgggcgcacccgggcgattttgccggtgcatctttttggtcaggccgccgacatggacccgattctggagattggccgtcgccggggcctgcacgtcatcgaagacagcgcccaggcgatcggcacgctttacaaagaccgtccggtcggttcgctgggggtggcgggctgtctgagcttttatcccaccaagaatctgggagccttcggcgatgggggcatggtggtcacctccgacgaagggctgcgcgatcgcgtcgctgcgctgcgggtgcacggccagacccggcgctactaccacgacgaagtcggttactgctcgcgcctcgacgaaatgcaggcggcggtgctgcgcatcaaactgccgcatctggaagggtggaaccgccgccgcgcccagatcgcccagcgctacaacgcgctattctccgatctgccgcttgcaaccccggcccgcgccgcctattcgacccacacctaccaccagtacaccgtgcgctccgtccaccgcgagcgcttcgtggcgggcctgggcgagcaaaaagtcggggtgggcatctactacccggtaccgctgcatctgcaaaacgcttatgccgccctgggctaccgacccggggatctgcccgcagcggagcaggcggcggcggaagtcttctctttgccaatgtttccggagttgagcgacgcgcaaatcgagggggtggcgcgggcgatgcgcgcggcggcaccggtggcctgggtctga

SEQ ID NO: 43156 - protein, 382 aa, Gloeobacter violaceus PCC 7421
MVWYRPRFGGDPRLIPMLDLSLQTARLLPEIEKTLHEICTGGSFILGRHGRALEAEIAALSGASFGLGVASGTDALHLVLRALDIGPGDEVITSPFTFIATAEAISYCGATPVFVDIDPETFNIDPAQIEARITGRTRAILPVHLFGQAADMDPILEIGRRRGLHVIEDSAQAIGTLYKDRPVGSLGVAGCLSFYPTKNLGAFGDGGMVVTSDEGLRDRVAALRVHGQTRRYYHDEVGYCSRLDEMQAAVLRIKLPHLEGWNRRRAQIAQRYNALFSDLPLATPARAAYSTHTYHQYTVRSVHRERFVAGLGEQKVGVGIYYPVPLHLQNAYAALGYRPGDLPAAEQAAAEVFSLPMFPELSDAQIEGVARAMRAAAPVAWV

SEQ ID NO: 43157 - DNA, 1146 bp, Photorhabdus luminescens subsp. laumondii TTO1
  CDS (1)..(1146)
atggatagctttcttccattttctcgtcctgcaatcggtgatgaagaaattcaggcagtagagaaggttcttcgttcggggtggattacaacaggcccgcaaaatcatcaattggaacaggacttttgccgcatgtttggttgcaaacatgcggttgctttagcctcggcaacggcgggtatgcatctgacactaatggcactgggaattggccctggtgacgaagtgattacaccgtctcaaacttgggtttccacaataaatatgatctgtttgcttggtgctgaaccaatcatgattgatgttgatcgtcatactttaatggtcgacgcgcagacagtgaaaaaagcgattacttccagaaccaaagcgattattccggttcactatgccggtgcgccttgtgatttagatatattgcgtggaattgctcaggaggcgggtattcccttgattgaagacgccgctcatgcattaggaacccgttataagaatgaatggattggtgagcatggcacagcgattttctcttttcatgccataaaaaatgccacttgtgcagaaggggggttaattgctactgataacaatgaacttgttgaacgaattcgatgtctaaagtttcatggattgggtattgatgcttttgatcgtcagattcaaggcaggagaccacaggcggaagttgtagaaccgggttacaaatataatttatctgatattcacgctgcgattgctgttgtgcaattaagtaaattggaatcaatgaatattcgccgtcggcaaattgtcgcccgttattcaacggcattaaaagattctcctttgcagatgttaagtgtgcccgattatgagcatattcatgcacatcatctatttatggtgcgggttaataaggatgtttgtggcattgatcgcgacacattaatggaacgtttgaaaaacaagaatattggcacaggtttgcatttcagagctgcacatacacaaaaatattatcgagatcggtatccgcagttgtcattacctgaatcagaatggaattcagtaacactctgttcattgccactctttcctgatatgagtgatgatgatgtagatcgtgtcactgatgctttacaagaaattatttcggagcacagataa

SEQ ID NO: 43158 - protein, 381 aa, Photorhabdus luminescens subsp. laumondii TTO1
MDSFLPFSRPAIGDEEIQAVEKVLRSGWITTGPQNHQLEQDFCRMFGCKHAVALASATAGMHLTLMALGIGPGDEVITPSQTWVSTINMICLLGAEPIMIDVDRHTLMVDAQTVKKAITSRTKAIIPVHYAGAPCDLDILRGIAQEAGIPLIEDAAHALGTRYKNEWIGEHGTAIFSFHAIKNATCAEGGLIATDNNELVERIRCLKFHGLGIDAFDRQIQGRRPQAEVVEPGYKYNLSDIHAAIAVVQLSKLESMNIRRRQIVARYSTALKDSPLQMLSVPDYEHIHAHHLFMVRVNKDVCGIDRDTLMERLKNKNIGTGLHFRAAHTQKYYRDRYPQLSLPESEWNSVTLCSLPLFPDMSDDDVDRVTDALQEIISEHR

SEQ ID NO: 43159 - DNA, 1131 bp, Photorhabdus luminescens subsp. laumondii TTO1
  CDS (1)..(1131)
atgattccatttaacaaaccaccagtagttggcactgaattagattacatgaagcaagccatggaaagcggtaagctttgcggggatggtggtttcaccaagcgttgtgaagagtggatggaacaacatttcaattgcccgaaagttctattgacaccatcctgtaccgctgcactggaaatggcggctattttgctgaatatccaacccggtgatgaagttattatgccgagtttcactttcgtttccagttctaacgcgtttgtactgcgtggagcaactgttgtatttgtggatatccgtccagataccatgaatattgatgaaaccaaaatcgaagcagcaattacagctaaaacacgcgtgattgttccagtgcattatgccggtgtagcctgtgaaatggataccattatggccttggcagagaaatataatctgtttgtcgtggaagatgctgcacagggagtaatgtctacttataaagggcgtgcattgggaactatcggacacattggttgctacagtttccacgaaaccaaaaactactcctctggtggtgaaggtggtgcagcacttatcaatgatcaatcattgatttctcgtgcggaaattgtccgtgaaaaagggactaatcgtagtcagtttttccgtggtcaagttgataaatatacttggcgcgatatcggttcgagttatcttatgtcggaacttcaggctgcttatttgtgggcacaattggaagaggctgagaaaatcaatgagcgtcgtcttgccttgtggaatacctattatcaagcattaaaaccgctggttgatgctggtctcctgacattgccggtcataccggaagagctggagcataatgctcacatgttctatatcaagctgaaagatgttgaagaacgctcagcattcaatagctatatgaaggacgcaggtgtactaacagtattccattatgtttctctgcacaccagccccggtggtgaaaaatttggccgttttcatggggaagattgttttactacttgtgaaagtgatcgtctagtgcgcttgccgatgttttacaacataacagacgctgaacagcagattgtcatcaaacatattcgggaatacttcgcctga

SEQ ID NO: 43160 - protein, 376 aa, Photorhabdus luminescens subsp. laumondii TTO1
MIPFNKPPVVGTELDYMKQAMESGKLCGDGGFTKRCEEWMEQHFNCPKVLLTPSCTAALEMAAILLNIQPGDEVIMPSFTFVSSSNAFVLRGATVVFVDIRPDTMNIDETKIEAAITAKTRVIVPVHYAGVACEMDTIMALAEKYNLFVVEDAAQGVMSTYKGRALGTIGHIGCYSFHETKNYSSGGEGGAALINDQSLISRAEIVREKGTNRSQFFRGQVDKYTWRDIGSSYLMSELQAAYLWAQLEEAEKINERRLALWNTYYQALKPLVDAGLLTLPVIPEELEHNAHMFYIKLKDVEERSAFNSYMKDAGVLTVFHYVSLHTSPGGEKFGRFHGEDCFTTCESDRLVRLPMFYNITDAEQQIVIKHIREYFA

SEQ ID NO: 43161 - DNA, 1071 bp, Photorhabdus luminescens subsp. laumondii TTO1
  CDS (1)..(1071)
atgcaatttaccgatctggcagcacagcaacttaaaattaaagataaaattgacgcgaatatccagaaagtcctcgcacatggaaaatatattttagggcctgaagtcgacgaattagaagcaaagctgattgcctacaccggcgcgccatattgcattacctgcgccaatggcaccgatgccttgcaaattgccttaatggcgattggcattaaacccggcgacgaagtgattaccgccggctttacctacattgccaccgctgaaaccgttgcgctactgggcggggttccagtttatgttgacgtcaaacccaccacgtataacttagatccaacgcaactcgaagcggcgattaccccaaaaaccaaagcgatcattccggtttccttatttggtcaatgtgccgattttgacgaaattaatgccatcgcagcaaaacataacctgatcgtaatagaagacgcggcccaaagttttggcgcgacttataaaggcaaacgttcctgtaacttaacgaccatctcatgtaccagtttcttccctagcaaaccgttgggatgttacggcgatggcggcgctattttcacccgtgatgaagaactggcgaaaattattcgtcaaattgcccgtcatggacaagaccgacgataccaccatatccggatcggaattaatagccgcttagataccctgcaagcagctatcctgttacccaaactggagatattcgatgaagaaatggcattacgtcagcaggtggcagaaaactacaataacgcattgaacggcatcggtatcacgaccacgccctatattgagccacacaatctttcggcctatgcgcaatatactctccgcattaaaaaccgtgatgaattacaacgcagattaaaagaacagggtattcccaccgccattcattacccgatcccgctaaataaacaacccgcggtggccagcaatattgctctgcctataggagacgaaatcgcacaagaagtcattagcttgccgatgcatccttatttatccatagatataattaataaaattgccagttcaatttaa

SEQ ID NO: 43162 - protein, 356 aa, Photorhabdus luminescens subsp. laumondii TTO1
MQFTDLAAQQLKIKDKIDANIQKVLAHGKYILGPEVDELEAKLIAYTGAPYCITCANGTDALQIALMAIGIKPGDEVITAGFTYIATAETVALLGGVPVYVDVKPTTYNLDPTQLEAAITPKTKAIIPVSLFGQCADFDEINAIAAKHNLIVIEDAAQSFGATYKGKRSCNLTTISCTSFFPSKPLGCYGDGGAIFTRDEELAKIIRQIARHGQDRRYHHIRIGINSRLDTLQAAILLPKLEIFDEEMALRQQVAENYNNALNGIGITTTPYIEPHNLSAYAQYTLRIKNRDELQRRLKEQGIPTAIHYPIPLNKQPAVASNIALPIGDEIAQEVISLPMHPYLSIDIINKIASSI

SEQ ID NO: 43163 - DNA, 1158 bp, Photorhabdus luminescens subsp. laumondii TTO1
  CDS (1)..(1158)
atgaactcttcttttctccctttcgcactcccagaaatcagccaagaagaaattgatgaagtcattgactcacttaaaacaggctggataaccaccggacctaaaaccagaagatttgaacaagattttgcgcaatatttaggttccgatgttgaagccatagcggtaaattcagccacggcagggttgcatttagcattagaagccattggtattcagccgggtgatgaagtcatcgttccgacctatacctttacggcaaccgcagaagttgtccgttatttgggagctcaccctatttttgttgattctttacctgacagcctgaatattgacccaatagcaatagaaaaagccataaccgccaaaactaaagcaattatgccggtacactttgcaggtttatcctgtgatatggatgccattattgcaatagctaaaaaattcaatctacgaatcattgaagatgccgcccattcatttccgactttatataagggaaagaaaattggcacgctagataccgatgtcaccgtattcagcttttacgcgaataaaaccatgacgacagcggaaggtggcatgctagtctccagacatccagatatcataaaaagagcaaaaataatgcgcctccacggcattagcaaagacgcctttgatcgatatcaatctaaaatacctgcctggtattatgaagtgattgaaccaggctataaatataacatgcccgatatttgtgcatctatcggcatccatcaattacagaaaatagacactttccacaagaaaagagaggcaatggctaaactctatgatgatgaattaaaagatctaccgattatcttacccactaaacctcaagaatctaatagccaacacgcctggcatctatataccattagattaaatgatcaagtcaaaatatccagagatgactttattataaaaatggcagaaaaaaatatcggctgctctgtccattttattccactacacaaacaacccatctggaaaaatacctattctcttaacgaaaacaacttcccagtcgcagaagaaaactttaaaagaattgtatccatccctttatatacaaaaatgaccaaagaagaccaaatatacgttatcaaaacaattaaagagatcttggcataa

SEQ ID NO: 43164 - protein, 385 aa, Photorhabdus luminescens subsp. laumondii TTO1
MNSSFLPFALPEISQEEIDEVIDSLKTGWITTGPKTRRFEQDFAQYLGSDVEAIAVNSATAGLHLALEAIGIQPGDEVIVPTYTFTATAEVVRYLGAHPIFVDSLPDSLNIDPIAIEKAITAKTKAIMPVHFAGLSCDMDAIIAIAKKFNLRIIEDAAHSFPTLYKGKKIGTLDTDVTVFSFYANKTMTTAEGGMLVSRHPDIIKRAKIMRLHGISKDAFDRYQSKIPAWYYEVIEPGYKYNMPDICASIGIHQLQKIDTFHKKREAMAKLYDDELKDLPIILPTKPQESNSQHAWHLYTIRLNDQVKISRDDFIIKMAEKNIGCSVHFIPLHKQPIWKNTYSLNENNFPVAEENFKRIVSIPLYTKMTKEDQIYVIKTIKEILA

SEQ ID NO: 43165 - DNA, 1128 bp, Photorhabdus luminescens subsp. laumondii TTO1
  CDS (1)..(1128)
ctgataaagatgatcaattttcttgatttaaaagcaataaataaaaaatacgaaaacgaattaaaagaagctagttcaagagtaatagattcaggctggtacataatggggaaagagttagaatcttttgaaaaagaatttgcagagtattgtggcacaaaacattcgatcggtgtcgctaatggcttagatgctttaatactagtcctcagagcatggaaagaattaggtaaaataaaagatggtgatgaagttattgtacctgcaaatacttatatcgcatcagtattagcgattacagcaaataatttgaagcccgttctcattgagccagatcaaaatacatataacttaagccctaataatataatatccgcaatcacagaaaaaacaaaagttattttgcccatacatttgtatggtcaaatctcaccaatgcctgaaatcatgaagattgccaatgaatacaatctattagtactagaagatagcgcacaagcgcatggagctgaaatagtgggtaaaaaagccggtagctggggtaatgcatcaggatttagtttttatccaggaaaaaaccttggtgctttgggtgatgcaggtgcaattacaacaaacgatgaagaattaacaaccactataaaagcattacgtaattatggctcacatgaaaaatataaaaatatttatcaaggcattaacagtcgattagatgagcttcaagctgcatttctctctgtaaaattaaaatacctaaatatcgaaacagaatatcgacgtagcattgcaaagcattatttagagaatattaataatccatacataaaattacctatcaccattgaacaaaatgcactccatccagaaaaccatgtttggcatttgtttgtaattaattgttcacatagggaaaaactccaacaatatctttttgaaaaaggtatccaaacgttgattcattatcctatccctcctcataaacaaacagcgtattcagaatggaatacattaaatttccctattactgaaaaaattcatcagcaggtactttcactcccccttgaccctactatgaacattgaagcaatcgaatatgttatcgatatagttaatggtttcaagccatga

SEQ ID NO: 43166 - protein, 375 aa, Photorhabdus luminescens subsp. laumondii TTO1
MIKMINFLDLKAINKKYENELKEASSRVIDSGWYIMGKELESFEKEFAEYCGTKHSIGVANGLDALILVLRAWKELGKIKDGDEVIVPANTYIASVLAITANNLKPVLIEPDQNTYNLSPNNIISAITEKTKVILPIHLYGQISPMPEIMKIANEYNLLVLEDSAQAHGAEIVGKKAGSWGNASGFSFYPGKNLGALGDAGAITTNDEELTTTIKALRNYGSHEKYKNIYQGINSRLDELQAAFLSVKLKYLNIETEYRRSIAKHYLENINNPYIKLPITIEQNALHPENHVWHLFVINCSHREKLQQYLFEKGIQTLIHYPIPPHKQTAYSEWNTLNFPITEKIHQQVLSLPLDPTMNIEAIEYVIDIVNGFKP

SEQ ID NO: 43167 - DNA, 1152 bp, Vibrio vulnificus YJ016
  CDS (1)..(1152)
atgtttgagacaaattatatgattccattcaataaacctccagttactggtgaagaacttcaatttattcaggaagctatttcttgtgggaagctttcgggagatggagaattctcaagaaagtgcgaaaattggtttgtatcacatactggtacgactaaagctcttcttactccttcatgtactcatgcgctagaaatggctgcgatgctcatcgatatccagcctggtgatgaagtaataatgccaagttatacattcgttagtacagccaacgcttttgtattaagaggggccaaagtagtatttgtggacattcgagctgatacgatgaatatcgacgaatccaagatagaggtagctatcaccgagcgcactaaggcgatcgtgcccgtacattatgcaggggtggcttgtgatatggacactataatgggtttatctgacaaatatggtttgtatgttattgaagatgcagcccaagggatgatgtcaacttataaaggtcgagcgttaggtagtattggtcatatagggacctatagttttcatgaaaccaaaaattatacgagtggtggtgaaggtggtttactgttggttaatgatcagagtttttctcaacgagcagaaataattagagaaaaaggcactaatcgcaatcagttttttagaggtatggttgataaatatacatgggtagatgttggtagtagtatgttacctagtgaaattcaatctgcttatttatgggcccagttgattaatgctaaaagaattaatgagaagagaattaatgattggaattactattttgatagtttgttacccttgaaggaaaaaggattaattgagttgcccaacattccaattgaatgtacacacaatgctcatatgttctacattaaactaccggacttaacccaaagaacaaggtttattgaagccatgtttaaacaaggtgttctttctgtttttcattatataccattacattcttcgcctgcaggaaaaagttttggtcgattcaatggtaaggatatctatacaaccatggaaagtgaaaaattagttcgcttacctatgttttatggattggctctctcagagagaaataagatcatatctactatttttgatattttggagtcttaa

SEQ ID NO: 43168 - protein, 383 aa, Vibrio vulnificus YJ016
MFETNYMIPFNKPPVTGEELQFIQEAISCGKLSGDGEFSRKCENWFVSHTGTTKALLTPSCTHALEMAAMLIDIQPGDEVIMPSYTFVSTANAFVLRGAKVVFVDIRADTMNIDESKIEVAITERTKAIVPVHYAGVACDMDTIMGLSDKYGLYVIEDAAQGMMSTYKGRALGSIGHIGTYSFHETKNYTSGGEGGLLLVNDQSFSQRAEIIREKGTNRNQFFRGMVDKYTWVDVGSSMLPSEIQSAYLWAQLINAKRINEKRINDWNYYFDSLLPLKEKGLIELPNIPIECTHNAHMFYIKLPDLTQRTRFIEAMFKQGVLSVFHYIPLHSSPAGKSFGRFNGKDIYTTMESEKLVRLPMFYGLALSERNKIISTIFDILES

SEQ ID NO: 43169 - DNA, 1176 bp, Vibrio vulnificus YJ016
  CDS (1)..(1176)
atgttaaataccccattttctccatggccaagcttcactcaagaagaggccgatgcagtgagccgtgtgcttttgtcaaacaaagtaaactactggactggcactgaatgccgagagtttgaaaaagagttcgctgcctgggcaggctgtgaatacgcgattgcgctaggcaatggtacgctagcacttgatttagcgcttaaagccctaggtgttggcgggggggatgaagtgatcactacctcgcgcacctttttagcgtcggcctctgcaattgttactgcgggggcgaatcccgtttttgcggatgttgatcttaacagccaaaatatcaccgcagaaaccatcgatgcagtcgtcacagaaaaaaccaaagccgttattgtggtgcatttggcgggcatgccagcagaaatggacgctattatggcactcgctgccgagcgcggtttctatgtgatcgaagattgcgcgcaagcgcatggcgcaaaatacaaaggtcgcagcgtaggctccattggccacattggcgcttggtcattctgccaagataaaatcatgactactggcggtgaaggtggcatggtcactaccaatgatcaggcactttggtcggcaatgtggtcttataaagatcatggcaagagttacgatgcggtgtacaatcgccagcatcctccgggttttcgctggttgcatgaaagctttggcaccaactggcgtatgacagagctacaagggatcttgggccgaattcagcttcagcgtatggctgagtggacctcaaaacgtcaacataacggcaagttgattgatcaagccgtggcagacctgcctgtggtgcgtcgtgttgaagtggccgattacatagaacatgcagaatacaaacactatttatttgttaaccctgagcagttgaagcaaggttggactcgtgatcgcatcgttgaaacgatcaatgctgctggtgtgcctgcttatcaaggtagttgctcagaaatttaccttgaaaaagcgtttgataacactccatggcgtccagaagagcgtttaaaaaatgcggttactctgggtgaaacaagtttgatgttccttgttcatccgacgttaacaccagcggaaatggaaaaaacaacggctgtagtcagaaatgtgcttctaagcgcatcattgtaa

SEQ ID NO: 43170 - protein, 391 aa, Vibrio vulnificus YJ016
MLNTPFSPWPSFTQEEADAVSRVLLSNKVNYWTGTECREFEKEFAAWAGCEYAIALGNGTLALDLALKALGVGGGDEVITTSRTFLASASAIVTAGANPVFADVDLNSQNITAETIDAVVTEKTKAVIVVHLAGMPAEMDAIMALAAERGFYVIEDCAQAHGAKYKGRSVGSIGHIGAWSFCQDKIMTTGGEGGMVTTNDQALWSAMWSYKDHGKSYDAVYNRQHPPGFRWLHESFGTNWRMTELQGILGRIQLQRMAEWTSKRQHNGKLIDQAVADLPVVRRVEVADYIEHAEYKHYLFVNPEQLKQGWTRDRIVETINAAGVPAYQGSCSEIYLEKAFDNTPWRPEERLKNAVTLGETSLMFLVHPTLTPAEMEKTTAVVRNVLLSASL

SEQ ID NO: 43171 - DNA, 1146 bp, Rhodopseudomonas palustris CGA009
  CDS (1)..(1146)
atgccgcgcgttggattctcggagtggctcgcgttaacgaaggtagtcgctcgcggtcagctgttgcgttaccgcggaggcgagcaaggctacacaacccagttcgagcaaaatctcgaaaagcaaatcggcgtcaagcacgccctaacggtgaacagcggaacaagcgcgctgatctcagcgctcgcagccgcaggtataggtcccggtgacgaggtcctcgttcccgcctatacgtgggtggcgaccgcgatcgccccgctcatggtcggcgctgtcccgatcgtcgtcgacgtcaacgaaagcctgacgatcgatccggaagacatcaagcggaagatcacgccctacaccaaggcgatcatgccggttcacatgctcaatctggtgtgtgacatggactcgatcgtggcgatcgctcgcgagcaccggctcaagatcattgaagacgcatgtcaggctgtcgggctgacctacaaaggacgtcgcgtcggcacgatcggcgacgccggcgcgtatagtttcaaccaattcaagaacctcaattctggcgagggcggcgcggttctgaccaatgatgaccgtctctttacccgggctcgaatgttccacgatgccgggagctacacgcgagaatactcttacgagtccaacgaagcgccgttcaccggcatgaatttcaaggtctcggagctgactggcgcggtccttcacgcccagctgcccaagctcgaccccctgatttctcgcctgcgcgctcgctatccgatcatggtgaagcacttatccaagaccaataagctccgggtctcgccgcacaacgatcctgaaaacgccgccggactgacggtgattctcgacaccgcggaagacgccaagaagttcgcgcagaaccggggtgtcgatcggctgatcgacaccggccgccacgtctataccaattggcggccgatcatgacccagcgcaccttcgatgaccggatgaatccgtggaagtgggccaaacgagacatccaatactcggaagatatgtgcagcaagactctcgacatcctgtcgcgaacctgccgcgtgtctcttgggccgcaatacccgattccgttcatggaatggcgcggacggtccctcctcaaggcggtgtcctag

SEQ ID NO: 43172 - protein, 381 aa, Rhodopseudomonas palustris CGA009
MPRVGFSEWLALTKVVARGQLLRYRGGEQGYTTQFEQNLEKQIGVKHALTVNSGTSALISALAAAGIGPGDEVLVPAYTWVATAIAPLMVGAVPIVVDVNESLTIDPEDIKRKITPYTKAIMPVHMLNLVCDMDSIVAIAREHRLKIIEDACQAVGLTYKGRRVGTIGDAGAYSFNQFKNLNSGEGGAVLTNDDRLFTRARMFHDAGSYTREYSYESNEAPFTGMNFKVSELTGAVLHAQLPKLDPLISRLRARYPIMVKHLSKTNKLRVSPHNDPENAAGLTVILDTAEDAKKFAQNRGVDRLIDTGRHVYTNWRPIMTQRTFDDRMNPWKWAKRDIQYSEDMCSKTLDILSRTCRVSLGPQYPIPFMEWRGRSLLKAVS

SEQ ID NO: 43173 - DNA, 1152 bp, Rhodopseudomonas palustris CGA009
  CDS (1)..(1152)
atgaatcagcatctccgcaacgacccggtgcccttcatcgatgtcggcgctcagcgccgcaggttaggggccggcatcgacgaggcggtcggcaaggtgctgaaccattgccagttcctcaacggtccggaagtgatcgagctggaggcaaagcttgccgcctttgccggcgcgcgccatgtcgtgacctgctccagcggcaccgatgcgctgctgatggtgctgatggccaagggcatcggtcccggcgatgcggtgctgtgcccctcgttcaccttctgcgcgaccggtgaagcggtggcgctgaccggcgcgacgccgctgttcgtcgacgtcgacgaagtcaccttcaatatcgacatcgcctcgctgaagcgcggcatcggtaccgccaagaagctcgggctgaagccgcgggcgatcattccggtcgacctgttcggccaagccgccgatcacaccgcggtcggcgcggtcgcagccgatgaagggctgttcgtgctcgacgacgcggcgcagggctttggcgccagccatcgcggcaagaagctcggcagcttcggcctcgccaccgccaccagcttcttcccggccaagccgctcggctgtttcggcgacggcggtgcaatcttcaccgatgattccgaattcgccgaggcgctgaagagcgttcgcgtccacggccagggcaccgacaaatacgacaacgtccggctcggcctcaccggccgtctcgataccattcaggccgcgatcctgctgcagaagctgacgatcttcgaagacgagatcgcggcgcgcaacgtcgtcgccgagcgctattcgaaggcgctcgccgatgttgtcaccgttccgcggcttgccgaggactgcacctcggtgtgggcgcagtacaccatccggctgccgcatggcgtcgatcgcgatggttttgccgcggcgctgaagacgcaaggcatcccgaccgcgatctactatccgaagtcgatgcatcagcagaccgcgtatcgcggcttcccggttgccgatggcggcctgccggtgtgcgagcggctgtcgcgtgacgtcatcgccctgccgatgcacgcttatctcgacgcgccgacgcaggatcgcgtgatccaggccgtgcgcggcgcgctggggcggtaa

SEQ ID NO: 43174 - protein, 383 aa, Rhodopseudomonas palustris CGA009
MNQHLRNDPVPFIDVGAQRRRLGAGIDEAVGKVLNHCQFLNGPEVIELEAKLAAFAGARHVVTCSSGTDALLMVLMAKGIGPGDAVLCPSFTFCATGEAVALTGATPLFVDVDEVTFNIDIASLKRGIGTAKKLGLKPRAIIPVDLFGQAADHTAVGAVAADEGLFVLDDAAQGFGASHRGKKLGSFGLATATSFFPAKPLGCFGDGGAIFTDDSEFAEALKSVRVHGQGTDKYDNVRLGLTGRLDTIQAAILLQKLTIFEDEIAARNVVAERYSKALADVVTVPRLAEDCTSVWAQYTIRLPHGVDRDGFAAALKTQGIPTAIYYPKSMHQQTAYRGFPVADGGLPVCERLSRDVIALPMHAYLDAPTQDRVIQAVRGALGR

SEQ ID NO: 43175 - DNA, 1155 bp, Geobacter sulfurreducens PCA
  CDS (1)..(1155)
atgattccgctgtcagtgccaacccttaaagggaacgaatggaaatacgtcaaggaatgcctggatacgggatgggtatcctcggccggcaagtttgttgacaggttcgagtcggacttttgcgctttcaccggctcccgccacgcagtggcctgcgtgaacggaacggcggctctccaggtggctctcaggatcgtgggagtctgcgccggtgacgaggtcatcgtgccgaccctgactttcatcgccacggtcaatgccgttacatacctgggcgccgaacctgtgttcatggactgcgatgagttctacaacatcgatgtccgcaagacggccgagtttctcgagcaggagaccgagttcagggacggcagtacctggagccgggtcacgggacggcgaattgctgcgatcgtgccggtccatgtcttcggcaatgccgccagaatgagcgagctcgtagccctctgccgagagcgcaacatcaaggtggtggaggattcgaccgaaagcctcggcaccgtctactgctccggcgagttggacgggaagcacacgggtaccgtgggtgacatggggtgcttctcgttcaacggcaataaaatcatcaccaccggcggcggcgggatgatcgtcaccgatgtccccgaatacgccgagcgggccaggtacctcaccacccaggcaaaggatgacgaggtcaggtacgtccacaatgaagtgggctacaactttcgcctgaccaacgttcaggcggccatcggcgtggcccagttggagctgctccccgaattccttgaggcgaaacgcgccaattatctcgcctaccaggagaggatcgaccgcatcgacggactcatcctggcggaaggccccgcctatgcccgcaacaaccactggatgtacgcgttgcagatagatccggccgtctatggcaaggaccgtgagcagttgatggaatatctgaaaggggagggagtccagacccgtccggtctggtacctgaaccatctgcaggtccccttccgcgactgccggaactatcgcatagaaaaggcgttccagttgctggaggcgaccctgagcatcccgtgcagcgccaacctgagcgaaagcgacatcgacttcgtcgccgaaaggctgcgccgtggctag

SEQ ID NO: 43176 - protein, 384 aa, Geobacter sulfurreducens PCA
MIPLSVPTLKGNEWKYVKECLDTGWVSSAGKFVDRFESDFCAFTGSRHAVACVNGTAALQVALRIVGVCAGDEVIVPTLTFIATVNAVTYLGAEPVFMDCDEFYNIDVRKTAEFLEQETEFRDGSTWSRVTGRRIAAIVPVHVFGNAARMSELVALCRERNIKVVEDSTESLGTVYCSGELDGKHTGTVGDMGCFSFNGNKIITTGGGGMIVTDVPEYAERARYLTTQAKDDEVRYVHNEVGYNFRLTNVQAAIGVAQLELLPEFLEAKRANYLAYQERIDRIDGLILAEGPAYARNNHWMYALQIDPAVYGKDREQLMEYLKGEGVQTRPVWYLNHLQVPFRDCRNYRIEKAFQLLEATLSIPCSANLSESDIDFVAERLRRG

SEQ ID NO: 43177 - DNA, 1092 bp, Geobacter sulfurreducens PCA
  CDS (1)..(1092)
atgattccaatggtagacctcaaggtccagtacctgaaacttaaagacgagatcgaccggggcattctggaagccctggagaagacccagttcatcctcggtcccaacgtgagcgccttcgaggaggaggctgcggcgtacctgggcgtgaagcacgccattggggtagcctccggcaccgacgcccttcatcttgctctggccgcagccggcatcaaggagggtgacgaggtgatcacctcccccttcaccttcatcgcaacggccgaggccattcgctatgtgggggcgacgccggtcttcgtcgacattgacccgcgcacctacaatatcgatccggcagccatcgaggcggccatcacccccaggacccgtgcagtgctgccggtccacctgttcggccagcccgccgatatgggggccatcgaggcgatctgcgccaaacacggcctccttctggtcgaagattgcgcccagtccttcggcgccgccgcggcaggccggatgaccggttccatcggcgctctgggggccttcagcttcttccccagcaagaaccttgggtgctacggcgacgggggcctcgtgacaacctcctgctccgagacggccgagatggtcaaggtgctccgcaaccacgggagcaaggtccgctatcaccattcggtcatcggctacaacagccgcctcgacgagatccaggccgtgatcctgcgggccaagctcaagcatatcgacgagtacaaccagggacggcgccgggtggcgcatctctactcggaactgctggccggcaccggcatcgtcacccccttcgaggacggcaagggcgttcacgtctaccaccagtacacactgctcacggaccggcgcgacgacatcatgaaagccctgaccggggcgggcatcgcctccgccatttactatcccatcccgctgcacaagcaggatgtctttgcagtacagttcgccggcctgaccctcccggtgaccgaggatgcggcggcccgctgcatgtcgctccccatcttccccgagatgaccgaggagcaggtgcgcgaggtggtcggggtcatcaagagcgcgctctag

SEQ ID NO: 43178 - protein, 363 aa, Geobacter sulfurreducens PCA
MIPMVDLKVQYLKLKDEIDRGILEALEKTQFILGPNVSAFEEEAAAYLGVKHAIGVASGTDALHLALAAAGIKEGDEVITSPFTFIATAEAIRYVGATPVFVDIDPRTYNIDPAAIEAAITPRTRAVLPVHLFGQPADMGAIEAICAKHGLLLVEDCAQSFGAAAAGRMTGSIGALGAFSFFPSKNLGCYGDGGLVTTSCSETAEMVKVLRNHGSKVRYHHSVIGYNSRLDEIQAVILRAKLKHIDEYNQGRRRVAHLYSELLAGTGIVTPFEDGKGVHVYHQYTLLTDRRDDIMKALTGAGIASAIYYPIPLHKQDVFAVQFAGLTLPVTEDAAARCMSLPIFPEMTEEQVREVVGVIKSAL

SEQ ID NO: 43179 - DNA, 1185 bp, Geobacter sulfurreducens PCA
  CDS (1)..(1185)
atgaaccctaatgcaagtttcgacaatatgactgaatccagcgcccccccttcattcaaggaaaaactccacgttgggcgccccaatgtcggcaatcgggaagcacttcttgcccgcatcaacgacatgctcgaccgccgttggctcaccaataacggtccttttgtccaagagctcgagcaaaaaatgagtgagtttctcggcgttcgaaactgcatcgccatgtgcaatgcaaccatcgccctcgagatcaccacccgggcactcggcatgagcggcgaggtgatagtgcctccgttcactttcgtggcgaccgctcacgctttgcaatggcaggagataacccccgtattctgcgacatcgacccgacgacccaccatatcgatcccaagaagatcgaatcaatgatcacgccccgcacaaccggcatcgtcggagttcatctctggggacgcccttgtgcagtcaacacccttacggagatagcagcaaaacataagttaaaacttatcttcgacgcggctcacgctttcggctgctcgcacggcggccgaatgataggcggcttcggcgacgcagaggtgttcagcttccatgccaccaagttcttcaataccttcgaggggggactcgtcgcaaccgacaatgacgagttggcccagaagatcaggctcatgaagaacttcggcttcgagggttacgacaacgtcatctatattggcaccaacggcaaaatgacggagatctgcgcggccatggggctcacgaaccttgaaagcctcgacgagttcatccagaccaaccacaccaactattaccgttatcgtcaggggctctccgggctgccgggcgtgtcggtgattgagtacaacgaggccgaacggaacaattatcaatacgtggtactggagatcgacgagaagatggcgggagtatccagagatcgtttggtagaggcactccatgcgaaaaacgtcatcgcccggaggtatttctacccaggctgccaccggatggaaccgtatcgctcgtactttccacactcacggctgctcctgccgaagacagaaagattggcgagacgggtcatgctgctgccgacgggcacggcagtcgaactggagcatattgatgcaatctgcgttctcataaaacgaatcatcaacggctccatactctcctag

SEQ ID NO: 43180 - protein, 394 aa, Geobacter sulfurreducens PCA
MNPNASFDNMTESSAPPSFKEKLHVGRPNVGNREALLARINDMLDRRWLTNNGPFVQELEQKMSEFLGVRNCIAMCNATIALEITTRALGMSGEVIVPPFTFVATAHALQWQEITPVFCDIDPTTHHIDPKKIESMITPRTTGIVGVHLWGRPCAVNTLTEIAAKHKLKLIFDAAHAFGCSHGGRMIGGFGDAEVFSFHATKFFNTFEGGLVATDNDELAQKIRLMKNFGFEGYDNVIYIGTNGKMTEICAAMGLTNLESLDEFIQTNHTNYYRYRQGLSGLPGVSVIEYNEAERNNYQYVVLEIDEKMAGVSRDRLVEALHAKNVIARRYFYPGCHRMEPYRSYFPHSRLLLPKTERLARRVMLLPTGTAVELEHIDAICVLIKRIINGSILS

SEQ ID NO: 43181 - DNA, 1149 bp, Bdellovibrio bacteriovorus HD100
  CDS (1)..(1149)
atgtttagtgatgtaatcgcttttattcaggatctgtacggtagtaagagttttattcccttacatgctcctatttttacggggaatgaaaaaaaatatgtaattgaagcaattgactccacatatgtctcatcagttggagcatttgtagatcgctttgaggtggattttgcgaaatatgttggtgcgaagaaagctgtcgttactggaaatggaacctctgctcttcatgctgctctacatttattgggtgtatctcgcggagatgaagtcattacccaagctctaacatttgtagcaactccgaatgcgatttcatattgtggagctagtcctgtatttctcgatagtgatgagttgacattagggctttcagtaacgtcattggcagaatttttattccagaatgccgaggtaagaggggacttttgttataacaaaagaactggaaatcgtataatggcctgcatgcctatgcatgtttttggccatccggttcaaatcaaggaaatagtcaagctatgtgatgaatattcaattccggtgattgaagatgctgcagagtcattaggtagtgagttcgaaggacggcatacggggttatacggccgaattggggtgtttagttttaacggtaataaaataattacctccggtggtggaggaatgcttgttactaatgatgtggatctaggtattcgcgcaaagcatttaactactacagcaaaagtgccgcatgcttgggagttctttcatgatgaaatcggatttaattatagaatgccgaacttaaatgctgcattgattgtgggtcagttggagcagctgcctagattcgtaagggataaacgagaaacagctcagatttataattcttatttttctcataagggtattgaatttgtgtgtgaaccttttggggcgaagtccaactattggcttaatgccattcttttgagtagtagatctgaacgcgattcgtttctgaatgagacgaatagaagtggtgttatgacgaggccagtatggaatttaatgcccgatcttcctatgtatcgcactaatttgtgcggtgacatatctgtggcacgaatgctgtctgatcggctcgtaaacattccaagcagtgtaaggcttcctcgaggttaa

SEQ ID NO: 43182 - protein, 382 aa, Bdellovibrio bacteriovorus HD100
MFSDVIAFIQDLYGSKSFIPLHAPIFTGNEKKYVIEAIDSTYVSSVGAFVDRFEVDFAKYVGAKKAVVTGNGTSALHAALHLLGVSRGDEVITQALTFVATPNAISYCGASPVFLDSDELTLGLSVTSLAEFLFQNAEVRGDFCYNKRTGNRIMACMPMHVFGHPVQIKEIVKLCDEYSIPVIEDAAESLGSEFEGRHTGLYGRIGVFSFNGNKIITSGGGGMLVTNDVDLGIRAKHLTTTAKVPHAWEFFHDEIGFNYRMPNLNAALIVGQLEQLPRFVRDKRETAQIYNSYFSHKGIEFVCEPFGAKSNYWLNAILLSSRSERDSFLNETNRSGVMTRPVWNLMPDLPMYRTNLCGDISVARMLSDRLVNIPSSVRLPRG

SEQ ID NO: 43183 - DNA, 1137 bp, Bdellovibrio bacteriovorus HD100
  CDS (1)..(1137)
atgaaaattccattcaatctaccgcctaaaagctcgaacgaagagaagtacatttctcaagccatctccaacaaaaaactcagtggagaaggtcagttcaataaaaaatgcacggaatggttcaacaagaaccttccaaccttgatgaccgtcatcaccccgtcttgcacctcggctctggaaatggccatggttttggccgatatcggtccgggcgatgaagtcatcctgccatctttcactttcacttccactgccaacgttgtcgccctgtatggcgccatcccggtttttgtcgacgtggaccccaagaccatgaacatcgatgtcgatgccattgccaaagccatcaccgcccgcacacgcgtgatcatgccggttcactatgccggcgtgggctgcgagatggacaaaatcatggaccttgcgaacaagaacaacatctgggtggttgaagacgcggctcagggcatctttgcttcctacaagggcaaagccttgggagcttggggccatatggccgctttcagcttccatgaaaccaaaaatatcgtctgcggcgaaggcggtgccttgaccatcaacgatccccgtctggtggcgcgcgctgaaatcgtgcgcgacaaggggaccaatcgccagcaattcctgaacggccaagtcgacaaatacacctggcaggacaaagggtcttcctatctgctgtccgagctttcagctgcttttcttttgtcccaactggaagagggcgaaaaaatcacggcccgccgtatggcgatctggaagcagtactatgccggcatggcggatctggaagctgctggcaaagtccagcgcatgaccgtgcctgcggaggccaaagccaacgcgcatatcttctatttcctgctacctactatgcagacgcgcattgagctatggacccacctgaaagaagccggaatccagtccacattccattatgtgcctttgcattctgctccggcgggtttgaaatacggcaaagtcagcggcagcatggctgtcactgatgatcactcagcccgtttgctgcgactgcctttgtgggcggacatgacagcggcggatgctcagttcgtcctggacgaagttaataaattttttaaggggaaataa

SEQ ID NO: 43184 - protein, 378 aa, Bdellovibrio bacteriovorus HD100
MKIPFNLPPKSSNEEKYISQAISNKKLSGEGQFNKKCTEWFNKNLPTLMTVITPSCTSALEMAMVLADIGPGDEVILPSFTFTSTANVVALYGAIPVFVDVDPKTMNIDVDAIAKAITARTRVIMPVHYAGVGCEMDKIMDLANKNNIWVVEDAAQGIFASYKGKALGAWGHMAAFSFHETKNIVCGEGGALTINDPRLVARAEIVRDKGTNRQQFLNGQVDKYTWQDKGSSYLLSELSAAFLLSQLEEGEKITARRMAIWKQYYAGMADLEAAGKVQRMTVPAEAKANAHIFYFLLPTMQTRIELWTHLKEAGIQSTFHYVPLHSAPAGLKYGKVSGSMAVTDDHSARLLRLPLWADMTAADAQFVLDEVNKFFKGK

SEQ ID NO: 43185 - DNA, 1176 bp, Treponema denticola ATCC 35405
  CDS (1)..(1176)
atgcaagatgttcaggctaaaaaaacaattcctttttttactccttccttttctgaagaagaagaaaaagctttgatgagggtactccgctcagggtggcttactacggggaaggaaacccttgagtttgaaaaagaatttgcttcctttacgggaagtaagactgcccttgccgtaaactcggcttcaagcgggctcatgcttgcaatggatgcctgcggtataaagagcggaaccaaaatcttgacaagtccctatacctttatttcgactgcaacctctgccctgcacttaggcggcgatgtagtttatgccgatatcgaaaaagattcttacagtatagaccctgaaaaaatcgaaactacattaaaaaaagataagaacgtaaaggccattgttccgattcatattgcgggaaatgtttgtaatatgaaggcgataaatgaccttgcaaaaaaatattccgttgccgtgatagaagatgcggctcatgcttttccttcaaagactaaagaaggttatgccggaactctcggtacctgcggcgttttttctttttatgcgacaaagacgattacgacaggcgagggcggaatgatttgtactaacgatgaaaaaattgcagagcgtataaaacttatgcgttctcacggtataaaccgcacaatctgggacaggtacaccgacacaaaggcttcatggaagtacgatgttacggctgagggctggaagtgtaacctgcccgatattctttctgcaataggaagagtgcagcttaaaaaggctaaaactttttttgagcagcgtaaaaaaattgcccaaaaatataatgcagcatttgcagggaacgattcttttattcttcctcccgatggagaaggaaatgcttggcatctttatattttgcggcttaaccttgaagctttaaaaataggaagagatgagtttggtcaagccttacaagaaagaggtttgggtatttcgatgcactttatacctcattttgaaatgtcttatataaaagaaagatacggtttaaatagtttcgattttccggaatcgaataaaaaatatttgcaaagtttgagtttgcccttttatccttcaatgagtgaagacgattccgattatgttatcgaaacggtaattaaacttgcaaaattgaataggcgttaa

SEQ ID NO: 43186 - protein, 391 aa, Treponema denticola ATCC 35405
MQDVQAKKTIPFFTPSFSEEEEKALMRVLRSGWLTTGKETLEFEKEFASFTGSKTALAVNSASSGLMLAMDACGIKSGTKILTSPYTFISTATSALHLGGDVVYADIEKDSYSIDPEKIETTLKKDKNVKAIVPIHIAGNVCNMKAINDLAKKYSVAVIEDAAHAFPSKTKEGYAGTLGTCGVFSFYATKTITTGEGGMICTNDEKIAERIKLMRSHGINRTIWDRYTDTKASWKYDVTAEGWKCNLPDILSAIGRVQLKKAKTFFEQRKKIAQKYNAAFAGNDSFILPPDGEGNAWHLYILRLNLEALKIGRDEFGQALQERGLGISMHFIPHFEMSYIKERYGLNSFDFPESNKKYLQSLSLPFYPSMSEDDSDYVIETVIKLAKLNRR

SEQ ID NO: 43187 - DNA, 1107 bp, Treponema denticola ATCC 35405
  CDS (1)..(1107)
atgtatatcccttttttatcattgcaaaaaataactgaaagctttgaaccgtatctctcgcaaaaaataaatgaggttgtaaaaaaaggctggtatattcacggagaggaatgtaaagcatttgaaaaagagtttgcagaattttgcggagttaagtattgcattggtgtaggaaacggtcttgaagctttaaaattgattctccgtgcttacaagttgcttggtgtttttcaagaaggtgatgaaattattgttccgtcaaacacttttatagctactattcttgcagtgagtgccgaaaatttgacgcctgtttttgttgaaccggatataaatgattatttaattgacgtagaaaaaatagaagataagataagttcaaaaacaaaggctattatgccggtgcatttatacggcagactttgtaatatggaggctattactgcctttgcaaagcagcacaacttaagagtgattgaagatgcggctcaagcacacggcgcaaaacaaaccgaaaaacgaagcggagctttcggcgatgccgcaggttttagtttttatccgggtaaaaatttgggctgtttaggcgacggcggctgcgttacaactgattacgacgaacttgcagatgtcgtacgaaagctggcaaattacgggtcaagtataaaatacgtgcacgaatataagggagaaaattcccgtcttgacgaaatacaggccgccgtgctctcggtaaaactgcaaagacttgatgcggacaataatcgccgccgtcaaatcgcagcgatgtataatgccggaataaaaaataaagctgttattttacctaaactgcaccaaaaagaagaacacgtgtggcatatctattgcgttcgagttcaaaacagaaaagccttcattaattatttaaaagattgtggaatagagacggttattcattatccgactccgccccataaacaaaaagcatataaagagttttctcatctttacttaccgataagtgaaaaaatacatgcagaagtggttagtcttccgatgagccctttattaaccgatgaggaagttaattacgtaattgaaaaagtaaacgaatggaaaaactga

SEQ ID NO: 43188 - protein, 368 aa, Treponema denticola ATCC 35405
MYIPFLSLQKITESFEPYLSQKINEVVKKGWYIHGEECKAFEKEFAEFCGVKYCIGVGNGLEALKLILRAYKLLGVFQEGDEIIVPSNTFIATILAVSAENLTPVFVEPDINDYLIDVEKIEDKISSKTKAIMPVHLYGRLCNMEAITAFAKQHNLRVIEDAAQAHGAKQTEKRSGAFGDAAGFSFYPGKNLGCLGDGGCVTTDYDELADVVRKLANYGSSIKYVHEYKGENSRLDEIQAAVLSVKLQRLDADNNRRRQIAAMYNAGIKNKAVILPKLHQKEEHVWHIYCVRVQNRKAFINYLKDCGIETVIHYPTPPHKQKAYKEFSHLYLPISEKIHAEVVSLPMSPLLTDEEVNYVIEKVNEWKN

SEQ ID NO: 43189 - DNA, 1116 bp, Bacillus cereus ATCC 10987
  CDS (1)..(1116)
atgggagacagaatatttctttcatcaccacatatgagtgatgaagggtatgaaatgcattatgttaaggaagctttcgatacaaattggattgcaccacttggggaaaatgtaaacgggtttgaaagagaactagccgagaaagttggttctaaagaagctgcagcactgtcttctgggacagctgcaattcatttggctttaaaagcagcgggagtaggggagggagatattgttttctgccaaacacttacattctcagctactgccaaccctatcatttatcaaaatgctactcctgttttcatagatagtgactatgaaacttggaatatgtgtcctaaagctttagaagaagcttttaaaaaatatccgaacgtaaaggcagttatcgtagttcatttatacggtctttcagcagatatggataagattgttgcactttgtaaaaagtatgatgtggctttaattgaagatgctgcagaatctttaggaacgtactataaagggaagcatactggaagttttggtgattatggtattttctcttttaatggaaataagattattacaacctctggtggtggtatgctcgtttctaataatgaagaaagagtttcaaaggtaaggttctgggctactcaaagtagagatcaagcgagacattaccaacatagtgaattaggttttaactatcgcatgagtaatgtagttgctggtattggtagagggcagcttaaagtattagatcaaagggttcagaagaaaagatacatatttaatttttataagagagaattagaagggcttgaaggtattgaatttatgcctagtaatgagtggaacgaaccaaactattggctaagttctatgacactaaacggtaagattcgcccaattgatgtaatggaagctcttgaaaaagaaaatattgaatctagaccagtttggaagccaatgcacttgcaaccattctttgagaaatatgattttgttggtacagatgtgtcggagaaactttttgagaatggtgtttgcctaccaagtgatacaaaaatgacagataaagacttagatagagttgtgaaaattattaaagggttgtggatagtgtaa

SEQ ID NO: 43190 - protein, 371 aa, Bacillus cereus ATCC 10987
MGDRIFLSSPHMSDEGYEMHYVKEAFDTNWIAPLGENVNGFERELAEKVGSKEAAALSSGTAAIHLALKAAGVGEGDIVFCQTLTFSATANPIIYQNATPVFIDSDYETWNMCPKALEEAFKKYPNVKAVIVVHLYGLSADMDKIVALCKKYDVALIEDAAESLGTYYKGKHTGSFGDYGIFSFNGNKIITTSGGGMLVSNNEERVSKVRFWATQSRDQARHYQHSELGFNYRMSNVVAGIGRGQLKVLDQRVQKKRYIFNFYKRELEGLEGIEFMPSNEWNEPNYWLSSMTLNGKIRPIDVMEALEKENIESRPVWKPMHLQPFFEKYDFVGTDVSEKLFENGVCLPSDTKMTDKDLDRVVKIIKGLWIV

SEQ ID NO: 43191 - DNA, 1104 bp, Methanococcus maripaludis S2
  CDS (1)..(1104)
atgatacctattgcaaaacccatactaggtaatgaagagatttctgcagtaactgatgtgttaaaaagcggaatgattgcacagggtaaagaagttgaattgtttgaacgtgaattttgtgagtatcacaacgtaaaatatggtcttgcagtttctaatgggacaacggctttagacgtcgcattaaaatcgttaaaagttagttctggagacgaagtaataacaacgccctttacatttattgcttcatcaaattgtattttatatcagggtgcaaagactgtttttgcagatattgatgaaaaaacatttaacatcgatccaaatgaagttttagaaaacattaattcgaaaacgaaagcaataattgcagttcacctctatggtcaacctgcagatatgaaagcacttagggaaattgcagacgatcacaagctatttttaatcgaggatgctgcacaagctcacggcgcagaatttgaaggcaaaaaaattggaaattttggagatattacaacatttagtttttaccctacaaaaaatatgacaagtagcgagggagggatggttgtaactaataatccagaaatcgcaaaaatttcagatttaataagaaatcatggtcaggctgaaaagtacttacatacagctttaggttataattttagaatgacaaatatttcagcagcaatagggagagttcagcttaaaaaagttgaagaatggactgaaaaaagaattaaaaatgcaaaagaattatctaaacgactttctaaaattgatggtctgtctattccatatttggacaaacgtgtaaggcacgtatttcaccagtatgttttaagggttgaagctgatttttcattatctcgagacgaattttccaggtatttaaacgaaaatggggtaggtacgggtattcattatccaattccggttcataaccagccagtttatcaaaacttgggatatgataaagatgaatgtccaaattcaatagatgctgcaaaaaaggttttaagccttccagtgcatccttctgtatctttagatgatattgaatatattacacaaaaaattgaaaatcgtggaggtgttaattaa

SEQ ID NO: 43192 - protein, 367 aa, Methanococcus maripaludis S2
MIPIAKPILGNEEISAVTDVLKSGMIAQGKEVELFEREFCEYHNVKYGLAVSNGTTALDVALKSLKVSSGDEVITTPFTFIASSNCILYQGAKTVFADIDEKTFNIDPNEVLENINSKTKAIIAVHLYGQPADMKALREIADDHKLFLIEDAAQAHGAEFEGKKIGNFGDITTFSFYPTKNMTSSEGGMVVTNNPEIAKISDLIRNHGQAEKYLHTALGYNFRMTNISAAIGRVQLKKVEEWTEKRIKNAKELSKRLSKIDGLSIPYLDKRVRHVFHQYVLRVEADFSLSRDEFSRYLNENGVGTGIHYPIPVHNQPVYQNLGYDKDECPNSIDAAKKVLSLPVHPSVSLDDIEYITQKIENRGGVN

SEQ ID NO: 43193 - DNA, 954 bp, Gibberella zeae PH-1
  CDS (1)..(954)
atgagacaagtgtacctacccttttccaaggctgagatagacgaggacaccattgccgacgtcggtcacgtcctgcgttctggctggctcaccaatgggccaaaggtggaggaatttgaaaagatgctatcggattactttggaggacgacaagtgcggacattcaactctggcacaagcagcctggaaatagggctgcgggttgcgggtattcgccctggagaccatgtcatcacaacacccatctcatgggttgccaccgcaaatgtcatactggccatcggggccacgcctgtgtttgcagatatcgacagaaagacacgaaatatagacttggaacaagttgagaaagccattacccaacgcacgaaagctatcattcctgtccacctggcaggacggccggttgacatggatcgtctctatgatttggccaataagtataacctaagggtcattgaagatgctgctcaagcgattggttccacatggaagggaaagcgaattggttcattcggcgacatcgtctcgttcagctttcaggctacaaagaatatcacaactggcgaaggtgggtgtcttgtactcaacgacgaaaaagaagccgctctagccgagaagttgcggttccagggtatggtgcgaagcggctacgacggcatggaagttgatgttctgggcggcaagcataacatgaatgaaattgcagcgacaatcggactcggtcaatttggacgtctagaggaaatcacagccaagcgtcatgctcttgctcagcattatttcacttctttcggtccggattttgagcagggtttcagggaaggcatgtttcccgtcgctgagcaggttggacgctctatagtgacactacccatgttcccatcaatggccgagtctgatgttgaacgtgtggttttcgctgttagagatgtatttgagacgcataggtag

SEQ ID NO: 43194 - protein, 317 aa, Gibberella zeae PH-1
MRQVYLPFSKAEIDEDTIADVGHVLRSGWLTNGPKVEEFEKMLSDYFGGRQVRTFNSGTSSLEIGLRVAGIRPGDHVITTPISWVATANVILAIGATPVFADIDRKTRNIDLEQVEKAITQRTKAIIPVHLAGRPVDMDRLYDLANKYNLRVIEDAAQAIGSTWKGKRIGSFGDIVSFSFQATKNITTGEGGCLVLNDEKEAALAEKLRFQGMVRSGYDGMEVDVLGGKHNMNEIAATIGLGQFGRLEEITAKRHALAQHYFTSFGPDFEQGFREGMFPVAEQVGRSIVTLPMFPSMAESDVERVVFAVRDVFETHR

SEQ ID NO: 43195 - DNA, 1104 bp, Leptospira interrogans serovar Copenhageni str. Fiocruz L1-130
  CDS (1)..(1104)
atgataaatattccttatataaatttagttgagcagtggaaaaacgaacgggaagaattacttccggttcttgattccgttttaggttccggtcagtacattggtggacaagaagtcgcaaagtttgaagaggatgtcgcaaagttctgcggagtgaaatacgcggttgctttaaatagtggaaccgatgcgctcgtatgtggacttttagaacttggtattcaaccgggcgatgaagtgattactcctccaaactcttttattgcttctacggcttcgattgttcatataaaagcgaaaccagtatttgtcgatgtaggagaggaccagaatctagatccggaaaaattggaaaaggctatcacgtctaaaacaaaagcgattatgcctgttcatctaactggccgggttgccgcgatgaatgaaattatgaggattgcagacaaatattctatacccgtaattgaagatgcagcacaatctattggttctaaatatgatggtaagtttagtggttctattggtaaaattggatgtttctctacccatccattaaagaatttaaatgcttgcggtgatggtggatttttgacaacaaatgatgagaagatttataactctgtaagtagggttagaaatcatggtctaattgataggaatactgtcggtgaatttggttttgtaacgagaatggatgcaattcaggcggcgattttaaatttccgtttaacgcgtttgccgcaagttattgaaaaaagacgtcagaatgcacaactttataaaaccttattagataaaaggaatgtttttatcccggaagataaacctttagaatttaatacttatcatactttcgtaatacaagtcgaaagaagagatgaattaaaagattatttattttcacaggggattgagacatccattcattatccgattcccatccatcttcaacccgctagtaggaatcttggatataaacagggagacttccctattacggaaaaacaagcgggccgaattttaactttgcccattcatcaatatttgaaagatgttgacttacataaaattgcccaagcggttaatcgtttctacgaatcgtaa

SEQ ID NO: 43196 - protein, 367 aa, Leptospira interrogans serovar Copenhageni str. Fiocruz L1-130
MINIPYINLVEQWKNEREELLPVLDSVLGSGQYIGGQEVAKFEEDVAKFCGVKYAVALNSGTDALVCGLLELGIQPGDEVITPPNSFIASTASIVHIKAKPVFVDVGEDQNLDPEKLEKAITSKTKAIMPVHLTGRVAAMNEIMRIADKYSIPVIEDAAQSIGSKYDGKFSGSIGKIGCFSTHPLKNLNACGDGGFLTTNDEKIYNSVSRVRNHGLIDRNTVGEFGFVTRMDAIQAAILNFRLTRLPQVIEKRRQNAQLYKTLLDKRNVFIPEDKPLEFNTYHTFVIQVERRDELKDYLFSQGIETSIHYPIPIHLQPASRNLGYKQGDFPITEKQAGRILTLPIHQYLKDVDLHKIAQAVNRFYES

SEQ ID NO: 43197 - DNA, 1101 bp, Leptospira interrogans serovar Copenhageni str. Fiocruz L1-130
  CDS (1)..(1101)
atgcaagtaagatattcatatttaaaacaacaatttgaaaattgcgatgatctttgggatgaattaaaaaggtttgttccgacaggagattttactttagggaaacctttaattgaatttgaaaatcaattctctaagttaatcggtgcaaagtatgcgataggggtgaattcgggtacggatgctattaaactttccttaaaagctcttggcgtaggatttggtgacgaagtaattacgacggcaaatacatttgtagcaacagtgggggcgattgctgaactcggagccattccggtgttcgtagattgcgatgatactttttgtatgaatgtagatttattggaaaaagtcattagtaaaaaaactaaagctatagttcctgttcatttcacaggttatatgactgatatgagaaaattgatgcccatagcaaaaaagtataacctgcctgtagtagaagatgcttgtcagtctatcctaggggcaatcgagaacaaaaaagctgggacttggggaaatacgggagccttctctcttcatcctttaaaaaatttgaatgtttggtcggatggaggtgttattgttacggatgacgaggaacttgcaaaaaatctacgattacttagaaatcacggtttgatcgatcgtgataacgttgaaattttaggatgtaattctaggttagataccatacaagctgtcgttggcaattggcttattcctaatgcagtagctatttcaaataaacgtattgaaaatgcgaattattatgatcaacatttaaggagtatttctcaaattactcttcccccaagacccaaagattttaggatcgtttatcatttatatatcgtttttgcagagaatcgggatcatctcttagattattgtataaaaaaaggaatagaggctaaggtacattatccgattccaatttatagacaaaaggcactaacagcctatggatataaagaaggtgattttcctgtaacggacgcacatacaaaaaagattattacattcccttgtgatcaacatctttcaaaggaagaaatggattatgttgtttctattataaaagaattctattctaagtaa

SEQ ID NO: 43198 - protein, 366 aa, Leptospira interrogans serovar Copenhageni str. Fiocruz L1-130
MQVRYSYLKQQFENCDDLWDELKRFVPTGDFTLGKPLIEFENQFSKLIGAKYAIGVNSGTDAIKLSLKALGVGFGDEVITTANTFVATVGAIAELGAIPVFVDCDDTFCMNVDLLEKVISKKTKAIVPVHFTGYMTDMRKLMPIAKKYNLPVVEDACQSILGAIENKKAGTWGNTGAFSLHPLKNLNVWSDGGVIVTDDEELAKNLRLLRNHGLIDRDNVEILGCNSRLDTIQAVVGNWLIPNAVAISNKRIENANYYDQHLRSISQITLPPRPKDFRIVYHLYIVFAENRDHLLDYCIKKGIEAKVHYPIPIYRQKALTAYGYKEGDFPVTDAHTKKIITFPCDQHLSKEEMDYVVSIIKEFYSK

SEQ ID NO: 43199 - DNA, 1116 bp, Thermus thermophilus HB27
  CDS (1)..(1116)
atgaactctaatggctatcattctatgaaggctatccccgtttacgacccccttcccgaggtagaagccctctggcccgagctagaagaggccttccgccgggtcatgcattcggggcagtacatcctaggccctgaggtggaagcctttgagcaagaggtggcggcttacctcggggtgaagtacgccattggggtgaactcgggcacggacgctctggtcatcgccctccgggctttgggcgtgggcccgggggacgaggtgatcaccacccccttcaccttctttgccaccgccgaggccatcagcgccgtgggcgcgaccccggtcttcgtggacatagatccgaagaccttcaacatcaaccccgacctgatagcccccgccatcaccccacgcaccaaggccatcctccccgtgcacctctacggcctccccgcagatatggacaccatcctggaaatcgcccgctcccacggcctcaaggttctggaggactgcgcccaggccttcggggccacctacaagggcaggaaggtgggtaccctgggggatgccggggccttctccttcttccccaccaagaacctggggggatacggagacggcgggctcatcgccacgaacagcgatgaggtggccgagatggcccgcatgctccgggcccacggctctcgcaggaagtaccacaacgagatggtcggctacaactccagactggacgccttgcaggccgccttcctccgggtgaaactcaagcacgtggatgctttcaacgcccgccgccgggaagtcgcggcccgttacaacgatcttctccaaggggttccgggcctggtcttgccccccttgacagaggggcatgtcttccaccagtacaccgtccgcattcccgtaggacgggaccaggtagccgaggagctggcaagcaaggggattggcaccatggtgtactacccggtacccctccaccggcttccggtctacgggtatccagaaggcaccttccccgaggccgaacgggcaagccgggaggtcctctccttacccatgggcccctttctgggtccccagaacgagcacgtggcctcgctactgcgagagattctcgcatga

SEQ ID NO: 43200 - protein, 371 aa, Thermus thermophilus HB27
MNSNGYHSMKAIPVYDPLPEVEALWPELEEAFRRVMHSGQYILGPEVEAFEQEVAAYLGVKYAIGVNSGTDALVIALRALGVGPGDEVITTPFTFFATAEAISAVGATPVFVDIDPKTFNINPDLIAPAITPRTKAILPVHLYGLPADMDTILEIARSHGLKVLEDCAQAFGATYKGRKVGTLGDAGAFSFFPTKNLGGYGDGGLIATNSDEVAEMARMLRAHGSRRKYHNEMVGYNSRLDALQAAFLRVKLKHVDAFNARRREVAARYNDLLQGVPGLVLPPLTEGHVFHQYTVRIPVGRDQVAEELASKGIGTMVYYPVPLHRLPVYGYPEGTFPEAERASREVLSLPMGPFLGPQNEHVASLLREILA

SEQ ID NO: 43201 - DNA, 1134 bp, Desulfovibrio vulgaris subsp. vulgaris str. Hildenborough
  CDS (1)..(1134)
atgagcactcccctccgtctttcccgttccatcgtcggacaggccgaagccgaggccgtaagccgcgtcatcatcgaagacggctaccttggcatgggcagtgaagtgaaacgcttcgaagaggacatcgccgcctttctcggcgtgcctgcgaaccatgtcatcaccgccaacaccggtaccgccgccctgcaccttgccgtgcaggcagccgtggaaccggggcgcgaggtgctggtgcagtcgctgaccttcgtggcgtcgttccaagccatctccgcagccggggccgtgcccgtggcctgcgaggtgcgccccgagacctgcaccatcgacctcgatgacgccgcccgtcgcctcaccgacaagaccgcggccatcatgcccgtgcactacgccagcaaccccgcctacctcgacgacgtctacgccttcgcccagcggcacgggctgcgcgtcatcgaagacgcggcccatgccttcgggtgccgccacgacggcaggctggtgggcacgttcggcgacatcgcctgtttcagcttcgacggcatcaagaacatcaccagcggcgagggcggctgcatcgtcaccgccgaccagaccgtggcccagcgctgccgcgacgctcgtctcctgtccgtggagaacgacaccgagaagcggttcaccgggcagcgaagctgggacttcgatgtcacccgtcaggggtggcgctaccacatgagcaacctcatggccgccatcgggcgtgtgcagctgtcgcgcctgcccggcgagttcggccctgcacgcaaggcgctggccgccatctaccgtgaagaactcgcgggcgttcccggcgtaaccctgttcgcaactcggccggaggatgacatcatcccccatatcttcgtggtgcgcatcgacgccgcgcggcgtgacgccgtgaaggaggtgcttgccgccgcgggcgtgcccaccggcatgcactacaagcccgcgcatctgctctccttctatggcggcgggcgcacctgcctgccggtgacagaggccctgtatcacgagatagtgaccctgccgctgcaccccggcatcaccgccgaagaggtgcgcgtcatctgcgccgaactgcgcaaggcccttgccgcctga

SEQ ID NO: 43202 - protein, 377 aa, Desulfovibrio vulgaris subsp. vulgaris str. Hildenborough
MSTPLRLSRSIVGQAEAEAVSRVIIEDGYLGMGSEVKRFEEDIAAFLGVPANHVITANTGTAALHLAVQAAVEPGREVLVQSLTFVASFQAISAAGAVPVACEVRPETCTIDLDDAARRLTDKTAAIMPVHYASNPAYLDDVYAFAQRHGLRVIEDAAHAFGCRHDGRLVGTFGDIACFSFDGIKNITSGEGGCIVTADQTVAQRCRDARLLSVENDTEKRFTGQRSWDFDVTRQGWRYHMSNLMAAIGRVQLSRLPGEFGPARKALAAIYREELAGVPGVTLFATRPEDDIIPHIFVVRIDAARRDAVKEVLAAAGVPTGMHYKPAHLLSFYGGGRTCLPVTEALYHEIVTLPLHPGITAEEVRVICAELRKALAA

SEQ ID NO: 43203 - DNA, 1182 bp, Desulfovibrio vulgaris subsp. vulgaris str. Hildenborough
  CDS (1)..(1182)
atggaactcaaggtcaatttcagcggtcgcgccctcaggtacaccgaagaggaaatcgccaccgtggtggacgccatgcgcaatgcggagacgctcacgcagggccgctacatgcaggaattccagcagaggttctcccggttcatcggtgtggagcacagcttcgcagtcatgaacggcgtctcggcactggagctttcggcccagctttgccgcttccgccccggtgacgaggtcatcatcccgtcacacaccttcaccgcttcggcctatcccttcgccaagaagggggcgaaactggtgtgggccgacatcgacctcgccacccgcgtcgtcaccgccgagagcatcgagaaggtgctcacgccgcgcaccagggccatcgtcgtggtgcacctgtacggctacgtggccgacatgcccgccatcatggacctcgcgcgcaggcacaacctgctggtcgtcgaagacaccgcgcagtccatcggcgcggacatcgacggcgtcatgtccggtgccttcggcgacttcgccatctattcgttccattcgcacaagaacatgaccaccctcggcgaggggggcatgctcgtggtgaaggaccccgcactggcgaagctggtgcccgccctgcgccacaacgggcattgcggcttcgacttcgagcgccccgactactggaagcccgccatgggcaacgtggacatgcccgaaatcgatggcgagttcctgtggcccaacaactactgcatcggcgagatagagtgcgcgcttggcatcaaacagcttgaacgcgtctcccgcatcaacgccgagaagcgcgaacgcgccatacgcttcatcgacgcgctggcggactaccccgaactcgaattccaccgggtggacaccacccgccacaactaccacctgctggccgcccgcatgaccaacggcaggcgcgacgacttcatccgcgccatgcatgacgagaagggcgtgaagtgcgtggtgcagtactacccgctcgaccgttacccgttctacaagaaactgggcttcggcacggcggactgccccaacgccgacctcttcttcgacaacatggtctccttcccgttccagcactggctgacagaaggcgagttcgaccacatgctcgcctcgaccatcgacgtgctcgaaaccctccgcaagggatag

SEQ ID NO: 43204 - protein, 393 aa, Desulfovibrio vulgaris subsp. vulgaris str. Hildenborough
MELKVNFSGRALRYTEEEIATVVDAMRNAETLTQGRYMQEFQQRFSRFIGVEHSFAVMNGVSALELSAQLCRFRPGDEVIIPSHTFTASAYPFAKKGAKLVWADIDLATRVVTAESIEKVLTPRTRAIVVVHLYGYVADMPAIMDLARRHNLLVVEDTAQSIGADIDGVMSGAFGDFAIYSFHSHKNMTTLGEGGMLVVKDPALAKLVPALRHNGHCGFDFERPDYWKPAMGNVDMPEIDGEFLWPNNYCIGEIECALGIKQLERVSRINAEKRERAIRFIDALADYPELEFHRVDTTRHNYHLLAARMTNGRRDDFIRAMHDEKGVKCVVQYYPLDRYPFYKKLGFGTADCPNADLFFDNMVSFPFQHWLTEGEFDHMLASTIDVLETLRKG

SEQ ID NO: 43205 - DNA, 1179 bp, Desulfovibrio vulgaris subsp. vulgaris str. Hildenborough
  CDS (1)..(1179)
atgagcttcactcccgcatccgcattcatccccttctctccgccgcagataggcccggaagaggagcacgaacttctcgaggccctgcgcagcggctggataaccaccggcccccgcgtgcgcgccttcgaagccgccacagcagccgtggcgggcgcgacccacggcgtggccacgttctcgtgcaccgacgccatgcttgtggctttggccgccttcggggtcggccccggcgacgaggtgataaccaccccgtacaccttcatctccacggcgcaggtcatcctgcatcgcggggcgcgccccgtgttcgtggatgtggacccgcgcaccttcaacatcgaccccgcccgcatcgaggccgccatcaccccgcgcacgaggggcatcatgcccgtgcacttcgcggggcaggtgtgcgacatggacgccatcctcgccatcgcccgcaggcacggtctcttcgtcatcgaggatgccgcccacgccttcggcgccacccacaacgggcaccccgtgggcacactgggcgacgtggcgtgcttcagcttctacgccaccaagaacatcaccacggccgaaggcggcatggccgtcaccagcgatgccgacctcgcacagcgtatgcgggtgctctccatgtacggcatcagcgacgcacgcgagatatggcagaagcgctacacccgcgcgggcaacatccactatgacgtgcaggagctcggctacaagtgcaacatgaccgacctgtgtgccgcgctggggctggtgcagctgcgccgcatggacgccatcgccgccgcccgccgcagctacgccgccatctacgacgaggcgttcgccgacctgcccgtgacgacgccccatgtcgccccctacgcggggcacgcatggcacctctacccgctgcggctcgaccttgaccgcatcagcctctcacgcgacgaggtcatcctgcgcctcaaggaatgcaacgtgggaacgagcgtcatgttcacgccgttgcacctcttctcgtacttccagcgcgagatggggttcaacgaaggcgacttccccgtggccgaagacctcttctcgcgcgtggtatgtctgcccatgtcgcccgccctcggtgaagagcgcatccgcaaggtggccgagaccgtggcgcacgtcgtcaccgaaggcgcgaggtag

SEQ ID NO: 43206 - protein, 392 aa, Desulfovibrio vulgaris subsp. vulgaris str. Hildenborough
MSFTPASAFIPFSPPQIGPEEEHELLEALRSGWITTGPRVRAFEAATAAVAGATHGVATFSCTDAMLVALAAFGVGPGDEVITTPYTFISTAQVILHRGARPVFVDVDPRTFNIDPARIEAAITPRTRGIMPVHFAGQVCDMDAILAIARRHGLFVIEDAAHAFGATHNGHPVGTLGDVACFSFYATKNITTAEGGMAVTSDADLAQRMRVLSMYGISDAREIWQKRYTRAGNIHYDVQELGYKCNMTDLCAALGLVQLRRMDAIAAARRSYAAIYDEAFADLPVTTPHVAPYAGHAWHLYPLRLDLDRISLSRDEVILRLKECNVGTSVMFTPLHLFSYFQREMGFNEGDFPVAEDLFSRVVCLPMSPALGEERIRKVAETVAHVVTEGAR

SEQ ID NO: 43207 - DNA, 1119 bp, Bartonella quintana str. Toulouse
  CDS (1)..(1119)
atgcaattcatcgatcttggggcacagcgtgcacgcattaaagataaaattaatgctgcaattacgcatgtggtagccagtggcaagtatattttggggccaaaagtaacagaatttgaagagcgattggcagattatcttggcgttaaacatgtggttgcgtgtgccaatggaactgatgccttgaagatgcctcttatggctagaaatattggtccaggtgatgctgttttttgtcctagctttacgttttccgcaactgctgaagtggtcgcgttggtgggagcagaacctgtttttgtggatgttcggcctgatacattcaatattgacgttgataaactttgtgaagcaattgagatgattaaaaaggagggatgtctcaaaccaaaggcaattattgctgttgatttgtttggactctctgctgattatgcacaaattactaaagtggctgtaaaggaaaatctttttgtgattgaagatgctgcccaatctataggggggaaaagcggtaatattatgtgcggagcttttggtgatgttgccgcgacaagtttttatcctgcaaaaccattggggtgttatggcgatgggggtgctatgatgaccaatgatgaagatttagcagcagtgttacgttcgatcttatttcatggtaagggtgaaacgcaatatgataatgtgcgtatcggtttgaattcacgtctcgatacaattcaagctgcaattttactagaaaagttcgttatctttgaggatgaggtggaaaagcgtgtagcgattgcgcaatattattccaataatttaagagatattgtcacagttccagaagtgggagaagatactcgttgtgcttatgcacaatacactattaaggcaaaagaccgcgatagattacaggactatttacagaaaaactctattccgacaatggtttattacaaaactccattgcatcaacagctagcttataagcactttccttatgtaaaaggttctctttctgtttctgagtctttaggaaactgtgttttaagtttacctatgcatccttatttgacacaaagtgatcaggatatgattatccagaaaataagagatttttatcattcttga

SEQ ID NO: 43208 - protein, 372 aa, Bartonella quintana str. Toulouse
MQFIDLGAQRARIKDKINAAITHVVASGKYILGPKVTEFEERLADYLGVKHVVACANGTDALKMPLMARNIGPGDAVFCPSFTFSATAEVVALVGAEPVFVDVRPDTFNIDVDKLCEAIEMIKKEGCLKPKAIIAVDLFGLSADYAQITKVAVKENLFVIEDAAQSIGGKSGNIMCGAFGDVAATSFYPAKPLGCYGDGGAMMTNDEDLAAVLRSILFHGKGETQYDNVRIGLNSRLDTIQAAILLEKFVIFEDEVEKRVAIAQYYSNNLRDIVTVPEVGEDTRCAYAQYTIKAKDRDRLQDYLQKNSIPTMVYYKTPLHQQLAYKHFPYVKGSLSVSESLGNCVLSLPMHPYLTQSDQDMIIQKIRDFYHS

SEQ ID NO: 43209 - DNA, 1119 bp, Bartonella henselae str. Houston-1
  CDS (1)..(1119)
atgcaatttatcgaccttggggcgcagcgtgcgcgcattgaagataaagtgaatgctgcaattgcgcatgtggttgccagtggtcaatacattttggggccaaaagtaacagaatttgaagagcaattggcagattatcttggcgttaaacatgtaattgcctgtgccaatggaacggatgccttgaagatgcctcttatggctaaaaatattgggccaggtgatgctgttttttgtcctagcttcacgttttcggcaactgcggaagtggttgctttggtgggagcagaacctgtttttgttgatgttgtgtctgatacatttaatatcgacgttgataaactttgtgaagcaattgagatgattaaaaaagagggacgtctcaaaccaaaagcaattattgctgtggatttgttcgggcttcctgccgattatgcgcaaattgctcaagtggctgcaaaggaaaatctttttgtgattgaagatgctgctcaatcaatggggggaagaagcggtagtattatgtgcggagcttttggtgatgtggctgcgacaagtttttatcctgcaaaaccattagggtgttatggcgatggaggcgctatgatgaccagtgatgatgatttagcagcgcttttacgttctatcctgtttcatggaaaaggtgaaacgcaatatgacaatgtgcgtatcggtttgaattcacgcttggatacaattcaagctgcaatcttgctagaaaagttcgttatatttgaagaggagatggaaaagcgtgttgcgattgcgcaatattatgccaataatttaagagatattgttacagttccagaagtggcagaagatgctcgttgtgcctatgcacaatacactcttaaagtgaaaaaccgcgatagattacaagactatttacagaaaaattctattcctacaatggtttattataaaactcctttgcatcaacagccagcttataaacactttccttatgtcaacggttctctttctgtttctgaatctctgagagattgtgttctcagtttaccaatgcatccttatttgacaaaaaatgatcaggatatgattatccagaaaataagagatttttaccattcttga

SEQ ID NO: 43210 - protein, 372 aa, Bartonella henselae str. Houston-1
MQFIDLGAQRARIEDKVNAAIAHVVASGQYILGPKVTEFEEQLADYLGVKHVIACANGTDALKMPLMAKNIGPGDAVFCPSFTFSATAEVVALVGAEPVFVDVVSDTFNIDVDKLCEAIEMIKKEGRLKPKAIIAVDLFGLPADYAQIAQVAAKENLFVIEDAAQSMGGRSGSIMCGAFGDVAATSFYPAKPLGCYGDGGAMMTSDDDLAALLRSILFHGKGETQYDNVRIGLNSRLDTIQAAILLEKFVIFEEEMEKRVAIAQYYANNLRDIVTVPEVAEDARCAYAQYTLKVKNRDRLQDYLQKNSIPTMVYYKTPLHQQPAYKHFPYVNGSLSVSESLRDCVLSLPMHPYLTKNDQDMIIQKIRDFYHS

SEQ ID NO: 43211 - DNA, 1176 bp, Acinetobacter sp. ADP1
  CDS (1)..(1176)
atgctgaatactgcttttgccccatggccaagttttacccaagaagaagcggatgcagtgtcgagtgtgctgctctctaatcgggtcaattactggacagggcagcactgccgtgaatttgaaaaagagtttgcagcatgggtcggtacagcctatgcggtggctgtgtcaaatggtaccacagcgcttgatctggcgttgaaagcattggatattggtgcaggcgatgacgtgattgtgacttcacgtacctttttggcatcggcaagttcaattgtgactgcaggcgcaaatcctgtatttgcagatgttgagctggactcacaaaatatttccaaagccacaattgaagcggttcttacaccgaagaccaaagccattatctgtgtgcatctggcaggttggatgtgcgatatggacccaatcatgcaactggctgccgagcacgggctttatgtgattgaagactgtgctcaagcgcatggtgccgcgtataaaggtcgtgcagcaggctcaattggacatattggtgcctggtcgttttgtcaggacaaaatcatgaccacgggtggcgaagggggtatggtcaccacacatgatgaaacattgtggaaaaagatgtgggcctacaaagatcatggtaaaaactacgacagcatttaccataaacagcatccgccagggtttcgctggttgcatgattcgtttggcaccaactggcgaatgatggaaatgcaggcggtgattggtcagattcagctaaagcgtatgaacgaatggaccgcattacgcacagttcacgctgaacacattctgcaagcctttgaggcatcttcatattttcaggtggatcgtccagattctaattatgttcatgcctattataagtgctatgtacaggtcattcctgagcaattgcccgaaggctggacacgtgatcgtattatgaatgagctaaatgcgcttggggtgccatgttttagcggttcatgttcggaagtctatctggagcatgcctttgatgatacgccgtggcgaccagagcagcgcttagccaatgcaaaacggctgggcgaaaccagtctgatgttgttggtgcatcccacattgacggctgaaaatatgcagcagaccctcaatggtattcagcatgttcttcagatgatggcagcatag

SEQ ID NO: 43212 - protein, 391 aa, Acinetobacter sp. ADP1
MLNTAFAPWPSFTQEEADAVSSVLLSNRVNYWTGQHCREFEKEFAAWVGTAYAVAVSNGTTALDLALKALDIGAGDDVIVTSRTFLASASSIVTAGANPVFADVELDSQNISKATIEAVLTPKTKAIICVHLAGWMCDMDPIMQLAAEHGLYVIEDCAQAHGAAYKGRAAGSIGHIGAWSFCQDKIMTTGGEGGMVTTHDETLWKKMWAYKDHGKNYDSIYHKQHPPGFRWLHDSFGTNWRMMEMQAVIGQIQLKRMNEWTALRTVHAEHILQAFEASSYFQVDRPDSNYVHAYYKCYVQVIPEQLPEGWTRDRIMNELNALGVPCFSGSCSEVYLEHAFDDTPWRPEQRLANAKRLGETSLMLLVHPTLTAENMQQTLNGIQHVLQMMAA

SEQ ID NO: 43213 - DNA, 1314 bp, Erwinia carotovora subsp. atroseptica SCRI1043
  CDS (1)..(1314)
atgagcacccaaaacctaagagaagacatcgctaaactggtcgagcaatatgctaaccaggcttttgcctccaaagtatttttggccggtgaaagtgtcatccctcctgcgggcaaagtgatcggtgctccagaaataaaaatgatggttgatgcttgtctggatggctggctgacaacagggcgttttaaccgtgaatttgaacgccgtttgggtgaattccttggtgtaaaacatgtcctgacgacagtatcaggttctgccgctaaccttctggctctggctacgctgacatccccgaaactgggcgatcgtgcgttaaaggcgggtgacgaagtgattactgttgctgcagggtttccaaccacggttaacccatcaattcagtatggcctgattcctgtttttgttgacgttcatattccaacttacaatatcgaccccagcaaaattgaagcggcaattagcgacaaaacccgtgcaattatgatcgcgcatactctgggtaatgtatttgatttatctgaagttaagagaattgctgataaatacaacctctggctgatcgaagactgctgcgatgcgttgggcgctaaatacaacggccagatcgttggcacatttggcgacattgctaccgtaagtttctaccccgcacaccatattacgatgggcgaaggcggtgcagtctttactaattcatctgaattgagaacaatcaccgaatctttccgcgactggggacgtgattgctactgtgaaccgggctgtgataacacctgtaataatcgattcggccagaaattaggttccctgccttttggctatgaccataaatatacctattcacatgtcgggtacaacctcaaaatctcggatatgcaagctgcatgtggcctggcgcaaatggatcgcttgccggatttcgtggcgaagcgtaatgccaattttgaatacctgaaagcaggtcttgcatcatgcgaagagttcattgagttacctgaagctacgccaaattctgagccatcatggttcggtttcccgattacccttaaagaagaaagcggtattaatcgtatcgatctggttaaattcctggacgatgcgaaaattggcacacgtttgttgtttgcgggtaacctgactcgtcagccttactttgaaggcgtgaaatatcgtgttgttggtgaattaaccaatactgaccgtatcatgaatcagactttctggatcggcatttatccgggattagatactgaacatcttgattttgtgatcggaaaatttgaagaattctttgggttgaatttttaa

SEQ ID NO: 43214 - protein, 437 aa, Erwinia carotovora subsp. atroseptica SCRI1043
MSTQNLREDIAKLVEQYANQAFASKVFLAGESVIPPAGKVIGAPEIKMMVDACLDGWLTTGRFNREFERRLGEFLGVKHVLTTVSGSAANLLALATLTSPKLGDRALKAGDEVITVAAGFPTTVNPSIQYGLIPVFVDVHIPTYNIDPSKIEAAISDKTRAIMIAHTLGNVFDLSEVKRIADKYNLWLIEDCCDALGAKYNGQIVGTFGDIATVSFYPAHHITMGEGGAVFTNSSELRTITESFRDWGRDCYCEPGCDNTCNNRFGQKLGSLPFGYDHKYTYSHVGYNLKISDMQAACGLAQMDRLPDFVAKRNANFEYLKAGLASCEEFIELPEATPNSEPSWFGFPITLKEESGINRIDLVKFLDDAKIGTRLLFAGNLTRQPYFEGVKYRVVGELTNTDRIMNQTFWIGIYPGLDTEHLDFVIGKFEEFFGLNF

SEQ ID NO: 43215 - DNA, 1113 bp, Erwinia carotovora subsp. atroseptica SCRI1043
  CDS (1)..(1113)
atgaaaaaaccagtgtatgtaacaagcccgttattaccccctttggatgaatttactccttatcttgaggaaatatgggaaaataaatggctgactaataatggcaccttccatcagcgtttagagcaagctttggcggattatctaggtgttccgtaccttagtttgttttccaacggcacgctggcattattaactgctttgcaaacgttacgtatcactggtgaggtaattaccacaccttactcatttgtggcgacatcacatacattattatggaatggattaaagcccgtatttgttgatatagatccagtgacatgtaatcttgatccttcgaaattagagcaagctattacgccagcaacgtctgcaattttaccggtgcactgttatggactgcctgcggatgttgaccgaattcaaaatatagctgatatatatggtttgaaagtgatctacgatgcggctcatgcttttggtgttaaaaagaatgatgtcagcatactcaatcatggagatctttctatacttagctttcatgcaacgaaggtttttagcactatcgaaggcggtgcgattatttctcaagatgaaaaaacgaaaaaaagaattgattatcttaaaaatttcggatttgtcgatgaagtgacagttgttgctcctggtattaatgcaaaaatgaacgaggttcaggctgcatttggattgcttcaattgaaatatattgattcagcattaaatcaacgtaaaaatatttattcaagatactgtgagcttttgaaagatatctcaggaattaatgtgattagtattcctgacaatgtgacttggaattatgcctatttccctattttcttctctgatgccttccctaaaaaaagagacgaagtttacgatattctgagggagaataatatatatgctcgtcgatatttttatcctctgattagcactttcccgatgtatcggggattagactcagcgaaagaagatggtctaccgacggcatctcatatcgcggacaatgtactctgtcttcctatctacccggacttgtcagatgaaagtatattggatgtcgttaaatgtatttctgattgtgtaaactga

SEQ ID NO: 43216 - protein, 370 aa, Erwinia carotovora subsp. atroseptica SCRI1043
MKKPVYVTSPLLPPLDEFTPYLEEIWENKWLTNNGTFHQRLEQALADYLGVPYLSLFSNGTLALLTALQTLRITGEVITTPYSFVATSHTLLWNGLKPVFVDIDPVTCNLDPSKLEQAITPATSAILPVHCYGLPADVDRIQNIADIYGLKVIYDAAHAFGVKKNDVSILNHGDLSILSFHATKVFSTIEGGAIISQDEKTKKRIDYLKNFGFVDEVTVVAPGINAKMNEVQAAFGLLQLKYIDSALNQRKNIYSRYCELLKDISGINVISIPDNVTWNYAYFPIFFSDAFPKKRDEVYDILRENNIYARRYFYPLISTFPMYRGLDSAKEDGLPTASHIADNVLCLPIYPDLSDESILDVVKCISDCVN

SEQ ID NO: 43217 - DNA, 1149 bp, Erwinia carotovora subsp. atroseptica SCRI1043
  CDS (1)..(1149)
atgacggattttttgcctttttcccgcccgaccatgggcgacgaggaaattgctgccgtggcagaagtattacgttctggctggataaccacggggccgaaatgtcagcagttagagcaggctttttgccagcagtttgggtgccaacaggcgattgcggttagctccgcgacgggcggaatgcacgttacgctgatggcgctcggcattggacctggtgacgaggttattacgccgtctcagacttgggtttcaaccgtcaatatcatcacgctattgggtgcggaaccggtgatggtggatgtggatcggcatacgttgatggtgcgatcgcaggatattgaagccgcaattacgccgaagaccaaagcgattattcccgtgcattacgccggtgcgcccgccgatctggatgcgctgcgcgcactcagtgaacgctatggcattccgctcattgaggatgcggcgcatgccgtcggtacgcaataccgtggtgagtggattggtgcgcgtggaaccgccattttctcgtttcacgcgattaaaaatatcacctgtgcggaaggtggcatggtggtgacggatgacgaagcactcgccgagcgtatacgcagtctgaaatttcacgggctgggtgtggatgcgtttgacaggcagttacaggggcgcaagccgcaggccgaagtggtgacgccggggtttaaatacaatctggcggatatcaatgcggctattgcgctggtccaactggataaactcccagcgatcaacgcccgccgtcagcagcttgccgcgcgttatctcacgcagttgcactcgctgccgctccaaccgctggcggttcctgactatccccatttgcacgcctggcacctgtttatggtgcgcgtggacgaaacgcagtgcggtatttcacgcgatgatctgatggcggcgctgcaaacacatggcattggcaccgggctgcatttcagagcggtgcatacgcagaaatattaccgtgagcgctacccgcatttgcacctgccggaaacggagtggaattcggcgtcgctcatgacgctaccgctgttccccgatatgcaggacagcgatgtcgatcgcgtcgtcgcggcgttaacctcgattctggagtctgttcgtgattga

SEQ ID NO: 43218 - protein, 382 aa, Erwinia carotovora subsp. atroseptica SCRI1043
MTDFLPFSRPTMGDEEIAAVAEVLRSGWITTGPKCQQLEQAFCQQFGCQQAIAVSSATGGMHVTLMALGIGPGDEVITPSQTWVSTVNIITLLGAEPVMVDVDRHTLMVRSQDIEAAITPKTKAIIPVHYAGAPADLDALRALSERYGIPLIEDAAHAVGTQYRGEWIGARGTAIFSFHAIKNITCAEGGMVVTDDEALAERIRSLKFHGLGVDAFDRQLQGRKPQAEVVTPGFKYNLADINAAIALVQLDKLPAINARRQQLAARYLTQLHSLPLQPLAVPDYPHLHAWHLFMVRVDETQCGISRDDLMAALQTHGIGTGLHFRAVHTQKYYRERYPHLHLPETEWNSASLMTLPLFPDMQDSDVDRVVAALTSILESVRD

SEQ ID NO: 43219 - DNA, 1131 bp, Erwinia carotovora subsp. atroseptica SCRI1043
  CDS (1)..(1131)
atgattccatttaatgcgccaccggttgtcggtacggaactggattatatgcaggctgccatgagcagcggcaaattgtgcggcgatggcggatttactcgccgctgtcagcagtggctggaacattactccggtagcaagaaagtcctgcttacgccttcctgcacagcgtcgctggagatggccgctatcctactggatattaagcccggcgatgaagtgatcatgccgagctataccttcgtctctaccgccaacgcctttgtgctgcgcggtgcgaagatcgtgtttgtcgatatccgcccagatacgatgaatattgacgagacgaaaatcgaagcggcaattacggaaaaaacacgcattatcgtgccggttcactacgcgggcgtcgcctgcgagatggacgcgattatggcactggcgaaaaaatacgatttatatgtcgtggaagatgcggcacagggcgtgatgtccagctacaaaggccgcgttctggggtctattggtcacatcggctgcttcagttttcacgaaaccaaaaactacacctcgggcggtgagggcggggccacgttgattaatgacgcgaggctggtggaacgagcggaaatcatccgtgaaaaaggcaccaaccgtagccagttcttccgtggacaggtggacaaatacacctggcgtgacatcggctcaagctatctgatggcggatattcaagctgcttatctctgggcacagctggaagccgcgcgacccatcaacgagcgtcgcctgaaactgtggcagaactactatgcggcattcaaatcgctggccgatgcggggcgtataacactgccgaccgtgcctgccaatgggatccacaacgcgcacatgttttatatcaaactgcgcgatcaggacgaccgcagtgcgtttatcaattacatgaaagaagccgaaatcatgacagtctttcattatatcccgctacatagctgcccggcgggtctgaacttcggtcgtttctccggtgacgatcgctacaccacgcaggaaagcgaacggctggtacgtttaccgctgttctacaacctgtcggacgtcaatcagcgcaccgtcattaataccattctgagcttcttctcctga

SEQ ID NO: 43220 - protein, 376 aa, Erwinia carotovora subsp. atroseptica SCRI1043
MIPFNAPPVVGTELDYMQAAMSSGKLCGDGGFTRRCQQWLEHYSGSKKVLLTPSCTASLEMAAILLDIKPGDEVIMPSYTFVSTANAFVLRGAKIVFVDIRPDTMNIDETKIEAAITEKTRIIVPVHYAGVACEMDAIMALAKKYDLYVVEDAAQGVMSSYKGRVLGSIGHIGCFSFHETKNYTSGGEGGATLINDARLVERAEIIREKGTNRSQFFRGQVDKYTWRDIGSSYLMADIQAAYLWAQLEAARPINERRLKLWQNYYAAFKSLADAGRITLPTVPANGIHNAHMFYIKLRDQDDRSAFINYMKEAEIMTVFHYIPLHSCPAGLNFGRFSGDDRYTTQESERLVRLPLFYNLSDVNQRTVINTILSFFS

SEQ ID NO: 43221 - DNA, 1113 bp, Propionibacterium acnes KPA171202
  CDS (1)..(1113)
gtgaccgcccagttcattcctcccgctaagccgatcctcggcgatgacgagcgtaaggccgtcgacgaggttattgcctccggcatggtcgcccagggcccccaggtccacgccttcgaggacgagttctcctcccaggtcgtcgacggggttcactgcgtcgccgtcaactcgggaacctcggccctccacattggcctgctggcctctggcatcggtgagggcgacgaggtcatcgtcccttccttcactttcgccgctaccggcaactcggtagccctgtccggcgccaagccggtgttcgctgacgtcgacccggtcacgtttaccctcgacccggcttccatcgaggcctctattaccgacaagaccgccgcgatcatgccggtgcacctctatggtctcccggctaacatggccgaaattgtcgcgatcgccacaaaacacggtctcaagatcttcgaggattgtgcccaagcccacgctgccagcatcgacggcaagcatgtcggtacttttggcacctttggagctttctccttctacccgacgaagaacatgacctcgggcgagggtggcatgatcaccacctctgacccggaaatcgcccgtaaggctgccatgctccgcaaccagggcatggagaagcgttacgccaacgagtacgttggtctcaacaaccgcatgactgacatccacgcttccatcggacgggtgcagttgaccaagctggccggctggaccaagacccgccaggagaacgcggcgttcctgtcgtccaacatcaccgaggccatcacccccgccgtgccggagggttatgtgcacgtgtaccaccagtacacgattcgtcttgagggagctactggtgaggagcgtgaccgtttcgtcaccgctctcaaagaggaacaccaggttggctcgggtgtctactacccgattccgaaccaccggctgccgtcgctggccccttacgccccgggcctggagcttccgaacaccgagaaggttgccgccgagtgtgtctcactgccggtccatccctcgctgtcccaggctgaccgtgagcgcatcgttgccgctgtcaatacctgcgcgaaagcaggtgcctga

SEQ ID NO: 43222 - protein, 370 aa, Propionibacterium acnes KPA171202
MTAQFIPPAKPILGDDERKAVDEVIASGMVAQGPQVHAFEDEFSSQVVDGVHCVAVNSGTSALHIGLLASGIGEGDEVIVPSFTFAATGNSVALSGAKPVFADVDPVTFTLDPASIEASITDKTAAIMPVHLYGLPANMAEIVAIATKHGLKIFEDCAQAHAASIDGKHVGTFGTFGAFSFYPTKNMTSGEGGMITTSDPEIARKAAMLRNQGMEKRYANEYVGLNNRMTDIHASIGRVQLTKLAGWTKTRQENAAFLSSNITEAITPAVPEGYVHVYHQYTIRLEGATGEERDRFVTALKEEHQVGSGVYYPIPNHRLPSLAPYAPGLELPNTEKVAAECVSLPVHPSLSQADRERIVAAVNTCAKAGA

SEQ ID NO: 43223 - DNA, 1182 bp, Desulfotalea psychrophila LSv54
  CDS (1)..(1182)
gtgtcaaatgcctccttttctccctggccctctttctctcaagaagaggccgatgctgtttcccgtgtacttctctctaataaagtaaattattggactgggcaggagtgccgcctttttgagcaggaatttgctcggtgggctggctgttcccatgctgtggcccttggtaatggtacccttgctcttgatctagccctaaaggcccttggtataggaaagggcgatgaggtgataaccacctcccgaacttttctggcaacggcctcatccattgttactgccggtgctgtcccggttttcgcagatcttgatcgaaatagtcagaatatctgtgcagaaacaattgaactgcatattaccaagaagaccaaggcgattattgtggtccatctagcaggtatgcctgcagagatggatgccattatggaacttgcgaaagcccatagtctctatgtcgtggaggattgtgcccaggcccatggcgctcgatataaggggcgtagtgtgggtaccattggtcatattggagcctggtcattttgtcaggacaagatcatgagcaccggtggtgagggtgggatggtgaccaccaatgatcgagaactatggtccaaaatgtggagttataaggatcatggaaaaagctatgaggctgtatatgaaaaggagcatccaccaggatttcgttggttgcacgagagctttggcaccaattggcgcatgaccgagatgcaggccaccattggtcgcattcaattgcaccgtatggagcagtggacagccgctcggaggatgaatgcccatgccattgatgatgtcgtagcagatctgtctgtcgtacgtcgagtcgaggtgccggaggattgtgtgcatgcctgttataaacattacctctttgtttgtcctgacgacctggcttctggctggagccgtgatcgtattgtcgaagagattgttgcccgtggagtaccctgctttcagggtagttgttctgaggtctatcgggagaaggcctttgacggtactggttggcgacccgaagttccccttgccaatgcccgtgaacttggtcagaccagtttgatgtttttggtccatccgaccttgactgaggctgagattgaaaagacttgtgttattgttcgggaggttttgcagagggcagagaaaaagggttaa

SEQ ID NO: 43224 - protein, 393 aa, Desulfotalea psychrophila LSv54
MSNASFSPWPSFSQEEADAVSRVLLSNKVNYWTGQECRLFEQEFARWAGCSHAVALGNGTLALDLALKALGIGKGDEVITTSRTFLATASSIVTAGAVPVFADLDRNSQNICAETIELHITKKTKAIIVVHLAGMPAEMDAIMELAKAHSLYVVEDCAQAHGARYKGRSVGTIGHIGAWSFCQDKIMSTGGEGGMVTTNDRELWSKMWSYKDHGKSYEAVYEKEHPPGFRWLHESFGTNWRMTEMQATIGRIQLHRMEQWTAARRMNAHAIDDVVADLSVVRRVEVPEDCVHACYKHYLFVCPDDLASGWSRDRIVEEIVARGVPCFQGSCSEVYREKAFDGTGWRPEVPLANARELGQTSLMFLVHPTLTEAEIEKTCVIVREVLQRAEKKG

SEQ ID NO: 43225 - DNA, 1107 bp, Desulfotalea psychrophila LSv54
  CDS (1)..(1107)
atgaaagagaaaaatatctatgtaacgcaaccttttttaccacccttagaagagttcacccctctgctcaaggaaatttgggagagtaagatcttgtcaaattgtggccctatgcatcaacgttttgagcaggccctctgtgattatcttggggttgagcacatctgtttgtttaataacggaacaattgcgcttatcactgcgcttcaagcactaggaattactggtgaggtaattacgaccccctactcctttgttgcaacggctaactcaattgtctggaatgggcttaaacctgtttttgtcgatattgattctgagactctaaacctcgatcctgctaaggttgaagcggcgatcactccagcgacgactgctattatgcccgtgcactgctatggcaatccttgtgatgtgaaagccattaatgagattgctcagaggcataagttaaaagttatttacgatgcagcccatgcctttgccgtgcaggataagggtggcagcatactacgccacggtgatcttagtgtgttgagctttcacgccaccaaggtctttaatacctttgaggggggagccattgtctgtaaaaatgctgagattaagcagcgtattgatcagctgaaaaactttggctttgtcgatgagacaacggtggctcttgcaggtatcaatggcaagatgagtgaggttaatggtgcctttggtctggtgcagcttaattatattgatgaagcaataaaacaacgtagcttggttgatgagtattatcgcgaacaattaagggatgtgaagggaattaccgtcccatcttcttcagcactgaaacaaaattactcatattttcccgttttggtggaggaagagtatccgcttacgcgtgatgtgttgtatcagaaacttaaagataataatatctatgccaggcgttatttttatccgctgatgagtgattttcctatgtataggggggaaccttcaagtaagaaagagaacctttctgtcgcaacagaggtagcaagtaaggttttgtgcttgcctatttatccgactcttgacttaaatggtttgcaacgagttgttagtttttttaagaaggtgtag

SEQ ID NO: 43226 - protein, 368 aa, Desulfotalea psychrophila LSv54
MKEKNIYVTQPFLPPLEEFTPLLKEIWESKILSNCGPMHQRFEQALCDYLGVEHICLFNNGTIALITALQALGITGEVITTPYSFVATANSIVWNGLKPVFVDIDSETLNLDPAKVEAAITPATTAIMPVHCYGNPCDVKAINEIAQRHKLKVIYDAAHAFAVQDKGGSILRHGDLSVLSFHATKVFNTFEGGAIVCKNAEIKQRIDQLKNFGFVDETTVALAGINGKMSEVNGAFGLVQLNYIDEAIKQRSLVDEYYREQLRDVKGITVPSSSALKQNYSYFPVLVEEEYPLTRDVLYQKLKDNNIYARRYFYPLMSDFPMYRGEPSSKKENLSVATEVASKVLCLPIYPTLDLNGLQRVVSFFKKV

SEQ ID NO: 43227 - DNA, 1203 bp, Desulfotalea psychrophila LSv54
  CDS (1)..(1203)
atgccgggttttgaagtatttggagaagaagaaaagcaacaggtgaacgaagttcttgatagtggtgtgctttttcgttacgaattcaaagaccagcgtaagggtgtttataaggtaaaagagtttgaaaacaaatttgccagctatgcaaatagcacccatggccaggcagtaacctcgggaagtgccgctctgaaagtagctcttatggggcttggagttggtcctggtgatgaggttatcacccagggttttacctttgttgctacctgggaggctattctggaaattggtgccactcctgttttcaccgaggtcgatgaaaccatgaatatggatccagcagaccttaaaaagaagattaccgccaagacaaagtgtattatccctgtgcacatgttgggtgctcccgctcgtatagaagagattgttgccattgctaaggcaaaaaacatctttgtcctcgaagatagtgctcaggcaccaggcgcccgcattaacggcaagcatgtaggttcctttggcgattgtggaacattttcttttgactcagtaaagaccatcaccaccggtgaaggtggaatgattattaccgataacgccgatctttggcgcactatgtctgagtatcatgaccatggtcatgatcatctggataatcccggtggacgtggtggtgacaaacgtcgctttattggttccaattatcgtatgatggaaattcagggtgccattggcttggctcagctgggcaaactcgactatattgtttctcagcaccaaaagcacaaggcaatattaaaagaggccgcctcggcaattcctggtgtctcttttagacatatcatggatgaaaaaggtgattctgcctcattcttctcatttttccttcaggacaaagagcacagctcccgggtaaatgaggttcttcgagcagagggttgtggggcaattaattttgccgaaaacacctggcacttttaccccaaatgggaacatctgcttggcgccaaaacctgtaccgcttcaggctggccctttgtcggtggagagaatcgtaagcgctttgtttatgatcctgccgccctgccacagtcagcagacctcattggtcgttgtctggtctaccctattgctgtaaaaacagatgaggcaaagcttgctcaaatgtgtactgccctgaagaaagctgctcaggtgtag

SEQ ID NO: 43228 - protein, 400 aa, Desulfotalea psychrophila LSv54
MPGFEVFGEEEKQQVNEVLDSGVLFRYEFKDQRKGVYKVKEFENKFASYANSTHGQAVTSGSAALKVALMGLGVGPGDEVITQGFTFVATWEAILEIGATPVFTEVDETMNMDPADLKKKITAKTKCIIPVHMLGAPARIEEIVAIAKAKNIFVLEDSAQAPGARINGKHVGSFGDCGTFSFDSVKTITTGEGGMIITDNADLWRTMSEYHDHGHDHLDNPGGRGGDKRRFIGSNYRMMEIQGAIGLAQLGKLDYIVSQHQKHKAILKEAASAIPGVSFRHIMDEKGDSASFFSFFLQDKEHSSRVNEVLRAEGCGAINFAENTWHFYPKWEHLLGAKTCTASGWPFVGGENRKRFVYDPAALPQSADLIGRCLVYPIAVKTDEAKLAQMCTALKKAAQV

SEQ ID NO: 43229 - DNA, 1188 bp, Desulfotalea psychrophila LSv54
  CDS (1)..(1188)
atgaaagtacctttgcttgatttgcgagcccaattggctacgattgaagatgagatggttgaggcggtggtaaatgttgttcgctctacccgttatattcaaggaccggaggtagaaggtcttgaacaggaaattgctgagtatagtggcgttgcccgtggtgtcggggtaagcagtggtaccgatgcccttttggttagtttgatgagtcttggaataggacagggggattatgttcttaccaccccatactcttttttcgcgaccatgggcgttattttacgcgtcggggcaaaacctgtttttgctgatattgatttagagagttataatattgatccggagaagatggcagaggtcttggcggctgatgttgatcataagattaaggccatcattccggtccatctctatggacagtgtgctgatatgaaggccatcaacaagcttgccgagcagtacaatattcccgtggttgaagatgccgctcaggccattggcgcagagtatccccttgttcatgccgatggcagtgtagaggttaagaaagctggtgctctaggcacatgtggttgtttttccttttttcccagtaagaaccttggtggtattggcgatggcggtatggttgtaactaccgacgaaaaatttgccgatcatcttgccttgatgcgtaatcatgggatgaatcctaagtattatcatccaagtgtgggcggtaattttcgtcttgatcctattcaggcgaccgctctgcgagtaaagctacctcatcttaatagttggcatgatggccgtcgcgaaaatgccgatagttatgcggagatgtttgcccgcacctcattgctagatgaggctaaggtggtcttgcccaagcgggtttatcaggagtttgaaggagagattgccggtcgttttcatatttataaccagtttattttacgggtagagaaacgcgatgaattgcgtgacttcttgctcgcggagggtgtaggttgtgaagtctattatccggtacctctgcataagcaggagtgtttgggggcctatagccatggcctttcctatccagaggctgaaaaggccgccgatacaaccattgccctgccaatttatgctgaacttactgcccccatgcagcagtatgtggtagataaaatagctgagttttacagcaaagattgctaa

SEQ ID NO: 43230 - protein, 395 aa, Desulfotalea psychrophila LSv54
MKVPLLDLRAQLATIEDEMVEAVVNVVRSTRYIQGPEVEGLEQEIAEYSGVARGVGVSSGTDALLVSLMSLGIGQGDYVLTTPYSFFATMGVILRVGAKPVFADIDLESYNIDPEKMAEVLAADVDHKIKAIIPVHLYGQCADMKAINKLAEQYNIPVVEDAAQAIGAEYPLVHADGSVEVKKAGALGTCGCFSFFPSKNLGGIGDGGMVVTTDEKFADHLALMRNHGMNPKYYHPSVGGNFRLDPIQATALRVKLPHLNSWHDGRRENADSYAEMFARTSLLDEAKVVLPKRVYQEFEGEIAGRFHIYNQFILRVEKRDELRDFLLAEGVGCEVYYPVPLHKQECLGAYSHGLSYPEAEKAADTTIALPIYAELTAPMQQYVVDKIAEFYSKDC

SEQ ID NO: 43231 - DNA, 1314 bp, Yersinia pseudotuberculosis IP 32953
  CDS (1)..(1314)
atgagtcaagaagaattacgtcaacagattgctgagctggttgctcagtacgctgaaacggctatggcccctaagccatttgaagcaggtaagagtgtcgttccaccttcaggtaaagttattggtaccaaagaactccagttaatggttgaagcttctttagacggttggctaacaacgggccgttttaatgacgcttttgagaaaaaactaggcgagtatttgggcgttccttatgttctgactacaacttctggctcttcagccaacttattggctttgaccgcgctgacctcacctaaattaggggtacgggcgttgaagccaggtgacgaagttattactgttgccgcaggttttccaaccacagtaaacccaactattcagaatgggttaattcctgtctttgttgatgttgatattccaacttacaatgtaaatgctagcctgattgaagcggcggttagtgataaaaccaaagctattatgattgcccatacattaggtaatctattcgatctagctgaagttcgccgagtagctgataaatataacctgtggttaattgaagactgctgcgatgcgttgggttccacctacgatggaaaaatggctggtacatttggcgatattggtaccgttagcttctatcccgctcatcatatcaccatgggtgaaggtggggcggtatttacacaatcggcggaactgaagagtatcatcgaatctttccgtgattggggtcgtgattgttattgtgctccaggctgtgacaacacatgtaaaaagcgtttcggccagcaacttggctctttaccattcggttatgatcataaatatacttattcccatttaggctataacctaaaaatcacagatatgcaggctgcctgtggtttggcgcaactagagcgcatagaagagtttgttgaaaaacgtaaagctaactttaaataccttaaagacgcactccaatcttgcgctgactttcttgagttaccagaagcgactgaaaattcagatccatcatggtttggtttccctatcactctgaaagaagatagcggagttagccgcattgatctggttaaattccttgatgaagctaaagtgggaactcgcctactctttgccggtaatttaactcgccagccgtatttccatgatgtgaaataccgtgttgttggtgaattgacaaacaccgatagaattatgaatcaaactttctggattggtatttacccaggcctgacacatgatcatttggattatgtcgtgagtaagtttgaagagttctttggtttgaatttttaa

SEQ ID NO: 43232 - protein, 437 aa, Yersinia pseudotuberculosis IP 32953
MSQEELRQQIAELVAQYAETAMAPKPFEAGKSVVPPSGKVIGTKELQLMVEASLDGWLTTGRFNDAFEKKLGEYLGVPYVLTTTSGSSANLLALTALTSPKLGVRALKPGDEVITVAAGFPTTVNPTIQNGLIPVFVDVDIPTYNVNASLIEAAVSDKTKAIMIAHTLGNLFDLAEVRRVADKYNLWLIEDCCDALGSTYDGKMAGTFGDIGTVSFYPAHHITMGEGGAVFTQSAELKSIIESFRDWGRDCYCAPGCDNTCKKRFGQQLGSLPFGYDHKYTYSHLGYNLKITDMQAACGLAQLERIEEFVEKRKANFKYLKDALQSCADFLELPEATENSDPSWFGFPITLKEDSGVSRIDLVKFLDEAKVGTRLLFAGNLTRQPYFHDVKYRVVGELTNTDRIMNQTFWIGIYPGLTHDHLDYVVSKFEEFFGLNF

SEQ ID NO: 43233 - DNA, 1239 bp, Mannheimia succiniciproducens MBEL55E
  CDS (1)..(1239)
ttggtcggaattaccgacgtttttagatttttaactttatatattaagaggtttattatgttaaatactgctttcgaaccttggccgtcgttcacgcaggaagaggctgatgcggtttcccgcgtgattttatcaaatcgggttaattattggacggggaccgaatgccgcgaattcgaaaaagaatttgccgcttatgtggggacaaaatatgccgtttcattaaccaacggcacggtggcgctggatcttgccttaaaagcattaaatatcggtgccggtgacgacgtgattgtaacctcacgcacctttttggcatccgccagttcaatagttaccgccggtgctaatccggtatttgcggatgtggaattggattctcaggtaatttcccgtcgaaccattgaagccgtattaacgccgaataccaaagcgattatctgtgtgcatttagccggttggatgtgtgatatggatccgattatggatttagcaaaagaaaaaggtatctatgtgattgaagattgtgcacaagcgcacggcgcaatgtataaaggtaaatcggctggttccatcgggcatattgcggcctggtcgttctgtcaggataagattatgacgacaggcggtgaaggcggcatggtcactacaaacgataaaggtttgtggaataaaatgtggtcctataaagaccatggcaaagattttgacacagtatacaacaaacaacatccgccaggtttccgctggctgcataattcattcggcactaactggcggatgatggaggttcaggcggtaatcggacgaattcagttaacccgcatggcggattggactgcaaaacgtattaacaatatggaacgtattctgaatgcttttgatggcagcccgtatttttctgtgtacagaccaaatcaggattacgtacatgcggcatataaatgctatgtacaggttaacccgcaggcattgccggcaggttggtcgagagaccgtattatgcaggttattaatgagcaaggtgtgccttgttacagcggttcctgttctgaagtttacttggaaaaagcttttgataatacgccttggcgtccggcaaaaccgttacaaaatgcaaaatcgctgggtgaaaccagtttaatgtttttagttcatccgacccttagcgaggacagcctggttaaaacctgtgcggcgataactcaggttattcatgctttatcggaaaacaaatag

SEQ ID NO: 43234 - protein, 412 aa, Mannheimia succiniciproducens MBEL55E
MVGITDVFRFLTLYIKRFIMLNTAFEPWPSFTQEEADAVSRVILSNRVNYWTGTECREFEKEFAAYVGTKYAVSLTNGTVALDLALKALNIGAGDDVIVTSRTFLASASSIVTAGANPVFADVELDSQVISRRTIEAVLTPNTKAIICVHLAGWMCDMDPIMDLAKEKGIYVIEDCAQAHGAMYKGKSAGSIGHIAAWSFCQDKIMTTGGEGGMVTTNDKGLWNKMWSYKDHGKDFDTVYNKQHPPGFRWLHNSFGTNWRMMEVQAVIGRIQLTRMADWTAKRINNMERILNAFDGSPYFSVYRPNQDYVHAAYKCYVQVNPQALPAGWSRDRIMQVINEQGVPCYSGSCSEVYLEKAFDNTPWRPAKPLQNAKSLGETSLMFLVHPTLSEDSLVKTCAAITQVIHALSENK

SEQ ID NO: 43235 - DNA, 1077 bp, Mannheimia succiniciproducens MBEL55E
  CDS (1)..(1077)
atggaatttattgatttaaaggctcaacagcaaagaattaaagcgcaaattgacgcgggtattcagaaagtattggcacacggcaaatatattttagggccggaagttgcggaattggaagaaaagctggccgcttacgtcggtgcaaaatattgcattacttgcgccaacggcacggatgcattgcaaattgcgcaaatggcattgggtatcggtgccggtgatgaagtgattaccccgggatttacttatatcgctacggcggaaaccgtcgctttattaggtgctaaacccgtttatgtggatgtggatccaaaaacctataatattgatgcggagaaattagaggccgcaatcacaccgcgtaccaaagctattattcccgtcagtttatacgggcaatgtgcggattttgatgcggtaaacgccgtggcgaaaaaatacaatttaccggttattgaagatgccgcgcaaagtttcggcgcgagctataaaaaccgtaaaagttgtaatctaaccactatttcctgtaccagctttttcccgagcaagcctttgggttgttatggtgacggcggcgcaatttttactaatgatgatgcgttggccaatgtgattcgtcaggtggcgagacacggtcaggatcgccgctatcatcatattcgggtgggtgtaaacagccgattggataccttacaggcggcgattctgttaccgaaattagcgattctggatgatgaaattgccgcgcgccaaagagtagctgaaaactatactcgactgtttaatcaggcgggcgttaatacgactccgtttattgaagctcataaccaaagcgcttgggctcagtacaccattcaagtggataatcgtgccgatgtacaggaaaaactgaaaactttaggaattccgaccgcagttcattacccaatcccgttaaacaaacagccggcagtggcggatagccgtattcatttaccggtgggggatttgattgccgaacgcgtgatgagtttgcctatgcatccctatcttacgccggaagaacagcaaaaaatcgttcaaagtttagtatag

SEQ ID NO: 43236 - protein, 358 aa, Mannheimia succiniciproducens MBEL55E
MEFIDLKAQQQRIKAQIDAGIQKVLAHGKYILGPEVAELEEKLAAYVGAKYCITCANGTDALQIAQMALGIGAGDEVITPGFTYIATAETVALLGAKPVYVDVDPKTYNIDAEKLEAAITPRTKAIIPVSLYGQCADFDAVNAVAKKYNLPVIEDAAQSFGASYKNRKSCNLTTISCTSFFPSKPLGCYGDGGAIFTNDDALANVIRQVARHGQDRRYHHIRVGVNSRLDTLQAAILLPKLAILDDEIAARQRVAENYTRLFNQAGVNTTPFIEAHNQSAWAQYTIQVDNRADVQEKLKTLGIPTAVHYPIPLNKQPAVADSRIHLPVGDLIAERVMSLPMHPYLTPEEQQKIVQSLV

SEQ ID NO: 43237 - DNA, 1095 bp, Bacillus licheniformis ATCC 14580
  CDS (1)..(1095)
atgatcagattgatcgagccgtatattacatttgaagaagtgcaagcagaattaaaggagatattttcctctggcatgctgacaaaaggcccttatgtcagaacatttgctgatcatatgagacagtatgtcagtgcaaagcatgcttttttaacaacatcggcaacaacggctttatcgatgtgccttaaaagcctgaacgtgcaacccggagatgaagtaatcgtctcagacttctcgttccccgccactgtcaatgtaatagaagatttaggagccaagccggtttttgccgatgttgatcttgaaacatttaacatgcttccagaagaactggaaagtcaaatcacgtcccgtacaaaagccgttctttttgtagatgctcttggaaacccgacaggcatcaccaacattaagcaaatttgtaaggagtacggcttaccccttgtggatgatgccgcttgtgcgatcggcagcagcgaatacggctgtaaatccggaaaaattgccgatctcacctgtttcagctttcacccaagaaagctgcttacgacaggcgaaggcggggcaattacaaccgaccgggaagagttgaaagactggctttcggtcaaattaaaccatggcgctgccatctctgacggaaaattggattttatagatttcggctacaactacagattatccgatatccaagccgctcttggaattaaacagctccaaaaacttgatgacatcattcatcggagaaaccttcagcagaaagcatatagtgaacagcttgaacccctcggattccaaagtcaaaaaatcggtccagccgttgtacacaacatacaatccgccgttttcaaagttccaaaaaacatcgttcgcgacgaattgattcaatatttgagcgactgccatatagagtcgactttcggcacttattgtttaagcggcactccctattaccgccggaaataccaacagctaaaatcgaattctctctttcttgaacaacatacgattaccctcccttgccatgatgaagtcgatttagatcatgtggtttcagccatacaatcatttatcaaatttaaggttgattag

SEQ ID NO: 43238 - protein, 364 aa, Bacillus licheniformis ATCC 14580
MIRLIEPYITFEEVQAELKEIFSSGMLTKGPYVRTFADHMRQYVSAKHAFLTTSATTALSMCLKSLNVQPGDEVIVSDFSFPATVNVIEDLGAKPVFADVDLETFNMLPEELESQITSRTKAVLFVDALGNPTGITNIKQICKEYGLPLVDDAACAIGSSEYGCKSGKIADLTCFSFHPRKLLTTGEGGAITTDREELKDWLSVKLNHGAAISDGKLDFIDFGYNYRLSDIQAALGIKQLQKLDDIIHRRNLQQKAYSEQLEPLGFQSQKIGPAVVHNIQSAVFKVPKNIVRDELIQYLSDCHIESTFGTYCLSGTPYYRRKYQQLKSNSLFLEQHTITLPCHDEVDLDHVVSAIQSFIKFKVD

SEQ ID NO: 43239 - DNA, 1110 bp, Bacillus licheniformis ATCC 14580
  CDS (1)..(1110)
atgatcccgttagtcaatttaaaacgtcaatttcaaacagtaaaacaggatattttaaaagagtttgaacatgtgctggacagcggccaatatatattggggccaaaggttgaagaattagagaaaagaatagctgaaaagcttggtgtaaaagaagcggtcgcggtcgccaacggaacggatgcattggtgctgacgcttgaagctttcggcatcggcaaaggggatgaagtgattacgaccccgttcacttttttcgccaccgccgaagccgtctcaagggtgggggctgaacctgtgtttgctgatgtcgatcctgaaacatacaatcttgatccgaaaaaaatagaagaaaagatcacccctgctactaaagcgatcattcccgtccatatcttcggacagccggctgatatggacgagatcatggagcttgccaaaaaacacggactgcttgtgattgaggatgcctgccaagcgttcggcgcatcgtataaagagcggcctgtcggcagcatcggggatgccgcctgtttttcatttttccctacaaaaaacttgggaacattgggagacgggggaatggtgacgatttcagacccggatgcagcccggcaattaagaacactcagaacccatggcactagcaaaaaatacttccatgacaaaatcggtttcaacagccgtcttgatgaattacacgccgcagctttactcattcttcttgagaaaatcgacggctggaatgaacaaagaagaagagtggccagccgctacagagaaggtttgaaaacggcggagcacctcacactgccggcagagaaagaggaccgcacacatatctatcatctctattgtatcggcgcgaaaaaccgcgactacatcatacaatcgctgaaagagcaggacattcattcaggtgtgtattatccttgctgccttcatctgcaatcggtctattcttcactgcagtacaaaaaaggcgattttcctatagccgagtccttgtccgaaacccttttcgccattccgatggatccttttctagccgccgaggaacaagatcagattatttctgcgctgctgaaaaaaggaggaggggaaaagtga

SEQ ID NO: 43240 - protein, 369 aa, Bacillus licheniformis ATCC 14580
MIPLVNLKRQFQTVKQDILKEFEHVLDSGQYILGPKVEELEKRIAEKLGVKEAVAVANGTDALVLTLEAFGIGKGDEVITTPFTFFATAEAVSRVGAEPVFADVDPETYNLDPKKIEEKITPATKAIIPVHIFGQPADMDEIMELAKKHGLLVIEDACQAFGASYKERPVGSIGDAACFSFFPTKNLGTLGDGGMVTISDPDAARQLRTLRTHGTSKKYFHDKIGFNSRLDELHAAALLILLEKIDGWNEQRRRVASRYREGLKTAEHLTLPAEKEDRTHIYHLYCIGAKNRDYIIQSLKEQDIHSGVYYPCCLHLQSVYSSLQYKKGDFPIAESLSETLFAIPMDPFLAAEEQDQIISALLKKGGGEK

SEQ ID NO: 43241 - DNA, 1146 bp, Bacillus licheniformis ATCC 14580
  CDS (1)..(1146)
atgagtcagaataagcgaatttatttatcaccgccgcacatgagcggagacgaggagcgctatgtagccgaagcgtttcggacaaactggatcgcgcccctcggtccccttgtcgacacatttgaagaaaagcttgccgcctatgcggggacgtccggagccgcggcagtcagctcaggaacagctgcgatccacctggccttgaaattgctcggcgtcggcaaaggcgatacggtcttctgctcttcttttacgtttgtagcgagcgccaatccgatcatatatgagcaggctgaaccggttttcattgattctgaacgggatacatggaacatgtcgcccgaggcgcttgaacgggcgcttgacgaagcggagcgggccaggaatctcccgaaagccgtcatcgtcgtcaacttgtacggccaaagcgcgaaaatggacgagattatggccatttgcgatcgatttgccgtgcctgtcattgaagatgcagccgaatcgctcggttctgtttataaaggcagaaaaagcgggaccttcggacgcttcggcatttattcgttcaacggtaacaaaatcatcaccacatcgggcggaggaatgctggtcagcgatgatgaagacgcgttgaagaaggcgcgctttttagccactcaggcgcgcgagccagccattcattatcagcacgaaaaagcgggctacaattaccggatgagcaatgttctggccggaatcggcatcgcacagctcgccgttctggatgaccgggtacatgccagacgggcggttttcgagcgctataaggaggcgctttccggtatcgaaggtatagaattcatgcctgaggccggcatgtcaaaccgctggctcacgacattaacgttagacacagcaaagattcaaacaacaccggcggacatcatcgaacagctcgcaaatgaaaacattgaggcccgcccgttatggaagcctttgcacagacagcccctttttaaaggcgcggccttttatccgcacgatgaccagggctctgtctgctgcgacttatttcagcgcgggctctgcctgccgtcaggatcaagtatgacgcgaaaagagcaggaccgggtaattcaaatcgttgccgaccggattaaatataaatga

SEQ ID NO: 43242 - protein, 381 aa, Bacillus licheniformis ATCC 14580
MSQNKRIYLSPPHMSGDEERYVAEAFRTNWIAPLGPLVDTFEEKLAAYAGTSGAAAVSSGTAAIHLALKLLGVGKGDTVFCSSFTFVASANPIIYEQAEPVFIDSERDTWNMSPEALERALDEAERARNLPKAVIVVNLYGQSAKMDEIMAICDRFAVPVIEDAAESLGSVYKGRKSGTFGRFGIYSFNGNKIITTSGGGMLVSDDEDALKKARFLATQAREPAIHYQHEKAGYNYRMSNVLAGIGIAQLAVLDDRVHARRAVFERYKEALSGIEGIEFMPEAGMSNRWLTTLTLDTAKIQTTPADIIEQLANENIEARPLWKPLHRQPLFKGAAFYPHDDQGSVCCDLFQRGLCLPSGSSMTRKEQDRVIQIVADRIKYK

SEQ ID NO: 43243 - DNA, 1314 bp, Bacillus licheniformis ATCC 14580
  CDS (1)..(1314)
atgaaaaccgcaaacgaaaacatgacttgcacgagcaaacagctatttgtccttctgaatgatttgaaggaaggaaagctcgctggtgaatgccgtatagacgacacactggccaatcaaaaattaaaagagacattgcagcaggatcaattcgacataaccgccaatttgctgaacagaatggattccccgccctccagagttgactttatgccgcttcatcgactgatcacagaagaagaagtagatgacgtggttcatgcggtgaaagacgtgctgccgaccgggcaatttacaagcggtttttatgttggcgtatttgaagctgaaatagctgcttttttgagcaaaaagcatgtcatggcttcatccagcggaaccgatgccatgattgtcgcgctgaaggctgcgggtgttggacaaggtgatgaagtcattatgcctgcaaacagctttgctgcaacggaaaacgccgtgctcgcagctggaggcactccgattttctgcgatattgaccctgttacattttgcatggatccttcagaaattgaagcatgtgtcactttgaaaacgaaatgcattttgcctgtacacctttatggaaagctgcctgacatggaagccattgcaaaaaccgctgataaatacggcatcccgattattgaagacgcctgccaggcgatcggcgtttccgatctgggaaaaaacagcctttgctccatattaagcttcaatccgtataaaaatctcggcacttgcggaaaagccggcgcaattgtgacggatgatccatcatttgcatccgcatgcatggaatatatgtatcacggctttgaactgaatcaaaaaaataaaaaggcggctgactacggctttaacgctaagattgataatctgcaagccgctattggactggcaaggatgaaatatctttctttaaataatctgaagcgcttatatttagcagatcgttatattgcgcatttgcagcagtatgaagacagaggtctgatcaaattgcctcaaatgaccgatgatcatgtatggcatttgtttacaattaaaatactaaacggaaatcgtgaccaagtcaaagatatgatgcttaaatttcataatgtccaaacagatatatactacccgattttatcccatcatcaaaacacaccacttgtaaaagccaattatcggcacacatcactgccggtcactgaatcagtgcataaacaaatgcttcagcttcctctctatccggggctcaccgtagaagaacaagacaaagtaatggaggccttaattgatgtcgtatcatga

SEQ ID NO: 43244 - protein, 437 aa, Bacillus licheniformis ATCC 14580
MKTANENMTCTSKQLFVLLNDLKEGKLAGECRIDDTLANQKLKETLQQDQFDITANLLNRMDSPPSRVDFMPLHRLITEEEVDDVVHAVKDVLPTGQFTSGFYVGVFEAEIAAFLSKKHVMASSSGTDAMIVALKAAGVGQGDEVIMPANSFAATENAVLAAGGTPIFCDIDPVTFCMDPSEIEACVTLKTKCILPVHLYGKLPDMEAIAKTADKYGIPIIEDACQAIGVSDLGKNSLCSILSFNPYKNLGTCGKAGAIVTDDPSFASACMEYMYHGFELNQKNKKAADYGFNAKIDNLQAAIGLARMKYLSLNNLKRLYLADRYIAHLQQYEDRGLIKLPQMTDDHVWHLFTIKILNGNRDQVKDMMLKFHNVQTDIYYPILSHHQNTPLVKANYRHTSLPVTESVHKQMLQLPLYPGLTVEEQDKVMEALIDVVS

SEQ ID NO: 43245 - DNA, 1503 bp, Legionella pneumophila subsp. pneumophila str. Philadelphia 1
  CDS (1)..(1503)
atgattactatcaaagagttatatatacaaaaacaagaaaatctgaaaactgctttgagcaagctggatgctacagctcaaggtgtgttatttctggtagatagtgatgaacatttaataaggacagttacagatggtgacatccgaagattgctattaaaaggatttacattagattctactttagaggaattatcagagcattcatcaaaagctttacctgtctctgctacgattcaggatgcttatcatttgatgcaggaatatgaattagatcatattcccgttatcgatgagagtaatcgccccatacgcttgatccaccggagagaactctcttccaatattctgctttcctcgcctcatatcggtgagcatgagcagcaatacgtacaggaagcttttgccaccaactgggtagcccctttaggccccaatgttgattcttttgaaaaagaagtggcggaatacattaatataaaatcagctgtggctttaagctcaggaacagctgcaattcatctggcactcgtattactcgatgtgaaaccaggagatattgtgttcgcatccagctttacttttgtagccacagtgaatcctatcttataccaaggtgcgactccggtatttattgattctgatttggacacctggaatatgtctccagttgctcttgagcgggcattaagagaaagtaaagcaaaaaatcaaatgccaaaagctgtgattattgttaatttatatggacaaagtgctaattatgacgctttatgtcaattatgcaatgaatacaatgtgccaattatagaagatgcggcggagtctttgggagccacctataataacaagtacagcgggactttcggcaagttaggcgtgttttcatttaatggcaacaaaatcattaccacgtctggtggcggcatgttggtgtctgaagatgagagtctcatacaaagagcaagatttttatcaactcaggctcgcgaaccaatgccccattatgaacatactgtggttgggtataattacagaatgagtaatgtgcttgctggtataggcagaggtcagctgaaagtattggaaaaacgggttaaggcaagacgagctatttttgaacgatataagcaagccttggaatcttacccatttattgacatgatgccagagataacccaaggatacagtactcgttggttatcgacattggttattaaaccaacgccaaacaagataaaaccggaagaagtcattgagcaattaaagccatttaacattgaagcaagaagaacatggaagcctatgcatagacagcctttatttgcaggctctaaatactatcctcatgatgaacaattcagcgtttcagattacttgtttgatcatggtatttgtcttccttccgggtcaaatttaacccccagagacattgatagagtcattcattgtttgaatgatatttttattaaatataaacaaaacaattttgaggtagcttaa

SEQ ID NO: 43246 - protein, 500 aa, Legionella pneumophila subsp. pneumophila str. Philadelphia 1
MITIKELYIQKQENLKTALSKLDATAQGVLFLVDSDEHLIRTVTDGDIRRLLLKGFTLDSTLEELSEHSSKALPVSATIQDAYHLMQEYELDHIPVIDESNRPIRLIHRRELSSNILLSSPHIGEHEQQYVQEAFATNWVAPLGPNVDSFEKEVAEYINIKSAVALSSGTAAIHLALVLLDVKPGDIVFASSFTFVATVNPILYQGATPVFIDSDLDTWNMSPVALERALRESKAKNQMPKAVIIVNLYGQSANYDALCQLCNEYNVPIIEDAAESLGATYNNKYSGTFGKLGVFSFNGNKIITTSGGGMLVSEDESLIQRARFLSTQAREPMPHYEHTVVGYNYRMSNVLAGIGRGQLKVLEKRVKARRAIFERYKQALESYPFIDMMPEITQGYSTRWLSTLVIKPTPNKIKPEEVIEQLKPFNIEARRTWKPMHRQPLFAGSKYYPHDEQFSVSDYLFDHGICLPSGSNLTPRDIDRVIHCLNDIFIKYKQNNFEVA

SEQ ID NO: 43247 - DNA, 1116 bp, Legionella pneumophila subsp. pneumophila str. Philadelphia 1
  CDS (1)..(1116)
atgcaatttatcgacttaaaaacacaatattctttaattgagaatgatattttaaacagcattaaaagggtattaaatcatggccaatatattatggggcctgaaattgcagaacttgaaaaagagttagccacttttgttggagtgaagcatgcgattgtgaattcaagtggtacagatgctttattaatggcattgatggctctggatattcagcctggggatgaagtaattacaagcccatttagtttcttcgcaacagcagaagtgattagcctttgtcatgcaacacccgtctttgtagatatagatcctttaacttataatttggatcctgagcagttagagagagcaatcactaagaaaaccaaggccattatgccagttgatttatatgggcaatgcgcagattacgatgtgattaatgccattgcaactcaatacggtattcctgttattgaagatgctgcgcagagttttggagctacttataaaggcaaatactcttgttccctggctactattggctgtactagttttttcccgtcaaaacctttaggtggttatggtgattctggagcttgttttactaatgatgatgttttagcccaaaaattaattgaaattagaattcatggacaaaatgcccgctattgccatcatcgggtagggattaacggtcgaatggacactatccaagcagcaatactacttcagaagctgaaaatattttctaatgaaattctattgcgacaaaaagtagcaaaacgttatgatcaaatgctttctgagttagtgaaaactccttatgtgcatgaatgcaatgcgagtgtgtatgctcagtataccattgaggttgagaatagagatgtatttgcgaaatcaatgcaagcctcaggtatacctacagctgttcattacccaattgctatgcatcaacagcaggcacttggttacttaaattacaaacttggagattttccaaactctgaaaaagcaagtcaacatgtaattagcctgcctatgcacccttatttacaagaagatgagcaattgaaaatagttgcagcagttagaaatgctttacttgtgatgaatgaagaggccatggtataa

SEQ ID NO: 43248 - protein, 371 aa, Legionella pneumophila subsp. pneumophila str. Philadelphia 1
MQFIDLKTQYSLIENDILNSIKRVLNHGQYIMGPEIAELEKELATFVGVKHAIVNSSGTDALLMALMALDIQPGDEVITSPFSFFATAEVISLCHATPVFVDIDPLTYNLDPEQLERAITKKTKAIMPVDLYGQCADYDVINAIATQYGIPVIEDAAQSFGATYKGKYSCSLATIGCTSFFPSKPLGGYGDSGACFTNDDVLAQKLIEIRIHGQNARYCHHRVGINGRMDTIQAAILLQKLKIFSNEILLRQKVAKRYDQMLSELVKTPYVHECNASVYAQYTIEVENRDVFAKSMQASGIPTAVHYPIAMHQQQALGYLNYKLGDFPNSEKASQHVISLPMHPYLQEDEQLKIVAAVRNALLVMNEEAMV

SEQ ID NO: 43249 - DNA, 1083 bp, Bacteroides fragilis YCH46
  CDS (1)..(1083)
atgaagaagaataatatttatgttacaatgcccacattagcttcgttgggtgatgtcaatgcattgttggaaggagtttgggaacgtggtgttatgactcataacggtccgctggtacaacgttttgagaaagaagttgcagaatttctgaatcttaaaaatgtagtgacagtcacaaatggcactatagctatacagatggcaatcaaagcattagggctgaagggggaagttatcactactccttttacatttattgcaaccattagttccattatatgggaggggtgtaccccggtttttgtagatattgatccggagactttaaatattgatccggataaaatagaagaaaagataaccgaacatacttgtgctatattaccggtacatgtatttggcaatccatgtgatattgagaagatagaggaaatagcacgacgcaatgacctaaaggtaatttatgatgcggcacatgccgttggtgtgaattataatggtagatcaatttttgagtatggagatatttctacaacaagttttcatgctacgaaaatgttgaatacagcagaaggtggagcttgctttgctgtggacgacgggttgcatgagaagttgaagagacttcgcttcttcggttttgatgatggaaaagaagtcattgatgatggaacaaatggaaagatgaccgaagtccatgcggccattggtattgctaatctaaaacttttgcagtcagctttagatgaccggaaagaaaagtattttctatataaagagttgctttctcgttatccggagttgaaattccaacggattaatcaagattgtaattatagctattttccagtgatctttcctacagaagaaatattattatccgtagagcataggctgaatcagaatggtatttttccgagaagatatttttatccatctgtcaatacgttcatgaaacagcttccttatacagaaatgcccatatctgaagatatatcaaggagaattctttgtctaccgctatattattctttgtctaagagtgatattagtagaatagctgatactatgtaccttgaatag

SEQ ID NO: 43250 - protein, 360 aa, Bacteroides fragilis YCH46
MKKNNIYVTMPTLASLGDVNALLEGVWERGVMTHNGPLVQRFEKEVAEFLNLKNVVTVTNGTIAIQMAIKALGLKGEVITTPFTFIATISSIIWEGCTPVFVDIDPETLNIDPDKIEEKITEHTCAILPVHVFGNPCDIEKIEEIARRNDLKVIYDAAHAVGVNYNGRSIFEYGDISTTSFHATKMLNTAEGGACFAVDDGLHEKLKRLRFFGFDDGKEVIDDGTNGKMTEVHAAIGIANLKLLQSALDDRKEKYFLYKELLSRYPELKFQRINQDCNYSYFPVIFPTEEILLSVEHRLNQNGIFPRRYFYPSVNTFMKQLPYTEMPISEDISRRILCLPLYYSLSKSDISRIADTMYLE

SEQ ID NO: 43251 - DNA, 1134 bp, Bacteroides fragilis YCH46
  CDS (1)..(1134)
atgaacaaacgaatctggctttcgcttgctcacatgggtggccgtgagcaagactttataaaagaggcctttgatacgaactgggttgtccctttgggacctaacgtggatgcctttgagcaatctttggttgaatatttgcatgaagaccgtcgtgtggtggccttgagtgctggaacggctgcacttcacttgggcttgattcttctggatgtgaagcccggtgatgaagtgatctgccaaagctttacttttgccgcctctgccaatccgatttcttatctggaggccaaacctgtttttgtggacagtgagaaggatacctggaatatggatccggtattgctcgaggaggctataaaggaccgtttgcgcaagacgggtaagctcccgaaggctattatccctgtccacctttacggtatgcctgccaagatggacgagatcatggatattgcgggtcgttatggtatccccgtattggaggatgccgcggaggctttgggttcggaactgaacggacggaagtgtggcacattcggtgaactggccgctctctctttcaatggcaacaagatgatcacgacttccgggggaggtgctctgatctgtcgtacggaagaggaggcccgacagacaaagttctacgctacgcaggctcgtgatgccgctccgcattaccagcatacccatatcggttacaactatcggatgagtaatatttgtgcgggtatcggtcgtgggcagatgtttgttctcgatgaacatgttgcccgaagacgggctatacatactctttatacggagttgcttaaggacgttcccggtataacggttcttcaaaaccctgatgggaggtttgattcaaatttctggttaacttgtatcctggttgatccgagtgttgccggtaagactcgtgaggacattcgtttgaaactggatgctgagaatatagagactcgtcctttgtggaagccgatgcatcttcagcctgtatttgtagatgctccattctatggaaacggtacgagtgaacacttatttgatatcggcctttgtctgccttcaggaccgacattgacggatgaagatatcaggagagtagtagatacgatcagacaagatatgtaa

SEQ ID NO: 43252 - protein, 377 aa, Bacteroides fragilis YCH46
MNKRIWLSLAHMGGREQDFIKEAFDTNWVVPLGPNVDAFEQSLVEYLHEDRRVVALSAGTAALHLGLILLDVKPGDEVICQSFTFAASANPISYLEAKPVFVDSEKDTWNMDPVLLEEAIKDRLRKTGKLPKAIIPVHLYGMPAKMDEIMDIAGRYGIPVLEDAAEALGSELNGRKCGTFGELAALSFNGNKMITTSGGGALICRTEEEARQTKFYATQARDAAPHYQHTHIGYNYRMSNICAGIGRGQMFVLDEHVARRRAIHTLYTELLKDVPGITVLQNPDGRFDSNFWLTCILVDPSVAGKTREDIRLKLDAENIETRPLWKPMHLQPVFVDAPFYGNGTSEHLFDIGLCLPSGPTLTDEDIRRVVDTIRQDM

SEQ ID NO: 43253 - DNA, 1101 bp, Bacteroides fragilis YCH46
  CDS (1)..(1101)
atgataaagtttttagatttacaaaaagttactcagagatactcagatgaaatccaaaattctgtggctcgagttgtaaactctggttggtatttgcaaggtgtagagaatagtagctttgagcaaaagtattcgcaatatataggtgccaaatatactatagggtgtgccaatggtttagatgctcttatttggatatttcgggcatatattgaattaggattaatgcaaccaggagatgagataatagtaccttctaatacatatatcgcttctattttgtctataacagagaatggtttaattccagttcttgttgaaccagacataaatacttatcaaattgatgataaaaaaatagaggcggctattacgaataggaccaaagctattttgatcgtccatctttatggacaatgtgcttatactgaaaaaattagcactatttgtaagaaatttgatttaaaattagttgaagataacgctcaagctcatggatgtatatgggggaaccagaagacaggttctttagggaatgcagcagcacatagcttttatccaggaaaaaatttaggtgctttgggagatggaggggctgttacgacggatgatgaagaacttgcaaatgtggttcgcgctttagcaaattatggctctactaagaaatatgtatttcaatatacaggtcgtaatagtagattggatgagatacaagccgcagtgcttaatgtaaaattgaagtatttagataaagataatggttatcgaaaaaaaatagcgcgatattatattgataatattactaattctcaaataatattacctaaagttagtgattggaatgcacatgtttttcatatttttccagtacgctgtaaaaaacgtaatgaattgcagagttatttggctgaaaatggcattcaaacaattattcattatcctatacctcctcataagcaagagtgttataaagcttggaataacttatcttttcctgtatcagaaataatccataaagaggaattaagcttaccaatcagtcctgttctgacagacgttgaagcaaaaaaaattgtatctgtaataaatcaatttaaatga

SEQ ID NO: 43254 - protein, 366 aa, Bacteroides fragilis YCH46
MIKFLDLQKVTQRYSDEIQNSVARVVNSGWYLQGVENSSFEQKYSQYIGAKYTIGCANGLDALIWIFRAYIELGLMQPGDEIIVPSNTYIASILSITENGLIPVLVEPDINTYQIDDKKIEAAITNRTKAILIVHLYGQCAYTEKISTICKKFDLKLVEDNAQAHGCIWGNQKTGSLGNAAAHSFYPGKNLGALGDGGAVTTDDEELANVVRALANYGSTKKYVFQYTGRNSRLDEIQAAVLNVKLKYLDKDNGYRKKIARYYIDNITNSQIILPKVSDWNAHVFHIFPVRCKKRNELQSYLAENGIQTIIHYPIPPHKQECYKAWNNLSFPVSEIIHKEELSLPISPVLTDVEAKKIVSVINQFK

SEQ ID NO: 43255 - DNA, 1131 bp, Bacteroides fragilis YCH46
  CDS (1)..(1131)
atgaacaaacgaatctggctttcgcttgctcacatgggtggccgtgagcaagactttataaaagaggcttttgatacgaactgggttgtccctttgggacctaacgtggatgcctttgagcaatctttggttgaatatttgcatgaagaccgctatgtagtggctttgagtgccggaacggctgcacttcacttgggcttgattcttctggatgtgaagcccggtgatgaagtgatctgccaaagctttacttttgctgcctctgccaatccgatttcttatctggaggccaaacctgtttttgtggacagtgagaaggatacctggaatatggatccggtattgcttgaggaggctataaaggaccgtttgcgcaagacgggtaagctcccgaaggctattatccctgtccacctttacggtatgcctgccaagatggacgagatcatggatattgcgggtcgctatggtatccccgtattggaggatgccgcggaggctttgggttcggaactgaacggacggaagtgtggcacattcggtgaactggccgctctctctttcaatggcaacaagatgatcacgacttccggtggaggtgctctggtctgtcgtacggaagaggaggcccgacagacaaagttctatgcgacgcaggctcgtgatgccgctccgcattaccagcatacccatatcggttacaactatcggatgagtaatatttgtgcgggtatcggtcgtgggcagatgtttgtcctcgatgaacatattgcccgtcgccgtgccattcactctttgtatgttgatttgctgaaagatgtggcgggtattacggtcatggagaaccctgattcgcggtttgcttccaacttttggcttacttgtattctggttgatccgaagcttgcgggtaagagtcgtgaggatatccgtttgaggctggactccgagaacatagagacacgtcctctgtggaagccgatgcatcttcagcctgtgttcacggatgctccgttctatgggaatggtacgagtgagaggttgttcgatatcggcctgtgtctgccttcgggacctacactgacagatgaggatatcaggagagtggtggatacgattaggaagatgtag

SEQ ID NO: 43256 - protein, 376 aa, Bacteroides fragilis YCH46
MNKRIWLSLAHMGGREQDFIKEAFDTNWVVPLGPNVDAFEQSLVEYLHEDRYVVALSAGTAALHLGLILLDVKPGDEVICQSFTFAASANPISYLEAKPVFVDSEKDTWNMDPVLLEEAIKDRLRKTGKLPKAIIPVHLYGMPAKMDEIMDIAGRYGIPVLEDAAEALGSELNGRKCGTFGELAALSFNGNKMITTSGGGALVCRTEEEARQTKFYATQARDAAPHYQHTHIGYNYRMSNICAGIGRGQMFVLDEHIARRRAIHSLYVDLLKDVAGITVMENPDSRFASNFWLTCILVDPKLAGKSREDIRLRLDSENIETRPLWKPMHLQPVFTDAPFYGNGTSERLFDIGLCLPSGPTLTDEDIRRVVDTIRKM

SEQ ID NO: 43257 - DNA, 1143 bp, Bacteroides fragilis YCH46
  CDS (1)..(1143)
atgtataatgacataactactttcatccatagcctgtttggtacggatgaatttgttccgttgcacgctccgttgtttatcggtaacgaaaaaaaataccttgcagaatgtattgatactacttttgtctcgagtgtgggcaagtttgtcgatcgttttgaagagcttgttgcttgctatacgggctcaaaaagagctgttgtctgtgtgagtggtactaatgcattgcacatgggtatgcttcttgtcggtgtcgagcgtgatgatgaagttttaactcaggctcttacctttatcgctacctgtaacgccatcagttatattggtgcacatcctgtatttcttgatgtggatagagatactttggggctttctcctcttgctgtaaaaagatggttgtctgggcatgcggaagtaaggaatgggcagtgttataataagaagacgggacgccgcatcaaggcctgtgttcctatgcatacgttcgggcatcctatgaagattgacgaattgtcggcagtgtgcaacgaatatcatatagaacttgtcgaggatgcggccgaaagtatcggcagtttctataaaggccgtcatacgggtactttcggaagagtgggagccatcagttttaatggtaataaaacgattaccaccggtggtgggggtatgttgcttttccaggacgaagagttgggcaggctcgccaaacatttgacaacccaagccaaagttccgcaccgttgggcctttgttcatgatcatatcggctacaattaccgtatgcctaatatcaacgccgcattgggttgtgcccaaatggagaatcttgacaggtacgtttccaataaacgtgagacagcagaacggtatcgtgagttcttttctcatattcctgatgttgagtttgttgttgagcctgcgaacagccgttctaactattggttgaacgctgtacttttgaaagaccgccgggcccaacagtctttccttgaatatacgaacgatcatggtgtaatgacccgccccgtttgggaattgatgaacagacttgagatgtttcgtggatgtgagacggatggtttggaaaatactgtgtggttggaagaaagaattgtgaatataccaagtagtgtaagattataa

SEQ ID NO: 43258 - protein, 380 aa, Bacteroides fragilis YCH46
MYNDITTFIHSLFGTDEFVPLHAPLFIGNEKKYLAECIDTTFVSSVGKFVDRFEELVACYTGSKRAVVCVSGTNALHMGMLLVGVERDDEVLTQALTFIATCNAISYIGAHPVFLDVDRDTLGLSPLAVKRWLSGHAEVRNGQCYNKKTGRRIKACVPMHTFGHPMKIDELSAVCNEYHIELVEDAAESIGSFYKGRHTGTFGRVGAISFNGNKTITTGGGGMLLFQDEELGRLAKHLTTQAKVPHRWAFVHDHIGYNYRMPNINAALGCAQMENLDRYVSNKRETAERYREFFSHIPDVEFVVEPANSRSNYWLNAVLLKDRRAQQSFLEYTNDHGVMTRPVWELMNRLEMFRGCETDGLENTVWLEERIVNIPSSVRL

SEQ ID NO: 43259 - DNA, 1224 bp, Bacteroides fragilis YCH46
  CDS (1)..(1224)
atgaaaatacctttttcaccaccttatattgacgaggcggtcatcaacgaagtcgttgattcgttacgttccggttggatcacatccggtccgaaagtgaaggctttggaggaagaaattaaatctttctcgggagcaaaagaagtgctttgtgtcaattcctggacatcaggagctattatgatgttgcgttggctgggagtgaaggagggcgatgaagtgattgttcctgcctatacttacagtgcaacggcattggctgtgctccatgccggagccaaaccggtaatggtggattccggaactgattttaatatttcggtgggggctgttcgtaaagctattactcctaaaacaaaggcgattatacccgtagatattgctggttttccttgcgattatgaaagaatcatggcactggtgcaggaaccagaaatggtaaaactgttccgttcggaatctcctgtgcaagaaaaattgggacgcatcttggtgatgaatgatgctgcccactctttgggagcacgttacagtagctgtcagcgtaccggttgtgaaactgatgtggctatcttttcacttcatgccgtgaaaaatgtgactactgccgaaggtggggccatttgcctgaatctgcctaagccgttcgataatacggagttgtataaagagctacggatgacaagcttgaactgccagaccaaggatgctttttcgaaatctaaagccggaggatggcgttatgatattgtcggtttcgggatgaaaatcaatatggccgatgtaaatgccgccataggactggcacagatacgagaatatccggaattgctgaaagaacgaaagcgggtgtttaatgcttatagcgatgctttttcggcttgtgactgggccatcgttccgccttctgtggatggggaaaaggaaagctcttatcacatttatgctttgcgtattaaggactttaccgaagaacaacgagaccggatgattgatgaaatcgctaaaagtgaagtggctgtcaatgtgcactttataccgatgccgatgttgtcgttcttcaaatcgatgggatatgatataaaggattatccacaggcttatcagaactttaagagcgaaatatcattgccgatatatccccaattggatagtgaaaaattgaatttcattattgaaactgtaaaggcggcctatgcgaccgtgattgcagaaaaccgatag

SEQ ID NO: 43260 - protein, 407 aa, Bacteroides fragilis YCH46
MKIPFSPPYIDEAVINEVVDSLRSGWITSGPKVKALEEEIKSFSGAKEVLCVNSWTSGAIMMLRWLGVKEGDEVIVPAYTYSATALAVLHAGAKPVMVDSGTDFNISVGAVRKAITPKTKAIIPVDIAGFPCDYERIMALVQEPEMVKLFRSESPVQEKLGRILVMNDAAHSLGARYSSCQRTGCETDVAIFSLHAVKNVTTAEGGAICLNLPKPFDNTELYKELRMTSLNCQTKDAFSKSKAGGWRYDIVGFGMKINMADVNAAIGLAQIREYPELLKERKRVFNAYSDAFSACDWAIVPPSVDGEKESSYHIYALRIKDFTEEQRDRMIDEIAKSEVAVNVHFIPMPMLSFFKSMGYDIKDYPQAYQNFKSEISLPIYPQLDSEKLNFIIETVKAAYATVIAENR

SEQ ID NO: 43261 - DNA, 1110 bp, Bacteroides fragilis YCH46
  CDS (1)..(1110)
atggatgaaaaactaatcacggttacttctccacttcttccttccttggatgactttattccttatcttgaggatatctgggatcgtaaatggctcactaataatggtcattatcatcagaagttggagcaggctttatgtgagtatttaaaggtaccttatattagtctttttactaatggtacacttcctttaatgtgtgccttacaagcattacgtataaccggtgaagtgattacgactccttatagttttgttgccactacccattctctgtggtggaacgggattaagccggtgtttgtggatattgatcctgtaacctgtaatctggatcctgaaaaaatagaggccgctattactcccaagacgactgctattatgcctgtgcatgtttatggcaaaccttgtgacacggttcgtattcaagagattgcggataaatatggtttgaaggtcatttatgacgctgcccatgcatttggtgtggaggtaaacggcaagtcaatacttgaatccggtgatatgtccactctgagttttcatgctacgaaggtctataatacgattgaaggtggagctctggtctgtcacgacgaacagaccaagaaacgtattgattatctgaagaattttggctttgccggtgaaacgacgatcgttgcccctggtattaatggtaagatggatgaagtccgttccgcttatggactattgaatttgaaacaagttgattccgccattgaggctcgtcgtaaagttgccgttcaatatcgtgatgctttgaaagatatccccggtatccgtttcatggaggatatgcccggtgtccgtcacaactattcttattttcctatttttataaatgctgaggaatatggtctgactcgtgatgaactttacttcaagttgaaagagaatgacgtactcggcagaaggtatttttatccgttgataagtgagttttccacttatcgtgggctggaatccgcacatccggataatttgcccattgcgaataggatagcaaacagtgtgatttgtttgccaatatatgctggtttatcaatagactatatcaatcgaattttattattaataataaggtaa

SEQ ID NO: 43262 - protein, 369 aa, Bacteroides fragilis YCH46
MDEKLITVTSPLLPSLDDFIPYLEDIWDRKWLTNNGHYHQKLEQALCEYLKVPYISLFTNGTLPLMCALQALRITGEVITTPYSFVATTHSLWWNGIKPVFVDIDPVTCNLDPEKIEAAITPKTTAIMPVHVYGKPCDTVRIQEIADKYGLKVIYDAAHAFGVEVNGKSILESGDMSTLSFHATKVYNTIEGGALVCHDEQTKKRIDYLKNFGFAGETTIVAPGINGKMDEVRSAYGLLNLKQVDSAIEARRKVAVQYRDALKDIPGIRFMEDMPGVRHNYSYFPIFINAEEYGLTRDELYFKLKENDVLGRRYFYPLISEFSTYRGLESAHPDNLPIANRIANSVICLPIYAGLSIDYINRILLLIIR

SEQ ID NO: 43263 - DNA, 1098 bp, Bacteroides fragilis YCH46
  CDS (1)..(1098)
atggttaaatttttagatttacaaaaaattactcagaagtattctatagagatccacgaggctgttagtcgcgtaattgattccggctggtatttacagggacaggaaaatgaaaagtttgaagctaattactcaacatatattggaacgaagtatgcaataggctgtgcaaatgggttggatgctttgatttggatatttcgtgcctatatagaaatgggggtaatgaaggtcggtgatgaagttatcgttccagccaatacctatattgcttctattttagctatttcagagaatggtttgaaacctgtcttggtagagccggatcttaatacttatcaaattgacgataaaaggattggagaagccattacttccaaaacaagagcgattttgatagtacatttgtatggtcaatgtgcttatactgaaaagatcggggatctctgtaaaaagtataatttaaaattgatcgaagataacgcacaggcgcatggttgtctgtataatggtaaaaaaacgggttcattgggtgatgcagccggacatagtttttatcctggcaagaatcttggtgcgtttggtgacgccggtgctgtaactaccaatgatcaagaattagcaaaggtaatacgtgccattgctaactacggttcaacaaagaagtatgtatttaagtatataggccgtaatagccgtttggatgaaatacaggcagtcgtgttgaatgtaaaattgaaatatttagatgaagatgtagctattcggaaagaagtagcgaagtattatattgataatgtcaggaatcctaaaataattgttccaatagtaaatgattgggatagccatgcttttcatatatttcctattcgttgcacacagcgcgatgaactgcagaaatatttggctgataatggtgtgcagactattattcattacccaatacctcctcataaacaggagtgctataaagagtggaataatttaagttttccaataacagagcaaattcataatgaagagttaagtttgcctatgagttctgtaatacttaaaaaagaacaaaaaatagttattgatttattaaatagattttaa

SEQ ID NO: 43264 - protein, 365 aa, Bacteroides fragilis YCH46
MVKFLDLQKITQKYSIEIHEAVSRVIDSGWYLQGQENEKFEANYSTYIGTKYAIGCANGLDALIWIFRAYIEMGVMKVGDEVIVPANTYIASILAISENGLKPVLVEPDLNTYQIDDKRIGEAITSKTRAILIVHLYGQCAYTEKIGDLCKKYNLKLIEDNAQAHGCLYNGKKTGSLGDAAGHSFYPGKNLGAFGDAGAVTTNDQELAKVIRAIANYGSTKKYVFKYIGRNSRLDEIQAVVLNVKLKYLDEDVAIRKEVAKYYIDNVRNPKIIVPIVNDWDSHAFHIFPIRCTQRDELQKYLADNGVQTIIHYPIPPHKQECYKEWNNLSFPITEQIHNEELSLPMSSVILKKEQKIVIDLLNRF

SEQ ID NO: 43265 - DNA, 1224 bp, Bacteroides fragilis YCH46
  CDS (1)..(1224)
atgaaaataccattttcaccaccttatattgacgaggcggtcatcaatgaagtcgttgattcgttacgttccggttggatcacatccggtccgaaagtgaaggctttggagaaagaaataaaatctttctcgggagcaaaagaagtactttgtgtcaattcctggacatcaggagctattatgatgttgcgttggctgggagtgaaggagggagatgaagtaattgttcctgcttatacttatagcgcaacggcattggccgtgcttcatgccggggctaaaccggtgatggtggattccggaatggattttaatatctcggtagaggctgttcgtaaagctattactgctaaaacaaaggcaattatcccagtagacattgccggttttccttgcgattatgaaaagatcatggcactggtgcaggaacctggaatgataaaattgttccgtgcggaatctcccgtgcaagaaaaattaggacgtatcttggtgatgaatgatgctgcccattctttgggggcacgttacagtaaccggcagcgtaccggttgcgaaactgatgtggctatcttttcactccatgccgtgaagaacgtgactactgccgaaggcggagccatttgtttgaacttgcccaagccgttcgataatgcagagctgtataaagaactccggatgatgagcttgaactgccagactaaggatgctttttcgaaatcgaaagccggaggatggcgttatgatattgtcggtttcggaatgaaaatcaatatggccgatgtgaatgctgccatcggactggcgcaaatacgggaatatccggagttactaaaggagcgaaaaagggtgttcaatacctacaatgatgctttttcgacttgtgactgggctattgtgccgccttctgtagatggagaaaaggaaagctcttatcatatttatgctttgcgtgtgaaagactttacagaagagcaacgcgaccggatgattggcgagattgctaaacgtgaagtggctgtgaatgtacattttataccgatgccgatgttgtcgttcttcaaatcgatgggatatgctatgaatgattatccacaggcttatcagaattttaagggggagatatcattaccgatatatcctcaactggatagtgaaaaattgaatttcattattgatactgtaaaggcggcctatacgaccgtaatcgcagaaaacagatag

SEQ ID NO: 43266 - protein, 407 aa, Bacteroides fragilis YCH46
MKIPFSPPYIDEAVINEVVDSLRSGWITSGPKVKALEKEIKSFSGAKEVLCVNSWTSGAIMMLRWLGVKEGDEVIVPAYTYSATALAVLHAGAKPVMVDSGMDFNISVEAVRKAITAKTKAIIPVDIAGFPCDYEKIMALVQEPGMIKLFRAESPVQEKLGRILVMNDAAHSLGARYSNRQRTGCETDVAIFSLHAVKNVTTAEGGAICLNLPKPFDNAELYKELRMMSLNCQTKDAFSKSKAGGWRYDIVGFGMKINMADVNAAIGLAQIREYPELLKERKRVFNTYNDAFSTCDWAIVPPSVDGEKESSYHIYALRVKDFTEEQRDRMIGEIAKREVAVNVHFIPMPMLSFFKSMGYAMNDYPQAYQNFKGEISLPIYPQLDSEKLNFIIDTVKAAYTTVIAENR

SEQ ID NO: 43267 - DNA, 1149 bp, Burkholderia mallei ATCC 23344
  CDS (1)..(1149)
atgagcgcactgccgctgcgcgccgtcgaaccgtggatcgacgagcgcatctttgtcacccaaccgcatctcgcgccgctcgccgaattcctgccttatctcgaggcgatctgggaaagcaaggtgctgacgaacggcgggccgtttcatcagcagctcgagaaggcgctgtgcgactacctcggcgtgcgtcacctcgcgctcttcacgaacggcacgctcgcgctcgtcacggcgcttcaggcgctgcgcatcacgggcgaagtgatcacgacgccgtattcgttcgtcgcgaccgcgcactcgctgctgtggaacgggatcaagccggtgttcgtcgacatcgatccgagcacgctgaatctcgatcccgcgaagatcgaggcggcgatcacgccgcagacgaccgcgatcatgcccgtgcactgctatggccggccgtgcgacgtcgccgcgatccagaaaatcgccgacaactacaatctgaaggtgatctatgacgccgcgcatgcattcggcgtgaagacgcccgacggcagcgtgctcgagcacggcgacatgtcgatcctgagctttcacgcgacgaaggtgttcaacacgttcgaaggcggcgcgatcgtctgcccggacgcgaagacgaagcagcacatcgatcacctgaagaacttcggcttcgtcgacgaagtcaccgtcgtcgcggcgggaatcaacggcaagatgagcgagatcaacgcggcattcggtctgctgcagctcaagcacatcgacgatgcgctcgcgcgccgcgcgaagatcgacgccgcataccgcgacgcgctcgcccgcgtgcccggcatccgttgcctgccgcccgtcgacgcgccggtcgcgaatcattcgtacttcccgattctcgtcggcgacgactacccgatgagtcgcgacgcgctgtaccagcgcctgcgcgaccaccagatctacgcacgccgctatttctacccgctcatctccgatttcccgatgtatcgcgggctgccgtccgcgcagcgcggcaatctgcccgtcgccgccgacgccgccgcgcgcgtgctgtgcctgccgatctatccggcgctgtccgatgcatcgctcgagcgaatcgtatcgctgatggcgggagcgcatgcatga

SEQ ID NO: 43268 - protein, 382 aa, Burkholderia mallei ATCC 23344
MSALPLRAVEPWIDERIFVTQPHLAPLAEFLPYLEAIWESKVLTNGGPFHQQLEKALCDYLGVRHLALFTNGTLALVTALQALRITGEVITTPYSFVATAHSLLWNGIKPVFVDIDPSTLNLDPAKIEAAITPQTTAIMPVHCYGRPCDVAAIQKIADNYNLKVIYDAAHAFGVKTPDGSVLEHGDMSILSFHATKVFNTFEGGAIVCPDAKTKQHIDHLKNFGFVDEVTVVAAGINGKMSEINAAFGLLQLKHIDDALARRAKIDAAYRDALARVPGIRCLPPVDAPVANHSYFPILVGDDYPMSRDALYQRLRDHQIYARRYFYPLISDFPMYRGLPSAQRGNLPVAADAAARVLCLPIYPALSDASLERIVSLMAGAHA

SEQ ID NO: 43269 - DNA, 1152 bp, Burkholderia pseudomallei K96243
  CDS (1)..(1152)
atgagccagacttccgttcctttcctgccgttcgtcaaacccgagatcgacgaggaaaccattcagggcgtggccgacgtgctgcgctccggctggatcacgaccggcccgcagtgccagcgcttcgaggccgcgctgtccgaatactgcggcgggcgtcccgtacgcgtgttcaactcgggcacggcgacgctcgagatcggcctgcggatcgcgggcgtcggccccggcgacgaagtgatcacgacgcccgcgtcgtgggtcgcgacgagcaacgtgatcctcgagacgggcgcgacgcccgtgttcgtcgacatcgatcccgtcacgcgcaacctcgatctcgacctcgtcgaaaaggcgatcacgccgcgcacgaaggcgatcatcccggtgtacctcgcgggcctgcccgtcgacatggaccgcctctacgcgatcgcgcgcgcgcacgagttgcgcgtgatcgaggacgccgcgcaggcgctcggctcgacgtggcgcggccagcgcatcggcgcgatcggcgacatcgtgtcgttcagcttccatccgaacaagaacatcacgtcgatcgaaggcggcgcgctcgtgctcaacgacgaggccgaggcgacgctcgcgcagaagtaccggctgcagggcatcacgcgcacgggcctcgacgggatggactgcgacgtgctcggcggcaaatacaatctgaccgacgtcgccgcgcgcgtcggctggggccagctcgcgcacctcgaacgcttcaacgcgacgcggcacgcgctcgcgcgccgctacttcgacgcgttcgcgaacgggcccgcgtgcgcgctcggcgtcgggctgcccgtcgcggatttcgaaaacaccaactggcacatgttccagatcacgctgccgctcgagaagctgtcgatctcgcgcggcgaattcatggagcagttgaagcagcgcggcatcggctcgggcgtccattacccggccattcatcttttcacgctgtaccgcgcgcgcggctttgcgcagggcatgttcccccacgccgagcgcttcggcgcgtcgaccgtcacgctgccgctcttcacgcagatgagcgaggcgcacgtgcaacgggtcgtcgacgccgtcaaccagatttgcgaacaatacggaaaataa

SEQ ID NO: 43270 - protein, 383 aa, Burkholderia pseudomallei K96243
MSQTSVPFLPFVKPEIDEETIQGVADVLRSGWITTGPQCQRFEAALSEYCGGRPVRVFNSGTATLEIGLRIAGVGPGDEVITTPASWVATSNVILETGATPVFVDIDPVTRNLDLDLVEKAITPRTKAIIPVYLAGLPVDMDRLYAIARAHELRVIEDAAQALGSTWRGQRIGAIGDIVSFSFHPNKNITSIEGGALVLNDEAEATLAQKYRLQGITRTGLDGMDCDVLGGKYNLTDVAARVGWGQLAHLERFNATRHALARRYFDAFANGPACALGVGLPVADFENTNWHMFQITLPLEKLSISRGEFMEQLKQRGIGSGVHYPAIHLFTLYRARGFAQGMFPHAERFGASTVTLPLFTQMSEAHVQRVVDAVNQICEQYGK

SEQ ID NO: 43271 - DNA, 1155 bp, Methylococcus capsulatus str. Bath
  CDS (1)..(1155)
atgagcgtccagccgagcatactgttttccgatccggacatgagcctcgccgaactggaggcggtcgaggaagtgctgaaatcgccgaggctttccgccggctcggtggttgaagatttcgaggccgccttcgccgaatatctgggtcggaaacatgcggtggcggtgagcagtgccacgatggggctgctgctggcgcttcgggcttacggcatcgggccgggcgacgaagtcatagcccctcctttcggtttccgcgaaaccgcgcatgccattacgctggccggcgcgaagccggtgttcgtggacatcgactactggacctgcaccctcgtgccggacaaggcggctgccgccgtcacgccccagaccaaggccatcctggccggcaacgtcaacggccacccggcgctgtgggcgcagctccgggcgctggccgacgaatgcggcctgattctgatcgaggattccagcgaggccatcggctcgcgttatcagggcaggctggtcggaagcttcggtgactgctcgatcttcgacttcacccagcccagtgccctcaccaccggtgagggtggcatggtggtgaccgacgacgggaatctggcgctccgcctgcgcggctaccgcaaccgccgcctggacgagcgtaactcggtggtgttgggcgattcgccaccgtaccgggcggaaatgagcgacatcaacgcggccctcggcctggcccaactggagcggctggacgggatactcgagcggcgtaaggacgtcgaggcctattacgatgccttcatgcagtccttcgagggcatcaagccggcttatcaggcgccggaggtcgacgaactgcactggatggtctacctggtgcatctggggacgcgcttcacccgttccagccgtgacgtggtcatccaggacctggcgacggcggaggtggaatccgtggctttctgttcgcctctgcatacccagcgccattacctcgacctgggttaccgcaagggccagttcttcgtgacggaaaagctggcggaccgggccatcgccctgccgttccactgccatctcacggaagaccagatcggcttcatcgtccagaccgccaaggattcatccgtcaacgtgggcgccggtgccgcgatctatctgtga

SEQ ID NO: 43272 - protein, 384 aa, Methylococcus capsulatus str. Bath
MSVQPSILFSDPDMSLAELEAVEEVLKSPRLSAGSVVEDFEAAFAEYLGRKHAVAVSSATMGLLLALRAYGIGPGDEVIAPPFGFRETAHAITLAGAKPVFVDIDYWTCTLVPDKAAAAVTPQTKAILAGNVNGHPALWAQLRALADECGLILIEDSSEAIGSRYQGRLVGSFGDCSIFDFTQPSALTTGEGGMVVTDDGNLALRLRGYRNRRLDERNSVVLGDSPPYRAEMSDINAALGLAQLERLDGILERRKDVEAYYDAFMQSFEGIKPAYQAPEVDELHWMVYLVHLGTRFTRSSRDVVIQDLATAEVESVAFCSPLHTQRHYLDLGYRKGQFFVTEKLADRAIALPFHCHLTEDQIGFIVQTAKDSSVNVGAGAAIYL

SEQ ID NO: 43273 - DNA, 1095 bp, Methylococcus capsulatus str. Bath
  CDS (1)..(1095)
atgatccccatggttgatctcaagacccagtatgcccggctgaaaccggaaatcgacaaggggctggcggatgcgctggaatcctgtgccttcgtgctcggcccgaacgtgcaggccttcgagaaggaggccgccggctatctgggcgtgaagcatgccatcggggtggcatcgggtaccgacgccttgcatctggccctgctcgctgccggcatcggcgagggcgacgaggtcatcacgtcgcccttcaccttcatcgcgacggcggaggcgatccgctacgtcggcgccaagccggtgttcgtcgacatcgacgccaagaccttcaatctctgcccggcagcggtcgaagccgcggtgacggccaggacccgtgccatcatgccggtgcatctgttcggccagccggccgacatgccgcggctgcagtccatcgccgagcgccatgggttgaagatcgtcgaagactgcgcgcagtcgttcggcgccaccatcggcggccgccagaccggcagtttcggggtgagttccggtttcagcttcttccccagcaagaacctgggctgctacggcgacggcggcctggtgacgaccgattcggacgaggtggcggagcaggtcaggatgctgcgtaaccacggctcgaaggtgcgttactatcacgacgtgatcggctacaacagccggctggatgagctgcaggcagtggtgctgcgggtcaagctcaaatacatcgacgaattcaacgccaaccgacgccgcgtcgcccatctgtattcggaacttctgggcgggatcgccgaggtgccttacgaggatggcatcggccagcacgtctaccaccagtacactctgctgagcgaccgccgtgatgccatcctggaggcgctgcagaaagccggaatcggctgcgcgatctactaccccgtgccgctgcaccggcagaatgtgttcgcgcgggattacgccgatctcagcctgccggtctgcgaggcggtggcggcgcgttgcatctccctgccgatcttccccgagctggcggaagcggacatccgcaggatcgcggacgtggtgcgccaggcggtgaatggctga

SEQ ID NO: 43274 - protein, 364 aa, Methylococcus capsulatus str. Bath
MIPMVDLKTQYARLKPEIDKGLADALESCAFVLGPNVQAFEKEAAGYLGVKHAIGVASGTDALHLALLAAGIGEGDEVITSPFTFIATAEAIRYVGAKPVFVDIDAKTFNLCPAAVEAAVTARTRAIMPVHLFGQPADMPRLQSIAERHGLKIVEDCAQSFGATIGGRQTGSFGVSSGFSFFPSKNLGCYGDGGLVTTDSDEVAEQVRMLRNHGSKVRYYHDVIGYNSRLDELQAVVLRVKLKYIDEFNANRRRVAHLYSELLGGIAEVPYEDGIGQHVYHQYTLLSDRRDAILEALQKAGIGCAIYYPVPLHRQNVFARDYADLSLPVCEAVAARCISLPIFPELAEADIRRIADVVRQAVNG

SEQ ID NO: 43275 - DNA, 1182 bp, Methylococcus capsulatus str. Bath
  CDS (1)..(1182)
atgaccaagcagaccagcccggcgctcagggaagatttcctggttttcggcgcgcccgccatttcccgcgcggagatcgacgaagtcgtcgcctgcctcgaatcggggtggatcgggacggggccgcgggtggcccggttcgagtcggatttcgcccgctacaaaggcgtgccggaacagcgcgtcgccgcggtgaattcctgcaccgcggccctgcacctgagcctcctggcgttgggcctggagccgggggacgaggtcatcaccacgccgctgacgttctgtgccaccgtcaacgccattcttcacgccggactcaggccggtgctggcggacgtcgatccggcgacgctgaatctcgatccggcggcggtgggggccgccgtcggcgagcggacgcgggcgatcctgccggtgcatttcgccggccatccctgcgacatggccgccctgggcgaaatagccgcccgccacggcctgcgcgtggtggaggactgcgcccacgccatcgaaaccgaattccgcagccagcccgccggcaccttcggtgagttcgcctgcttcagcttctacgtgaccaagaacgtcgtcaccggcgaaggcggcatggtgatcggcaaggatgccgacagcatcggccgggtcaagaccctggcgttgcacggcatgagtcgggacgcctggaagcgcttcggcgacgagggcttcaagcattaccaggtcgtcgaatgcggattcaaatacaacatgatggatttgcaggccgcgatcggcatccatcagctcgcccgggtggaggagagctggcgccgccgccgcgagatatgggcgcgctaccaggaggccttcgccgacctgccggtgacccggccggccgaggcggcgccggattgccgccacgcctaccacctgtacacactgctgatcgacgagaaggaaaccggcgtgagccgtgatgccttcctggatgcgatgacggcgcgcagggtcggggtcggcgtccactacctcagcctgccggagcacccgtattaccgcgagacgctgggctggcggccggaggactttccccacgcccgacgcatcggccgccagaccgtgagcctgccgctatcgcccgccttgagcgacagcgacgtcgcctacgtcatcgacgccgtccgcgccatcgtactgcgctga

SEQ ID NO: 43276 - protein, 393 aa, Methylococcus capsulatus str. Bath
MTKQTSPALREDFLVFGAPAISRAEIDEVVACLESGWIGTGPRVARFESDFARYKGVPEQRVAAVNSCTAALHLSLLALGLEPGDEVITTPLTFCATVNAILHAGLRPVLADVDPATLNLDPAAVGAAVGERTRAILPVHFAGHPCDMAALGEIAARHGLRVVEDCAHAIETEFRSQPAGTFGEFACFSFYVTKNVVTGEGGMVIGKDADSIGRVKTLALHGMSRDAWKRFGDEGFKHYQVVECGFKYNMMDLQAAIGIHQLARVEESWRRRREIWARYQEAFADLPVTRPAEAAPDCRHAYHLYTLLIDEKETGVSRDAFLDAMTARRVGVGVHYLSLPEHPYYRETLGWRPEDFPHARRIGRQTVSLPLSPALSDSDVAYVIDAVRAIVLR

SEQ ID NO: 43277 - DNA, 1140 bp, Nocardia farcinica IFM 10152
  CDS (1)..(1140)
ttgagcactgaccgggtcatcttcagcaggccgtaccgggcgcgccgggaactggccaatctcgcggcggtgctcgcctccgaccacagccacggcgacggccccttcaccgcgtcggccaccgccaagctccaggcgatcaccgaggcgccgcacgcactgctgaccacctcgtgcacgtcggcgctggagatggcgggcctgctgctcgaactcggccccgaggacgaggtgatcgtgcccagtttcgcgttcacctccaccgcgacgtcgatggcgttgcgcggagccacgtgcgtgttcgccgacatcgacccggccaccgggaatctcgaccccgagtcggtcgccgcggcgatcgggccgcgcaccaaagcggtggtggtcatccactacggcggcgtggccgccgacatggccgggctgctcgagctggccgcgactcacggcttcgcgatcgtcgaggacaacgcgcacggcctgggcggccggtggcgcggcaggccgctcggcaccatcggcaccctgggcacgctcagcttccacgacaccaagaacgtgcactgcggcgagggcggcgcgctgctgctcaccgacgacatcctgatgggccgcgcggagatcatccgggagaagggcaccgaccgcgcccggttcctgcgcggcgcggtggacaagtactcctggcaggacatcggctcgagctacctgcccagcgaactcaacgccgcggtgctcgacgcccagctcgacgagttcgaccgcatccaggcgggcaggcaccgggtgtggaacgcctacgcggcgggcctgccggactgggcggcgcgcaacgacgtccggctgatgtcggtgcccgccgaccgcgaacacaccgcccatctgttctacctgcgcacacccaccgagcagcgccgcgacgacctgatcgcgcatctggccgcgcgcggcatctccgcgccgttccactacgtgccgctggactccagcccggccgggctcaagctgggccgcacaccgtatccgtgtgtgcgcagcgccgagttctccggcaccgtcgtgcgcctgccactgtggcccgatctggccgacgcccaggtcgagcgggtgatcgaggccgtcaccgcgttcacggtgtga

SEQ ID NO: 43278 - protein, 379 aa, Nocardia farcinica IFM 10152
MSTDRVIFSRPYRARRELANLAAVLASDHSHGDGPFTASATAKLQAITEAPHALLTTSCTSALEMAGLLLELGPEDEVIVPSFAFTSTATSMALRGATCVFADIDPATGNLDPESVAAAIGPRTKAVVVIHYGGVAADMAGLLELAATHGFAIVEDNAHGLGGRWRGRPLGTIGTLGTLSFHDTKNVHCGEGGALLLTDDILMGRAEIIREKGTDRARFLRGAVDKYSWQDIGSSYLPSELNAAVLDAQLDEFDRIQAGRHRVWNAYAAGLPDWAARNDVRLMSVPADREHTAHLFYLRTPTEQRRDDLIAHLAARGISAPFHYVPLDSSPAGLKLGRTPYPCVRSAEFSGTVVRLPLWPDLADAQVERVIEAVTAFTV

SEQ ID NO: 43279 - DNA, 1503 bp, Legionella pneumophila str. Lens
  CDS (1)..(1503)
atgattactatcaaagaattatacataaataaacaagaatgcctgaaaactgccttgaagaagctggatgctacggctcaaggtgtgttatttctggtagatagtgatgagtgtttgataagaacggttacagatggtgacattcgaagattactattaaaaggattcacattagattctactttagaggaattatcagagcattcatcaaaagctttacccgtctctgctacgattcaggatgcctaccatttaatgcaggaatatgaattagatcatattcccgttatcgatgagagtaatcgccccatacgcttgatccaccggagagaactatcttccaatattctgctttcctcgcctcatatcggtgagcatgagcagcaatacgtacaggaagcttttgccaccaactgggtagcccctttaggccccaatgttgattcttttgaaaaagaagtggcggaatacattaacataaaatcagctgtagctttaagctcaggaacagctgcaattcatctggcactcgtattactcgatgtgaaaccaggagatattgtcttcgcatccagctttacttttgtagccacagtgaaccctatcttataccaaggggcgactccggtatttattgattctgatttggacacctggaatatgtctccggttgctcttgagcgggcattaagagaaagtaaagcaaaaaatcaaatgccaaaagccgtgattattgttaatttatatggacaaagcgctaattatgacgctttatgccaattatgtaatgaatacaatgttccaattatagaagatgcggcggagtctttgggagctacctataacaacaagtacagcgggactttcggcaagttaggcgtgttttcatttaatggcaacaaaatcattaccacgtctggtggcggcatgttggtgtctgaagacgagagtctcatacaaagagcaagatttttatcaactcaagctcgagaaccagtaccccattatgagcatactgtggttgggtataattacaggatgagtaatgtgcttgccggcataggcagagggcagctgaaagtattggaaaaacgggttaaggcaagacgagctatttttgatcgatataagcaagccttggaatcttacccatttattgacatgatgccagagataacccaaggatacagtactcgttggttatcgacattagttattaaaccaacgccatacaagataagaccggaagaagtcatagagcaattaaagccgtttaaaatcgaagcaagaagaacctggaagcctatgcataggcagcctttgtttgtaggctctaaatactaccctcatgatgaacaattcagtgtttcagattacttgtttgatcatggtatttgtcttccttccgggtcaaatttaacttccagggatattgatagagtcattcattgtttgaatgatatttttattaaatataagcaaaacaattttgaggtagcttaa

SEQ ID NO: 43280 - protein, 500 aa, Legionella pneumophila str. Lens
MITIKELYINKQECLKTALKKLDATAQGVLFLVDSDECLIRTVTDGDIRRLLLKGFTLDSTLEELSEHSSKALPVSATIQDAYHLMQEYELDHIPVIDESNRPIRLIHRRELSSNILLSSPHIGEHEQQYVQEAFATNWVAPLGPNVDSFEKEVAEYINIKSAVALSSGTAAIHLALVLLDVKPGDIVFASSFTFVATVNPILYQGATPVFIDSDLDTWNMSPVALERALRESKAKNQMPKAVIIVNLYGQSANYDALCQLCNEYNVPIIEDAAESLGATYNNKYSGTFGKLGVFSFNGNKIITTSGGGMLVSEDESLIQRARFLSTQAREPVPHYEHTVVGYNYRMSNVLAGIGRGQLKVLEKRVKARRAIFDRYKQALESYPFIDMMPEITQGYSTRWLSTLVIKPTPYKIRPEEVIEQLKPFKIEARRTWKPMHRQPLFVGSKYYPHDEQFSVSDYLFDHGICLPSGSNLTSRDIDRVIHCLNDIFIKYKQNNFEVA

SEQ ID NO: 43281 - DNA, 1116 bp, Legionella pneumophila str. Lens
  CDS (1)..(1116)
atgcaatttatcgacttaaaaacacaatattctttaattgagaatgatattttaaacagcattaaaagggtattaaatcatggccaatatattatggggcctgaaattgcacaacttgaaaaagagttggccgcttttgttggagtgaagcatgcgattgtgaattcaagtggtacagatgctttattaatggcattgatggctctggatattcagcctggggatgaagtaattacaagcccatttagtttcttcgcaacagcagaagtgattagcctttgtcatgcaacacccgtctttgtagatatagatcctttaacttataatttggatcctgagcaattagagagagcaatcactaagaaaaccaaggccattatgccagttgatttatatgggcaatgcgcagattacgatgcgattaatgccattgcagctcaatacggtattcctgttattgaagatgctgcgcagagttttggggctacttataaaggcaaatactcttgttccctggctactattggctgtaccagttttttcccgtcaaaacctttaggtggttatggtgattctggagcttgttttactaatgatgatgttttagcccaaaaattaattgaaattagaattcatgggcaaaatgcccgctattgtcatcatcgggtagggattaatggtcgaatggacactatccaagcagcaatactacttcagaagctgaaaatattttctaatgaaattctaatgcgacaaaaagtagcaaaacgttatgatcaaatgctttctgagttagtgaaaactccttatgtgcatgaatgcaatgcgagtgtgtatgctcagtatactattgaggttgagaatagagatgtatttgcgaagtcaatgcaagcctcaggtatacctacagctgttcattacccaattgctatgcatcaacagcaggcacttggttacttaaattacaaacttggagattttccaaactctgaaaaagcaagtcaacatgtaattagcctgcctatgcacccttatttacaagaagatgagcaattgaaaatagttgcagcagttagaaatgctttacttgtgatgaatgaagaggccatggtataa

SEQ ID NO: 43282 - protein, 371 aa, Legionella pneumophila str. Lens
MQFIDLKTQYSLIENDILNSIKRVLNHGQYIMGPEIAQLEKELAAFVGVKHAIVNSSGTDALLMALMALDIQPGDEVITSPFSFFATAEVISLCHATPVFVDIDPLTYNLDPEQLERAITKKTKAIMPVDLYGQCADYDAINAIAAQYGIPVIEDAAQSFGATYKGKYSCSLATIGCTSFFPSKPLGGYGDSGACFTNDDVLAQKLIEIRIHGQNARYCHHRVGINGRMDTIQAAILLQKLKIFSNEILMRQKVAKRYDQMLSELVKTPYVHECNASVYAQYTIEVENRDVFAKSMQASGIPTAVHYPIAMHQQQALGYLNYKLGDFPNSEKASQHVISLPMHPYLQEDEQLKIVAAVRNALLVMNEEAMV

SEQ ID NO: 43283 - DNA, 1179 bp, Photobacterium profundum SS9
  CDS (1)..(1179)
gtgagtaatcctgtgatcccatatggtaaacaagaaataacccaacaagatatcgatgctgttattagcgtattgcaatctgattttttaacgcaagggcctcaagtgcctgcatttgaaaaagcgcttactgactttacaggtgcggaatatgcgttggcagtcaatagtgctacatcagcattacatattgcttgcctttcattagggctaggcaatggtgattggttatggacgacaccggttacatttgtcgcttctgctaattgtggtctttattgtggcgctcaggttgattttgtcgatatcgatccaaagacatataatatgtgtccagtatcgcttgaaaccaaactgaagctagcacaacaaaacaattgcctgccaaaagtggttgttcctgttcacttatgtggtcagccttgtgacatgaaagcgattcgaaggttagcggaccagtatggttttgctataattgaagatgcatctcatgctattgggggcaaatatgacagtaaacctgtgggcaactgtgaatactcagatattacggtgtttagttttcatcccgtgaaaattgtgacgacagccgaaggcggagcagcactgaccaatagtgtagaattagctgaaaaaatggctttattccgtagtcatggtattactcgtgatgagtctttgatgactgaagaatcacacggtggatggtattaccagcaagtagagcttggttacaattatcggatgactgagttgcaagcagccttgggggttagtcagatgacccgcttgagtgattttgtgacagctaggcaccgcttagctgatcgttataatcaactattggtcgagcttcctgttactcgtccataccaattgcctaatacttattcagggttgcatttatatgtgatccgtttaaatctagacgcaatcacaaagacgcaccgtgaagtttttgatgcacttcgaaataatggtattggggtgaaccttcactatattccagtgcatactcaaccatattaccaagatatggggtttaaacacggtgattaccctcatgcagaagattattatcataatgcgatttctttgccaatgttccatttaatgacggagcagcagcaagatgaagttgttcgtgttcttcgtcaggtattattggagaccaaatag

SEQ ID NO: 43284 - protein, 392 aa, Photobacterium profundum SS9
MSNPVIPYGKQEITQQDIDAVISVLQSDFLTQGPQVPAFEKALTDFTGAEYALAVNSATSALHIACLSLGLGNGDWLWTTPVTFVASANCGLYCGAQVDFVDIDPKTYNMCPVSLETKLKLAQQNNCLPKVVVPVHLCGQPCDMKAIRRLADQYGFAIIEDASHAIGGKYDSKPVGNCEYSDITVFSFHPVKIVTTAEGGAALTNSVELAEKMALFRSHGITRDESLMTEESHGGWYYQQVELGYNYRMTELQAALGVSQMTRLSDFVTARHRLADRYNQLLVELPVTRPYQLPNTYSGLHLYVIRLNLDAITKTHREVFDALRNNGIGVNLHYIPVHTQPYYQDMGFKHGDYPHAEDYYHNAISLPMFHLMTEQQQDEVVRVLRQVLLETK

SEQ ID NO: 43285 - DNA, 1173 bp, Geobacillus kaustophilus HTA426
  CDS (1)..(1173)
atgagcgatgttttattagaattagctaaaaaaattaaaaatatgtgtccagagaaagattttataccactacatgaaccgacattcacaggaaatgaaaaaaagtatgtagctgattgtattgaaacaggatgggtgtcttcagtcgggaagtatgtagataaatttgaacgattgttagcggagtttactggtgtaaaaagagcggttgctgttgtgaacggaaccgccgcccttcatattgctttaaagattgttggggttcagccaaatgatgaagtgctaatcccttccttaacttttgtcgcaactgggaatgcagttgtttattgtggggctgttccgcattttgtagatgtctcaaaaacaacattaggcattgatccatttaagcttgaagattatttgaaagagatagcggaagtaaagaataatgtttgtgtaaataagcaaactaacaggattattcgggcgattgttccaatgcatacatttggccatcctgttgatttagatccattgttggatatatgtgaacgatggaatttaatcatggttgaagatgccgcagaatcgctgggttcctattataaagggattcatacggggaatttcggaaaagcttctgccatgagttttaatggcaataagattattacaaccggtggtggaggagcaattttgacgaatgatgagaaactggcagattatgcgaaacatcttactactactgctaaactccctcatcgctggaaatatgaacatgatgaaataggctataattatcgtatgccaaatataaatgcggcattaggatgcgcacaatttgaacatttagaagattttattgaaaagaaacgtcaacttgttggtaaatatgagcaattgatagaagattatgatggaattaaattattcaaagaacctcagtttgcaaaaagcaattactggttgcaaacattaatttttgatgaaaaaatgtatgacataaatcaagttttggacacgttaaataaccataacgtgatggcaagacctgtatggaaaccgttacaccttttgaacccttttcaaaactttccaaaatctgatttgtcggtaacagaacaattgcagtatcaaattgtgaatgttcctagtagtccatacttaggggaagatgcggatgaataa

SEQ ID NO: 43286 - protein, 390 aa, Geobacillus kaustophilus HTA426
MSDVLLELAKKIKNMCPEKDFIPLHEPTFTGNEKKYVADCIETGWVSSVGKYVDKFERLLAEFTGVKRAVAVVNGTAALHIALKIVGVQPNDEVLIPSLTFVATGNAVVYCGAVPHFVDVSKTTLGIDPFKLEDYLKEIAEVKNNVCVNKQTNRIIRAIVPMHTFGHPVDLDPLLDICERWNLIMVEDAAESLGSYYKGIHTGNFGKASAMSFNGNKIITTGGGGAILTNDEKLADYAKHLTTTAKLPHRWKYEHDEIGYNYRMPNINAALGCAQFEHLEDFIEKKRQLVGKYEQLIEDYDGIKLFKEPQFAKSNYWLQTLIFDEKMYDINQVLDTLNNHNVMARPVWKPLHLLNPFQNFPKSDLSVTEQLQYQIVNVPSSPYLGEDADE

SEQ ID NO: 43287 - DNA, 1119 bp, Geobacillus kaustophilus HTA426
  CDS (1)..(1119)
atgaacgtgccaatgttggatttaagcgaacagtatgaacaattgaagccggagatcatgcgcgtattggatgaagtgatgcgctcctctcgctttattttaggagattatgtcaaaaagctagaagcagatattgccgcctacagccgggctagacatgggatcggctgcggcaacggaagcgatgcgatacatattgctttgcaagcggccggcgtcgggccgggcgatgaagtcatcacgacggcgttcacctttttcgcgacggcaggatcgattgcgcgggccggcgccaaaccggtgtttgtcgatatcgatccggtgacgttcaacatcgatccagcgaaaattgaagcggcggtgacggagaagacgaaagccatcatcccggtgcatttgtacgggcaaatggcggatatggaggcgattgccgcgattgccaagcggcatggattggttgtcatcgaggacgccgcccaggcgatcggcgcgaaatacaacgggaaatgcgttggcgagctggggacggcggcgacgtacagcttcttcccgacgaaaaacttgggcgcctacggggatggcggcatgatcattacgaatgatgacgaactggccgaaaaatgccgggtcatccgcgttcatggcagcaagccgaaatattaccatcatgtacttggctacaacagccgcctcgatgagatgcaagcggcgattttaagcgtcaaattcccgcatctggatcggtggacggaacagcggcgcaagcatgcggcgacgtatacgcgcctgctcgaggaggcggtcggcgaccttgttgtgacgccgaaagaagtcgacgggcgctatcatgtgttccatcaatacacgattcgagcgccgaagcgcgacgagctgcaagcgtttttgaaagaacaggggatcgcgacgatggtgtactatccgctgccgctgcatttacaaccggtgtttgcttcgctcgggtataaggaagggcagttgccggaggcggaaaaagcggcgaaagaagcgctgtcgctgccgatgttcccagagctgaaagaggagcagcaacagtacgtcgtggagaaaattgcggaattttaccgtcattccgcttga

SEQ ID NO: 43288 - protein, 372 aa, Geobacillus kaustophilus HTA426
MNVPMLDLSEQYEQLKPEIMRVLDEVMRSSRFILGDYVKKLEADIAAYSRARHGIGCGNGSDAIHIALQAAGVGPGDEVITTAFTFFATAGSIARAGAKPVFVDIDPVTFNIDPAKIEAAVTEKTKAIIPVHLYGQMADMEAIAAIAKRHGLVVIEDAAQAIGAKYNGKCVGELGTAATYSFFPTKNLGAYGDGGMIITNDDELAEKCRVIRVHGSKPKYYHHVLGYNSRLDEMQAAILSVKFPHLDRWTEQRRKHAATYTRLLEEAVGDLVVTPKEVDGRYHVFHQYTIRAPKRDELQAFLKEQGIATMVYYPLPLHLQPVFASLGYKEGQLPEAEKAAKEALSLPMFPELKEEQQQYVVEKIAEFYRHSA

SEQ ID NO: 43289 - DNA, 1158 bp, Salmonella enterica subsp. enterica serovar Paratypi A str. ATCC
  CDS (1)..(1158)
atggctgaaggaaaaatgatgttggactttttgcctttctcccgtccggcgatgggcgcggaagagcttgctgccgttaagaccgtactggactcaggttggataacaaccggcccgaaaaatcaggaactggaagcggcgttttgtcggctaactggcaatcaatatgccgttgccgtcagttcagccactgccggtatgcacatcgcgttgatggcgctgggcattggtgaaggcgacgaggtcattacaccgtcaatgacgtgggtttctacgctaaatatgatcgttttactcggcgcgaaccccgtcatggtcgatgtcgatcgcgatacgctgatggtcacgcctgaacatatcgaagccgcgattacgccacaaaccaaagcaattatccccgtccactacgctggtgcgcccgccgatctggacgctatttacgctcttggcgagcgttatggcattccagtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcggaggacgcgcgccacaagcggaagtcctggcgccgggctacaaatataatttgcccgacctcaacgccgctatcgcgcttgcccagttacagaaactggatgcgcttaacgctcgccgcgccgccatcgcagcgcagtaccaccaagcaatggcagacctgccttttcagcctctgagccttccgtcgtgggagcatattcacgcctggcatttattcattatccgggtcgatgaagcccgttgcggtattacccgggatgctctgatggcatcgctgaaaacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgggtcattaccgcccttcatcagatagcaggacaataa

SEQ ID NO: 43290 - protein, 385 aa, Salmonella enterica subsp. enterica serovar Paratypi A str. ATCC
MAEGKMMLDFLPFSRPAMGAEELAAVKTVLDSGWITTGPKNQELEAAFCRLTGNQYAVAVSSATAGMHIALMALGIGEGDEVITPSMTWVSTLNMIVLLGANPVMVDVDRDTLMVTPEHIEAAITPQTKAIIPVHYAGAPADLDAIYALGERYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDLNAAIALAQLQKLDALNARRAAIAAQYHQAMADLPFQPLSLPSWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 43291 - DNA, 1143 bp, Idiomarina loihiensis L2TR
  CDS (1)..(1143)
atgattccatttaataagccgcctttgacaggcaacgaagttcaatacattacagaagcattgaagggtaataagatttccggagacggcccttttggaaaacgctgtcagcaatggtttgaagaaaatttaccaactcaaaaggctcttttaacgccttcctgtactgcagcactcgagcttgccgctatccttattgatgtccagtctggcgatgaaataattatgccaagctacaccttcgttagcacagccaacgcatttgtattgcggggagctaaaatcgttttcgtcgatattcgccctgatacgatgaatattgatgaaacgaaaattgaggctgcaattacagatagaactaaagcgattgttcccgtccattatgcgggagttagttgtgaaatggacgccattatggatattgctgggcgttatagtctttacgttatcgaagatgcagctcagggagtaatgagtagctataaagaaagacctttaggcactattggccatttgggcgcttttagcttccatgaaaccaaaaactatacgagtggtggcgaaggcggcctgttaataattaatgatgctcgatttacagaacgagctgaagttattcgtgaaaaaggtactaatagaagtcaattttttagagggcaagtagacaagtatacttgggttgatattggtagtagctacctgcctagtgaaatgcaggcggcatacctttgggctcagcttgagaaagcaaatgaaataaatgatgctcgactccgtacttggaaatcttactatgattcttttagaaaattaattcaggaaggttttatagagttgccgataattcctgattattgtatccacaatgctcatatgttctatataaaagttaaaaacttacaagtgcgaactgagttactcgaatttttaaaaaataaaaatattttgggggcttttcactatatacctttacattcgactcctgtaggtaaggactgggggcgattttctgaggatgaagtgtatacaacatctgaaagcgaacgtttgttaagactaccaattttttttggtataaaagatgaagaagtttcgctagtagtaaaagaagtatcaaatttctttaaggaacctcatgcttaa

SEQ ID NO: 43292 - protein, 380 aa, Idiomarina loihiensis L2TR
MIPFNKPPLTGNEVQYITEALKGNKISGDGPFGKRCQQWFEENLPTQKALLTPSCTAALELAAILIDVQSGDEIIMPSYTFVSTANAFVLRGAKIVFVDIRPDTMNIDETKIEAAITDRTKAIVPVHYAGVSCEMDAIMDIAGRYSLYVIEDAAQGVMSSYKERPLGTIGHLGAFSFHETKNYTSGGEGGLLIINDARFTERAEVIREKGTNRSQFFRGQVDKYTWVDIGSSYLPSEMQAAYLWAQLEKANEINDARLRTWKSYYDSFRKLIQEGFIELPIIPDYCIHNAHMFYIKVKNLQVRTELLEFLKNKNILGAFHYIPLHSTPVGKDWGRFSEDEVYTTSESERLLRLPIFFGIKDEEVSLVVKEVSNFFKEPHA

SEQ ID NO: 43293 - DNA, 1179 bp, Azoarcus sp. EbN1
  CDS (1)..(1179)
atgacagataacgatacccactttgccgccctcgtcgatttggttggcactctctacggcggcggcccgacgcccttgcatcgccccgttttcgaaggcaacgaaaagcaatacctgatcgactgcatcgactcgaacttcgtgtcctcggtgggcgcgcgcgtgaccgagttcgaagagcggatcgccggcttcaccggggcacggtttgcggttgccacggtcaacggcacggccgcgctgcacgtcgccctgcaactggccggcgtggcgcggggcgatgaggtgatcagccaggcgctcacgttcatcgcgacctgcaatgcgctcacttacgccggtgcccggccggtttttatcgacgtggaccgggacaccctgggcctgagcccgcgggcgctgagaacctggcttgcggccaacgctgtaatgcgtgacgggcaggccttcaatcgggccaccggcgcgcggatcgcggcctgcgtgccgatgcacacgttcggcttgccttgccgcatcgaagaaatcgtcgcgatctgtgacgagtacgcgatacccgtcgtggaagatgccgcggagtcgctcggcagctacgtcggcgaacggcataccggcaccttcggaaggctcgcaacgctcagcttcaacggcaacaagatcatcaccaccggcgggggggggatgatcgtcaccaacgatgaagaactggccaggcgcgccaaacacttgaccacgacggccaagattccgcatccgtacgagttcgagcacgacgaaatcggctacaactaccggctacccaacgtgaatgccgcgctcggctgcgcgcagatggaaaagctgcccgcaatgctgacgatcaaggccgaggtggcgcagcgctacgcggcgttttgcgaacagcatggcctccgctatgtcggcgcgctgccgggcatgcggccgaatttctggctgaacgcggtcgtgctcgactcgcgtcaggcgcgtgatgcgctcctcgaatacaccaacagccggggcgtcatgacgcggccgatctggcgtttgatgtcttcgttggagatgttcaaggactgccagcacgatgggctggaaaactcgcgctggctcgaggatcgcgtcgtgaatcttccttccagcgtgcctgaaagcgaattctggagactccagcaatga

SEQ ID NO: 43294 - protein, 392 aa, Azoarcus sp. EbN1
MTDNDTHFAALVDLVGTLYGGGPTPLHRPVFEGNEKQYLIDCIDSNFVSSVGARVTEFEERIAGFTGARFAVATVNGTAALHVALQLAGVARGDEVISQALTFIATCNALTYAGARPVFIDVDRDTLGLSPRALRTWLAANAVMRDGQAFNRATGARIAACVPMHTFGLPCRIEEIVAICDEYAIPVVEDAAESLGSYVGERHTGTFGRLATLSFNGNKIITTGGGGMIVTNDEELARRAKHLTTTAKIPHPYEFEHDEIGYNYRLPNVNAALGCAQMEKLPAMLTIKAEVAQRYAAFCEQHGLRYVGALPGMRPNFWLNAVVLDSRQARDALLEYTNSRGVMTRPIWRLMSSLEMFKDCQHDGLENSRWLEDRVVNLPSSVPESEFWRLQQ

SEQ ID NO: 43295 - DNA, 1083 bp, Francisella tularensis subsp. tularensis Schu 4
  CDS (1)..(1083)
atgagtaaagtaaatgtaacaaaaccatacttaccagatataaataaatataaaagctatgtaaataaaatatacaaaaatggatggcttactaataatggtccgttagtgcaagagctagaaaaaagacttgcaaagtatctaggtgttaaaaatatagttttagtatcaaatggtacaattgcattagaaatcgcgtatagagcgttaggagtcaaaggaagtgcaattactactccattttcatttgttgctactacatcttcattggtttctaacaatgtaaaaccagtgtttgttgatattgatgagaatactctaagtatagacgtctctaaaattaagtatgctattgaagaggatacttcagctattgtgccagttcatgtgtttggaaatggttgtgaagttgaaaaaatagacatgctggctaaaaaacataacttaaaagttatttatgatgcagcacatgcttttgatgttaagtataagggtgagagtatattaaactatggtgatatttcgacattaagttttcatgcaacaaagatttttcattctattgaaggaggtgcgcttatcattaatgatgatagtcttgttgaaaaagttcgttatttcattaattttggtatagaaagctcagaatcaataccttacttaggtactaatgctaaaatgaatgaatttgaggcggctatgggactttgtgttctagatgatattatagaaattaagagcaaaaggaaagttattacagagatatatgaggctgggttagatggattggtaaagtttcaagaacagaatcagcattctagtaggaattatagctattttccagtaatatttaggactgaggaggaacttctcagagtacagaaagcactaatacaaaatgatataatatcgcgtagatatttttatccatcattagatagtcttagttatatagagccaaagcagtatatgccaatctcaagagatatatctaaaagaatattatgtttgccaatttatgcagagttagaagacgataaaattaataaaataattaataatatcaaagaggtttcctcatga

SEQ ID NO: 43296 - protein, 360 aa, Francisella tularensis subsp. tularensis Schu 4
MSKVNVTKPYLPDINKYKSYVNKIYKNGWLTNNGPLVQELEKRLAKYLGVKNIVLVSNGTIALEIAYRALGVKGSAITTPFSFVATTSSLVSNNVKPVFVDIDENTLSIDVSKIKYAIEEDTSAIVPVHVFGNGCEVEKIDMLAKKHNLKVIYDAAHAFDVKYKGESILNYGDISTLSFHATKIFHSIEGGALIINDDSLVEKVRYFINFGIESSESIPYLGTNAKMNEFEAAMGLCVLDDIIEIKSKRKVITEIYEAGLDGLVKFQEQNQHSSRNYSYFPVIFRTEEELLRVQKALIQNDIISRRYFYPSLDSLSYIEPKQYMPISRDISKRILCLPIYAELEDDKINKIINNIKEVSS

SEQ ID NO: 43297 - DNA, 1128 bp, Synechococcus elongatus PCC 6301
  CDS (1)..(1128)
atggctaagcaatcctatcggaaaattccttacaccaagccttcaattactgagctggagattcaatatgcaactgatgcagcccgaaacggctggggtgaacattgctatgactacatcatccgctttgaagaagcatttaaacaacacctaggtgtgcaatatgccattgcaaccagtagctgtactggtgctttgcacatgggtatgcatgctttagggattggtcctggtgatgaggtgatactggccgatacgaattggatagctactgcagctccaattattcatctcggggctataccagtctttgtggatattttgccggatagttggtgtttagatcctgagcaagttcaagctgctattacacctaagacaaaggcaatcatagcagtgcatttatatggaaatctttgtgagatggatgctttgctggcaatcggagagcgatacagcattcctgttattgaagatgcagccgaggcaattgggtcggtctatcacggtaagcgggcaggtagcatgggtcgcttcggagcattctcatctcatggtaccaagaccattacaactggtgaaggcgggatgtttgtcaccaatgatccggaactatatgaacatgttctaacgctttctaatcatggaagagctcgcgggcagactaagcaattttggcctgacatggtcggctttaagtacaaaatgagtaatatccaagctgcaattggctatgctcaaatgcaacgcatcgagattcttatacatatgaaacgtaaaatcttttcgatgtatcagaactatcttaaggatctcccagttcaaatgaatcatgagcctagaggctgtacgaatgggtactggatgccaacatttgtggttaacgaaaaagtttcttttaatcgcaataagttgattagcaagctgaaatcaaatggggtggatgctagggtgtttttctggcctcttagctcaacatcaaccggaggccgtaaagccttagataagccttacctttcagaaagcattcatctacatgcactaaatcttccttctcactaccaacttagcaatgaagaaagtatgtttatttgcactcttataaagaatacatccttttctgggtaa

SEQ ID NO: 43298 - protein, 375 aa, Synechococcus elongatus PCC 6301
MAKQSYRKIPYTKPSITELEIQYATDAARNGWGEHCYDYIIRFEEAFKQHLGVQYAIATSSCTGALHMGMHALGIGPGDEVILADTNWIATAAPIIHLGAIPVFVDILPDSWCLDPEQVQAAITPKTKAIIAVHLYGNLCEMDALLAIGERYSIPVIEDAAEAIGSVYHGKRAGSMGRFGAFSSHGTKTITTGEGGMFVTNDPELYEHVLTLSNHGRARGQTKQFWPDMVGFKYKMSNIQAAIGYAQMQRIEILIHMKRKIFSMYQNYLKDLPVQMNHEPRGCTNGYWMPTFVVNEKVSFNRNKLISKLKSNGVDARVFFWPLSSTSTGGRKALDKPYLSESIHLHALNLPSHYQLSNEESMFICTLIKNTSFSG

SEQ ID NO: 43299 - DNA, 1074 bp, Campylobacter jejuni RM1221
  CDS (1)..(1074)
atgaattttatcaatcttcaagcccaatatctcgcatacaaagatgaaatcaatgctgaaattgaaagcgttttatcaagctcttcttttataggcggtacaaagcttaacgaatttgagcaaaatttagctcattttttaggtgttaaacacgctataggttgttcaagtggaaccagtgctttatatcttgccttaagaaccttagatattggcaaagatgatgaagttatagtgcctagttttactttcatagcaacagctgaagttgtggccttggtaggtgcaaaacctgtttttgtagatataaatttatcaaattacaatcttgattttgaagcagtgcaaaaagcaataactccaaaaactaaagctgttatagtagtgagtatgtttggacaaatgagtgatttaagggctttagaagaaattttaaaagataaaaatatcactttgatcgaagatggtgcacaaagttttggcgcaagtttcaaaggagaaaaatcctgctctatagctaaaatttcatgcacaagcttttttccttcgaagcctttgggagcttatggcgatggcggggctattttttgccatgatgatgaaattgctaaaaaaataagaattttactcaatcacggacaaactcagcgttataaacatgaatttataggtataaatggacgccttgacaccttacaagcagcgattttaaatgttaagttaaaatacctagaaaaagaattagacaaaagacaaaaattagcacaaatttataatgcaaatttaaaaaactgtcaaattccacaaattaatccaaatgcttttagcgcttatgcacaatacagtgttttagttgaagatagagctagtgtattgcaaaaatttgaaaaagctaatataccttatgctatacactatccaacccctttgcataaacaaccttgctttagtgagttttcaaatttagaacttaaaaattcagaatacgcaagcgaacacatcttatctttgcctttttcaccttttttaagtgaagaagagcaagagcaagttatttgtatttttaaagattga

SEQ ID NO: 43300 - protein, 357 aa, Campylobacter jejuni RM1221
MNFINLQAQYLAYKDEINAEIESVLSSSSFIGGTKLNEFEQNLAHFLGVKHAIGCSSGTSALYLALRTLDIGKDDEVIVPSFTFIATAEVVALVGAKPVFVDINLSNYNLDFEAVQKAITPKTKAVIVVSMFGQMSDLRALEEILKDKNITLIEDGAQSFGASFKGEKSCSIAKISCTSFFPSKPLGAYGDGGAIFCHDDEIAKKIRILLNHGQTQRYKHEFIGINGRLDTLQAAILNVKLKYLEKELDKRQKLAQIYNANLKNCQIPQINPNAFSAYAQYSVLVEDRASVLQKFEKANIPYAIHYPTPLHKQPCFSEFSNLELKNSEYASEHILSLPFSPFLSEEEQEQVICIFKD

SEQ ID NO: 43301 - DNA, 1146 bp, Campylobacter jejuni RM1221
  CDS (1)..(1146)
atgtttgaaaaagaaatttcttttataaaaagtctttttaataaagaaaatatcgccctacatgagccttgctttataggcaatgagaaaaaatatctcttagaatgtatcgatagcggttttgtttcaagcgtaggagaatttgtaacgcgttttgaagaagctttaaaagaaaaaaccaaagcacgctttgtcatcgctacaaatacaggtacagcagcccttcatatcgctttattagctaatggtatcgatgaaaactgcgaagtcatcactcaaagcataagctttgtcgctacgaccaatgctatcgcttatacaggtgcaaaacccgtttttttagatatagatgaaaacactctaagtttaagtcctaaggctttagagcattttttagaaaatcaaacttatcaaaaagataatcttagctataacaaaaccacacacaaacccatcaaagcttgtgttattatgcacacctttggtttaagcgctcatataaaagccatcaaagagctttgtgaaaaataccacatccttttaattgaagatgctgcagaagccttaggaagcacctatgaaaacaaggccttaggcacttttggaaagtgtggaattttaagctttaatggtaataaaatcatcacaggtggatgcggtggggcgatattaagcgatgatgaaaatttagccaaacttgcaagacaccttagcaccacagctaaaatcccccatccttacgaatacgatcatgataggatagcttataattaccgtctttgcaatataaacgcagcaatcttgcttgcaggacttgaaaatttagaactttttttagaaaacaaaagagaacttgctaaaatttacaaggatttttttaaaaatcacgataaatgtaaatttatcgatgaaaaaagcaatgaaaaaagcaatttttggctcaataccttgctttttaaagatgaaaatttaagaaatatctttttagaagaatgcttgaaaaataatattttcgtccgtcctgtatggaaaagcttaccgagtttaaaagcttttcaaaactgtcaaagcaatgagcttataaacactaaaaaattagaaaaacgcttgattaatttacctagtagcgttagaataaagaaatga

SEQ ID NO: 43302 - protein, 381 aa, Campylobacter jejuni RM1221
MFEKEISFIKSLFNKENIALHEPCFIGNEKKYLLECIDSGFVSSVGEFVTRFEEALKEKTKARFVIATNTGTAALHIALLANGIDENCEVITQSISFVATTNAIAYTGAKPVFLDIDENTLSLSPKALEHFLENQTYQKDNLSYNKTTHKPIKACVIMHTFGLSAHIKAIKELCEKYHILLIEDAAEALGSTYENKALGTFGKCGILSFNGNKIITGGCGGAILSDDENLAKLARHLSTTAKIPHPYEYDHDRIAYNYRLCNINAAILLAGLENLELFLENKRELAKIYKDFFKNHDKCKFIDEKSNEKSNFWLNTLLFKDENLRNIFLEECLKNNIFVRPVWKSLPSLKAFQNCQSNELINTKKLEKRLINLPSSVRIKK

SEQ ID NO: 43303 - DNA, 1137 bp, Chloroflexus aurantiacus
  CDS (1)..(1137)
atgacaacatcatggcgggtgccgtttggcgatttacgacgcagtcatcaggcactcaccgcagacctgatcgctgccgccggtcgtgtgattgagagcggctggtttattttgggtcatgaagttgctgctttcgagcaggagtttgccacgttttgtggtgcccgccattgtgttggtgtggccagtggtgccgaagcgttgtacctggcactggcggctgccgggatcggccctggtgatgaagtgattaccgtcgcaaatgcgtgcatgtacgacgtagctgccattcttcaggccggtgcacgtccagtactggttgatgttgatcccgctacgcagaatattgatccggcggcagtggcggcggctatcactccgcgcacgaaagccgtgattccggtacatctgttcgggcggctagccgatatggcggctattacggcattggccgaacggcacggtctcgtcgtcattgaagatgcagcgcaggcgcacggagcatggcgtaccggtgctgatggacaaccacggatggccgggcaatggggtaatctggcagcgtttagcttctaccccagcaagaatctgggcgcgcttggtgatggtggtgcggtagtaaccaatgatgatcagatggcagcgcaacttcgtcggttgcgcatgtacggctgggaacgcaaatactacacgagcgaggtgggtgggcggaattcgcgcctcgatgagctacaggcagcacttctgcgtgtcaagctcccgcatcttgccgccgctaatgcggcccgtcgtgaacgggcggcctggtacgcgactgcattggccgatctgccgcttggtttgccggtggacgagccgggtcacgtgtatcatctctatgtggtcaccttacctgatcgggccagccgtgaccggttacgcgaccatctccttgccaacggcattggttgtgatattcattatccggtaccaacccatctacaaccggcctacgccgatcttggctatcatccaggaagcctgccggtgaccgaagatctggccggacgcattttatctctgccaatgtacccggaattgacgtatgaagagattatgctggttgccgagacgattcgagcgggggggatatggtaa

SEQ ID NO: 43304 - protein, 378 aa, Chloroflexus aurantiacus
MTTSWRVPFGDLRRSHQALTADLIAAAGRVIESGWFILGHEVAAFEQEFATFCGARHCVGVASGAEALYLALAAAGIGPGDEVITVANACMYDVAAILQAGARPVLVDVDPATQNIDPAAVAAAITPRTKAVIPVHLFGRLADMAAITALAERHGLVVIEDAAQAHGAWRTGADGQPRMAGQWGNLAAFSFYPSKNLGALGDGGAVVTNDDQMAAQLRRLRMYGWERKYYTSEVGGRNSRLDELQAALLRVKLPHLAAANAARRERAAWYATALADLPLGLPVDEPGHVYHLYVVTLPDRASRDRLRDHLLANGIGCDIHYPVPTHLQPAYADLGYHPGSLPVTEDLAGRILSLPMYPELTYEEIMLVAETIRAGGIW

SEQ ID NO: 43305 - DNA, 1101 bp, Magnetospirillum magnetotacticum MS-1
  CDS (1)..(1101)
atggccgataacatccctctcgtcgatctcaaggctcagttccgctccatcgaggcggatgtcaacgccgccatcgccgccgtgctggcgcggggcgatttcattctgggcaaggacgttgacggttttgagaaggaattcgcggcattttcgggggcgtcccactcggtgggctgcgccaacggcaccgatgcgctgcagctggccatgatggcgctggatatcggtccgggcgacgaggtgatcgttccggccatgaccttcatcgccaccgcgctgggcgtcagtctggcgggagccacgccggttctggtggacgtggaggccgagaccggcctgctggacccagccaaggccgaggcggccatcacgccgaagaccaaggccatcctgccggtgcacctgttcggccagatggcaaatctcaaggcgctgaaggctatctgcgacaagcataagctgtatctggtggaagatgcggcgcaagcccatggcgccagccgtgacgggctgaaggctggcacggtggggtccatcggctgcttctcgttctatcccggcaagaatctcggcgcctatggtgatgccggtggtctgctgaccaacgaccctgccctggcccagaagcttttcctgctgcgccatttgggttcatccaagaagtaccaccacgagatcatcggccccaattcgcgcctggacaccatccaggccgccattctgcgggtcaagctgccccatctggctggctggaacgacgcgcgccgcaagcatgccaagcgttacgacgcggccctggccgacatcaagggtgtgcgcctgaccaagagcgatccgggcagcgtctatcatctttacgttatccgcgtggaagagcgcgaccgggtgctgaaggccctgaacgaagctggcatcggcgcgggcatccactatcccttcgccctgcacgagctggaggcctatgcttccctgggccataagcccggcgccttccccatggccgaggactgggcgcaccactgcatcagcctgcccatctacgccgaactgcccgatgatgccgcttcgcgcgctgccgccgtgctgcgccaggtgatctga

SEQ ID NO: 43306 - protein, 366 aa, Magnetospirillum magnetotacticum MS-1
MADNIPLVDLKAQFRSIEADVNAAIAAVLARGDFILGKDVDGFEKEFAAFSGASHSVGCANGTDALQLAMMALDIGPGDEVIVPAMTFIATALGVSLAGATPVLVDVEAETGLLDPAKAEAAITPKTKAILPVHLFGQMANLKALKAICDKHKLYLVEDAAQAHGASRDGLKAGTVGSIGCFSFYPGKNLGAYGDAGGLLTNDPALAQKLFLLRHLGSSKKYHHEIIGPNSRLDTIQAAILRVKLPHLAGWNDARRKHAKRYDAALADIKGVRLTKSDPGSVYHLYVIRVEERDRVLKALNEAGIGAGIHYPFALHELEAYASLGHKPGAFPMAEDWAHHCISLPIYAELPDDAASRAAAVLRQVI

SEQ ID NO: 43307 - DNA, 1176 bp, Azotobacter vinelandii
  CDS (1)..(1176)
atgctggacagccccttccccccctggccctgtttcaccgaggaagaagccgacgccgtgcgccgggtgctcctctccaatcgggtcaactactggaccggccaggagtgccacgccttcgaggaggagttcgccgcctggagcggctgcacccacgccatcgccctggccaacggcagcgtggccctggatctggcgctcagggccctggggatcggccccggcgacgaggtggtggtgacgccgcgcagcttcttcgcctcggccgcctgcatcgtcaacgccggcgccacgccggtgttcgccgacatcgaccgcgactcgcagaacgtcaccgccgagaccatccgcgcggtgctgacgccgcgtacccgggcgttgctctgcgtgcacctggccggctggccctgcgacatggagccgatcatggcactggccgaagcgcgcggcctcaaggtgatcgaggactgcgcccaggcccatggcgcgcgctaccggggtcgctcggtcggcggcatcgggcatgtcggtgcctggtcgttctgccaggacaagatcgtcagcaccggcggcgagggcggcatgctcaccaccgacgaccgggcgctgtggtcgcggatgtggtcgctcaaggaccacggcaagagctgggaggcggtccatgcgcgccgccatccgccgggatttcgctggctgcacgagagcttcggcggcaacgcgcggatgaccgaaatgcaggcggcgctcgggcgcatccagttgcgccggctgcccgactggcacgccaggcggctggccaacgccgggcgcatctggcgctgcgcgcggcatctgccggggctgcgcgtgccgcgcccgccggcggacatcgaacacgccgcctacaaatgctacctgttcgtcgagccttcccgtctgaagagcggctggagccgcgaacgcatcctcgaggcgatcgccgcgcgcggcgtgccctgcttctcgggcagttgcgccgagctgtacctggaacgggccttcgagggcacgccctggcgtcccgccgagcgcctgccggtggcccgcgagctgggcgagaccagcctgatgttcctcgtccaccccaccctgggcgtccgcgagatcgagcgcacctgcgccgcgctgggcgcggtgatggacgaggcggcgcactga

SEQ ID NO: 43308 - protein, 391 aa, Azotobacter vinelandii
MLDSPFPPWPCFTEEEADAVRRVLLSNRVNYWTGQECHAFEEEFAAWSGCTHAIALANGSVALDLALRALGIGPGDEVVVTPRSFFASAACIVNAGATPVFADIDRDSQNVTAETIRAVLTPRTRALLCVHLAGWPCDMEPIMALAEARGLKVIEDCAQAHGARYRGRSVGGIGHVGAWSFCQDKIVSTGGEGGMLTTDDRALWSRMWSLKDHGKSWEAVHARRHPPGFRWLHESFGGNARMTEMQAALGRIQLRRLPDWHARRLANAGRIWRCARHLPGLRVPRPPADIEHAAYKCYLFVEPSRLKSGWSRERILEAIAARGVPCFSGSCAELYLERAFEGTPWRPAERLPVARELGETSLMFLVHPTLGVREIERTCAALGAVMDEAAH

SEQ ID NO: 43309 - DNA, 1194 bp, Nostoc punctiforme PCC 73102
  CDS (1)..(1194)
atgaataaaatggctgttagagttccttttgtagacctgaagttgcaacatgaaccaattcaaatgcaattgcaatatgcaatccaatctgtattggaacagggagattttattttagggcaagcactctcagattttgaagcagcatttgcggcagtatcggaggcagcttatggtgttggtgttgcatcaggaacagatgcgatcgctctcggattgcaagcttgtaatattggtgctggcgatgaggtaattttaccagccaacactttcattgctaccttgattggggttatccgcgctggcgcgaagccaattctggtagattgcgatcgccaaacagctttaattgatttagaggccgcagcaaaggcaattacgcctcaaactaaagcaattattcctgtacatctctatggtcaaatggtatcgccacgtgaactcatcaaatttgctgatacctacaaactactaatttttgaagatgccgcccaagcacaccttgcccaaagagacggatatcacgctggctcagtaggcatagcagcagcttttagtttctatcccagcaaaaatttgggagcatttggggatgggggaatgctgctgacacgaaattcagatgtcgcccagaagatgggacgtttgcgaaattatggtgcatcgcaaaagtattttcatactgaacctggtacaaatagccgcttggatactttacaagcagctattttgcaccaaaaattaccatatttgccacagtggaatcgcgatcgcttgactattgcccagcagtacgatcttgaactagcacccttggcaactactggtattatccctatagaaaaccaaagtgatacaggacacgtttatcatctttacgtcattaaagttgatgattcttgcccaatagaacgccagcaactccaggaaaaactcacagcggtaggaattcaaactggcattcactatccaattccttgtcatctccagccagcgttcagcaacttaggctatcagcctggagatttccctcaagcagaaaaactgtcacagcaaatattatcattaccgatgtatcctggtttgagcagtagccaagttaaagaagttgtagctgcgatcgctcatgcagtttcaacaacttctaaggtagatgaaacctccaatgctgaccttgacagcgtggtagcctaa

SEQ ID NO: 43310 - protein, 397 aa, Nostoc punctiforme PCC 73102
MNKMAVRVPFVDLKLQHEPIQMQLQYAIQSVLEQGDFILGQALSDFEAAFAAVSEAAYGVGVASGTDAIALGLQACNIGAGDEVILPANTFIATLIGVIRAGAKPILVDCDRQTALIDLEAAAKAITPQTKAIIPVHLYGQMVSPRELIKFADTYKLLIFEDAAQAHLAQRDGYHAGSVGIAAAFSFYPSKNLGAFGDGGMLLTRNSDVAQKMGRLRNYGASQKYFHTEPGTNSRLDTLQAAILHQKLPYLPQWNRDRLTIAQQYDLELAPLATTGIIPIENQSDTGHVYHLYVIKVDDSCPIERQQLQEKLTAVGIQTGIHYPIPCHLQPAFSNLGYQPGDFPQAEKLSQQILSLPMYPGLSSSQVKEVVAAIAHAVSTTSKVDETSNADLDSVVA

SEQ ID NO: 43311 - DNA, 1149 bp, Nostoc punctiforme PCC 73102
  CDS (1)..(1149)
atgatccaaagtgtaaatcccatccctgcctttgatatcaagcagcaatacaccaccatcgaagcagaagtaagtgcagccgttttagaggttctggcttctggccgctatattggcggccctctagttgaaggctttgagcaacaatttgctgcttataatactgttactcaatgtgtggcttgtaattctggtactgatgcgctctacttagcgttacgagtcttggaaattggtgcaggcgatgaagtgattacaacgcctttcacctttattgctacatctgaagtaattagtgccgtgggtgcaaaacctgttttcgttgacattgacgctactacctttaatttggatgtggagcaagtagcagcagcgattacacctaaaactaaagcaattatcccggttcacctatttggacaacctgtggatatgacatcattgatggcgatcgctcaatctcacaatttgtcaataattgaagattgcgctcagtctacaggtgcaatgtgggccaatgaaaaagtaggaagtattggacatattggttgctttagtttctaccctaccaaaaatcttggtggttgcggcgatggcggagcaataacgactaacgatcctgcgatcgctactaaactgcgaatcctccgggagcatggtagtaaagttcgatatttacacgaggaaattggtgtaaatagccgcttggatgctctccaagcaaccatattgcagattaaactacgttatttagatacttggaatgatcgccgtcgagatatcgccaattattactatcagttccttagccaaattccgggaatcgtcccgcctcaagaattacctgggggtattggggtatggaatcaatacactgttcgcatctcaggtgaagggcggaatggttctagcgccaaatatcgagattgggtgcgtaatcaattgcaagaacagggcgtaagttcaatgatttattacccctatcctttacatttgcagccagtgtatcaaaatctaggctatcaaattggggacttaccaatagcagagcaagcttgccatgaagtcatagctttgcccatgttcccagaattgacacagcaccagcaagaccaggtgatttatgcgttaaaggattgtttggggtga

SEQ ID NO: 43312 - protein, 382 aa, Nostoc punctiforme PCC 73102
MIQSVNPIPAFDIKQQYTTIEAEVSAAVLEVLASGRYIGGPLVEGFEQQFAAYNTVTQCVACNSGTDALYLALRVLEIGAGDEVITTPFTFIATSEVISAVGAKPVFVDIDATTFNLDVEQVAAAITPKTKAIIPVHLFGQPVDMTSLMAIAQSHNLSIIEDCAQSTGAMWANEKVGSIGHIGCFSFYPTKNLGGCGDGGAITTNDPAIATKLRILREHGSKVRYLHEEIGVNSRLDALQATILQIKLRYLDTWNDRRRDIANYYYQFLSQIPGIVPPQELPGGIGVWNQYTVRISGEGRNGSSAKYRDWVRNQLQEQGVSSMIYYPYPLHLQPVYQNLGYQIGDLPIAEQACHEVIALPMFPELTQHQQDQVIYALKDCLG

SEQ ID NO: 43313 - DNA, 1269 bp, Nostoc punctiforme PCC 73102
  CDS (1)..(1269)
atggttattactagagaaaaaccggctttactcggaggttccaaggtttttccagagccattaccaaggtatatcagtactagttttcaggagacagaggccgcgattcaagtattgaaaagcggtattttatctgactatatcggtgctgctgggctgtactttatgggtgggaaacaagttcgcacattagaagaacaatgggctaactactttaatgttcgtcacgctttgagtgttaactctgctactagtggtttacatgccgctgtgattgcagctggtgttagttttggtgatgaggtaattgtgccaccgcaaacgatgtcagcaacggcaacagcagtggttatggcaaatggtactcctgtttttgtcgatcatgaggaggctagttgctgcattgatccagaagctgttgaaggtgctattagcacacgcacaaaagcaattatcgcagtcaatttgtttgggggcccagcccaactggtgcgcttacgtaaattagcagatcgacatggtttgattctaattgaggacaatgcccaagcaccaggaggtcagcatcagggccgttggttggggacaattgcgcatttgggagttttcagcctcaattgtcacaaaacgattcagtgtggtgaaggggggattgtagtcactaatgatgattacttggcgcggcgagtagcactggtgcgtaatcatggagagaacgcaatagaagcggaaaactggtatgaagatgctgatattgttggttacaattaccgtttaactgaacttcaaggggcgatcgctcaggttcaactccaacgtttggaagaattgacacagccacggctaaaaattgctgaagctttagaccaaggcttgtctaagtttaaagcattgcggacggctaaagttggcagtggcgatcgccatgtttactatacatatcccatctggatcgatccacaacaagctggattgtcgcgggacagatttgtggaggcacttcaagcagaaggatgtcctttaacggggcgttatgtgcgtcctttatacagactacctcttttccaaaagctgcaacaagaaggcaagacaattgtcagtcatcctactggtgtctgtcccatagctgaaaagacatataacgagacacttttatctacaactctcatccaaatacctgggggtattgacttagttgatcgtttcgtagcttctgttgctaaagtcctggctcatgctgaagagttaagtcgaggaaaagataaatga

SEQ ID NO: 43314 - protein, 422 aa, Nostoc punctiforme PCC 73102
MVITREKPALLGGSKVFPEPLPRYISTSFQETEAAIQVLKSGILSDYIGAAGLYFMGGKQVRTLEEQWANYFNVRHALSVNSATSGLHAAVIAAGVSFGDEVIVPPQTMSATATAVVMANGTPVFVDHEEASCCIDPEAVEGAISTRTKAIIAVNLFGGPAQLVRLRKLADRHGLILIEDNAQAPGGQHQGRWLGTIAHLGVFSLNCHKTIQCGEGGIVVTNDDYLARRVALVRNHGENAIEAENWYEDADIVGYNYRLTELQGAIAQVQLQRLEELTQPRLKIAEALDQGLSKFKALRTAKVGSGDRHVYYTYPIWIDPQQAGLSRDRFVEALQAEGCPLTGRYVRPLYRLPLFQKLQQEGKTIVSHPTGVCPIAEKTYNETLLSTTLIQIPGGIDLVDRFVASVAKVLAHAEELSRGKDK

SEQ ID NO: 43315 - DNA, 1167 bp, Nostoc punctiforme PCC 73102
  CDS (1)..(1167)
atgagtgactacattccttatggaaggcaagatattaatcaagaagatattgatgctgtaattgaagttttgcgctcagactggattactcaaggcccagctatagagagatttgagcaagctgttgccaactactgtggagcgaaatatgccgtagcggtttctagtgcgacagctgcattacatattgcttgtcttgctactgatttggagcaaggagatattctctggacatcaccaaatacctttgttgcctcagctaattgtggactttactgtggtgcaaaggttgactttgttgatattaacccaaatacctataatttgagcgtaaatgaattagaaagtaagttagctgaggcagaaaagcaaggttgtttgcccaaaatattaatacccgtgcattttgcagggcaatcttgtgaaatggaacaaattgctgctttatcacagcgttatggtttcaaaattatcgaagatgcttctcatgcgattggtgggagctatcaaggacaacctattggttcctgtcaattttctgatatggcagtttttagctttcatccagtaaaaattattacaactggtgaaggcggtatggtgctaacaaatcaagaggaattgtatcagagattaattagattaagaagtcatggcataactcgcaatccagatttaatgcaaggagaatctcaaggtttttggtattatcagcaactagaactaggtttcaactatcggatgacagatatccaagcagcattgggtagtagtcaactacaacgactagataaatttgtagaatgtcggcggttgatagctcaaagatataatcagctactacaagatttacccctgatgttaccttggcaacaccctgattctgaatctagttggcatttatatgtaattcggctcaagctggataagattaataaaactcatcgacaaatatttgaagaacttcgcagcacaggagttggtgtgaatttgcactacattccagttcatatacaaccttactaccaaaaattaggttttcaattaggagactttccaaaggttgagcaatactacgaggaagctattactatccccttatattatgggctaaatgaagagagtcaggataaagtagtaattccgctaagagagagcctgacatga

SEQ ID NO: 43316 - protein, 388 aa, Nostoc punctiforme PCC 73102
MSDYIPYGRQDINQEDIDAVIEVLRSDWITQGPAIERFEQAVANYCGAKYAVAVSSATAALHIACLATDLEQGDILWTSPNTFVASANCGLYCGAKVDFVDINPNTYNLSVNELESKLAEAEKQGCLPKILIPVHFAGQSCEMEQIAALSQRYGFKIIEDASHAIGGSYQGQPIGSCQFSDMAVFSFHPVKIITTGEGGMVLTNQEELYQRLIRLRSHGITRNPDLMQGESQGFWYYQQLELGFNYRMTDIQAALGSSQLQRLDKFVECRRLIAQRYNQLLQDLPLMLPWQHPDSESSWHLYVIRLKLDKINKTHRQIFEELRSTGVGVNLHYIPVHIQPYYQKLGFQLGDFPKVEQYYEEAITIPLYYGLNEESQDKVVIPLRESLT

SEQ ID NO: 43317 - DNA, 1161 bp, Nostoc punctiforme PCC 73102
  CDS (1)..(1161)
atgactaaaccaatcttgctctcgattccacacatgggcgatcgcgagctaaaactcatcaaagaagcttttgatactaactggattgcaccagttggtccacacatcaatgctttcgaggaagaattttgtcaagtaactggggctgggtatgcggcggctgttagttctggtacagcagctctacatttggctttacgattattaggcgttgagtctggagatgaagttttttgctctaccctgacatttatagctaccgctaatccaattgcctacttaggagcaaaaccagtatttattgatagcgatcgcacttcttggaatatgaatcctgacttattgcaggaagcgctagagaaccgcgcacgttttggcagattgcctaaagcagtggtacttgtgcatctgtatggtcaaagtgcagatatcgatcccatcctgaaagcttgcaatcaatatgacgttcctttaattgaagacgcagctgaagctttaggtgctacctacaaagagcgttcccccggaacttttgggcgcattggcatttactccttcaatggcaataaaatcatcactacctccggtggtgggatgttggtttcggacgatccacaattggtagcaaaagcccgtttcttagcaacccaagcgcgcgatttatctccccattaccaacattcggaaattggttacaactaccgccttagcaatgttttagctggtattggtcgcggtcaattacatcttttgagtgagcgagtggcagctagaagacgcaactttaagatttaccaacaggttttaggaaatctcccaggcatagaatttatgccggaagctatttttggccgtgctactcgctggttaacctgtttaacaatcgatccagcaacttttggagcagatcgagaacaagtccgcatcgcacttgccgcacagcaaattgaaactcgtcctgtgtggaagcctttgcatctccagcctgtgtttgctgagtgtgaatatattggagatacagtcgctaaagatttatttacacacggtctttgcctaccttcgggatctaatctcacagacgaagatttggagcaagtgattaatgaaattctagcagttcaccataatagttctaaaactcatacttatatgtttctatag

SEQ ID NO: 43318 - protein, 386 aa, Nostoc punctiforme PCC 73102
MTKPILLSIPHMGDRELKLIKEAFDTNWIAPVGPHINAFEEEFCQVTGAGYAAAVSSGTAALHLALRLLGVESGDEVFCSTLTFIATANPIAYLGAKPVFIDSDRTSWNMNPDLLQEALENRARFGRLPKAVVLVHLYGQSADIDPILKACNQYDVPLIEDAAEALGATYKERSPGTFGRIGIYSFNGNKIITTSGGGMLVSDDPQLVAKARFLATQARDLSPHYQHSEIGYNYRLSNVLAGIGRGQLHLLSERVAARRRNFKIYQQVLGNLPGIEFMPEAIFGRATRWLTCLTIDPATFGADREQVRIALAAQQIETRPVWKPLHLQPVFAECEYIGDTVAKDLFTHGLCLPSGSNLTDEDLEQVINEILAVHHNSSKTHTYMFL

SEQ ID NO: 43319 - DNA, 1152 bp, Nostoc punctiforme PCC 73102
  CDS (1)..(1152)
atgccagaattcatccctttcgctttacctgatattggagaagaagaaattagtgaggttgttgattctttacgatctggttggttgactacaggacctaagaccaaacgttttgagcaatattttgcagatttcattggttctggagtagaagcgatcgcagttaattctgccacatcagggttacatctcgctctggaagcattgggaattggtcccggagatgaagtaattaccacagtccacaccttcacggctacagcagaagtgattcgttacttaggagccaatccagtctttgttgatattaatttagctactctcaacattgatgctagcaaaattgaggctgctattactccccgcactaaagccatcatgcctgtccattttggtggacttgcttgtgatatgcaatcaattttaacaattgcccaaaagcatcaattgaaagtagttgaagatgctgcccatgctatcccgacaacctatcagggtaagttgattggtagcttagatagtgatgtcaccgtctatagcttttatgcaaccaaaaccattgctacaggtgaagggggtatgctagtaacccgtaacccggaaatagctcaaagatgccgaactatgcgcttacatggcatcaatcgagatgctttcgatcgctatacctcaactaaaccctcatggtattacgaggtagttgcaccaggcttcaaatataatatgacagatgtcgcggcttctcttggtatccatcaattgaagaaagccaagacactacagcaacaacgagctgcgatcgctaatcgatacaatatagaactaagcgacttacctttacatctgccagcattacctgctgatggagatattcactcttggcatctatatgtaattcgtttagccgattctgtacaagttagtcgcaataactttattgagcaattggctgctaaagggattggttgtagcgttcactatattcctttacacttgcatccctactggcgcgacacttacaatctctgcttagaagattttcctcaagcatcctatgcttctgaacggatagtaagcctaccaatctacacaaaaatgactgaggcagatcaaactcatatcattgaaatcatcaacaaaactttgacttga

SEQ ID NO: 43320 - protein, 383 aa, Nostoc punctiforme PCC 73102
MPEFIPFALPDIGEEEISEVVDSLRSGWLTTGPKTKRFEQYFADFIGSGVEAIAVNSATSGLHLALEALGIGPGDEVITTVHTFTATAEVIRYLGANPVFVDINLATLNIDASKIEAAITPRTKAIMPVHFGGLACDMQSILTIAQKHQLKVVEDAAHAIPTTYQGKLIGSLDSDVTVYSFYATKTIATGEGGMLVTRNPEIAQRCRTMRLHGINRDAFDRYTSTKPSWYYEVVAPGFKYNMTDVAASLGIHQLKKAKTLQQQRAAIANRYNIELSDLPLHLPALPADGDIHSWHLYVIRLADSVQVSRNNFIEQLAAKGIGCSVHYIPLHLHPYWRDTYNLCLEDFPQASYASERIVSLPIYTKMTEADQTHIIEIINKTLT

SEQ ID NO: 43321 - DNA, 1149 bp, Pseudomonas syringae pv. syringae B728a
  CDS (1)..(1149)
atgagtcaaacttttcttgccttttcacggccgtccattggcgatgaagaaattgctgcagtgacgcgcgtgctgcgttccggatggatcaccaccggaccggaatgtcagaagctggaggaagagttcgccgcgcgggtcggcgcgcggcatgcagtggcattgtcttcggccaccggggcaatgcacgttgcgctgctggcgctgggtgtagggcctggcgatgaagtgattacgccgtcgcaaacctgggtgtcgacagccaatatgatctgcctgctgggagccactccggtgtttgtcgatgtcgaccgcgacaccctgatgaccagcgccgcgttgatagagcatgccatcactccgcggaccaaggcgatcgtgccagtgcattatgcaggcgcggcattcgatcttgacccgctgtatgcgctggccgaccggcacggcatcaccgtgatcgaagacgctgcgcatgctgccggcactgcttaccaaggacgcccggtcggccagcagggcactgcgatcttttcgtttcacgcgatcaagaacatgacctgtgccgaaggcgcgatgctggtcaccgacaatgcacggctggctgatcgggtgcgtcagcttaaattccatggcctgggtgtcgatgcctacgatcgcctgaccctgggtcgcaaaccgcaggccgaggtcatggagcctggcttcaaatacaacctggccgacattaatgcgagcattgcgcgggtgcagttgcagcgcctcgacgccatcaatgcacagcgccaggcgctcgccagccattacctcgaacgactggccaatagccccgttctgcctctcgccctgccccggtatgcccagcaacacgcttggcacctgttcattctgcgcattgatcccgagcgctgcgggctggatcgcgatgccttcatgaaggccttgcaagcgcgaaatatcggcaccggcatccacttcatcgcgacccacctgcacagctattaccgcaagcgtttcccggatgtacgcctgcccgacactgaatggaattcatcacggctgtgttccatccccctgttccccgacatgagcctcgatgatgtcgagcgggttgtcggtgccattgaatcgaccctggaatccagccattga

SEQ ID NO: 43322 - protein, 382 aa, Pseudomonas syringae pv. syringae B728a
MSQTFLAFSRPSIGDEEIAAVTRVLRSGWITTGPECQKLEEEFAARVGARHAVALSSATGAMHVALLALGVGPGDEVITPSQTWVSTANMICLLGATPVFVDVDRDTLMTSAALIEHAITPRTKAIVPVHYAGAAFDLDPLYALADRHGITVIEDAAHAAGTAYQGRPVGQQGTAIFSFHAIKNMTCAEGAMLVTDNARLADRVRQLKFHGLGVDAYDRLTLGRKPQAEVMEPGFKYNLADINASIARVQLQRLDAINAQRQALASHYLERLANSPVLPLALPRYAQQHAWHLFILRIDPERCGLDRDAFMKALQARNIGTGIHFIATHLHSYYRKRFPDVRLPDTEWNSSRLCSIPLFPDMSLDDVERVVGAIESTLESSH

SEQ ID NO: 43323 - DNA, 1176 bp, Pseudomonas syringae pv. syringae B728a
  CDS (1)..(1176)
atgcccggtcacccgcttggcaaagcgctgattcaaagaaacatggaggcttcgatgattaacgtgaccaagacgtatctgggtgatatcgaccagttcaaacgctacgtcgaaggcatctacgcacgtggctggctgaccaatcacggtccgctggccagggaactgacggatcgactcaaggactacctgggtgtcaggcacattattctgaccaacaacggcaccctggctctgcaagtggcctatcgggctctcggcctgagtggcagcgcagtgaccacgccattcagttttgtcgcgaccagcagctcgctgcagtgggaaggtatccggcccatctttgccgatatcgatgctcacacctggaacatctcgcccaaacacatcgaaaacagtattgccgaagacaccactgcgatcgtcgccacccacgtgtttggcaatccttgtgacgtgcaagccattgagcacatagcccgcgagcacaagctcaaggtcgtctatgacggcgcacacgcattcgccgtgcgtcacgccggccagtcggtgctcaatcatggcgatatcagcaccctgagttttcacgccaccaaactgtttcacaccattgaaggtggcgcgatcatcaccaacgatgacgaactggccagacaggcccatctgatgtgcaacttcggcatttccggcgtcgaccggatcgatgggatcggcattaacgccaagctcaacgagttctccgccgccatggggctgtgcattctcgacaatatcgacagcattctcgaacagcgcgcagagatagccgatcactacacctcatcgctgcaagactatctggatctgcagacaccccaagccgacagccagttgaatcacagctattaccctgtggccctgcgcgacgagcaacaactgttgagcgtgcgcacagcactcaaccagcacaagatcaacccccgccgttacttctacccctcgctggacacccttgaatacctgcagcctcaacccggccagccggtctccagagcgttgagcgaacgagtgctgtgcctgccgatctatccaggcctgctgagaagcgagcaggacctggtgatccgcaccctgatcgaagcctgcaccgtgactgaagctgactaccgggcttgcaccgttgcgcgggtctgctga

SEQ ID NO: 43324 - protein, 391 aa, Pseudomonas syringae pv. syringae B728a
MPGHPLGKALIQRNMEASMINVTKTYLGDIDQFKRYVEGIYARGWLTNHGPLARELTDRLKDYLGVRHIILTNNGTLALQVAYRALGLSGSAVTTPFSFVATSSSLQWEGIRPIFADIDAHTWNISPKHIENSIAEDTTAIVATHVFGNPCDVQAIEHIAREHKLKVVYDGAHAFAVRHAGQSVLNHGDISTLSFHATKLFHTIEGGAIITNDDELARQAHLMCNFGISGVDRIDGIGINAKLNEFSAAMGLCILDNIDSILEQRAEIADHYTSSLQDYLDLQTPQADSQLNHSYYPVALRDEQQLLSVRTALNQHKINPRRYFYPSLDTLEYLQPQPGQPVSRALSERVLCLPIYPGLLRSEQDLVIRTLIEACTVTEADYRACTVARVC

SEQ ID NO: 43325 - DNA, 1161 bp, Desulfovibrio desulfuricans G20
  CDS (1)..(1161)
atgcgtgagtcctttctggttttcggacagccccttatcgaacaggacgaaatagacgaagtcgtggactccatgcacaaggcatggatcggcaccggtcccaaggtgcatcagtttgaacgcgatttcgccgcatacaagggcgtggcgcatgccgccgccgtcaactcgtgcacggcagccctgcaccttgcctgtcttacactcgaccttgcacccggcgacgaggtgataaccaccgccatgaccttctgcgcgtcggtcaatgccatcatccatgccggcggtactcccgtgctggctgatgcagaccccgtcacgcttaatatttcggccgaaaccatagccccgcacatcggcccgcgcacccgcgccatcatggtggtgcactacgcaggacgctgctgcgatatggaccccataatggagctggcccgcaaacacggtctgattgtcatcgaagactgcgcccacgccattgaaagcgaatacaaagggcgcaaagccggcaccatagggcacataggctgcttcagcttttacgccaccaaaaacatcgtcaccggcgaaggcggcatgatcatttctgacgacaaagccgccatagaccgctgcaaaataatggcactgcacggcatgagcgccgacgcatgggccagattcagcgatgcgggctacaagcactatcaggttgttgatcacggctttaagtacaacatgatggatattcaggcggccatgggcatccatcagctgcggcgcgtggaagaatactggaaacgccgcgcctgcatatggcagaagtacaatgaaggactggccggacttggcatgggcctgcccgccgacgccgaggaacatacccgccatgcgtaccacctgtacaccatacgggtgtcggccgcgtgctgcggcgtggaacgcgacgccatgcttgaagcgctgagggcgcacaacataggcgtgggcgtacactatctggcagttcccgaacacccctactaccggcgccgtttcggctgggacccggcagacactccggtggccacagcttacgggcgcgagactgtcagcctgcccctttcccccaaactgtcagacggtgatgtggacgatgtcatagaagccatccgcgccatctgcacggaatctgccagatga

SEQ ID NO: 43326 - protein, 386 aa, Desulfovibrio desulfuricans G20
MRESFLVFGQPLIEQDEIDEVVDSMHKAWIGTGPKVHQFERDFAAYKGVAHAAAVNSCTAALHLACLTLDLAPGDEVITTAMTFCASVNAIIHAGGTPVLADADPVTLNISAETIAPHIGPRTRAIMVVHYAGRCCDMDPIMELARKHGLIVIEDCAHAIESEYKGRKAGTIGHIGCFSFYATKNIVTGEGGMIISDDKAAIDRCKIMALHGMSADAWARFSDAGYKHYQVVDHGFKYNMMDIQAAMGIHQLRRVEEYWKRRACIWQKYNEGLAGLGMGLPADAEEHTRHAYHLYTIRVSAACCGVERDAMLEALRAHNIGVGVHYLAVPEHPYYRRRFGWDPADTPVATAYGRETVSLPLSPKLSDGDVDDVIEAIRAICTESAR

SEQ ID NO: 43327 - DNA, 1158 bp, Psychrobacter sp. 273-4
  CDS (1)..(1158)
atgattccctatggccgccaagacattaatcaacaagatattgatgctgttgttgaagtcctcaaatcagattttctgactcaaggtcctaaagttcctgcatttgaacaagcggtcaaggacgcttgtgatgcaaaatatgcgttggcggtcaatagtgcaacatctgcattacatattgcttgtcttgcattaggattaaaaaaaggtgattggctttggacgacgcctaatacttttgtcgcttcagcaaattgtgggctttactgcggtgcacaagttgactttgtagatatcgatcctaaaacttacaacctatgtgcaaaagagttagaaaaaaagctagttatcgcagaaaaagcagggaagttacctaaggtggttattccagtacattttagtggtcaaccatgtgatatggaagcaatatacagtttatcaaaacaatatggatttaagattattgaagatgcttcgcatgccatcggtggtaaatataaaggtgagcctattggtaactgtcgatatagcgacattacggtatttagttttcatccagtaaaaataatcactactgctgaaggtggtatggcaacaacgaatagtccagagttagcacagaagttagacttactacgcagccatggcattactcgtgatactgacttaatgaccaaacctacggatggtccttggtattatcagcaagtcgatttgggttttaattatcgtatgacagagttgcaagctgctttgggtgtgtcgcaaatgcagcgtttagaggcttttgttgccaaacgtcatgaattagcacagcgttatgataccttgcttaaagacttgcctgtaacgctgccttggcagcataagaatagctattcaggcttacatttatatgtgattcgcttgcagttagataagatcaagaaaacacacttagaagtttttgaagggatgcgtgaagctggtatcttggttaatttgcattatatacctgtgcatatgcaaccttattatcaatcaatgggctttaaagctggtcagtttcctcaagcggaacaatactataaagaagctataagtattccaatgtttccgacgatgactaatcaacagcaagaaaaaatagttaatactttacaacaactattattttag

SEQ ID NO: 43328 - protein, 385 aa, Psychrobacter sp. 273-4
MIPYGRQDINQQDIDAVVEVLKSDFLTQGPKVPAFEQAVKDACDAKYALAVNSATSALHIACLALGLKKGDWLWTTPNTFVASANCGLYCGAQVDFVDIDPKTYNLCAKELEKKLVIAEKAGKLPKVVIPVHFSGQPCDMEAIYSLSKQYGFKIIEDASHAIGGKYKGEPIGNCRYSDITVFSFHPVKIITTAEGGMATTNSPELAQKLDLLRSHGITRDTDLMTKPTDGPWYYQQVDLGFNYRMTELQAALGVSQMQRLEAFVAKRHELAQRYDTLLKDLPVTLPWQHKNSYSGLHLYVIRLQLDKIKKTHLEVFEGMREAGILVNLHYIPVHMQPYYQSMGFKAGQFPQAEQYYKEAISIPMFPTMTNQQQEKIVNTLQQLLF

SEQ ID NO: 43329 - DNA, 1077 bp, Methanococcoides burtonii DSM 6242
  CDS (1)..(1077)
atgatcccaatagcaaaaccagatatcggtgaagaagaaattgaagccgtttgtaaagtactccgctcaggaatgatagcagaaggaaaacgtgttgcagaattcgaagaagaatttgcaagctacatcggaacggaacatgcagttgcagtcaattccggcacagcagctcttcacgctgcactccttgcacatggaataggaaatggggatgaagtaataacaacttcattcagctttattgccaccgcaaactcgataatgtacaccggcgcaaaacctgtatttgtggacattgtcccagacacgttcaatatcgatcccacgcttgtcgaagaaaagatcactgataacacaaaggcaataatgccagtccacctctacggacatcctgcagagatgaaggccattaccgatattgcaaaggaccatgacctgatactcatcgaagacgcatgccaggcacatggagctgcctatggcgggaagaaggtcggttcatttggaacaggagcattcagcttctacccaaccaagaacatgacgaccagcgaaggcggaatgatgactaccaacgatgaagaggtcgccaaaaaagcaaaaatgatacgtgcccatggatcacagcagcgttacctccacgaaatgatcggatataatctaagaatgacagacatcggagctgccataggattaacacaacttaaaaaactgccatcatacaattccctaaggcaacgaaatgcatccttgctctcaaaaggactaagaaatacagacggaattaccatacctgttgtgaaagagggatgtgagcacatgttccaccaatacaccatccgtctaaacaacagggatgaaatgctaacaaagctagggcaggcaggaataggcactggagtatattatccgatacccatacacatgcaaccgatctacaaagatgcaggttatacagacaaacttccagaatgtgagaaagcatcaaaagaagtgctctccctgccagtgcatccaggagtttcagaagatgaaattcaacagataatcgatgcagtcataaagggagttgaatga

SEQ ID NO: 43330 - protein, 358 aa, Methanococcoides burtonii DSM 6242
MIPIAKPDIGEEEIEAVCKVLRSGMIAEGKRVAEFEEEFASYIGTEHAVAVNSGTAALHAALLAHGIGNGDEVITTSFSFIATANSIMYTGAKPVFVDIVPDTFNIDPTLVEEKITDNTKAIMPVHLYGHPAEMKAITDIAKDHDLILIEDACQAHGAAYGGKKVGSFGTGAFSFYPTKNMTTSEGGMMTTNDEEVAKKAKMIRAHGSQQRYLHEMIGYNLRMTDIGAAIGLTQLKKLPSYNSLRQRNASLLSKGLRNTDGITIPVVKEGCEHMFHQYTIRLNNRDEMLTKLGQAGIGTGVYYPIPIHMQPIYKDAGYTDKLPECEKASKEVLSLPVHPGVSEDEIQQIIDAVIKGVE

SEQ ID NO: 43331 - DNA, 1113 bp, Methanococcoides burtonii DSM 6242
  CDS (1)..(1113)
atgattccacttgcacaacccgacatcggagaagaagagatacgacttgttaacgaagtgttgaggtcaggctggcttagcatgggtccaaaggtaatagaatttgagaaattgtttgccaaatacatgggcaccaaacatgcaattgcaattaatagcgggacaagtggattacatctttgcataaaatcattgaatataagcaaaggtgatgaagttataacctcgcctttcagtttcatagcttccagcaactgcatcatgttcgaaggcggaacaccagtgttcgtggatattgatcccgatacacttaacttggatgcaaaacagatcgaggatgcaataaccgaaaatacgaaggcaatattacctgtccatgtttttggccatccttgtgaaatggatgcaattatggatatagcagaagagcacgatttggctgtagtagaagacgcttgtgaagcaattggagcagaatataaaggtaagaaagccggaacatttggtaatgcatctgtatttgcattttatcctaacaagcagatcactaccggtgaaggagcaatgatcgtgacagatgatgatcacattgccaaattgtgcaaaagcatgcggaatcaaggtcgctcagaagatgcagaatggttgaaccacattatgctcggatacaattaccgacttgatgaaatgagctgtgctttaggaataggtcaacttgatcggatcgatgaattacttggtaaaagatcaagggttgcagaaaaatatacaaagaagcttaatggggttgatggtattgttacgcagtacctatcccaggatgtgaaaatgagctggttcgtatatgttgttcaagtgagccaggaaatagatcggaatgaagttatgaaatacctaagagaacatgacgttagctgtaggccatattttactccgatacatctgcagccattctataaggaaacatttggatataaagaaggcgatttcccgatatgtgaaagagtttgcgaatcaactattgcactaccattttatggtaacatcgacgagcaaactatagaagaagtatgttctgtgctcaaggatgcactggaaatatataaaaattga

SEQ ID NO: 43332 - protein, 370 aa, Methanococcoides burtonii DSM 6242
MIPLAQPDIGEEEIRLVNEVLRSGWLSMGPKVIEFEKLFAKYMGTKHAIAINSGTSGLHLCIKSLNISKGDEVITSPFSFIASSNCIMFEGGTPVFVDIDPDTLNLDAKQIEDAITENTKAILPVHVFGHPCEMDAIMDIAEEHDLAVVEDACEAIGAEYKGKKAGTFGNASVFAFYPNKQITTGEGAMIVTDDDHIAKLCKSMRNQGRSEDAEWLNHIMLGYNYRLDEMSCALGIGQLDRIDELLGKRSRVAEKYTKKLNGVDGIVTQYLSQDVKMSWFVYVVQVSQEIDRNEVMKYLREHDVSCRPYFTPIHLQPFYKETFGYKEGDFPICERVCESTIALPFYGNIDEQTIEEVCSVLKDALEIYKN

SEQ ID NO: 43333 - DNA, 1224 bp, Anabaena variabilis ATCC 29413
  CDS (1)..(1224)
atgaaacaaaagttgaatgatttagctatatttggtggaacaccaagatttgttgaaaagttacacgttggtcgtcctaacattggcaaccgcgataatttattatcacgtatcaatgatatcttagatagaaaatggcttacgaacaatggtatttatgtacaggagtttgaacgacaaattgctgaatttgttggagtaaaacactgtatcgctacgtgtaacgcaacagtagccttagaaatagccattcgtgctgtaggtttcactggtgaagtgattattccttctttcacatttattgctactgcacacgctctcaaatggcaagaaatcacacctgttttttgtgatatagacccccagactcataatatagatcccaacaaaatagttcaaagcataacccctcgaactactggtattattggtgttcatttgtggggtcgcccttgtgacgtagaggctttaagtgaaatttctcttactcacaatttgaaattaatgtttgatgctgctcatgcttttggctgttcacatcaaggacgcatgataggtagctttggtgatgctgaagtttttagttttcatgcaactaaatttttaaacacatttgagggaggagcaatagttacaaatagtgatgaattagcggaaaaaattcgattgatgactaactttggttttgctggctatgaccgagttatctatatcggtactaatggaaaaatgaatgaagtttcagcagcaatgggtttaacaggattcgataatctagatgaatttgttttcattaactatcgtaattataagtattaccaaagagaactaaaagaaattcctgggattaagttgattacttacaacgagactgagaaatctaattatcagtatattattttagaaattgatgagatgatcttgggaattagtagagatcaattactgaaaacattacaagctgaaaatgtaatagctcgaagatatttttatccgggttgccataatatggaaccgtactattcatattatccttattctaagttattgctaccagaaacagaaaaggtagttcaaagagtaatttctttacctacgggaacatcggtaagtatcgacgatattactaatattatagatattatcaagtttgtaatagaaaactcaacttattttcaatctgagttaagtcattcagtacaaatatcaaacattattttatag

SEQ ID NO: 43334 - protein, 407 aa, Anabaena variabilis ATCC 29413
MKQKLNDLAIFGGTPRFVEKLHVGRPNIGNRDNLLSRINDILDRKWLTNNGIYVQEFERQIAEFVGVKHCIATCNATVALEIAIRAVGFTGEVIIPSFTFIATAHALKWQEITPVFCDIDPQTHNIDPNKIVQSITPRTTGIIGVHLWGRPCDVEALSEISLTHNLKLMFDAAHAFGCSHQGRMIGSFGDAEVFSFHATKFLNTFEGGAIVTNSDELAEKIRLMTNFGFAGYDRVIYIGTNGKMNEVSAAMGLTGFDNLDEFVFINYRNYKYYQRELKEIPGIKLITYNETEKSNYQYIILEIDEMILGISRDQLLKTLQAENVIARRYFYPGCHNMEPYYSYYPYSKLLLPETEKVVQRVISLPTGTSVSIDDITNIIDIIKFVIENSTYFQSELSHSVQISNIIL

SEQ ID NO: 43335 - DNA, 1149 bp, Anabaena variabilis ATCC 29413
  CDS (1)..(1149)
atgatccaaagcctaagttcgattcccgcctttgatatcaagcagcaatatgcttccatagaagccgaagtcagcagagccgttgtagaagcactggcttctgggcgttatattggtggccctccagtcgaaagttttgagcaacaatttgctgcttatcatggcgttactgattgtgtcgcttgtaattctggtacagacgctctatttctagctttacgcgccttaggaatcggtgcaggcgatgaagtaattactacaccattcacctttgtcgctacggctgaagtgatcagcgccgtaggtgcaaaaccggtatttgttgacatcgatgagacaagttttaacctagatttacagcaagtagcggcggcgattacaccccgaaccaaagcgattatcccagtgcatctatttggacagcccgtggatatgacaacgctaatggcgatcgctcaagctcacaatatcgcagtaattgaagattgcgctcagtccacaggcgcgacttgggacggcaaaaaagtcggtagtattggacatattggctgttttagcttctaccccaccaaaaatctaggtgcttgcggtgatggtggcgcgattacaaccaacgatccagaaattgctgccaaggtgcggatcatcaaggaacatggacagagacatcgttatcaatatgaagaaataggtgttaatagccgcttagatgcgattcaagcagtaattttgcagattaaactaccttatcttgatacttggaatcgccaaagacaagcgatcgccgcctattaccaaaaatatctcagtcaaattcccggtatcatccccccgcaagaactagctggtggcgtgagcgtgtggaatcaatatactattcgcgtcatcaccgcaggaaggaacggtaatagcgccacacaccgggaggcggtaaaaaatagcttgcaagaaaagcaagtaggctcgatggtttactatccctaccctttacatttgcaaccagtttatcaatatctcggttatcagccaggacaattaccagttgcagaacaagcttgcaatgaagttttatccttacccatgtttcccgaactaacaaccgaacagcaagatcaagtaatttatgcgttgaaggatattcttttgtag

SEQ ID NO: 43336 - protein, 382 aa, Anabaena variabilis ATCC 29413
MIQSLSSIPAFDIKQQYASIEAEVSRAVVEALASGRYIGGPPVESFEQQFAAYHGVTDCVACNSGTDALFLALRALGIGAGDEVITTPFTFVATAEVISAVGAKPVFVDIDETSFNLDLQQVAAAITPRTKAIIPVHLFGQPVDMTTLMAIAQAHNIAVIEDCAQSTGATWDGKKVGSIGHIGCFSFYPTKNLGACGDGGAITTNDPEIAAKVRIIKEHGQRHRYQYEEIGVNSRLDAIQAVILQIKLPYLDTWNRQRQAIAAYYQKYLSQIPGIIPPQELAGGVSVWNQYTIRVITAGRNGNSATHREAVKNSLQEKQVGSMVYYPYPLHLQPVYQYLGYQPGQLPVAEQACNEVLSLPMFPELTTEQQDQVIYALKDILL

SEQ ID NO: 43337 - DNA, 1179 bp, Anabaena variabilis ATCC 29413
  CDS (1)..(1179)
atgactataaaaattccttttgtcgatttgcagttacaacaccagccaatcgaaaatcagatacagcaagcgattcagaaagtattacaacagggagactttatattaggcaaagcagtttccgagtttgaatctgcctttgcagccgcctcaggagtaggttatggagtgggtgtagcttcgggaactgatgcgatcgccttgggtttaaaagcctgtaatataggccctggtgatgaagtaatcttacccgctaatacttttgtcgccacattaattggtgttctccaagtaggtgctaaacccattctcgtagattgtgaccccctaacagccttaattgacttagaagcagcagccaaagtagtcaccaccaatactaaagcaattattcccgtgcatctctatggacagatggtatcaccccaaaagttaatagattttgcccaaacgcacaaggtgttaatctttgaagacgcagcccaggcgcacctagcccatagagaaggatatcaagctggttccgtggggacagccgccgcttttagcttttatcccagcaagaatttaggtgcattgggtgatgggggaatattactaactagcgatgcagatatagccaggaaagttgccagcatacgcaattatggttcatcccagaagtatgttcacgtcgaactgggtacaaatagccgtctggataccttacaagcagccgtattactggaaaaattgcctcatttaccgcaatggaatagcgatcgcctcaccatcgcccaaacatacgatctagaattagcaccactagcatctgctggtattatccccatgcaaaaccagagtggcacgggtcatgtttatcatctttacgcgattaaaattgatgattcctgtccagtcgaacgtcagcacatccaagaacaactgacagccgtagggattcaaaccggcatccattacccgattccttgtcatttacagccagcatttactgatttaggctataaacctggagattttccccaatcagaaaaactagccaagcaaatattatccttaccgatgtatcctggtttgaaccaaagccaaattagagaagttgtagcagctatagccaaagcagtaggagattttcccgaaaaaccagcatctactacccaggaaagtaaagtagcataa

SEQ ID NO: 43338 - protein, 392 aa, Anabaena variabilis ATCC 29413
MTIKIPFVDLQLQHQPIENQIQQAIQKVLQQGDFILGKAVSEFESAFAAASGVGYGVGVASGTDAIALGLKACNIGPGDEVILPANTFVATLIGVLQVGAKPILVDCDPLTALIDLEAAAKVVTTNTKAIIPVHLYGQMVSPQKLIDFAQTHKVLIFEDAAQAHLAHREGYQAGSVGTAAAFSFYPSKNLGALGDGGILLTSDADIARKVASIRNYGSSQKYVHVELGTNSRLDTLQAAVLLEKLPHLPQWNSDRLTIAQTYDLELAPLASAGIIPMQNQSGTGHVYHLYAIKIDDSCPVERQHIQEQLTAVGIQTGIHYPIPCHLQPAFTDLGYKPGDFPQSEKLAKQILSLPMYPGLNQSQIREVVAAIAKAVGDFPEKPASTTQESKVA

SEQ ID NO: 43339 - DNA, 1176 bp, Synechococcus elongatus PCC 7942
  CDS (1)..(1176)
atgacgtctatccccgcctttaatctgactgagcagtaccgccgtatcggtgctgagctagaaactgcgacagccaaggtcttagcctcggggggctacatcggcggacagactgttgcggactttgaagcggcttttgcagcggccatgggtgtgacggaagccgtgggctgcaattcgggcaccgatgcgctgcatctagcactgcgggcattagacatcgggcctggggacgaagtcatcacttcgccgtttaccttttttgcctctgcagaagcgattagtttggcgggggccacacccgtcctagtcgacatcgaaccccagttcttcaacctcgactatcgccagatcgaagcagcgattaccccgcgcaccaaggcgattattcccgttcatctgttcggccatccggcggcgatgtcggagattatggcgattgcccgagcccacaatctgcgcgtgattgaggattgtgcccaagcgacgggagcaacttggcagggtcagccggttggcagctttggcgactgtggctgctttagcttctatccgaccaaaaatttgggggcctgcggcgatggcggcctcgtcacaaccaagaatcctgaagtggccgatcgcctgcgatcgctgcgtcagcatggcatgcgggtgcgctactaccacgatgagatcggcctgaatagccgtttggatgcgctgcaggcggtgattctctcgattaagctgcgctacttggatgagtggaatcagcagcgccaagcgatcgcgcagcgctatggcgaagcgatcgccgcgattcccggtctggtcgcccccagcgtgcacgccgatgccgtccatgtctggcaccaatacacggtgcgggtgcaggcctgtggcgatcgcagccgctgtgtcagtcatccctgcgatcgccaaggactttgccgcgactggctgcaacaacaactgcaagcccaaggcattggctcgatgatctactaccccgtgcctgtgcatctgcagcaggcctacagccagttaggctacaagactggcgacttccctgaagccgagcgtgccgcccaagaagtcctgtcgctgccgatgttcccggaactcaacgaggatgatcaggctcgggtgatcacggctctgaaggatctggcgatcgcagccgtccagtcctag

SEQ ID NO: 43340 - protein, 391 aa, Synechococcus elongatus PCC 7942
MTSIPAFNLTEQYRRIGAELETATAKVLASGGYIGGQTVADFEAAFAAAMGVTEAVGCNSGTDALHLALRALDIGPGDEVITSPFTFFASAEAISLAGATPVLVDIEPQFFNLDYRQIEAAITPRTKAIIPVHLFGHPAAMSEIMAIARAHNLRVIEDCAQATGATWQGQPVGSFGDCGCFSFYPTKNLGACGDGGLVTTKNPEVADRLRSLRQHGMRVRYYHDEIGLNSRLDALQAVILSIKLRYLDEWNQQRQAIAQRYGEAIAAIPGLVAPSVHADAVHVWHQYTVRVQACGDRSRCVSHPCDRQGLCRDWLQQQLQAQGIGSMIYYPVPVHLQQAYSQLGYKTGDFPEAERAAQEVLSLPMFPELNEDDQARVITALKDLAIAAVQS

SEQ ID NO: 43341 - DNA, 1119 bp, Crocosphaera watsonii WH 8501
  CDS (1)..(1119)
atggctgactttatccctgttaacgaacccttactagacggtaatgagaaaaaatatttgaacgaatgtatcgacactggttggatctcttcagggggtccctttgtgaagcagtttgaggccaaatttgctgaaaccgtccgtagaaaacacgctattactgtctgtaatggttcagttgctttagatgctgcggtggttgccttagacatccaagcaggagatgaggtcattctacctacctttaccatcatatcttgtggtgcagccattgtcagagccggaggtattcctgtggtggtagattgcgatcctctcacctggaatatggatgttagccaaatagaagccaaaattacccccaaaacaaaagcgatcatggtagttcatatttatggtctccctgtagatatgaaccccgtcttggaattggctgataaatatggcttaaaaattatcgaagatgcagcagaaatgcacgggcaaacctacagggataaaccctgtggtagtttcgggggtattagtacctttagcttttatcctaacaagcacgttaccacaggagaagggggaataattgtcaccgatgatgatagtttagccgaaaaatgtcgctccttacgtaacctttgttttcaaccacaaagacgttttattcatgaagagttaggttggaatttacgctttaccaatctacaagctgctgttggtttagcacaattggaaagattaccagaatttgtgcaacgaaagcgcaaaatgggggctttttatactgaacttttagccgaagtttctcagctagaattgtccttagttaaaactgattatgctgagagtatttattgggtttatgggatgattataaaagatgacgttccctttgatgcagcagaagcaatgcaacggttacgagagaaaaaaataggaactcgtccctttttctggggaatgcacgaacaacccgttttccataaaatgggactcttaaaagacgtttcttgccctgtagcagaaaggttatctcgtcgaggtttttatgttcccagtggtttagctttaacagaagatcagatgaaacaggttgttatagctgttaaagaagtgtttaactaa

SEQ ID NO: 43342 - protein, 372 aa, Crocosphaera watsonii WH 8501
MADFIPVNEPLLDGNEKKYLNECIDTGWISSGGPFVKQFEAKFAETVRRKHAITVCNGSVALDAAVVALDIQAGDEVILPTFTIISCGAAIVRAGGIPVVVDCDPLTWNMDVSQIEAKITPKTKAIMVVHIYGLPVDMNPVLELADKYGLKIIEDAAEMHGQTYRDKPCGSFGGISTFSFYPNKHVTTGEGGIIVTDDDSLAEKCRSLRNLCFQPQRRFIHEELGWNLRFTNLQAAVGLAQLERLPEFVQRKRKMGAFYTELLAEVSQLELSLVKTDYAESIYWVYGMIIKDDVPFDAAEAMQRLREKKIGTRPFFWGMHEQPVFHKMGLLKDVSCPVAERLSRRGFYVPSGLALTEDQMKQVVIAVKEVFN

SEQ ID NO: 43343 - DNA, 1053 bp, Crocosphaera watsonii WH 8501
  CDS (1)..(1053)
atggccgctgttgtgcaacggggggattttatcttaggaaaaagcttaaaagaatttgaagcggaatttgctcaagctagtggtgtcaattatggtgtgggagtcgcctctggaaccgatgcgatcgctctaggactacaagcttgtggtatcatagaaggggatgaagtgttagtgccagctaatacctttattgcgacggtgataggagtaattcaagcaggggcaacccctattttagtggactgcgatcgccatacagctttaattgacttaaacttagcggccaaagccattacacccaaaaccagagccattctacccgtccatttatacggtcaaatggtgtccccaaaagccttattagactttgcccaggcccacaatctcattatctttgaggatgcagcacaagcacatttagcccaacgagaaggttatatggctggctccgttggtatggctgctgcttttagcttttatcccagtaaaaatttaggggcctttggcaacggaggaatgttgattacatctgatcaagaagtcgcccaacgggttcaaaccttacgtaattatggcgcaccgaaaaaatattatcatacagaagtgggcaaaaatagccgtttagatagcttacaagcagccattttacaagttaaactacctcatttatctcaatggaatcaattgagaaatcaagcagcacaaatttatgatcaggggttaaaatcaggaagagataataaagtagtcccgatgacgaatctcgctcaagaaggtcacgtttatcatttatatgttgtccgtattaatgaagcctcttctatgactcgtgaacaggttcaagactttctcaaggaaaaaggcatccaaacaggcattcattaccccattccttgtcacctacaacctgcttacaaaagcttaggttatcagttaggagattttccccaagcagaaatgttatgtgaacaaattttgtctttacccatgtatcctggtattaaatcagaagatattgcttgggtagttgaacaaatatctttaatttaa

SEQ ID NO: 43344 - protein, 350 aa, Crocosphaera watsonii WH 8501
MAAVVQRGDFILGKSLKEFEAEFAQASGVNYGVGVASGTDAIALGLQACGIIEGDEVLVPANTFIATVIGVIQAGATPILVDCDRHTALIDLNLAAKAITPKTRAILPVHLYGQMVSPKALLDFAQAHNLIIFEDAAQAHLAQREGYMAGSVGMAAAFSFYPSKNLGAFGNGGMLITSDQEVAQRVQTLRNYGAPKKYYHTEVGKNSRLDSLQAAILQVKLPHLSQWNQLRNQAAQIYDQGLKSGRDNKVVPMTNLAQEGHVYHLYVVRINEASSMTREQVQDFLKEKGIQTGIHYPIPCHLQPAYKSLGYQLGDFPQAEMLCEQILSLPMYPGIKSEDIAWVVEQISLI

SEQ ID NO: 43345 - DNA, 1155 bp, Exiguobacterium sp. 255-15
  CDS (1)..(1155)
atgaaacacatcccgttatcgatcccacatctcagtggtcaggaaatgcgttatgtcacggaagccttggaaacgaactgggttgcgccgctcggtccgaatgtcgaagccttcgaagcagcaatgaaaacatacagcggttccgctgcgacactcgcgacgagcagcgggacagccgccatccatttggcactggcgacactcggcgtgacggccggagatgatgtcttctgtcagtcgttgactttcatcgcttcgacaaatccgatccgttatgtcggtgcacggccggttttgattgattccgaaccggagacgtggaacatgtcaccggcagcactgcgacgggcgatgattcaagccgcgacccggggacgcctgccgaaagccgtcatcgtcgtccatctgtacggcgttgtcgcgaaggtcgaagagattgccgccatctgtgaggagtatgatgtaccgctgatcgaggacgcggcagaatcactcggatcgacgatcaacggtcggatgacaggcacgttcggaacattcggtatctattcgtttaacggcaataaaatcatcacgacgtcgggcgggggtatgttggtctcaaatgacacccgcttgatcgaacgggccttttatctcgcgacacaagcccgtcagcccgtcttacattatgagcatacggaagtcggcttcaattaccggatgagcaatgtctctgccggaatcggacgcggccagctggaagtgattgaagagcgggtcgaagcacggcggaccattttcgaacggtatgtccgggcctttgagacggtcgacgcgtcacattaccagcaggaaatcgaaggaagccgcgcgaaccgttggctgacggcactgacattaccgggcggcatgcagcaacgggatgcgttgattcagcagttgaagcaaaaaaacatcgaggcgcgtccggcctggaaaccgatgcacttgcaacctgtttaccgggatgtaccttacatcacggcgaatgaagaagatgtcagccgtcgtctgttcgaggaaggaatctgtttaccgtccgcttcacaaatgagctttacggatcaggcactcgtcattcgttttgttcgccaaggactcgttgaagatgttcgacgaaatgttcagttatga

SEQ ID NO: 43346 - protein, 384 aa, Exiguobacterium sp. 255-15
MKHIPLSIPHLSGQEMRYVTEALETNWVAPLGPNVEAFEAAMKTYSGSAATLATSSGTAAIHLALATLGVTAGDDVFCQSLTFIASTNPIRYVGARPVLIDSEPETWNMSPAALRRAMIQAATRGRLPKAVIVVHLYGVVAKVEEIAAICEEYDVPLIEDAAESLGSTINGRMTGTFGTFGIYSFNGNKIITTSGGGMLVSNDTRLIERAFYLATQARQPVLHYEHTEVGFNYRMSNVSAGIGRGQLEVIEERVEARRTIFERYVRAFETVDASHYQQEIEGSRANRWLTALTLPGGMQQRDALIQQLKQKNIEARPAWKPMHLQPVYRDVPYITANEEDVSRRLFEEGICLPSASQMSFTDQALVIRFVRQGLVEDVRRNVQL

SEQ ID NO: 43347 - DNA, 1116 bp, Mesorhizobium sp. BNC1
  CDS (1)..(1116)
atgcagttcatcgacctcggtaagcagcgcgatcgaattcaggaaaagcttgagaaacggctggcaaaggtgctggccgaggggcgctatatccttggccccgaggtcgccgagttcgaggagaagatcgcggcctatctgggtgtcaaatatgccattgcctgcgcaaatggcaccgacgcgcttttgatcccgctcatggccaagggcatcgggccgggggatgccgtcttcgtgccgagctttacctttgcggccaccgccgaggttgtggcgctcgcgggcgcttcgccggtcttcgtcgatatcgacccggaaacctacaatattgatatcgacagcctgcaagcggcgatcgctgctgtccgggaaaagggagagcttgcgcccaaggcaatcataccggtcgaccttttcggcctcgccgccgactattccgccatctcacggattgccgcgcgcgaggggctgttcgtgatcgaggatgccgcccaggccaccggcggctcgcagggcaataccatgtgcggcgccttcggcgatgtggcaggcaccagcttctacccggccaagccgctcggctgttacggcgacggcggcgccatgttcaccaatgacggggaccttgccgaaatcctccgctccgtcgcgttccatggcaaggggcagagccaatatgacaatgtgcgaatcggcgtcaattcgcggctcgacaccatgcaggcggcgatcctgatcgagaagctcgccatcctgtcggaggaaatggagcttcgccagaaggtggccgcgcgctacagcgaggccttgggggacgtggtgaaggttcccgcgatcccatcgggcaaccgttccgcctgggcgcaatatgcgatcgaaacgcctgcgcgcgacaaggtgagggcggcgctcaaggaagagggcatcccttccgtcgtctattatgaaaagccgctgcacctgcaggaggcctacgccgcctatccacgcgcgccgaaaggtctggaggtttcggaaaccctgccggaacgtatcctctgcctgccgatgcacccctatctatccgaggcagaccaggaccgggtcgtcgccacgattcgtagcgcggtgaagtaa

SEQ ID NO: 43348 - protein, 371 aa, Mesorhizobium sp. BNC1
MQFIDLGKQRDRIQEKLEKRLAKVLAEGRYILGPEVAEFEEKIAAYLGVKYAIACANGTDALLIPLMAKGIGPGDAVFVPSFTFAATAEVVALAGASPVFVDIDPETYNIDIDSLQAAIAAVREKGELAPKAIIPVDLFGLAADYSAISRIAAREGLFVIEDAAQATGGSQGNTMCGAFGDVAGTSFYPAKPLGCYGDGGAMFTNDGDLAEILRSVAFHGKGQSQYDNVRIGVNSRLDTMQAAILIEKLAILSEEMELRQKVAARYSEALGDVVKVPAIPSGNRSAWAQYAIETPARDKVRAALKEEGIPSVVYYEKPLHLQEAYAAYPRAPKGLEVSETLPERILCLPMHPYLSEADQDRVVATIRSAVK

SEQ ID NO: 43349 - DNA, 1137 bp, Mesorhizobium sp. BNC1
  CDS (1)..(1137)
atggaaaccggcaggctgtcgttcctcacgggtccgaagaccgccgagttcgagcgccgttgggcggaaaaatacggtgtagatacggcggtggcggtttcgaacggaaccgcagcgcttcacgtcgcggtcacctatctgaatcccgaaccgggagacgagatcatcctatcgccgatcacagacgtgggcacggtgatcccgatcatctaccagctggccatccccgtctttgccgatgttaatccggtgacacagaacattgaccctgcgtcgatcgagaagaatatcacctcgcgcacgcgggcaattatcgtcacgcatgtctatggccatcccgccgacatggatgcgatcatggcaatcgcgcgtaagcatgatctgttcgtgattgaagattgcgctcaagcacatcttgcatgttacaaggggaagctttgcggcaagatcggcgatgttggatgcttcagctttcagcaatcgaagcatatgaccaccggcgacggcggcatggtgattaccaacggtgatggacgcttcggccggaaactcaggcattgctcggacaagggctggccacgcgagaagggcggccgcgatcatattttcctcgcaacgaactatcacatgacggaactgcaagccgccgtggggcttggtcagcttgaacagcttgagcagtttgttgatgcacggattaaagccgccgacaggctgacggagctgctttcgggcgtcgcggtgacgccggtcctgcccatgcgcgatacgatcggcgtgtatttcttctacagcttccgaatcgaccccgcgaaattgacggtctcggtaccggagctgatgaaagctctggtggccgagggcatcgatggattcattgggtatcctggccccatcccgctttaccgttatcccatgatccgggaacataagacattcggaaattccggctggcccttcaccttggaaggcgttcgcaaagacgacttcggatcgccgctttgccccgaggcggagaaggcgtgcaaggaaacgatttgcatgtggtggacggatcgcatggaagaacgccacctcgtgcaaattgctggcgcgattggaaaggtcatcgccgcctattcccgtgtttcggcctga

SEQ ID NO: 43350 - protein, 378 aa, Mesorhizobium sp. BNC1
METGRLSFLTGPKTAEFERRWAEKYGVDTAVAVSNGTAALHVAVTYLNPEPGDEIILSPITDVGTVIPIIYQLAIPVFADVNPVTQNIDPASIEKNITSRTRAIIVTHVYGHPADMDAIMAIARKHDLFVIEDCAQAHLACYKGKLCGKIGDVGCFSFQQSKHMTTGDGGMVITNGDGRFGRKLRHCSDKGWPREKGGRDHIFLATNYHMTELQAAVGLGQLEQLEQFVDARIKAADRLTELLSGVAVTPVLPMRDTIGVYFFYSFRIDPAKLTVSVPELMKALVAEGIDGFIGYPGPIPLYRYPMIREHKTFGNSGWPFTLEGVRKDDFGSPLCPEAEKACKETICMWWTDRMEERHLVQIAGAIGKVIAAYSRVSA

SEQ ID NO: 43351 - DNA, 1188 bp, Mesorhizobium sp. BNC1
  CDS (1)..(1188)
atgtccgggatggcaaaggtcggtttgcgggagtggtttgcggtcgggcgggttatcgcatccgggcacctggcgcggtatagcggcgtgggtgaaggaccgctaacgcgatttgaggcggattattcggagaaattcggtgtcaagcacacgctcgccgtgagcagcggcaccgccgcactcatctcggcgctcgctgcggcgggcgtagggccgggcgacgaggttctggtgcccgcctatacctggatcgccaccgcggccgcgccgctggcggtcggcgccgttccggtgcttgtcgatatcgaccagacgctgaccattgatcccgcggacatcctgcgcaagatcacgccgcgcacgcgcgctatcctgccggtgcatatggcgaatatggtctgcgacatggatcggatcatggagatcgcccgtgagcgtgggcttctcgtgatcgaggatgcctgtcaggcggtcggtgtcacatataagggccggcgggtgggcaccatcggagatatcggcgcctacagcttcaaccagttcaagaacatgaacgtcggcgagggtggggcggtcgtcacaaatgaggaccggtattacgtccgcgcccgtatgtatcacgatgtcggttccatctttcgcggtcacctcgataatgaaaacgagccgcatttcttcggggtcaatttcaaggccagccaaattcagggtgccatgctcaacgtccagctcgccaagctcgatccaatgctggctcgcatgcgggctcgctatcggttgatgacccgggtgctggcggcctcgtccgcattcaggatcggtccgcataacgatgtcgagaatgccgtcggactgcatgtgatcttcaatacagcggaagaggccgcagattttgcggcccggaacaagcgcggcgtctaccggctctacgattcaagccggcacgtttatacgaactggctgccggtgcttgagcagcgcgcggcccatcctgaaatgaacccgttcgcatgggcctcacggaaagtcgaatatgcgccggatatgtgcgcgcgcacgctcgacatcctgcagcgcagctgccgcatcagcctcggcgaaaactatcctctgccgcttgtggcttatgtcgcccggcggctcgccagcggtggcgaggcagcaaggcaggtgtcctatgcggtatag

SEQ ID NO: 43352 - protein, 395 aa, Mesorhizobium sp. BNC1
MSGMAKVGLREWFAVGRVIASGHLARYSGVGEGPLTRFEADYSEKFGVKHTLAVSSGTAALISALAAAGVGPGDEVLVPAYTWIATAAAPLAVGAVPVLVDIDQTLTIDPADILRKITPRTRAILPVHMANMVCDMDRIMEIARERGLLVIEDACQAVGVTYKGRRVGTIGDIGAYSFNQFKNMNVGEGGAVVTNEDRYYVRARMYHDVGSIFRGHLDNENEPHFFGVNFKASQIQGAMLNVQLAKLDPMLARMRARYRLMTRVLAASSAFRIGPHNDVENAVGLHVIFNTAEEAADFAARNKRGVYRLYDSSRHVYTNWLPVLEQRAAHPEMNPFAWASRKVEYAPDMCARTLDILQRSCRISLGENYPLPLVAYVARRLASGGEAARQVSYAV

SEQ ID NO: 43353 - DNA, 1137 bp, Crocosphaera watsonii WH 8501
  CDS (1)..(1137)
atgccagtgaataccatcccccctgtagatttagtccgtcaatacaagcttattagtgaagaggttgatcgtgctgtcctcgaagttgtccgttccgggcgttatatcggtggtgaagttgttaaggactttgaagaacaactcgctaaatatgtcggtagtgcgcactgtattggttgtaactcaggaaccgatgccctatatttggccttacgagcattaaatattggtgctggagatgaggtcatcaccacaccatttacctttattgccaccacagaaaccgtcagtttagtgggagctaaaccagtttttgtggatattgaacgggataccttgaatatggatgtgggagccattgaagcagctattacccctcaaaccaaagccattatccctgtacatctctttggccaaccggttaacatggcccgtttaatggacattgcccaaaaacataatctgtatgtgatcgaagactgcgctcaaagtacaggggcaaaatgggaagaggatctgacaggaaatattggtcatgttggttgttttagtttctttcccaccaaaaacttaggaacttgtggggatggtggtgcggttaccacaaatgatccggcgatcgccgaaactattaaagttattaaagaacacggttcagcacaacgatattatcacgatgttgtgggtatcaatagccgtcttgatagtatccaagcagctattcttcgggttaaattgtcttatcttgatcagtggaataaacaacgaagagaaatttcccaacggtatcatcaactattagcaggtattcctggaatacaacttcctcaagaaattaagggaggttatcatgtatggaatcaatacactattttagtaaaaaatcataacaataatgaaaaaaccacaagagatgacctgagagaaaagttacaagaaaatggtatcatctcaatgatttattatcccattcccttacatttacaaaaggtttatcataatttaggttatcaaaagggtgctttttctgtaacagaagaagcagcaaatgaagtgttatccttacctatgttccccgatatttctcccgaagaacaagaacaagttgcttatgctttaagagattattttgcttaa

SEQ ID NO: 43354 - protein, 378 aa, Crocosphaera watsonii WH 8501
MPVNTIPPVDLVRQYKLISEEVDRAVLEVVRSGRYIGGEVVKDFEEQLAKYVGSAHCIGCNSGTDALYLALRALNIGAGDEVITTPFTFIATTETVSLVGAKPVFVDIERDTLNMDVGAIEAAITPQTKAIIPVHLFGQPVNMARLMDIAQKHNLYVIEDCAQSTGAKWEEDLTGNIGHVGCFSFFPTKNLGTCGDGGAVTTNDPAIAETIKVIKEHGSAQRYYHDVVGINSRLDSIQAAILRVKLSYLDQWNKQRREISQRYHQLLAGIPGIQLPQEIKGGYHVWNQYTILVKNHNNNEKTTRDDLREKLQENGIISMIYYPIPLHLQKVYHNLGYQKGAFSVTEEAANEVLSLPMFPDISPEEQEQVAYALRDYFA

SEQ ID NO: 43355 - DNA, 1176 bp, Ralstonia eutropha JMP134
  CDS (1)..(1176)
atgaccgctaccgccgcttccgaattccttcccttcgtccggcccgagatcgacgcggacaccattgccgaagtcggcaaggtgctggcatccggctggatcacctccggcccgaagatgcaggcgttcgaggacgccctgtcccagctctttggcggacgccccgtgcgcaccttcgccaatggctcggccacgatggaaatcgcgctgcggatcgcggacatcggccccggcgatgaagtcatcaccacgccgatcacgtgggtcgccaccgcgaacgtggtgctcgccgtgggcgcgaagcccgtgttcgtcgacatcgacccgcgcacgcgcaatatcgacctcgacgccgtggaagcggccatcacgccgcgtacgcgcgccatcatgccggtgtacctgtctggcctgccggtcgacatggaccgcctctatgcgatcgccaccaaatacaatctgcgcgtgatcgaagatgccgcgcaggccatcgattcgcgctggcaaggcaagcgcatcggcgcctttggcgacctggtcagcttcagcttccaggccaacaagaacatcaccagcgtcgagggcggctgcctggtgatgaacacgccggaagaagccgtgcgcgccgaacgcctgcgcctgcagggcgtgatccgctcgggcatggacggcatggacgtcgaagagcccggtggcaagttcaacctgaccgacgtgaatgccgcgatcggcctcgcgcagctcgcaaagctcgacgccatcaccgcgcgccgcgccgcactggccgagacctatttccgatgcgccgccgacgcggggctggccgaactcggcattgaactgccccagccgctggacccgcagcaagccacgaccaactggcacatgttccaggtcgtgctgcccacggagcgcctcgaaggcggcccgcagcaggctcgccagaacgtgatgcaggccatgcgcgagcgcggcatcggcaccggcgtgcactatcccccgattcaccttttcacctactaccgttcccttggctggcgcgctggcatgctgccgcacgccgaacgcatcggtcgcggcatcgtcacgctgccgctgttccccgccatgcaagccgccgatgtggaacgggtctgcgcaactctcagcgaaacatgcaaacgtctctccaaatga

SEQ ID NO: 43356 - protein, 391 aa, Ralstonia eutropha JMP134
MTATAASEFLPFVRPEIDADTIAEVGKVLASGWITSGPKMQAFEDALSQLFGGRPVRTFANGSATMEIALRIADIGPGDEVITTPITWVATANVVLAVGAKPVFVDIDPRTRNIDLDAVEAAITPRTRAIMPVYLSGLPVDMDRLYAIATKYNLRVIEDAAQAIDSRWQGKRIGAFGDLVSFSFQANKNITSVEGGCLVMNTPEEAVRAERLRLQGVIRSGMDGMDVEEPGGKFNLTDVNAAIGLAQLAKLDAITARRAALAETYFRCAADAGLAELGIELPQPLDPQQATTNWHMFQVVLPTERLEGGPQQARQNVMQAMRERGIGTGVHYPPIHLFTYYRSLGWRAGMLPHAERIGRGIVTLPLFPAMQAADVERVCATLSETCKRLSK

SEQ ID NO: 43357 - DNA, 1053 bp, Methanococcoides burtonii DSM 6242
  CDS (1)..(1053)
atgtatgtcgatgacgacatcaagagagcagttgaacaggtactggacagcggccgtttcatcaaaggagaacaattacgccttttggaacaggaatttgccgatttttgtaatgctaaaaacgctgttggcgttagttcagggacttcagcaatactgcttacaatgatggcacttggaattggaaagggtgacgagataatcgtaccttcccatacattcattgcaagtgcaagtcctgctaaattcttaggtgcaacacctgtatatgtagatatagaccctgacacatacactgttgatcctaataaaatcgaagaagcaattactgagaacactaaagcgatcatagctgtccacctctacggacatcctgccgatatgaacagcataaacgatattgcatcaaagtatgggatacctgttgtcgaggattcatgtcaggcacatgctgccaaatacaaaggaaagaggacaggagcgcttggagatattgctgtttttagcttcttcccatcaaagaacatgaccgttgccggagatggcggaatagccgttacgaacaatgaagaacttgctgaaaagatagccatgttgagggatcatggaaggaacaacaaatataccagtgacctccttggcctgaaccttcgtctcagcgagatccctgcagccataggaaggcaacaactcagccatctgagcgattggacagataaaagaagacaggctgctgcccgatacaacgagcttcttcgaggagtggtggaaacgccatttgaagctcaatgggcaactcacgcataccatttatacgttatccagaccgaggcccgtgacgaccttgccaaatacctcaatgacaacggcatcagcacaggaatacactacccggtcccagttcacagacagccatgtatggaagcaggtaaagtaaccctgcctgttacagacaaggtagtagataggatactttcacttccaatgcacccacaacttacagatgaacagattaaattcgttgctgaaaaaatacaggagtggataaattga

SEQ ID NO: 43358 - protein, 350 aa, Methanococcoides burtonii DSM 6242
MYVDDDIKRAVEQVLDSGRFIKGEQLRLLEQEFADFCNAKNAVGVSSGTSAILLTMMALGIGKGDEIIVPSHTFIASASPAKFLGATPVYVDIDPDTYTVDPNKIEEAITENTKAIIAVHLYGHPADMNSINDIASKYGIPVVEDSCQAHAAKYKGKRTGALGDIAVFSFFPSKNMTVAGDGGIAVTNNEELAEKIAMLRDHGRNNKYTSDLLGLNLRLSEIPAAIGRQQLSHLSDWTDKRRQAAARYNELLRGVVETPFEAQWATHAYHLYVIQTEARDDLAKYLNDNGISTGIHYPVPVHRQPCMEAGKVTLPVTDKVVDRILSLPMHPQLTDEQIKFVAEKIQEWIN

SEQ ID NO: 43359 - DNA, 1137 bp, Methanococcoides burtonii DSM 6242
  CDS (1)..(1137)
atggaaggtttggaagtaatgtcagacaatactatccgcctgtcaagatcagttattggggaagaagaaaagaaagctgttcttgatgtactggataggcaatatctgggaatggggcaggatgtcctatattttgaacaagagcttgccacttattttgccagagaggctgtatgcgtcaatactggcactgctgcccttcatcttgcccttcaggcacttggagtaggtcccggagatgaggtgcttgtacaatctttgacatacgttgcatcctttcaggcaatatctgccacaggggcacgccctgtgccctgtgacatagaccccgacacgataaccctaaatgttgacgatgctaaaaaacgaataacagaacatactcgtgttgtaatgcctgttcattatgccagtagtgtaggaccactggatgagatatatgaatttgcccaggataatgacctgcgagtagtggaagatgctgctcaagcttttggaacatactacaacgataagaaagttggcagcttcggagacattgcatgttttagttttgacggtatcaaaaatatcacatctggagaaggcggagctgttgttaccgatgataaagaagtattgcaaagggtaaaggatgcgcggcttcttggagtggaaaaagatactgagaaaagatacagtggagatagaagctgggattttgatgtgagtatgcaaggatggcgatatcacatgagcaatgtgatggctgctattggtattgaacaatttaaaaagttcccgatatttgcagaaaaaagaaaggaactattgaagcgttatcaaagcaaccttgcaaatataaattcgatcgaacttcttaaacaggatgcaaaccaaattgtaccccatatttttgtgatcaagctcaaaaactatgaccgtaatactctaaggaaaatgctcgaggatgttggaatccctacggggatccattacaaaccaaatcacaaactgagctattacgatactggagttgaacttccatgtacagatacagttgcaaaagaaatattaacactaccattgcaccccgaacttcagatttccgatgtagatcacatttgtgaaatgttgaaacaatgcttggggatataa

SEQ ID NO: 43360 - protein, 378 aa, Methanococcoides burtonii DSM 6242
MEGLEVMSDNTIRLSRSVIGEEEKKAVLDVLDRQYLGMGQDVLYFEQELATYFAREAVCVNTGTAALHLALQALGVGPGDEVLVQSLTYVASFQAISATGARPVPCDIDPDTITLNVDDAKKRITEHTRVVMPVHYASSVGPLDEIYEFAQDNDLRVVEDAAQAFGTYYNDKKVGSFGDIACFSFDGIKNITSGEGGAVVTDDKEVLQRVKDARLLGVEKDTEKRYSGDRSWDFDVSMQGWRYHMSNVMAAIGIEQFKKFPIFAEKRKELLKRYQSNLANINSIELLKQDANQIVPHIFVIKLKNYDRNTLRKMLEDVGIPTGIHYKPNHKLSYYDTGVELPCTDTVAKEILTLPLHPELQISDVDHICEMLKQCLGI

SEQ ID NO: 43361 - DNA, 1149 bp, Pseudomonas aeruginosa UCBPP-PA14
  CDS (1)..(1149)
atgtcactggactttctgccattctcccggccaagcatcggcgaggacgaaatcgccgccgtggagcaggtcctgcgttccggctggatcaccaccgggccgaagaaccaggagcttgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagcgccctcgccgaacgggtccgccgcctcaagttccacggcctcggggtcgatgcctacgaccgcctgagccatggacgcaagccgcaggcggaagtgatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggcctgcggcctgggccgcgacgccttcatggaagccctgaaggcgcgcggcatcggtagcggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggacatcctggagaaacgtcgatga

SEQ ID NO: 43362 - protein, 382 aa, Pseudomonas aeruginosa UCBPP-PA14
MSLDFLPFSRPSIGEDEIAAVEQVLRSGWITTGPKNQELEQRFAERLGCRHAVALSSATGALHVTLLALGIGPGDEVITPSLTWVSTANVITLLGATPVFVDVDRDTLMCSAQAVEAAIGPRTRAIVPVHYAGSTLDLEGLRTVAGRHGIALVEDAAHAVGSEYRGRPVGSRGTAIFSFHAIKNLTCAEGAMFVSDDSALAERVRRLKFHGLGVDAYDRLSHGRKPQAEVIEPGFKYNLADLNAALALVQLKRLDALNARRQALAERYLERLAGLPLAPLGLPAHKQRHAWHLFILRIDAEACGLGRDAFMEALKARGIGSGIHFIASHLHHYYRQRQPRLSLPNSEWNSARLCSIPLFPDMRDDDIERVARAIEDILEKRR

SEQ ID NO: 43363 - DNA, 1161 bp, Magnetospirillum magnetotacticum MS-1
  CDS (1)..(1161)
atgcataacgagatcatctgccgccttgaagccgtatggcgccggaccctacgggttgacggcccggtgcccttgcatgctccggtcttcgagggccacgaatgggagtacgtcaaggactgcctcgacactggctgggtgtcgtcggtgggggcctatgtcgatcgcttcgaggccatgctggccgacatcaccggggcgcaccatgcggtcgccacggtcaacgggagcgccgcgctggaggtctgcctgcatctggctggcgttggggcgggtgatgacgtcgtcttaccgtccctcaccttcatcgccacagccaatgcggtcagccatctcggcgcctcctgccggttcgtggatgtggatgaggcgaccctgggtctcgacccggcccggcttgacgatcatctcgcgcgccatggggaccggccgatcaaggcggtggtggtcatgcacacattcggccatgccgccgacctggatggtctgatgcaggtttgcgcccggcatggggttcccctgatcgaggatgccgcagaatccctgggcagttatagcggcggtcgccacacgggaacgagcggtctgctgtcggcgcttagtttcaacggcaataagatcgtcaccaccggcggcggcggagccgtcttgaccaacgatcccgacctggcgcgtcgggccaagcatctgaccaccacggccaagctttcccacccctatcgcttcgaccatgacgaggtgggctggaactatcgtcttcccaacctgaacgcggccctgggctgcgcgcaattggaagccctgcccgcctatctcggccgcaagcgtaggctggccagcctctaccaggaggcctttgccgatttgcccggcgtgaaggtggtggcggaccgcgccggatgcgccgggaatttctggctgaatgccttgatcctcgatcggccagaccgcgatcttgtggcgcaagtgatcgagggagccgccgctcggggtcttcagtgtcggcccatctggacgcccatgcaccgcctgcccatgtatcggtactgtccgcgcgacgatctggcggtgaccgaggcactggaagaccggctgatcaatattccatccagcccaagcccggttcttgacgccgtcatatccgccggggcgggattatga

SEQ ID NO: 43364 - protein, 386 aa, Magnetospirillum magnetotacticum MS-1
MHNEIICRLEAVWRRTLRVDGPVPLHAPVFEGHEWEYVKDCLDTGWVSSVGAYVDRFEAMLADITGAHHAVATVNGSAALEVCLHLAGVGAGDDVVLPSLTFIATANAVSHLGASCRFVDVDEATLGLDPARLDDHLARHGDRPIKAVVVMHTFGHAADLDGLMQVCARHGVPLIEDAAESLGSYSGGRHTGTSGLLSALSFNGNKIVTTGGGGAVLTNDPDLARRAKHLTTTAKLSHPYRFDHDEVGWNYRLPNLNAALGCAQLEALPAYLGRKRRLASLYQEAFADLPGVKVVADRAGCAGNFWLNALILDRPDRDLVAQVIEGAAARGLQCRPIWTPMHRLPMYRYCPRDDLAVTEALEDRLINIPSSPSPVLDAVISAGAGL

SEQ ID NO: 43365 - DNA, 1323 bp, Magnetospirillum magnetotacticum MS-1
  CDS (1)..(1323)
atgatgagcaccctggcccttctgggcggaacccctatccgcaccaagctgtttcccgcctattcggtcatcggcgacgatgaccgcgccgccgtggccaaggtgatggaaagcggtatcctgtcacgcttccttggcacctggcacaatgatttcttcggcgggcccgaggtcaaggccttcgaacacgaatgggccaccgccttttccgccgcccatgccatcagcgtcaactcggccaccagcggcctttacgccgcggcgggcgcggccggaatcgggcccggcgacgaggtcatcgtctcgccctacaccatgagcgcctcggcggtggccgccctggtgttcaatgccgttcccgtcttcgccgatatcgatcccgacagctattgcctgtcggccaagaccatcgcggccaagatcacgccgcgcaccaaggccatcatcgtggtccatatcttcggcaatgtggccgatatggaccccatcatggatctggccaagaaacatggcctgaccgtgatcgaggactgcgcccaggcgcccttcgccacctataagggccgtaatgtgggcactctgggccatatgggcgtgttcagcctcaattaccacaagcacatccataccggcgaaggcggcgtggtcaccaccaacgattcccggctggccgagaaggttcagctgatccgcaaccatgccgaggcggtggtggagaagaagggcgtgtccgatctggtcaacatgatcggcttcaatttccgcttaggggaaatcgaggccgccatcgggcgcagacaattgctcaaaggccccgatctggtgcggcgccgtcaagccaatgtccgctatctggaagaccgcatcaaaggcatcccctacctgtccatgccccgggtccaagacggtgtcgagcacgtctattacgtccacggcctgtcctatgacgcggaagcggcgggcgtgtcgcgcgccaccttcgtgcgtgcgctgaaggccgaacttgccgccaccgagcttcgggaaggcgaaggcgtactgatgggcgagggctatgtccgcccgctttatctccagcccctgtaccagaagcgagtcggctatggcgaggtgggctgccccttcaaatgcccccattacaccggaacccccgactacgccccggggtcgtgccccaataccgaggacgcccatttcaaccgggtgatcacccacgaactgatccgccccccggcctgtcgctccgatctggacgacgtggccaatgccttcgccaaggtggcggaaaacatggcggcgctgcgcgatctggagcgcaagtga

SEQ ID NO: 43366 - protein, 440 aa, Magnetospirillum magnetotacticum MS-1
MMSTLALLGGTPIRTKLFPAYSVIGDDDRAAVAKVMESGILSRFLGTWHNDFFGGPEVKAFEHEWATAFSAAHAISVNSATSGLYAAAGAAGIGPGDEVIVSPYTMSASAVAALVFNAVPVFADIDPDSYCLSAKTIAAKITPRTKAIIVVHIFGNVADMDPIMDLAKKHGLTVIEDCAQAPFATYKGRNVGTLGHMGVFSLNYHKHIHTGEGGVVTTNDSRLAEKVQLIRNHAEAVVEKKGVSDLVNMIGFNFRLGEIEAAIGRRQLLKGPDLVRRRQANVRYLEDRIKGIPYLSMPRVQDGVEHVYYVHGLSYDAEAAGVSRATFVRALKAELAATELREGEGVLMGEGYVRPLYLQPLYQKRVGYGEVGCPFKCPHYTGTPDYAPGSCPNTEDAHFNRVITHELIRPPACRSDLDDVANAFAKVAENMAALRDLERK

SEQ ID NO: 43367 - DNA, 1158 bp, Burkholderia cepacia R18194
  CDS (1)..(1158)
atgttcggcccacccaatctcgactgcattccattcggccgcccgttcgtggtcggcaaggagctctactacatcgcgaaagcggtcgagcagggcggcctcgccggcgaccaggcgttcacgaagctctgccaccgctggctggaagcgcgcatcggctgccagcgcgcgctgctcacgcactcgtgcacggccgcgctcgagatggccgcgatcctcgccgacgtgcagcccggcgacgaagtgatcatgccgtcctacacgttcgtgtcgaccgccaacgcgttcgtgctgcgcggcgcgacgccggtgttcgtcgacatccgccgcgacacgctgaaccttgacgagacgcagatcgccgccgcgatcacccagcgcacgcgcgcgatcgtgccggtgcactacgcgggcgtcgcatgcgacatggacgtgatcgggcagctcgcggcggaccacgacctgtgggtgatcgaggacgccgcccaggcgctgcagtcgacgtggaacggcaagccgctcggcagcctcggccacctcgcgtgcctcagcttccacgagaccaagaacgtgatctcgggcgaaggcggcgcgctgctggtcaacgacccgcgcctcgtcgagcgcgcggagatcatccgcgagaagggcaccaaccgcagtcagttcttccgcgggcaggtggacaagtacacatgggtcgacgtcggctcgtcgttcctgccgggcgagctgatcgcggcattcctgtacgcgcagttcgagcacgcggacgtgatcaccgcgcagcggcgcgcgaccgtgcagcgctaccaggacgcgctgcagccgctgcacgcggacgggctgatcgagctgcccgcgatttcgctcgccgagcgcggcaacggccacatgttctatttcctcgcacgcgacctcgccgaacgcaccgatctgctgcagcagatccgcgcggtgggcgtgaacgcggtgttccattacgtgccgctgcacagttcgccggccggccagcgctacgggcgctgcgggtccggcatggcggtgacggacctcgtcgccgaccggctcgtccggctgccgctgtaccacgacatgaccgaagccgaacaggatcgcatcctcgaagtggtcttcgatttctaccgcacccgataa

SEQ ID NO: 43368 - protein, 385 aa, Burkholderia cepacia R18194
MFGPPNLDCIPFGRPFVVGKELYYIAKAVEQGGLAGDQAFTKLCHRWLEARIGCQRALLTHSCTAALEMAAILADVQPGDEVIMPSYTFVSTANAFVLRGATPVFVDIRRDTLNLDETQIAAAITQRTRAIVPVHYAGVACDMDVIGQLAADHDLWVIEDAAQALQSTWNGKPLGSLGHLACLSFHETKNVISGEGGALLVNDPRLVERAEIIREKGTNRSQFFRGQVDKYTWVDVGSSFLPGELIAAFLYAQFEHADVITAQRRATVQRYQDALQPLHADGLIELPAISLAERGNGHMFYFLARDLAERTDLLQQIRAVGVNAVFHYVPLHSSPAGQRYGRCGSGMAVTDLVADRLVRLPLYHDMTEAEQDRILEVVFDFYRTR

SEQ ID NO: 43369 - DNA, 1152 bp, Burkholderia cepacia R18194
  CDS (1)..(1152)
atgagccagactaccgctccgtttctgccgttcacccgccccgagatcgatgaggaaaccatccagggcgtcgtcgaagtgctgcgctcgggctggatcaccaccggcccgcagagccagaaattcgaagcggcgctgtccgagtactgcggcggccgtccggtccgcgcgttcaactcgggcacctgcacgctcgagatcggcctgcgcatcgcgggcgtcggtgccggcgacgaggtgatcacaacgccggcgtcgtgggtctcgaccagcaacgtgatcatcgagaccggcgcgacgcccgtgttcgccgacatcgatcctgtcacgcgcaacatcgacctcgacaagctcgagcaggcgatcacgccgcgcacgaaggcgatcatccccgtgttcctgtccggcctgccggtcgacatggaccgtctgtacgcgatcgcacgcgcgcacaagctgcgcgtgatcgaggatgcggcgcaggcattcggctcgacgtggaacggcaagcgcatcggcgcgatcggcgacatcgtgtcgttcagcttccacgcgaacaagaacctgacgacgatcgaaggcggcgcactcgtgctgaacaacgaggaagaagcgacgctcgcgcagaagtaccggctgcagggcatcacgcgcacgggcttcgacgggatggactgcgacgtgctcggcggcaagtacaacctgaccgacgtcgccgcacgtgtcggcctcggccagctgccgcacatcgaccgcttcaccgcgcagcgccgcgcgctcgcacgggcgtatttcgccgcgttcgacggcagcgcggccgtgaagctcggcgtcggcctgccggttgccgacttcgagaacagcaactggcacatgttcctgatcacgctgccgctcgagcggctgacgatcacgcgcgccgaattcatggcgcaactgaaggaacgcggcatcggcacgggcatccactacccggcgatccatcttttcacgctgtaccgtgcgcgcggcttcaaggagggcatgttcccccacgccgaacggtacggcgcgtcgaccgtcacgctgccgctcttcacgcagatgacggaaggcgacgtgcgtcgcgtagtcgacgccatcaaccagatttgcgaacaatacggaaaataa

SEQ ID NO: 43370 - protein, 383 aa, Burkholderia cepacia R18194
MSQTTAPFLPFTRPEIDEETIQGVVEVLRSGWITTGPQSQKFEAALSEYCGGRPVRAFNSGTCTLEIGLRIAGVGAGDEVITTPASWVSTSNVIIETGATPVFADIDPVTRNIDLDKLEQAITPRTKAIIPVFLSGLPVDMDRLYAIARAHKLRVIEDAAQAFGSTWNGKRIGAIGDIVSFSFHANKNLTTIEGGALVLNNEEEATLAQKYRLQGITRTGFDGMDCDVLGGKYNLTDVAARVGLGQLPHIDRFTAQRRALARAYFAAFDGSAAVKLGVGLPVADFENSNWHMFLITLPLERLTITRAEFMAQLKERGIGTGIHYPAIHLFTLYRARGFKEGMFPHAERYGASTVTLPLFTQMTEGDVRRVVDAINQICEQYGK

SEQ ID NO: 43371 - DNA, 1152 bp, Burkholderia cepacia R1808
  CDS (1)..(1152)
atgagccagactaccgctccgttcctgccgttcacccgccccgaaatcgacgaggaaaccattcagggcgtcgtcgaagtgctgcgctcgggctggatcaccaccggcccgcagaaccagaagttcgaggccgcgctgtccgagtactgcggcggccgtccggtgcgcgcgttcaactccggcacctgcacgctcgagatcggcctgcgcatcgcgggcgtcggccctggcgacgaggtgatcaccacgcccgccacgtgggtgtcgaccagcaacgtgattatcgaaaccggcgcgacgcccgtgttcgccgacatcgatccggtcacgcgcaacatcgacctcgacaagctcgaacaggcgatcacgccgcgcacgaaggcgatcatcccggtctacctgtccggcctgccggtcgacatggaccgcctgtacgcgatcgcccgcgcgcacgacctgcgcgtgatcgaagacgccgcgcaggcgctcggctcgacgtggaaaggccagcgcatcggcgcgatcggcgacatcgtgtcgttcagcttccacgcgaacaagaacctgacgacgatcgaaggcggcgcactcgtgctgaacgatgaggacgaggcggcgctcgcgcagaagtaccggctgcagggcatcacgcgcaccggcttcgacggcatggactgcgacgtgctcggcggcaagtacaacctgaccgacgtcgccgcgcgcgtcggcctcggccagctgccgcacctcgagcgcttcaccgcgcagcgccgggcgctcgcgcgcgcgtatttcgccgcgctcgacggcggtgcggccgtgaagctcgggctcggcctgccggtcgccgacttcgagaacagcaactggcacatgttccaggtcacgctgccgctcgagcggctgtcgctctcgcgcgccgatttcatggcgcagatgaaggagcgcggcatcggcaccggcgtccactatccggccatccatcttttcacgctgtatcgtgcgcgcggcttcaaggagggcatgttcccccacgccgaacggtacggcgcctcgaccgtcacgctgccgctgttcacgcagatgacggaagacgacgtgcgtcgcgtggccgacgccatcaatcagatttgcgaacaatacggaaagtaa

SEQ ID NO: 43372 - protein, 383 aa, Burkholderia cepacia R1808
MSQTTAPFLPFTRPEIDEETIQGVVEVLRSGWITTGPQNQKFEAALSEYCGGRPVRAFNSGTCTLEIGLRIAGVGPGDEVITTPATWVSTSNVIIETGATPVFADIDPVTRNIDLDKLEQAITPRTKAIIPVYLSGLPVDMDRLYAIARAHDLRVIEDAAQALGSTWKGQRIGAIGDIVSFSFHANKNLTTIEGGALVLNDEDEAALAQKYRLQGITRTGFDGMDCDVLGGKYNLTDVAARVGLGQLPHLERFTAQRRALARAYFAALDGGAAVKLGLGLPVADFENSNWHMFQVTLPLERLSLSRADFMAQMKERGIGTGVHYPAIHLFTLYRARGFKEGMFPHAERYGASTVTLPLFTQMTEDDVRRVADAINQICEQYGK

SEQ ID NO: 43373 - DNA, 1107 bp, Rubrivivax gelatinosus PM1
  CDS (1)..(1107)
atgaaccagcaccggattcctgtctaccgcccagatctcagcgggaacgtcaaagcctatgtcaacgagtgcatcgactcgtcgtggatctcctcgcgcggccgcttcgtcggagagttcgagtccgcgttcgcggcgtacatcggggtcgagcacgccgcctccgtctgcaacggcacggtcgccctgcatctggcgctgctggcgctgggcatcggaccgggcgacgaggtcatcgttcccacgctcacctacatcgcgcccgtcaatgccatctcgtacaccggcgccacgcccgtcttcgtggattcgctgcgcagcagctggcagatggacccggaggacgtgcggcgccacatcacgccgcgcacacgcgcgatcctcgcggtccatctctacggtcagacctgcgacatggccgcgctggccgcgatcgcgcgcgagcaccgcctgttcctcgtggaagactgcgcggaggccttcggatcgacgtacgcgggccggcatgccgggaccttcggcgacatcgccacgttcagcttcttcggaaacaagaccatcacgaccggcgaaggcggcatggtcgtcaccaatgacaagaccctgaacgaacgcgcgcgccacttcaagggccagggtctggccgcgcaccgcgagtactggcacgacgtggtcggctacaactaccgcatgacgaacatcgccgcggccatcggcctcgcgcaactcgagcgggccgacgagatcatcgcgcgcaagcgggatctggcccagcagtacgcgcgtcgcctcgccggcctgccgatcgagctccacgccgaggcgcccgacacgcagcacagctactggatggtgtcgatcctgaccgagcgcgccgaagcgcgtgagccgctgcgtgcggctctggccgaagcgggcatcgagacccgccccctgttctatccagtgcacacgatgccgatgtatgcccgcagctaccgcaagcacccggtggcggaggacctggcatggcgcggcatcaacctgccgagctggcccggcctgagcggcgaacagatcgaccacatcgcccactcgatcgcaagcttctgctccaggtcggcatga

SEQ ID NO: 43374 - protein, 368 aa, Rubrivivax gelatinosus PM1
MNQHRIPVYRPDLSGNVKAYVNECIDSSWISSRGRFVGEFESAFAAYIGVEHAASVCNGTVALHLALLALGIGPGDEVIVPTLTYIAPVNAISYTGATPVFVDSLRSSWQMDPEDVRRHITPRTRAILAVHLYGQTCDMAALAAIAREHRLFLVEDCAEAFGSTYAGRHAGTFGDIATFSFFGNKTITTGEGGMVVTNDKTLNERARHFKGQGLAAHREYWHDVVGYNYRMTNIAAAIGLAQLERADEIIARKRDLAQQYARRLAGLPIELHAEAPDTQHSYWMVSILTERAEAREPLRAALAEAGIETRPLFYPVHTMPMYARSYRKHPVAEDLAWRGINLPSWPGLSGEQIDHIAHSIASFCSRSA

SEQ ID NO: 43375 - DNA, 1167 bp, Rubrivivax gelatinosus PM1
  CDS (1)..(1167)
atgaccgcgccgcccttcctgcccttcgcgctgcccgagatcggcgaggaggagatcgccgaggtcgtcgacacgctgcgctcgggctgggtcaccaccgggccgaaggcgcggcgcttcgagcaggacttcgcggccttcctcggcgatccgacgctgcaggccatcgccgtcaactccgccaccgccggcctgcacctcgcgctcgaggcgctgggcatcggcccgggcgacgaggtcatcaccaccacccacaccttcaccgccacggccgaggtggtgcgctacctcggcgccgacgtggtgctggtcgacatcgacccggccacgctgaacatcgacccggcccgggtcgaggccgcgatcacgccgcgcacccgcgccatcatccccgtccactacgccggcctcgcggcgaacgtggacgcgatcctcaccctggcgcgctgccacggcctgaaggtggtggaggacgcggcgcacgcgctgcccaccacctgcggcggcgcgctggtcggcacgctgggcagcgacgccacggtgttcagcttctacgccaacaagaccatcaccaccggcgagggcggcatggtggtcacgcgcgacccggagctcgcgaagcgcgtgaaggtgatgcgcctgcacggcatcagccgcgatgccttcgaccgcttcaccgccaagacgccgagctggcactacgagatcgtcgcgccgggctacaagtacaacctcaccgacatcgccgcggcgctgggcatccaccagctccagcgcgcacgcggcttccagcagcgccgggcggcgatcgcgcagcgctaccgcgccgccttcgccgacctgccggtgcagctgccgcccgagcctgcggccggcgagctgcacgcctggcacctctacgtgctgcggctggccgacgcggcaccgctggcgcgcgacgccttcatcgagcggctgttcgcgctgggcatcggcgtcagcgtgcactacatcccgctgcacctgcacccctactggcgcgagcgctacggcctggatgcggcgcagttcccccacagccagcacgcctacgaacgcatgctgagcctgccgctgtacacgaagatgagcgaggcggacatcgagcgcgtgatcgcggccgtgcggcagcagctgctgcagggctga

SEQ ID NO: 43376 - protein, 388 aa, Rubrivivax gelatinosus PM1
MTAPPFLPFALPEIGEEEIAEVVDTLRSGWVTTGPKARRFEQDFAAFLGDPTLQAIAVNSATAGLHLALEALGIGPGDEVITTTHTFTATAEVVRYLGADVVLVDIDPATLNIDPARVEAAITPRTRAIIPVHYAGLAANVDAILTLARCHGLKVVEDAAHALPTTCGGALVGTLGSDATVFSFYANKTITTGEGGMVVTRDPELAKRVKVMRLHGISRDAFDRFTAKTPSWHYEIVAPGYKYNLTDIAAALGIHQLQRARGFQQRRAAIAQRYRAAFADLPVQLPPEPAAGELHAWHLYVLRLADAAPLARDAFIERLFALGIGVSVHYIPLHLHPYWRERYGLDAAQFPHSQHAYERMLSLPLYTKMSEADIERVIAAVRQQLLQG

SEQ ID NO: 43377 - DNA, 1158 bp, Pseudomonas fluorescens PfO-1
  CDS (1)..(1158)
atgattccctacggccggcaaagcctcgaccagacggacatcgacgcggtggtcgaggtgttgcagtccgactggttgacccagggtccgaccatcgaacgcttcgagcaggcgatggccgagcgttgtcaggccgatttcgccgtggcagtgtgcaacgccacggcggcgctgcacattgcctgtctcgcggcggggctgggaacgggcgaccgcttgtggaccacgccgaacacctttctcgcgtcggccaactgcggccgttattgcggtgccgacgttgatttcgtggacatcgatccgctgacctggaacctcgatgccgaagttctggcaagcaaactcgatgctgccgaacgcgatggtacgctgcccaaagtgctggtggcagtggcgttctccgggcagagctgcgacatgcggcggattgccgaactggccgagcgctataacttcacggtcatcgaagacgcctcccacgcggtcggcgccagttacgccgggcgcccggtgggttgcggtgaatttgccgcgatgaccgtgttcagctttcatccggtgaagatcatcaccagcgctgaaggcggcatggtgctgaccaatcgcccggaactggccgagcgcctgcaacgcctgcgcagccacggcatgacccgcgatccgcagcagatgaccgaacccagccacggcccgtggtactaccagcaggtcgaactgggtttcaattaccggatcaccgatctgcaagccgcgctgggcctgtcacagttgggcaaactggacgagttcatcgcccgtcgccgggagctggccgcgcgttacgaccgcttgctggcgtacttgccggtgactgtgccgagcctccagccggacgccgaatcggcctggcatctttatgtggtgcgtttgcagaccgaacgcatcagcctcagccaccgtcaggtgttcgaaggcttgcgcgccgccggcgtcggcgtgaacctgcactacattccggtgcatttgcagccgtactatcgtgacctgggtttctccgagggtgacttccccgaagcggagcgttattacgccgaagcgatcagcctgccgctgtttccgttgctgagcgatcagcagcaggattatgtggttgagcaattgcgtcggttgactgaatga

SEQ ID NO: 43378 - protein, 385 aa, Pseudomonas fluorescens PfO-1
MIPYGRQSLDQTDIDAVVEVLQSDWLTQGPTIERFEQAMAERCQADFAVAVCNATAALHIACLAAGLGTGDRLWTTPNTFLASANCGRYCGADVDFVDIDPLTWNLDAEVLASKLDAAERDGTLPKVLVAVAFSGQSCDMRRIAELAERYNFTVIEDASHAVGASYAGRPVGCGEFAAMTVFSFHPVKIITSAEGGMVLTNRPELAERLQRLRSHGMTRDPQQMTEPSHGPWYYQQVELGFNYRITDLQAALGLSQLGKLDEFIARRRELAARYDRLLAYLPVTVPSLQPDAESAWHLYVVRLQTERISLSHRQVFEGLRAAGVGVNLHYIPVHLQPYYRDLGFSEGDFPEAERYYAEAISLPLFPLLSDQQQDYVVEQLRRLTE

SEQ ID NO: 43379 - DNA, 1122 bp, Pseudomonas fluorescens PfO-1
  CDS (1)..(1122)
atgagcagaattcactacaccaaacccagcgtcggcgaactcgaagcgcaatatgccctggatgccgtgcagaacggctggggcgcgcgctgctacgaatacctgacccgcttcgagcacggttttgccgagcacctgggcgcgacctacgccatcgccacctccagttgcaccggagccctgcacatgggcatggcggcgctgggcatcggcgaaggcgatgaagtgatcctgggcaacaccaactggatcgcctcggcggcgccaatcacttatctgggcgccacgccggtgttcgtcgatgtgctggccgacagctggtgcctcgacccgcagcaggtcagaaacgcgatcagcccgcgcaccaaggccattctggcggtgcacctgtacggcaatctgtgtgacatggatgccttgctggccatcggcaaggaattcgggattcccgtgatcgaagatgcggccgaagccatcggttcgcagtggcgcggtcaggcggctggttcgatgggagccttcggtgctttctcgttccacggcaccaagaccatgaccaccggcgagggcggaatgttcgtcacctcggacaaggccttgtacgagcgcgtgctgaccctgtccaaccacggtcgcgtggcgggctgcaccaagcagttctggccagagttcgtcggtttcaaatacaagatgagcaacctgcaggcggccgtcggttgcgcgcaggtcgagcggatcgaagagttgatcgcgcgcaagcgggcgatcttttccaactatgcgcaggcgctggaaggcgtaccgggcgtgtcgctcaatcccgagccggctcacgggcgcaacggttactggatgccgaccgtggtgttcgatgccgacaccggtatccatcgcgaccagttgatcgcggctttccaggcggctgacatcgatgcccgggtgttcttctggccgctgtcgacgttgccgatgttcagcgggcacaacgttgacaccccggtgtcattcgccctgccggagcgcgccttcaatctgccgagctatcacgacatgaccgacgccgatcagcagcgcgtcgtgcaagtggtgctggacatgttggcaggcaggcccgcgctgtga

SEQ ID NO: 43380 - protein, 373 aa, Pseudomonas fluorescens PfO-1
MSRIHYTKPSVGELEAQYALDAVQNGWGARCYEYLTRFEHGFAEHLGATYAIATSSCTGALHMGMAALGIGEGDEVILGNTNWIASAAPITYLGATPVFVDVLADSWCLDPQQVRNAISPRTKAILAVHLYGNLCDMDALLAIGKEFGIPVIEDAAEAIGSQWRGQAAGSMGAFGAFSFHGTKTMTTGEGGMFVTSDKALYERVLTLSNHGRVAGCTKQFWPEFVGFKYKMSNLQAAVGCAQVERIEELIARKRAIFSNYAQALEGVPGVSLNPEPAHGRNGYWMPTVVFDADTGIHRDQLIAAFQAADIDARVFFWPLSTLPMFSGHNVDTPVSFALPERAFNLPSYHDMTDADQQRVVQVVLDMLAGRPAL

SEQ ID NO: 43381 - DNA, 963 bp, Pseudomonas fluorescens PfO-1
  CDS (1)..(963)
ttgaagctcaaggaaaagctcgacgtcgatcatctgctgtttctgagtaacggtaccattgccctgcaaattgcaattcgagccttggaactgaaaggtgaaatcatcaccacgcctttcagctatgtagccacgacgtccagcatcgtctgggaaaattgcacgccgatcatggtggatatctgccaggacacgctgaatatcgatccggcgaaaatcgaacaagcgatcactccgcgaaccacggccattctggctacccatgtgttcggcaatccctgcgatgtcgaagcgatcgatgcggtggccaaaaagcatggcttgaaagtcatctatgatgccgctcacgcctttggtacgacccataaagggcgttccctgctggcgtacggcgatattgcaacttgcagttttcatgcaaccaagctttttcacaccatcgaaggtggcgcggtcgttacttccgatcctgaaatcctgaaaagcatggccatgaagagaaacttcggccatacctcgttgactgatttcggtggcgtcggcgtcaatggcaagaactcggaagttcacgctgcaatgggactgacgaatctgaagtacgtcgaagagatcctggagaagcgcaaggaactctgcgactactacaaagagaacctgactgacctgcctgtcgagttccagaagattgcagcggatacgcaatacaatcactcctacttcccggtgatcttcgaaagtgagaaagtgcttctggctgtcatggaagtgctcaacctccacaatatttatcctcggcgctatttttacccgtcgctttccgagcttccgtacgtcgaggggcaaagttctccgatctcggaggatgtttcccgccgcatcatttgcctgccgctctaccacaccctgtcgcgggaagagatcgacatgatctgccgactcatcaagcgctctgtcaggtattga

SEQ ID NO: 43382 - protein, 320 aa, Pseudomonas fluorescens PfO-1
MKLKEKLDVDHLLFLSNGTIALQIAIRALELKGEIITTPFSYVATTSSIVWENCTPIMVDICQDTLNIDPAKIEQAITPRTTAILATHVFGNPCDVEAIDAVAKKHGLKVIYDAAHAFGTTHKGRSLLAYGDIATCSFHATKLFHTIEGGAVVTSDPEILKSMAMKRNFGHTSLTDFGGVGVNGKNSEVHAAMGLTNLKYVEEILEKRKELCDYYKENLTDLPVEFQKIAADTQYNHSYFPVIFESEKVLLAVMEVLNLHNIYPRRYFYPSLSELPYVEGQSSPISEDVSRRIICLPLYHTLSREEIDMICRLIKRSVRY

SEQ ID NO: 43383 - DNA, 1149 bp, Pseudomonas fluorescens PfO-1
  CDS (1)..(1149)
atgagtcaggcgtttctccccttctcccgccccagtatcggtgatgaagaaattgccgccgtggagcaagtcctgcgctccggctggatcaccaccgggccgaaaaaccaggccctcgaagaacaatttgcccagtacgtcggcagtcgtcatgccgtggcactttcctcggccaccggtgccatgcatgtaacgttactggcgttgggaatcggccccggcgatgaagtcatcaccccgtcgcagacctgggtgtcgaccgccaacatgatctcgctgctcggcgccacgccggtgttcgtcgatgtcgaccgcgacaccctgatgaccgacgccgcgcgcatcgaagccgccatcaccccgcgcaccaaagcaatcattccggtgcattacgctggcgccgcgtttgatctcgacccgctctacgcgctggccgacaagcatggtatcgccgtgatcgaagacgccgcccacgccgccggcacccgctacaagggtcgtcacgtcggctcgcaaggcaccgcaatcttttctttccacgcgatcaagaacatgacctgcgccgaaggcgcgatgttcgtcaccgacgacgaagccctggccaaccgcgtgcgcatgctcaagttccatggcctgggtgtcgatgcctacgaccgcctgacccacggccgcaaaccccaggcccaggtgatcgagcccggtttcaaatacaacctggccgacatcaacgccgcgattgcgctggtgcaactggagcgtctggacgcaatcaacgcccgccgcaccgagctggccacgcaatacctgcaaaaactcgaaggcctgcccgtgcaaccgctggccgtgccgaactacccgcaacagcacgcctggcacctgttcatcctgcgcatcgacagcgaacgctgcggcatggaccgcgaagccttcatgaagggcttgcaggagcaaggcatcggcaccggcatccacttcatcgccacccacctgcacacctggtatcgccagcgtgccccgcacctgtccctgcccgacaccgagtggaactcggcgcggctgtgctcgattcccttgtttcccgacatgaccgaccaggatctggaccgggtcgtcggggccattgaacacctgatggggaaacgcccgtga

SEQ ID NO: 43384 - protein, 382 aa, Pseudomonas fluorescens PfO-1
MSQAFLPFSRPSIGDEEIAAVEQVLRSGWITTGPKNQALEEQFAQYVGSRHAVALSSATGAMHVTLLALGIGPGDEVITPSQTWVSTANMISLLGATPVFVDVDRDTLMTDAARIEAAITPRTKAIIPVHYAGAAFDLDPLYALADKHGIAVIEDAAHAAGTRYKGRHVGSQGTAIFSFHAIKNMTCAEGAMFVTDDEALANRVRMLKFHGLGVDAYDRLTHGRKPQAQVIEPGFKYNLADINAAIALVQLERLDAINARRTELATQYLQKLEGLPVQPLAVPNYPQQHAWHLFILRIDSERCGMDREAFMKGLQEQGIGTGIHFIATHLHTWYRQRAPHLSLPDTEWNSARLCSIPLFPDMTDQDLDRVVGAIEHLMGKRP

SEQ ID NO: 43385 - DNA, 1131 bp, Rhodospirillum rubrum
  CDS (1)..(1131)
atgattcctcagacttttccgaaagcctctcttcttgaggaccgggccgagatcgaccttgggctggcccgggttctcgagtccggctggtacatcctggggccggaggtcgaagccttcgaggccgagttcgcccgctattgtggcgtagcccatggggtgggggtcgccaatggcacggatgcgatcgaactggccctgcgcgccctgggggttggtccgggggatgtggtggcgacgccctcgcatacggcggtggcgacggtcgccgcggtgatcgccgccggcgcccggccgctgtggatcgatatcgatccggccagctatcttcttgatctcgaccacctcgaggcgcaagtggcggcctttcgccagggccccgggggggaccggctgaaggcggtggtggcggttcatctctatgggtcgatggtctcgcccgcagggttgcttgcggtctgtcgccgccatggcctgctgctggtcgaggattgcgcccaggcccatggcgccctctggaacggccaaagggcgggaagcttcggcgatgccagcgctttcagcttttatccgacgaagaatctgggagccctgggcgatggcgggatggtcgtaaccgccgatgcggccgtggccgagcgcgccgcttttctgcgccaatatggctggaaagagcgctatgtcagctttgaagtgggcattaactcgcgtctcgaccccatgcaggcggcgattttgcgggttttcctgaagcgtttggatgaaaggaatgaaaagcgccgcgccttggccgatctttattcccgtaatctggccgatgtttccgaggttgttttgcccgtcagccccgccccggggacggccgtctatcatcagtatgtgatccgcgtcgccgatcgccacgccctggccgattttctaaaggcccacggcgtcggcacggcggttcattatcccgttcccgtccaccgccaacccgcctatctggatttcgcccgcgacgccgatcttccccatacggacgccgtcgccggccatatcctgagcttgccgatgtatccccacctgccgcccgacgacgcggcgcgggtgacggatctggtgaaagccttcttttcgcgctctccttag

SEQ ID NO: 43386 - protein, 376 aa, Rhodospirillum rubrum
MIPQTFPKASLLEDRAEIDLGLARVLESGWYILGPEVEAFEAEFARYCGVAHGVGVANGTDAIELALRALGVGPGDVVATPSHTAVATVAAVIAAGARPLWIDIDPASYLLDLDHLEAQVAAFRQGPGGDRLKAVVAVHLYGSMVSPAGLLAVCRRHGLLLVEDCAQAHGALWNGQRAGSFGDASAFSFYPTKNLGALGDGGMVVTADAAVAERAAFLRQYGWKERYVSFEVGINSRLDPMQAAILRVFLKRLDERNEKRRALADLYSRNLADVSEVVLPVSPAPGTAVYHQYVIRVADRHALADFLKAHGVGTAVHYPVPVHRQPAYLDFARDADLPHTDAVAGHILSLPMYPHLPPDDAARVTDLVKAFFSRSP

SEQ ID NO: 43387 - DNA, 1191 bp, Rhodospirillum rubrum
  CDS (1)..(1191)
atgggcataagcgagttcaagcccctgtcgccacccgccgtggtcgacgccccgatcgcttttggccggccgtccttgggcgccgccgagatcgaggccgtcgccaaggtcctcgcctcggggtggatcggcatgggcgagcagaccctggcctttgagcgcgacctgggcgcgcgcatcggctgtccgcatacggtcttgctcaattcctgcacttcggccttgttcctttccctgcatatgcacgccataggcgcgggcgacgaggtcgtgcttcccagtctgaactggttttccgcagccaatgccagcttgtggctgggcgcccgcccggccttttgcgatgtcgatgaagaaaccttatgcgtcaccccggaaaccgtcgcggcggcgctgacgccgcgcacccgcgccgtggtcgtcgtccacatgggcggccatcccgtcgatatcgaggggatcgcggcgatcctgccgcccggcgtcctgctgatcgaggacgccgcccatgccatgggcggggcctatctggatggccggccggtcggatcggcgggcaatcccacctgctacagcttttacgccaataagaatctctcgaccggcgagggcgggctgctggcggcgccgacggccgagatggccgacagggcccggcggttgcggctgcatggcctgggggccgatagctggaaacgctatatcgatccgcgcgccagcatcgggctgaccccttcggaggtcggcttcaagatgaactacaccgatctgcaggccgccatcggccgggttcagttgtcgcggctggacgccatgcaggcccgccgccgcgagatctgcgcgcgctatcgccaaaggctgggcggggccgggctcgctctgggcttccaggcgatgatcgaggatccgcgccatgcccgccaccttctggtggtgcgtttgccggtgggggaaggccacgcccggcgcgacgatgttttccttggcctcaaaaagcagggaatcggcgtcgccatccattacacgcccttgcaccatatggccgtctatcgggattacgcggcgcggccgctgccggtgaccgatcgcctgagcgacagcatcctcagccttcccttgagcgcctgcctgagcgatgaggatgtcgagcgggtctgcgagcggctgatcgacgcggtggcgccgtcatga

SEQ ID NO: 43388 - protein, 396 aa, Rhodospirillum rubrum
MGISEFKPLSPPAVVDAPIAFGRPSLGAAEIEAVAKVLASGWIGMGEQTLAFERDLGARIGCPHTVLLNSCTSALFLSLHMHAIGAGDEVVLPSLNWFSAANASLWLGARPAFCDVDEETLCVTPETVAAALTPRTRAVVVVHMGGHPVDIEGIAAILPPGVLLIEDAAHAMGGAYLDGRPVGSAGNPTCYSFYANKNLSTGEGGLLAAPTAEMADRARRLRLHGLGADSWKRYIDPRASIGLTPSEVGFKMNYTDLQAAIGRVQLSRLDAMQARRREICARYRQRLGGAGLALGFQAMIEDPRHARHLLVVRLPVGEGHARRDDVFLGLKKQGIGVAIHYTPLHHMAVYRDYAARPLPVTDRLSDSILSLPLSACLSDEDVERVCERLIDAVAPS

SEQ ID NO: 43389 - DNA, 1176 bp, Ralstonia metallidurans CH34
  CDS (1)..(1176)
atgactgcttccgctccgcaggatttcctgccgttcgtccgcccaaatattgacgatgccaccatagccgaagtcggcaaggtgctggcatccggctggatcacgtccggacccaaggtgcaggcgttcgaggccacgctgtccgatctgttcggcggccgccccgtgcgcacgttctccaacggctcggcaacgatggaaatcgcgctgcgcatcgccgacatcggccccggcgacgaagtcatcaccacgccaatcacctgggtcgccacggcaaacgtggtcctgacggttggcgcccgtccggtcttcgtcgatatcgatccgcgcacgcgcaatatcgacctggatgccgtagaagccgccatcacgccgcgcacgcgagccatcatcccggtctacctgtccggtctgccggtcgacatggaccgcctctacgccatcgcgaagcgccataacctgcgtgtgatcgaagatgccgcgcaggctatcgactcgcgctggcgcggccagcgcatcggcgcatttggcgatctggtcagcttcagcttccaggccaacaagaacatcaccacgatcgagggcggctgcctcgtcatgaactcgcccgaggaagcgcagcgcgcggagcgcctgcggctgcaaggcgtgatccgcaccggcatggacggcatggacgtcgaggagccgggcggcaagttcaacctgaccgacgtcaacgctgccattgggctggcccagctccagcatctggacgcgatcaccgcacgccgcgccgaactggccgagacctatttccgctgcgccgccaacgccggactggccgatctcggtatcgaactgccgctgccgcgcgacccggacgtggctaccaccaactggcacatgttccaggtggtgctgccgaccgaccgcctgcgtggcggcgccgcggaagcgcgcaagcacgtcatggagtcgatgcgcgagtcaggcatcggcactggcgtgcattacccaccggttcacctgtttacttacttccgctccctgggctggcgcgaaggcatgctgccgcatgccgagcgcattggccgcggcatcgtcacgctgccgatgttccccgccatgcagacagccgacgtggagcgggtttgcgcaactctaagcgaaacatgcaaacgcctctctctctaa

SEQ ID NO: 43390 - protein, 391 aa, Ralstonia metallidurans CH34
MTASAPQDFLPFVRPNIDDATIAEVGKVLASGWITSGPKVQAFEATLSDLFGGRPVRTFSNGSATMEIALRIADIGPGDEVITTPITWVATANVVLTVGARPVFVDIDPRTRNIDLDAVEAAITPRTRAIIPVYLSGLPVDMDRLYAIAKRHNLRVIEDAAQAIDSRWRGQRIGAFGDLVSFSFQANKNITTIEGGCLVMNSPEEAQRAERLRLQGVIRTGMDGMDVEEPGGKFNLTDVNAAIGLAQLQHLDAITARRAELAETYFRCAANAGLADLGIELPLPRDPDVATTNWHMFQVVLPTDRLRGGAAEARKHVMESMRESGIGTGVHYPPVHLFTYFRSLGWREGMLPHAERIGRGIVTLPMFPAMQTADVERVCATLSETCKRLSL

SEQ ID NO: 43391 - DNA, 1146 bp, Ralstonia metallidurans CH34
  CDS (1)..(1146)
atgacagccagccttccgtcggaatccgtgcgcgccctgctcgaggaccgcatctacgtcacccagccacacctgcctccgctcgacgagttcctgccctatctgcagcagatctggaactcgcgcgtgttgaccaatggcgggccgtttcaccagcagttcgagcgtgaactgtgcgagtaccttggcgtcccttacctgtcgctgttcgccaatggcacgctcgcgctcgtgacggcgctacaggcgctgcggatcacgggagaggtcatcacgacgccatactcctttgtggcgacggcgcactcgctgctgtggaacggcgtcaagcccgtcttcgtcgacatcgacccgcatacgatgaatctcgatccggcaaagatcgaggccgcgatcacaccgcagacaacggcgatcatgcccgtgcattgctacggccacccctgcgatgtcgacgcgatccagaagatcgcggacaactacaacctcagggtgatctacgatgccgcccatgccttcggcgtccgtaacgaaagcggcagcatcctgaagcacggcgacctgtcgattctcagcctgcacgccaccaaggtcttcaacacgttcgaaggtggcgccatcatctgccccgatgccaagacaaagcagcgcatcgatcatctgaagaacttcggttttgtcgacgaagtcaccgtcgtcgctgccggcatcaacggcaagatgagtgaaatcaacgctgcgtttgggctgctgcagttgcagcacatcgacgaggcgctcgagcgccgcaaggcgatcgatgcacgctatcgcgaactgttgcgcaacatccccggcattcgttgccaggcggatgccggcgaaaccacagccaactacgcgtacttccccattcacgtcgaagctgactacccgatcagccgggatgccctgtttgacaagttccgcgagcaaggtatcttcgctcggcgctacttctatccgctgatctcggatttcccgatgtatcgcggcctgccgtccgccagccgccataacttgcccattgcatcggaggcggcgctgaaggtgctgtgcctgccgatctatccggcgctcactgaagagcaagttcagcgcgtcgtgagcatcatcgcggagcattga

SEQ ID NO: 43392 - protein, 381 aa, Ralstonia metallidurans CH34
MTASLPSESVRALLEDRIYVTQPHLPPLDEFLPYLQQIWNSRVLTNGGPFHQQFERELCEYLGVPYLSLFANGTLALVTALQALRITGEVITTPYSFVATAHSLLWNGVKPVFVDIDPHTMNLDPAKIEAAITPQTTAIMPVHCYGHPCDVDAIQKIADNYNLRVIYDAAHAFGVRNESGSILKHGDLSILSLHATKVFNTFEGGAIICPDAKTKQRIDHLKNFGFVDEVTVVAAGINGKMSEINAAFGLLQLQHIDEALERRKAIDARYRELLRNIPGIRCQADAGETTANYAYFPIHVEADYPISRDALFDKFREQGIFARRYFYPLISDFPMYRGLPSASRHNLPIASEAALKVLCLPIYPALTEEQVQRVVSIIAEH

SEQ ID NO: 43393 - DNA, 1146 bp, Burkholderia fungorum LB400
  CDS (1)..(1146)
atgaatgctgtcgtaccgcttagggctattgcgccacagatagacgagcgcatttacgttacccaaccgcatcttccgccgctcgaagaattcattccctatcttcagcagatctgggacagtaaggtgctgaccaacggcggcccgtttcaccagcagttcgaagccgcgctgtgcaagtacctcggggtcaagcatctcgcgctcttcaccaacggcacgcttgcgctgcttaccgcgctgcagacgctgcgcatcaccggcgaggtcatcacaacgccttattcattcgttgcaaccgcgcactcgctggtctggaacggtatcaagccggtattcgtcgacatcgatccgcgcacgctgaatctcgacccttcaaaaatcgaggccgcgatcacgccgcagaccaccgccatcatgccggtgcattgctacggcaaggcatgcgacgtcgaagcgattcagaagatcgctgacaactacaatctgaaggtaatttacgacgctgcccatgccttcggtgtgcagaccgaaaccggaagcgtgctcgagcacggcgacctctccatcctcagcttccacgccaccaaggtcttcaacacgtttgaaggcggcgcgatcatctgtcaggacgagagaacgaaacagcggatcgaccatttgaagaacttcggttttgtcgatgaagtgactgtcgttgcatgcggcatcaacggcaagatgagcgagatcaacgcggcattcgggttgctccagctacagcatatcgatgacgcactggcacggcgcgcccggatcgacgcgatctatagggaacggctgcgcgacgtgcgcggaattgcttgcgtggcgaaggcgggcgaaacagtggcgaatcacgcgtacttcccgattctcgtcggcccggactaccctctcagccgcgacgcgctgtaccagaagttccgcgatcgcgatatttacacgcgccgctatttttacccactggtctcggagtttccgatctatcgcagcctgccttccgcgcggcccgataatctcccggtcgcccacgccgcttcacaacagatactgtgtctgccgattttcccggcgctgacggatgacatgctcgatcacatcatcgggatcatctcggatatctga

SEQ ID NO: 43394 - protein, 381 aa, Burkholderia fungorum LB400
MNAVVPLRAIAPQIDERIYVTQPHLPPLEEFIPYLQQIWDSKVLTNGGPFHQQFEAALCKYLGVKHLALFTNGTLALLTALQTLRITGEVITTPYSFVATAHSLVWNGIKPVFVDIDPRTLNLDPSKIEAAITPQTTAIMPVHCYGKACDVEAIQKIADNYNLKVIYDAAHAFGVQTETGSVLEHGDLSILSFHATKVFNTFEGGAIICQDERTKQRIDHLKNFGFVDEVTVVACGINGKMSEINAAFGLLQLQHIDDALARRARIDAIYRERLRDVRGIACVAKAGETVANHAYFPILVGPDYPLSRDALYQKFRDRDIYTRRYFYPLVSEFPIYRSLPSARPDNLPVAHAASQQILCLPIFPALTDDMLDHIIGIISDI

SEQ ID NO: 43395 - DNA, 1146 bp, Burkholderia fungorum LB400
  CDS (1)..(1146)
atgaacgcagctttgccgcttcgcgctatcgagtcacctgtcgacgagcgcatctacgttacccagccgcacctcgcgccgctcgaagagttcatcccttatcttcagcagatctgggacagcaaggtgctgaccaacggcggcccgtttcaccagcagttcgaacaggcgttgtgcaagtacctcggcgtgcgccatctcgcgctgttcacgaacggcacgctggcgctgctcaccgcgttacaggcgctgcgtgtgacgggcgaggtgatcacgacaccctattcgttcgtggcaaccgcgcactcgctggtgtggaacggcatcaagccggtgttcgccgatgtcgacccggacacgctcaatctcgatccggccaggatcgaggcggccatcaccccgcagaccaccgcgatcatgccggtgcactgttacggcaagccgtgcgacgtcgatgccatccagaagatcgccgacaactacaatctgaaagtgatctacgacgcggcccatgcgttcggcgtccagaccgacaccggcagcgtgctcgaacacggcgatctcgcggtgctgagttttcacgctaccaaggtgttcaacaccttcgaaggtggcgcgatcatctgccaggacgcgaagaccaagcagcgcatcgaccatctgaagaacttcggtttcgtcgatgaagtgacggtggtggcatccggcatcaacggcaagatgagcgagatcaatgccgcgttcggcttgctgcaactgcagcacatcgacgaagcactggcccggcgcgcgcagatcgatgcaatctatcgcgagcggctgcgcgacattcccggcatccgttgcatgcagaaagccggcgagaaagtggcaaaccactcgtacttcccgatcctggtcggtccggatttcccgatcagccgcgacgcgctgtaccagaagttccgcgaccacgatatctacacgcggcgctacttctatccgctgatttcggacttcccgatctatcgtggtctgccgtccgcacgccgtgaaaacctgccgatcgcgcatgctgccgcgcaacaggtgctatgcctgccgattttcccggcgctgaccgacggcatgctcgaccgcatcatcggacttatcgcggattgctga

SEQ ID NO: 43396 - protein, 381 aa, Burkholderia fungorum LB400
MNAALPLRAIESPVDERIYVTQPHLAPLEEFIPYLQQIWDSKVLTNGGPFHQQFEQALCKYLGVRHLALFTNGTLALLTALQALRVTGEVITTPYSFVATAHSLVWNGIKPVFADVDPDTLNLDPARIEAAITPQTTAIMPVHCYGKPCDVDAIQKIADNYNLKVIYDAAHAFGVQTDTGSVLEHGDLAVLSFHATKVFNTFEGGAIICQDAKTKQRIDHLKNFGFVDEVTVVASGINGKMSEINAAFGLLQLQHIDEALARRAQIDAIYRERLRDIPGIRCMQKAGEKVANHSYFPILVGPDFPISRDALYQKFRDHDIYTRRYFYPLISDFPIYRGLPSARRENLPIAHAAAQQVLCLPIFPALTDGMLDRIIGLIADC

SEQ ID NO: 43397 - DNA, 1119 bp, Burkholderia fungorum LB400
  CDS (1)..(1119)
atgaaacccgaaatcgacgaggaaacgattcagggcgtcgccgacgtgctgcgctccggctggatcaccaccggcccgcagaaccagaaattcgaagcggcgctctccgaattctgcggcggccgcccggtgcgcacgttcaattcgggcacggcgacgctggaaatcggcctgcgcattgccggcgtgggcgaaggcgacgaggtgatcacctcgccggcctcgtgggtctcgaccagcaacgtgatctatgaagtcggcgcgacgccggtgttcgccgacatcgacccggtcacccgcaacatcgacctcgatctgctcgaaaaggccatcacgccgcgcaccaaagcgctgattccggtctatctgtcgggcctgccggtcgatatggaccggttgtatgccattgcccgcgcccacaagctgcgcgtgatcgaagacgccgcgcaggcgttcggctcgacgtggaaaggcgagcgcatcggccggctgggcgacatggtctcgttcagcttccatgcgaacaagaacctcacctcgatcgaaggcggcgcactcgtgctgaacaatgagcaggaagccatccttgcgcagaaataccgcctgcaaggcatcacgcgcaccggcttcgacggcatggactgcgacgtgctcggcggcaagtacaacctgacggacgtcgccgcgcgcgtcggcctcggtcagttgccgcatctggagcgctttctcgcgcagcgcaggaaactggtgcgcgcgtatttcgcgggcttcgagggcggcgcggcgacgaaactgggagtcggcctgccgtttgctgactttgaaaacagcaattggcacatgttccagatcacgctgccgctcgaaaaactctcgatcgaccgcgccggcttcatgggccaactgaaagagcgcggcatcggttcgggcgtgcactacccggcgatccacctgttctcgctgtaccgcgcgcgcggcttcagcgaaggcatgtttccgcatgcggagcggttcggcgcgaccaccgtcacgctgccgcttttcacgctgatgaacgaaggcgacgtggagcgcgtatgccgcgcggtcaatgaaatttgcgaacaatacggaaaataa

SEQ ID NO: 43398 - protein, 372 aa, Burkholderia fungorum LB400
MKPEIDEETIQGVADVLRSGWITTGPQNQKFEAALSEFCGGRPVRTFNSGTATLEIGLRIAGVGEGDEVITSPASWVSTSNVIYEVGATPVFADIDPVTRNIDLDLLEKAITPRTKALIPVYLSGLPVDMDRLYAIARAHKLRVIEDAAQAFGSTWKGERIGRLGDMVSFSFHANKNLTSIEGGALVLNNEQEAILAQKYRLQGITRTGFDGMDCDVLGGKYNLTDVAARVGLGQLPHLERFLAQRRKLVRAYFAGFEGGAATKLGVGLPFADFENSNWHMFQITLPLEKLSIDRAGFMGQLKERGIGSGVHYPAIHLFSLYRARGFSEGMFPHAERFGATTVTLPLFTLMNEGDVERVCRAVNEICEQYGK

SEQ ID NO: 43399 - DNA, 1110 bp, Enterococcus faecium
  CDS (1)..(1110)
atgggaggaacagaagaaaaatatgttgctaaggcttttaaagataattggatagcgccattaggtgaaaatgtggataaatttgaagaaagtattacaaaatatactggttctaagggcggagcttctgcgttaagttcaggtacagctgccatacatcttgccttaagactgcttaatgttggaaaaaacgatattgtctttgctccttcatttacttttatagctacagtaaatcctattttatatcaaggggctgtaccagtgttcattgactcagaacctaatacatggaatatgagccctgttgcactagagagcgcattagaagaagctgaaagaaacaaccaattacctaaggcaatcatcgtagtgaatttatatggtcaaatggctgattatgaacgaattttagctattgcaaaccaatttaatgttccagtgatagaagatgcagcggaatcgttaggttctacttataagggaatttcgtcaggcttatttgggacaattgggatctattcatttaacggtaataagatcatcacaacctcaggtggaggagctctagtgtctagtgataaaaaatatgttgagcattcaagatttttagcaacacaagcaagagatcaagcaccgtattatcaacatagcgaaataggttataattaccgtctaagcaatatttctgccggtatcggacgtggacaaatggaagtattgaatgatagagtagctaaacgaagagaaattttcaatcgatataaggaagctttttctggaattgatagaattgaaatgatgccagaagtggatggcatggtgccaaatcgttggttgtctactttaacgatcaatgattataattctattgatcaagtagttaacgtaataaataaactaaatgaaaaaaacattgaaacaagagctttgtggaaaccactacatttgcaaccagtatttcaaggggtaaaaatgtattaccatgataataatcttagtgtgtcagaaaagttatttaatagcggcttatgcttaccttctggaagtaatatgacagatagtgaacaagaatttgttattgatgagtttaaaaaaatattcaagtag

SEQ ID NO: 43400 - protein, 369 aa, Enterococcus faecium
MGGTEEKYVAKAFKDNWIAPLGENVDKFEESITKYTGSKGGASALSSGTAAIHLALRLLNVGKNDIVFAPSFTFIATVNPILYQGAVPVFIDSEPNTWNMSPVALESALEEAERNNQLPKAIIVVNLYGQMADYERILAIANQFNVPVIEDAAESLGSTYKGISSGLFGTIGIYSFNGNKIITTSGGGALVSSDKKYVEHSRFLATQARDQAPYYQHSEIGYNYRLSNISAGIGRGQMEVLNDRVAKRREIFNRYKEAFSGIDRIEMMPEVDGMVPNRWLSTLTINDYNSIDQVVNVINKLNEKNIETRALWKPLHLQPVFQGVKMYYHDNNLSVSEKLFNSGLCLPSGSNMTDSEQEFVIDEFKKIFK

SEQ ID NO: 43401 - DNA, 1098 bp, Magnetococcus sp. MC-1
  CDS (1)..(1098)
atgtccacacccacgcagatccccgtatggagcattgataccggaccagcagcggctcaggcggtggcccacgccgtgcaaaatcggcaaattgggcagggtaagctgacccgtctgtttgagcagcagttggctcagctgctgggggtgccccatctgttttgcaccaccagtggtaccaacgccctgctcatggcccttatccaactgggggtcggctgtggggatgaggtgattattcccgcgatgagctgggtggcaacggctaacgcccccctgttgctgggggccaaggtggtgttggtggatgtagaacccacccgccccgtcatggatataaacaagctacaggcggccattagcccaaaaaccaaagcgatcattgcggtgcatctcaacggcattgccacgcagatggagccgttgttggcgatagcccaagcgcacggtatcggtgtggtggaagatgcctgtcaagccctgctcagccgccatcacgggcgctgtttgggcagttttggtcggtttggggccttttcgctgggggtggcgaagatgcttaccaccggtcagggggggctgctggtgtgccagagtgccgaggatgccgcagccattgagtcgatccgcaaccagggccaatgtggtggggtgctgggggagaagatggagcggctaggcggtaactttaaatttaatgatgtgctggccgcccttggtttggtgcagttgccgctgctggcgggtcgggtacgccaccatttggccattcaagaggcctatgcaaggggcttggctggggtggcaggcatgcgtgcaatctcggccaacgcagcggcgggtgagcatcctctcagggccgaatggcactgccaagaccggcagcgttttatccaaaggatggcagagcagggcattgaggtagcggcgcgcagcaccggtttgcatcgggtgccccacattggtgcccagttggccgattgtgagcaatacccccatgcccaagcctacgaggggcactttatcactctgccttcggggcctgagcagccgttggaaaatgtgcaacgggtaatcgaagcgatccatgccttataa

SEQ ID NO: 43402 - protein, 365 aa, Magnetococcus sp. MC-1
MSTPTQIPVWSIDTGPAAAQAVAHAVQNRQIGQGKLTRLFEQQLAQLLGVPHLFCTTSGTNALLMALIQLGVGCGDEVIIPAMSWVATANAPLLLGAKVVLVDVEPTRPVMDINKLQAAISPKTKAIIAVHLNGIATQMEPLLAIAQAHGIGVVEDACQALLSRHHGRCLGSFGRFGAFSLGVAKMLTTGQGGLLVCQSAEDAAAIESIRNQGQCGGVLGEKMERLGGNFKFNDVLAALGLVQLPLLAGRVRHHLAIQEAYARGLAGVAGMRAISANAAAGEHPLRAEWHCQDRQRFIQRMAEQGIEVAARSTGLHRVPHIGAQLADCEQYPHAQAYEGHFITLPSGPEQPLENVQRVIEAIHAL

SEQ ID NO: 43403 - DNA, 1110 bp, Magnetococcus sp. MC-1
  CDS (1)..(1110)
atgcagttcatcgatctaaaaacccagtatctcgcttatcaggctgagattgacgccgccatgaaggatgtggtggatacggtgcgttttattaatggcccttggattggcgacctggagcgggacctggccgcttttgtgggggtcaagcatgccattggggtctcttcgggcaccgatgctctgctggcgctgttgatgtcctggggcattggccctggggatgaggtgattaccaccgcctttacctttattgccacggcggaggtgattgctttggtaggggccaagccggtgtttgtggatattgagcccgacaccctgaatattgacccggttaaggtggaggcggccataacccccaacaccaagcttattctgccggtttcgctgtatggtcagtgtgccgactatgtggcgctcaatgccattggtgccaagtatggtatccctgtgttggaggatgcctgtcaatccttgggttccagctttcagggcaagcgctcctgtgcgctgaccgaggcggcggcgacctccttttttccggccaagccgttgggctgttttggggatgggggcatggtctttaccgacaatgacgagctggccgaaaaggtgcgccaagttaaagatcatggtcaatcggcccgctatcaacacggctttttaggcatcaatggacgtctggactccattcaagcggcggtattgggggccaagctgccccacttccaggatgagattgacgcccgtcagcgcattgccaaccgctatatcgaggggttgcagggccatgtgcagacccccattattcgtgcgggtaatatcagcgtgtttgcccagtttaccgtgcgggttgccaaccgcgacgccgtgcaaaaggtgatgggggagcatggggtgccgacagcggtacactaccccattccactgccgcatcagccggtctttaaggccatccgcgccaagagtggcgaagcggagccctgcttccctgagtcggagaaggccgcagcagaggtgatgagtctgcccatgcacccattcttgagcgaggcggatcaagataaggtggtggagaccctcatccaagcggttaagggcgcatag

SEQ ID NO: 43404 - protein, 369 aa, Magnetococcus sp. MC-1
MQFIDLKTQYLAYQAEIDAAMKDVVDTVRFINGPWIGDLERDLAAFVGVKHAIGVSSGTDALLALLMSWGIGPGDEVITTAFTFIATAEVIALVGAKPVFVDIEPDTLNIDPVKVEAAITPNTKLILPVSLYGQCADYVALNAIGAKYGIPVLEDACQSLGSSFQGKRSCALTEAAATSFFPAKPLGCFGDGGMVFTDNDELAEKVRQVKDHGQSARYQHGFLGINGRLDSIQAAVLGAKLPHFQDEIDARQRIANRYIEGLQGHVQTPIIRAGNISVFAQFTVRVANRDAVQKVMGEHGVPTAVHYPIPLPHQPVFKAIRAKSGEAEPCFPESEKAAAEVMSLPMHPFLSEADQDKVVETLIQAVKGA

SEQ ID NO: 43405 - DNA, 1146 bp, Magnetococcus sp. MC-1
  CDS (1)..(1146)
atgattccattggcaatcccccatctaggggggcgggaagcggactatttgcagcagtgtattgagagcacctttgtctcctctgtgggtccctttgtggaccgctttgagcaacaggtggcgcaggcagccggagtagcccatggggtggcggtcgccaccggcaccgctggactgcacgccgccctagccgccctgcatgtgcagcgggatgatctggttattctacccgcccttacctttattgccagtgccaatgccatcgcctatctcggggcgacaccctggattatggatgtggatcccctgagttggaccctggatccccacgtggtggaacaggccctggcccaacacagccactggcagggggatcgtttgatccacacccccagcgggcgacgcatcgccgccatgatgccggtgcatgtactgggtaccccggcagatatgcagcggcttatccccatcgcccagcgctataaactgccggtggtggccgatggtgccgccgccctgggggctatggcccatggtcaagccattggggcactgggggcggaactgacggtcttctcgtttaatggcaacaaaaccgtcacctgtggcggtggcggggcggtggtcagccacgatgcggctttgattcaacgggtgcgtcatttgaccaccaccgcccgccaaggccctggctacgaccatgacgaagtaggctttaactatcgcatgaccaatttacaggcagcggtgggctgtgcccaaatggagcgcttgacggagctggtgggggccaaacggcgcattcgcgaccgctatgccgacgcattgggagatctgcccggcgtcaccccgtttcaggccccaagttgggccaagagcgcttggtggttctcgggggtggtggtggatcgccccccccagaggcaagaacacctgcgcgcgcaactgcggcagttgggggtggacgcacgccccttctggaagcccatccaccaacaggccccctaccgcaacgcccccgttagcgccaccccagtggtggatggtttatggtggcagatcttgaccctcccctgctcctgcgggttgacggaacaggaccagcagcgggttattgatggggtaaggcaggtattgaaagggtaa

SEQ ID NO: 43406 - protein, 381 aa, Magnetococcus sp. MC-1
MIPLAIPHLGGREADYLQQCIESTFVSSVGPFVDRFEQQVAQAAGVAHGVAVATGTAGLHAALAALHVQRDDLVILPALTFIASANAIAYLGATPWIMDVDPLSWTLDPHVVEQALAQHSHWQGDRLIHTPSGRRIAAMMPVHVLGTPADMQRLIPIAQRYKLPVVADGAAALGAMAHGQAIGALGAELTVFSFNGNKTVTCGGGGAVVSHDAALIQRVRHLTTTARQGPGYDHDEVGFNYRMTNLQAAVGCAQMERLTELVGAKRRIRDRYADALGDLPGVTPFQAPSWAKSAWWFSGVVVDRPPQRQEHLRAQLRQLGVDARPFWKPIHQQAPYRNAPVSATPVVDGLWWQILTLPCSCGLTEQDQQRVIDGVRQVLKG

SEQ ID NO: 43407 - DNA, 1125 bp, Magnetococcus sp. MC-1
  CDS (1)..(1125)
atgcaattcgtcgatctccttgcccagcatcggtccatccaggtgtcgttagacgccgccattgcccatgtggttgagcactccagctttatccgtggtccccatgtggaggcttttgagcagggcttcgcgcaaatgatgggggccaagcactgtatctcctgcggcaacggcaccgatgccctctatatcgccatgcgtgcgctggggctggaggccggggacgaggtgatcaccaccgcccatagttggattgccaccagcgaaaccatcacccaggcgggcgggcaggtggtgttttgcgacaccgaacccaactgtttttgtctcgatcccttacagattgaatccaaaattaccccacgcacgcggggtattattgcggtgcatctctatggtcagcctgcggatatgtcggccattatggcgctggcgaaagcctatgacctgtgggtgatcgaggatgccgcccaggctcacttggccgccatggatggtcaactggtgggccgttttggggatgttgccaccttctctttctaccccggtaaaaatttgggtgccatgggggatgccggatgtttggtcacagaccggcaggatgtggcggattttgcccgcttgtttgcccgccatggggggaaaaataatcatcaaatagagggtataaacagccgcatggatggtttgcaggcggcggtgcttaatgtcaaaatgccccacctagaggggtggacccgcgcccgcgaggcgttggcccagcgctatgatagcatgctggccgagctgccccaggtcatcaccccaacggtgcgcagtggttgtcgccatgtgtatcatctctatgtcatccgggtgccgcagcgggatgccttgcaagcctatttagcagagctctatattcccacggtgatcaactaccctcaggcgctgcctttctacccagcctatgcgcggcttggccacaagccggtggattttcccgttgcttttcagcatgcgcaggagatcctctctttgcccatgcacccctttttaagtcaacaggatcaagaacgggtggtggaaggcattcgcgccttttatgcgcaaccggtttcgattgcgtttgaagagggctcttga

SEQ ID NO: 43408 - protein, 374 aa, Magnetococcus sp. MC-1
MQFVDLLAQHRSIQVSLDAAIAHVVEHSSFIRGPHVEAFEQGFAQMMGAKHCISCGNGTDALYIAMRALGLEAGDEVITTAHSWIATSETITQAGGQVVFCDTEPNCFCLDPLQIESKITPRTRGIIAVHLYGQPADMSAIMALAKAYDLWVIEDAAQAHLAAMDGQLVGRFGDVATFSFYPGKNLGAMGDAGCLVTDRQDVADFARLFARHGGKNNHQIEGINSRMDGLQAAVLNVKMPHLEGWTRAREALAQRYDSMLAELPQVITPTVRSGCRHVYHLYVIRVPQRDALQAYLAELYIPTVINYPQALPFYPAYARLGHKPVDFPVAFQHAQEILSLPMHPFLSQQDQERVVEGIRAFYAQPVSIAFEEGS

SEQ ID NO: 43409 - DNA, 1206 bp, Magnetococcus sp. MC-1
  CDS (1)..(1206)
atgaacccagagcgcccctttcttccttacggtcggcaaaccattgaggcggatgatgttgaagccgtaagccaagtgcttctcggggattggctcaccggtggtcccagcgtgaccgcttttgagcaagccctcgccgcgcaggttgaagccccccatgccgtggcgtgtgccaatggcacggctgccctccatttggccatgctggccctaggcattggcccgggggatgcggtgattgtgcccaccctcacctttttagccaccgccaatgccgcacgttttgtcggggccgaggtgatttttgcggatgtggatccccatacgggtttgctgggggatgccacctttgcccaagcgcttcaacgggcaggggagcgcccggtacgggcggttataccggtccaccttaacggccaactctgcccagagttggcgcagatcgcccaacgggccaaagcccttggcattgcggtggtcgaggatgcctgtcacgccctgggcagtcgtcaccatgggccacagggctatctggcgggggcgtgccgccattcggagatgacggttttctcgtttcatcccgttaaaaccattgccatgggtgaagggggggccatcaccacccacaacccacaactggcggagcggctgcaatcctaccgcaaccatggcatgagccgagatccagagcactttacccaaccccatgaagcgcgggatgcccaaggtgagctcaacccttggtactatgaaatgacggaacccggctttaactaccgagccagtgacctgcattgcgccttggggttaagccaactgcacaagcttgggcgttttgtcgccgcccgtcagcaactggccaccctctaccaccataaattggcggcgctggcccccatcctcaccccgattccaatggttgagggggcagatcccgctctgcacctgtttgcggtgtggattgattttgagcaattgggtatgagccgtggggcgctcatgcaagcccttaaagccaagggcattggcacccaggttcactatctgccggtgcatcgtcaaccctattatcggcggttgggcagcattgacctgcccggtgcggatgcctattaccagggctgcctctctctacccttctaccccagcttgcaggagggcgacctagatcgggtggtgcaagcgttggcggaactctggccctga

SEQ ID NO: 43410 - protein, 401 aa, Magnetococcus sp. MC-1
MNPERPFLPYGRQTIEADDVEAVSQVLLGDWLTGGPSVTAFEQALAAQVEAPHAVACANGTAALHLAMLALGIGPGDAVIVPTLTFLATANAARFVGAEVIFADVDPHTGLLGDATFAQALQRAGERPVRAVIPVHLNGQLCPELAQIAQRAKALGIAVVEDACHALGSRHHGPQGYLAGACRHSEMTVFSFHPVKTIAMGEGGAITTHNPQLAERLQSYRNHGMSRDPEHFTQPHEARDAQGELNPWYYEMTEPGFNYRASDLHCALGLSQLHKLGRFVAARQQLATLYHHKLAALAPILTPIPMVEGADPALHLFAVWIDFEQLGMSRGALMQALKAKGIGTQVHYLPVHRQPYYRRLGSIDLPGADAYYQGCLSLPFYPSLQEGDLDRVVQALAELWP

SEQ ID NO: 43411 - DNA, 1083 bp, Methanosarcina barkeri str. fusaro
  CDS (1)..(1083)
atgatttcaattgccaagcccctgatgggtaaggaagagattgatgcagtaacaaaggtcctgagatcaggcatgattgcacagggcccaaaagtcgaagaatttgaacttgctttttctgaatacactggttgtgagtatggggttgccgtgagctctggcactgcagctttgtacattgcgcttcttgcccatggcataggaaaaggagatgaagtgattacaagccccttcagtttcattgcaacagcaaacagcgtcctttataccggggcaaaacctgtttttgcagatattgaatcagatacatataatatagatcctgaaaaagttcaggagaaaataactccaaaaaccagagcaattttgcctgttcacctctatgggcatcctgcagacatgaaagcgataatggaaattgcagatgataataagcttattgtaattgaagatgcctgccagtcccatggtgcagaatgccttggaaaaaaagtgggcagtttcggaacaggagcattcagcttttaccctactaaaaatatgacaacaagcgaaggcggaattctcactacggacgacaaggaaattgcagagaaggcaaaaatgatccgtgctcacggctcaaaagttcggtatctgcatgaaatgctgggcttcaacctgcgtatgactgatattgcagctgcaatcggacttgtacagcttggaaagctggacgggtttacagcggccagacaaaagaatgcagagattctttcagcagggttaaaaggtatatccggaattatgccaccggtaataagagctgactgcacccatgtattccaccagtatacggtcagagcagaaaaaagagatcaactggcaactttcctgaaagaaaaagaaataggaacaggaatccattatcctatatccattcacaaacaacctttctacagggaacttggatacagggattctctaccggtcgcagaaaaggcggcggaagaggttatttctctccccgtgcaccctgcattatccaaaactgatttgcaggaaatagtcgaggcgaccaaagaattttatgcaaaggattga

SEQ ID NO: 43412 - protein, 360 aa, Methanosarcina barkeri str. fusaro
MISIAKPLMGKEEIDAVTKVLRSGMIAQGPKVEEFELAFSEYTGCEYGVAVSSGTAALYIALLAHGIGKGDEVITSPFSFIATANSVLYTGAKPVFADIESDTYNIDPEKVQEKITPKTRAILPVHLYGHPADMKAIMEIADDNKLIVIEDACQSHGAECLGKKVGSFGTGAFSFYPTKNMTTSEGGILTTDDKEIAEKAKMIRAHGSKVRYLHEMLGFNLRMTDIAAAIGLVQLGKLDGFTAARQKNAEILSAGLKGISGIMPPVIRADCTHVFHQYTVRAEKRDQLATFLKEKEIGTGIHYPISIHKQPFYRELGYRDSLPVAEKAAEEVISLPVHPALSKTDLQEIVEATKEFYAKD

SEQ ID NO: 43413 - DNA, 1089 bp, Geobacter metallireducens GS-15
  CDS (1)..(1089)
atggtggatttgaaggtgcagtatcatgcaataaaggaggagatcgacaggggcattctggaagcccttgaaaagacccagttcattctcgggcccaacgtgacggcgttcgaggaggaagcggccgcgtttctcggcgtaaagcatgccatcggcgttgcctcggggaccgacgccctccacctggcccttgccgctgcagggatcacggagggtgatgaggtgatcacctctcccttcacctttatcgccactgccgaggcgatccgttacgtgggggccacgccggtcttcgtggacgtggaccccaagagcttcaatatcgatcctgccaggatcgaggcggccatcacccccaggaccaaggcggtccttccggttcatctcttcggccagccggcggacatggatgccatccaggccctctgcaccaagcatggtcttttgatgatcgaagactgcgcccagtccttcggcgccgacgttaatggtcgcatgaccggcaccttcggggcgctgggggccttcagcttcttccccagcaagaacctggggtgctatggcgatggcggccttgtcaccacctcctgcccggaactggccgagcgggtgaaggtgctccgcaaccacgggagcaaggttcgctaccatcactcggtcattggctacaacagccgccttgacgagatacaggccgtgatcctgcgggtgaagctcaagcacatccgggaatacagcgaggggcgccgccgcgtggctcacctctacagcgaactgctggccggcaccggcgccacccctcccttcgaggatggcaagggaacccatgtctaccaccagtacacgcttctcaccgaccgccgcgacgccatcatgaaggccctcaccgacgcggggattgcctcggcggtttactatccgattcctctgcacaagcaggatgtcttcgccgccgactacgccggtgtttccctccccgcggccgaggaggtggcatcccgctgcatgtccctccccatcttcccggagatgaccgaagaacaggtacgccgggtcgtggacgtggtgaaatcggccctcaaggcatag

SEQ ID NO: 43414 - protein, 362 aa, Geobacter metallireducens GS-15
MVDLKVQYHAIKEEIDRGILEALEKTQFILGPNVTAFEEEAAAFLGVKHAIGVASGTDALHLALAAAGITEGDEVITSPFTFIATAEAIRYVGATPVFVDVDPKSFNIDPARIEAAITPRTKAVLPVHLFGQPADMDAIQALCTKHGLLMIEDCAQSFGADVNGRMTGTFGALGAFSFFPSKNLGCYGDGGLVTTSCPELAERVKVLRNHGSKVRYHHSVIGYNSRLDEIQAVILRVKLKHIREYSEGRRRVAHLYSELLAGTGATPPFEDGKGTHVYHQYTLLTDRRDAIMKALTDAGIASAVYYPIPLHKQDVFAADYAGVSLPAAEEVASRCMSLPIFPEMTEEQVRRVVDVVKSALKA

SEQ ID NO: 43415 - DNA, 1197 bp, Geobacter metallireducens GS-15
  CDS (1)..(1197)
atgagaagcgctccgattccctacggccgccagagcatcagtcccgccgacatccaggccgtcgtcgacgttctcaattccgactggctcacccaaggccccacagtggagcgcttcgagcagaccgtggccggctactgcggcaccgcccatggcgtggcagtgaacagtgccacctcggccctccacatggcttgcctcgcggcggggctcggtcccggcgacatcctctggacctcccccaacacctttgtggcctccgccaactgcgggctctactgcggcgccaccgtggacttcgtggacatcgatccccgcacctacaacatgagcgccgaacggctggaggagaagctggagcgggccgcacgggaggggaagctgccgaaggtggtgatcccggtccatttcgcggggcagtcgtgcgacatggaggccatcggccgccttgccgggcggtacggtttcaccgtcatcgaggatgcctcccacgccatcggcggacggtacaagagtgaaccggtcggcaattgccgccattccgccatgacggtcttcagcttccaccccgtcaagatcatcaccactggcgaaggggggatggtcctgactaacagcgcggaactgcacgagcggctggtccggctccgcagccacggcatcacccgcgacccggccctcatggcgggagaatcccacggcccctggtactacgagcaaatcgaacttgggttcaactaccggatgaccgacatccaggcggccctgggggtgagccaaatgacgcggctggatgagttcgtggagagacggcaccacctggcgaagcggtatgacgaggcacttcgcgatgacccgtttgttctgccgttccagcatcccgatagctactccgcttttcacctgtatgtcattcgcctccaggctggagagcccggcagcggacacaaggggcggaaagaggtgttcgaggctctccggcagcgtggcatcctggttaatgttcattacatccctgtgcatatccaaccctactatcgcgcaaacggtttcgatgcaggagatttccctcaagcggagcagtattaccgggaagcgatcactctgccgctctatgccggcctcgccgagatcgaccaggaccgggtcataacagcactccaggagcttctatgccccccttcggcgccgaaataa

SEQ ID NO: 43416 - protein, 398 aa, Geobacter metallireducens GS-15
MRSAPIPYGRQSISPADIQAVVDVLNSDWLTQGPTVERFEQTVAGYCGTAHGVAVNSATSALHMACLAAGLGPGDILWTSPNTFVASANCGLYCGATVDFVDIDPRTYNMSAERLEEKLERAAREGKLPKVVIPVHFAGQSCDMEAIGRLAGRYGFTVIEDASHAIGGRYKSEPVGNCRHSAMTVFSFHPVKIITTGEGGMVLTNSAELHERLVRLRSHGITRDPALMAGESHGPWYYEQIELGFNYRMTDIQAALGVSQMTRLDEFVERRHHLAKRYDEALRDDPFVLPFQHPDSYSAFHLYVIRLQAGEPGSGHKGRKEVFEALRQRGILVNVHYIPVHIQPYYRANGFDAGDFPQAEQYYREAITLPLYAGLAEIDQDRVITALQELLCPPSAPK

SEQ ID NO: 43417 - DNA, 1164 bp, Geobacter metallireducens GS-15
  CDS (1)..(1164)
atgcgcagcgaatttctccccttttccaaaccaaccatagacgacgacgagatcaatgaggtcgttgcatccctgaaatccgggtggatcaccaccggccccaaggtgaagcgcttcgaggaggcgttcaaggcctacgtcggcgcctcctacgccgtccccctgagttccgccaccgccgggctccacctgacgctcatcgccctgaagctggacgaaggggacgagatcatcaccacccccatgacctttgcctccacggtgagcatgatcgtcctctgtggggcaaagccggtgctcgtcgacatcgagccgggaaccctcaacatcgacgcggcaaagatccgcgaaaagatcaccccccgcacgaaggcgatcatcccggtccactttgccggccagtcgtgtgatatggaccccatcttcgccctggccaaggagttcggcctcaccgtcatcgaggacgcggcccacgccgccggcaccgagtacaaggggaagaggatcggctccctcgacagcatctccatcttttccttccaccccaacaagaacatcaccaccggcgaagggggaatggtctgcaccgccgacgagaccctggccgaggagatctcgctcctgaagttccacggcatgagccgcgaggcgtggaagcgcttcgccgccagcggcacccccaactacgacatcctccttcccggctacaagtacaacatgatggacatccaggccgccatcggcatccaccagctcccgaagctggacgggttcatcgagaagcgccgggaaatagccgaattctacaaggccgcctttgccgacgtccatgaactggctaccccggccctcgccccctacgaccagcgccatgcctggcacctctacacgccgctggtccgggtggagaagctcaccatcgatcgggacaccttcatggccgagctgaagaatctcaacatcggcaccggcctccactacaaggcgatccaccaccacgcctggtaccgggagaacatgccggtccccgcgggatcccttcccaacgccgactacgcctccgaccgcatcctctccctcccccttttcccggccatgaccatggacgacgcccgggacgtggtggcggcggtgaaggatgtcattgcccggaacaggaagtag

SEQ ID NO: 43418 - protein, 387 aa, Geobacter metallireducens GS-15
MRSEFLPFSKPTIDDDEINEVVASLKSGWITTGPKVKRFEEAFKAYVGASYAVPLSSATAGLHLTLIALKLDEGDEIITTPMTFASTVSMIVLCGAKPVLVDIEPGTLNIDAAKIREKITPRTKAIIPVHFAGQSCDMDPIFALAKEFGLTVIEDAAHAAGTEYKGKRIGSLDSISIFSFHPNKNITTGEGGMVCTADETLAEEISLLKFHGMSREAWKRFAASGTPNYDILLPGYKYNMMDIQAAIGIHQLPKLDGFIEKRREIAEFYKAAFADVHELATPALAPYDQRHAWHLYTPLVRVEKLTIDRDTFMAELKNLNIGTGLHYKAIHHHAWYRENMPVPAGSLPNADYASDRILSLPLFPAMTMDDARDVVAAVKDVIARNRK

SEQ ID NO: 43419 - DNA, 1179 bp, Geobacter metallireducens GS-15
  CDS (1)..(1179)
atgggaggttctccggccttttcggatactctccacgtgggccggcccaacattggagaccgctctgagtttttggaaagggtcaacggcatccttgaccggcgctggctcaccaataacggcatctgcgtccaggagttcgagcggcggcttgaggcgttgctgggggtcaaacactgtatcgccatgtgcaatgcaacggtggctctggaaattaccatcagagccctggggatgacgggggaagtgatcgttccttcatttacgtttgtcgccactccccattcactccagtggcagcagattacccccgttttctgtgatatcgatccagaaacacactccatcgacccgcgtcgggtcgagtcgctcattaccccccgcacgacaggaatcattggtgttcatctgtgggggaagccgtgcaagatcgaggcgttggctgagatcgccggtaggcgcaatctgagattgctcttcgatgcggcacatgcgttcggctgctcccataacggacgcatgataggaagtttcggcgatgccgaggtcttcagctttcacgcgacgaaattcttcaataccttcgaggggggagcggttgccaccaacgacgatgacctggccgcacggatcagactgatgaagaatttcgggtttgcgggctacgataacgtcgtctatatcgggacgaacggcaagatgtctgaaatctcggcggcaatggggctcacatcgctcgatcatttggaggaaatcattaccatcaatcgccgaaactatgcagcttatgccagtggccttgccaatgtgcaaggcattcgcctcgtcccctatgagggggctgatcgctacaactaccagtatgtggtccttgaggtagatgagcaggctgcgggcatccaccgcgacatgctgctgcaggcgcttcatgccgaaaatatcatggctcggcgatatttctatcccggctgccatcgtatggagccgtaccggtcatatttcccgaatgccggcatgctgcttcctgagaccgaacgacttgctgagcgagtattgtcactgccgacgggaacagccgtatcggaagaggatattgtcgatatctgctcaattattcggcttgtactaaagaatggggttgaagtgactaacgccttggccaatggtaaaaacacgtaa

SEQ ID NO: 43420 - protein, 392 aa, Geobacter metallireducens GS-15
MGGSPAFSDTLHVGRPNIGDRSEFLERVNGILDRRWLTNNGICVQEFERRLEALLGVKHCIAMCNATVALEITIRALGMTGEVIVPSFTFVATPHSLQWQQITPVFCDIDPETHSIDPRRVESLITPRTTGIIGVHLWGKPCKIEALAEIAGRRNLRLLFDAAHAFGCSHNGRMIGSFGDAEVFSFHATKFFNTFEGGAVATNDDDLAARIRLMKNFGFAGYDNVVYIGTNGKMSEISAAMGLTSLDHLEEIITINRRNYAAYASGLANVQGIRLVPYEGADRYNYQYVVLEVDEQAAGIHRDMLLQALHAENIMARRYFYPGCHRMEPYRSYFPNAGMLLPETERLAERVLSLPTGTAVSEEDIVDICSIIRLVLKNGVEVTNALANGKNT

SEQ ID NO: 43421 - DNA, 1089 bp, Ferroplasma acidarmanus
  CDS (1)..(1089)
atgattccagtatcagagcctgatataggcgagaaggaaatagaatatgtggatgatgcggtaagatcaggatgggtaagttcacatggcgaatatataaacagatttgaggataattttaagtcattcataggcacaaaattcgggcttacaacgtcaaatggaaccactgcactgcaccttgcattatctgctatgggcattaaggaaggggatgaggtaatagttcctgatttaacattcataagcccggtgaatgcagtgctatataaccatgcaacacctgttttatgcgatattgatcctgagaactggtgcattgatgcagaaaaaattgaaaaattaattacagaaaaaactaaagcaataatagtggtacatctttatggcaactctgctaatatggataggcttatggagataaaggaaaaatataatctttatttgatcgaggatacagcagaatcacttggtacggaatataaggggaaaaaactcggttcgttcggtgatgccggatgcttctccttttatggaaataaaacaatgacaacaggagaaggtgggttctgcacaaccaataatgaggaaatttacagaatgatgctgctgctcagagaccatggaatgaggcctgaaaacagatactggcatgattatattggatataattacaggatgacaaatctccaggctgcactgggagttgctcagcttgagaggttaaactcttttatagagaagaagaggcatattgcatcagaatataagaaaaacttaccgggaaatgtattgccacatcctgaggggaaattatataagggaacctactggctctactctatactcgctaaggataaggatgaaagggaacggttaataagcttcttattcggtaaaggaatagatacaaggaagttcttttatcctgtgcatgttatgccaccctataaggagtttaataaggtgaattatcccaatagcaccagcatctcagaaaggggaatcaatttgcccagcagtgtgaaattatctgacgatgaaataggatatatctgtgattgcattaaatcattttataaattataa

SEQ ID NO: 43422 - protein, 362 aa, Ferroplasma acidarmanus
MIPVSEPDIGEKEIEYVDDAVRSGWVSSHGEYINRFEDNFKSFIGTKFGLTTSNGTTALHLALSAMGIKEGDEVIVPDLTFISPVNAVLYNHATPVLCDIDPENWCIDAEKIEKLITEKTKAIIVVHLYGNSANMDRLMEIKEKYNLYLIEDTAESLGTEYKGKKLGSFGDAGCFSFYGNKTMTTGEGGFCTTNNEEIYRMMLLLRDHGMRPENRYWHDYIGYNYRMTNLQAALGVAQLERLNSFIEKKRHIASEYKKNLPGNVLPHPEGKLYKGTYWLYSILAKDKDERERLISFLFGKGIDTRKFFYPVHVMPPYKEFNKVNYPNSTSISERGINLPSSVKLSDDEIGYICDCIKSFYKL

SEQ ID NO: 43423 - DNA, 1134 bp, Cytophaga hutchinsonii
  CDS (1)..(1134)
atgatcccttttaataaaccgcatttaacaggtaaagaagttcattacatctatgaggctgttcattcagggaaaatttcaggaaatggcatttttactaaaaaatgtcatgatttctttacttccacatacggtttcacaaagacattgatgacatcaagctgtacagatgcgctggaaatgtcgtcattgttaatggatattcaaccgggggatgaaattatattaccaacgtttacgtttgtttcaacggcaaacgcttttgtattaagaggcgcaaagcttgtatttgtagatagtttagcaactgaaccaaatatgaacgttgagttgattgaaggtctgatcacatctaaaacaaaggcgattgttgtggtgcattatgccggcgtagcgtgtgatatggatgttgtaatgaacattgcaaaaaaatatcagttattcgtagtggaagatgccgcgcaggcaataagctcctattataaagataaaccattgggcggcattggcgattttggtgcattcagttttcatgaaacaaaaaatatcatttccggagaaggcggactgttggcaataaacaattcagattattgtaacaggtctgaaattatctgggaaaaaggtacaaaccgtagcgctttttttagaggcgaaacagataagtatggttgggtagatgttggttcctcgtttttaccatctgaaattataagcgcctttttatatgcgcagttagaaaacgtagctgaaattcaggctaagcgactggaaatctggaatacctattacaatacactaagccccttagcggaacataaaaaactcaggttgccttatataccggcgtatgcaaccaacaacgcacatatgttttatgtgatctgcaattctctggaagagcggaccgcattgattgattatttaaaagcacataatattctggctgtgtttcattatttatcgcttcataaatcaccttacttttcagataaacacgatggaagatcgatggattatgcagatcagtatgcagaaacgttggttcggttgcccttgttttatgatctttccaccgaagatcaggaatttatttgtactaaaatcttatctttttattcagaaaaaatatga

SEQ ID NO: 43424 - protein, 377 aa, Cytophaga hutchinsonii
MIPFNKPHLTGKEVHYIYEAVHSGKISGNGIFTKKCHDFFTSTYGFTKTLMTSSCTDALEMSSLLMDIQPGDEIILPTFTFVSTANAFVLRGAKLVFVDSLATEPNMNVELIEGLITSKTKAIVVVHYAGVACDMDVVMNIAKKYQLFVVEDAAQAISSYYKDKPLGGIGDFGAFSFHETKNIISGEGGLLAINNSDYCNRSEIIWEKGTNRSAFFRGETDKYGWVDVGSSFLPSEIISAFLYAQLENVAEIQAKRLEIWNTYYNTLSPLAEHKKLRLPYIPAYATNNAHMFYVICNSLEERTALIDYLKAHNILAVFHYLSLHKSPYFSDKHDGRSMDYADQYAETLVRLPLFYDLSTEDQEFICTKILSFYSEKI

SEQ ID NO: 43425 - DNA, 1131 bp, Cytophaga hutchinsonii
  CDS (1)..(1131)
atgaagcacattccgttttttacattggtgcatcaaaacgctttccttgaaaaggaaatagagtttttttataaagaactgcatgccgaggcctggtatattttaggaaaacgcgttgctcaatttgaaaaagcatatgctgcctataataatgtgcggcattgtattggcgtaggaaatggattggatgcattaacactttcgctgcgtgcattaaatattggaaaaggtgatgaagtggttgttccggcaaatagttttattgcaacgctgctggcggttacacaggtaggtgcaacacccattttagctgagcccgacaaacacacatttaatataacagcagaagaaattaaaaaaaaaattacgtcaaaaaccaaagtaattattcccgttcatttatatggtttgccttgcgcaatggaagatttaatttctttagcagaaacaaataatatattcattgttgaagacaatgcacaggcacatggtgcgacctacaaaaatcaaaaaacgggaagttttggaattgctaacgcaacaagcttttatccggtgaaaccacttggtgcttatggcgatggcggtgctgttacaacgaatgatgccgggctggcaagacagatccgcttgttgagcaattatggatcagaagaaaaatattattatgaaacgaccgggataaattcccggctggatgaaatacaggccggcgtattgtcgatcaaactcaattatcttgaccgatggaacgaagaacggattcagcttgcaaacctttattcagaaatattaaaagatacagaaggaattgtacttccggtttcttcaccagactgcaaacatatttaccatcagtatgtgattcaatcagacaaaagagatctgttgaaagagcacttaaaaaaacaaggtattgaaacaggtatccattatccggtgccgccacatctgcaaaaagcatatgactttttaaatctgcaaaaaggcagtctgccggttacagaaaagctgtcagaaacgattttaagtttacctatctataacggaatgaaaaacgaagatgtggaatatgtgtgtgaagtgataagaaattttataaataaaaaagttaaaccaacagtgcaatga

SEQ ID NO: 43426 - protein, 376 aa, Cytophaga hutchinsonii
MKHIPFFTLVHQNAFLEKEIEFFYKELHAEAWYILGKRVAQFEKAYAAYNNVRHCIGVGNGLDALTLSLRALNIGKGDEVVVPANSFIATLLAVTQVGATPILAEPDKHTFNITAEEIKKKITSKTKVIIPVHLYGLPCAMEDLISLAETNNIFIVEDNAQAHGATYKNQKTGSFGIANATSFYPVKPLGAYGDGGAVTTNDAGLARQIRLLSNYGSEEKYYYETTGINSRLDEIQAGVLSIKLNYLDRWNEERIQLANLYSEILKDTEGIVLPVSSPDCKHIYHQYVIQSDKRDLLKEHLKKQGIETGIHYPVPPHLQKAYDFLNLQKGSLPVTEKLSETILSLPIYNGMKNEDVEYVCEVIRNFINKKVKPTVQ

SEQ ID NO: 43427 - DNA, 1164 bp, Cytophaga hutchinsonii
  CDS (1)..(1164)
atgaaaatagataaagcaataccttacggaacacaagacattacgcagcaggatattgatgcagtaatagctgtacttcactctaaatttttaacacaaggtcccttggttaaagagtttgaagaaaaatttgctgcttatgtaggttcaagctatgcagttgcagtaaccaatggcactgcggccttgcacttatctgcaatggcattaggtgtaaacgcagattcaaaagtaataacaacgcccattacattttcagcttctgcaaactgcatccggtactgcggcggagaagttgtatttgcagatattgatccggaaaccgctttactggatatcaataacgtacgggcaatactggaagaacatccgaaaggaacattttcaggtatcatacccgttgattttgcaggttatccggtagatatggctgcattcagagccttggccgatgaacatggattgtggatcctcgaggattcctgccatgcacccggcgcatattttaccgacaaaaataatacgaaacatttttgcggagatggatcattagctgatctggctattttttcttttcatcctgtaaaacatattgcaaccggagaaggtggtatgattacgaccaattcagaagcacagtataaaaaattattgaaataccgttcacatggtatggtttatcagggaaattctgatttgatcgaaaaccatggcggctggtatatggaaatgcaggagctcgggtataattaccgcttgtcggatatcaatgcagctcttggtgtctctcagttatcacgtgcacagctaggcctgcaaagaaggcatgaaattgccaaacgatatgatactgcatttgcaggcacggcgattaaaaccatacctgttaaagaaaacgtttatcacggactacatttatatattatacaggttgaaaaccgtaaaggattatacgactacttaagagcaaataatatttttgctcaggtgcactatgtacctgtacatctgatgccgtattaccaaagcctgggttctaaaaaaggagatatgcctgtagcggaaaaatattacgatcattgtctgagtatacctatgtacccgacattgacggatgatgagcaagtatatgtgattgagaagatactaaacttttacaactga

SEQ ID NO: 43428 - protein, 387 aa, Cytophaga hutchinsonii
MKIDKAIPYGTQDITQQDIDAVIAVLHSKFLTQGPLVKEFEEKFAAYVGSSYAVAVTNGTAALHLSAMALGVNADSKVITTPITFSASANCIRYCGGEVVFADIDPETALLDINNVRAILEEHPKGTFSGIIPVDFAGYPVDMAAFRALADEHGLWILEDSCHAPGAYFTDKNNTKHFCGDGSLADLAIFSFHPVKHIATGEGGMITTNSEAQYKKLLKYRSHGMVYQGNSDLIENHGGWYMEMQELGYNYRLSDINAALGVSQLSRAQLGLQRRHEIAKRYDTAFAGTAIKTIPVKENVYHGLHLYIIQVENRKGLYDYLRANNIFAQVHYVPVHLMPYYQSLGSKKGDMPVAEKYYDHCLSIPMYPTLTDDEQVYVIEKILNFYN

SEQ ID NO: 43429 - DNA, 1107 bp, Cytophaga hutchinsonii
  CDS (1)..(1107)
atgcagaagcgtgtgtatctctcaccgccggatttgtccggcaatgaattccgatacatacaggaagcattagaatctaactggattgctccattcggcccccagttagattctttcacggaattattacaaacacaaacaggtacatcttttgcagtacctgttaattcaggtacttcagcgattcatttagcattgcttgcgttgcatattcaggaaggggatcttgttttttgtcctaccttcacatttgccgcaagtatttttcctgtgctgtatcaaagagctacccccgtatttattgatagcgaatcacattcatggaacatggatccggtattactggaacaggccattcttgattccatagaaaataaacagaaacccaaagcaattattctggttcatatttatggctttccggctatgctggatcagatacaggctattgctgctaaatatcatttataccttattgaagatgctgcagaagcgctgggctcttcctacaaaaataaagcacttggttcctttgggcatgcaggcgcgttatcttttaatggaaataaactggtaacaggcggaacgggtggtgctgttattacaaacgatgaagaactttttaatgaagtgcgtgtactggccaatcaagcgaaagaagaaaagccgtattacgaacacctgcaggtaggatacaattaccggatgtgtaatctaaatgctgctgttgcatgcgcgcagctggaacagcttggacaaaaaattaataaaaagaaacagatacgtgcgtggtatgcgatccatttatctggtgcagcaaatataaaacaggctgatgcaggtatcgataatgcctggctcacctgtgttgaatttgcatctgcggaatcgccggagaaagttcggctggccttggaagaagaaaatattgagagcaggaatgtgtggaatcccatgcacagacaacctgtttttaaggattgtacagcgtatctgaacggcgtttcggatgctgtatttgcgaacagcctgtgtctgccctcaggaacacaactgattgaaaaagatattattcacattactgatataattaagcgcagtctttaa

SEQ ID NO: 43430 - protein, 368 aa, Cytophaga hutchinsonii
MQKRVYLSPPDLSGNEFRYIQEALESNWIAPFGPQLDSFTELLQTQTGTSFAVPVNSGTSAIHLALLALHIQEGDLVFCPTFTFAASIFPVLYQRATPVFIDSESHSWNMDPVLLEQAILDSIENKQKPKAIILVHIYGFPAMLDQIQAIAAKYHLYLIEDAAEALGSSYKNKALGSFGHAGALSFNGNKLVTGGTGGAVITNDEELFNEVRVLANQAKEEKPYYEHLQVGYNYRMCNLNAAVACAQLEQLGQKINKKKQIRAWYAIHLSGAANIKQADAGIDNAWLTCVEFASAESPEKVRLALEEENIESRNVWNPMHRQPVFKDCTAYLNGVSDAVFANSLCLPSGTQLIEKDIIHITDIIKRSL

SEQ ID NO: 43431 - DNA, 1080 bp, Clostridium thermocellum ATCC 27405
  CDS (1)..(1080)
atgagtgacgaaggatatgaaaaacaatatattaatgaggcatttgagactaattggattgcaccgctgggaaaaaacgttgacgaatttgaaaaggagctggcagcaaaagtaggaataaaagccgctgcagcgttatcatcgggcacagccgccattcatatggcgctaaaggctgccggagtaggtgagggggatattgtgttttgcccgacacttacttttgcagctaccgccaatccaataatatatcagaatgcaataccggtgttcatcgacagcgattatgagacttggaatatgagccctgaagctttggaagaggcttttaaaaaatatccaaaggtgaaggctgtgctggtagtgcatctttacggattatcagccgatatggataaaatagttgagatatgcaaaaaacatgatgttcaacttattgaagatgctgctgaatctttgggtaccacttataaaggcagatatacaggtactattggggactatggcatttattccttcaacggcaacaagattattactacttccggcggcggtatgttagtgtcggataatgaagagagaattgcgaaagtaagattttgggcaactcaggcaagggacaatgccagacactatcagcacagcgaactgggttataactacaggatgagcaatgtaattgccggaattggcagagggcagttaaaagttttggatcagagaatagagaaaaaaaggtatatatttgatttttataaaagggaattgggctgcattgatgaaattgattttatgcctgtcaatgactggaataaacccaactgctggcttacctgcattacattgacgggcaaagtcagacctttggatgtgataataaggctggaagaggaaaatatagagtcaagaccagtatggaagcccatgcatatgcagccgttttatcaacattatgattacattggctcaaatgtttcggagaagatatttgaaaacggtgtttgtctgcctagcgataccaaaatgacggatgaggatctatacagagttgtaaatattataaaagggttgtggaaatag

SEQ ID NO: 43432 - protein, 359 aa, Clostridium thermocellum ATCC 27405
MSDEGYEKQYINEAFETNWIAPLGKNVDEFEKELAAKVGIKAAAALSSGTAAIHMALKAAGVGEGDIVFCPTLTFAATANPIIYQNAIPVFIDSDYETWNMSPEALEEAFKKYPKVKAVLVVHLYGLSADMDKIVEICKKHDVQLIEDAAESLGTTYKGRYTGTIGDYGIYSFNGNKIITTSGGGMLVSDNEERIAKVRFWATQARDNARHYQHSELGYNYRMSNVIAGIGRGQLKVLDQRIEKKRYIFDFYKRELGCIDEIDFMPVNDWNKPNCWLTCITLTGKVRPLDVIIRLEEENIESRPVWKPMHMQPFYQHYDYIGSNVSEKIFENGVCLPSDTKMTDEDLYRVVNIIKGLWK

SEQ ID NO: 43433 - DNA, 1170 bp, Clostridium thermocellum ATCC 27405
  CDS (1)..(1170)
atggagaaaagtgcggagcagaaattcataccttacgggtgccaatggattgaggaagatgatattaatgccgtggttgaggtattaagaggagattatctgaccacgggccccaaagtaaaggaatttgaagaaaatctggcacggtataccggtgcaaagtatgctgttgccgtgtccaacggtactgcggcacttcatgcggcatgttttgccgccggaataaaagagggggacgaagtaatcacaactcccattacttttgccgcttctgccaactgcttgctgtatatgggggcaaagcccgtttttgccgatattgatcctgatacatacaacattgatccgaaagaaatcagggccaggattaccgaaaaaaccaaggcaataataccggtgcattttaccggccagccctgtgatatggatgaaatattgaaaattgcagaagaatacaatcttttggtgatagaggacggagcccatgccctcggagcggaatataaaggcagaaaaatcggaagtcttggagatatgaccacctttagttttcatccggtaaagcatattacgaccggtgaaggcggcgcaattgtgacaaacagcgaagaattgtataaaaaactcactcttttcaggacgcatggaataacgagggaaacgggagatttattggagaaccatggcccgtggtattatgagcagcagtatttgggctataattacagaatgaccgatattcaggctgcattgggcataagtcagctaaaaaaatccgataaattcctgcaattaagaagagattatgcaaagctctacactgaagcttttaagtccgttgatgaggtggttgtgccgtaccagcttgacggtacagactcctcatggcatttgtatatcttaaagttgaaaacggaaaggcttaattgtgacagaaagaagatatttgaggagcttaaggaaagacggataggagtaaatgtccactacattcctgtgtattaccatccgttttacagaaaactgggatataaaaaaggtttgtgtcctaatgctgaagatttttatgaaagaataataacccttccgctgtttcctaagatggaaaaggaagatattctgtatgtaatttccaatgttaaggacgtaattcaaaaacatatcatatag

SEQ ID NO: 43434 - protein, 389 aa, Clostridium thermocellum ATCC 27405
MEKSAEQKFIPYGCQWIEEDDINAVVEVLRGDYLTTGPKVKEFEENLARYTGAKYAVAVSNGTAALHAACFAAGIKEGDEVITTPITFAASANCLLYMGAKPVFADIDPDTYNIDPKEIRARITEKTKAIIPVHFTGQPCDMDEILKIAEEYNLLVIEDGAHALGAEYKGRKIGSLGDMTTFSFHPVKHITTGEGGAIVTNSEELYKKLTLFRTHGITRETGDLLENHGPWYYEQQYLGYNYRMTDIQAALGISQLKKSDKFLQLRRDYAKLYTEAFKSVDEVVVPYQLDGTDSSWHLYILKLKTERLNCDRKKIFEELKERRIGVNVHYIPVYYHPFYRKLGYKKGLCPNAEDFYERIITLPLFPKMEKEDILYVISNVKDVIQKHII

SEQ ID NO: 43435 - DNA, 1137 bp, Microbulbifer degradans 2-40
  CDS (1)..(1137)
atgatgaaaacgataaaatttaatgagccttttttagcgggcaacgagttgaaatacttaaaagatgtttttcgacaagatcatttttatgggaatggtaagtatacaagattgtgcgccgaatttattcgaaaaaagctaagtgtagaaaatgttttgattaccgatagttgtacatctgcacttgagattgcggcgctgttaatgagagaaacaggtcaggagcaagaaattattttaccatcttatactttttcttccactgcttctgcatttgcgagggctgggtttaagttggtttttgcagaaatagatccgaaaacaatgatgatggatgttcgagatgtaagagaaaagtttactcaaaatacagcagcagtagttgtagtgcattatggtggttattgtgcagaagttaatgagtttagagcgctttgtgatgcaaatgaagtctacctcgtcgaagatgctgcgcaggcatttaattgctttttaaacaataaggcgctcggcacaataggtgattttggttgcttttcgttccatgagacaaaaaatgttcacgcaggcttatctggtgcattaattataaaagacaatagttttgttaatagagctacatatatatgggagcgtggaacaaataggcaggatgttttgaaggggcttgcaaacaaatattcttgggttgaaataggtggtagcttttatcctacggaattacaaactgcttttttgtacgctcaactggaagcgctcgaaagaaatatagaagaaaggaaagtgatttatgatgaatataaaataggtttggctcctttaaagttagccggtgtggtgtattacccagaatttcatgttgattataaatctaattatcatgcattttttgtggtttttaatagtgaaagtaaagcagatcaggttcgagagttcttaagggcaagaaatgttcatgcctatattgggtatattccactgcattcttcaccagtggggttgaaaatggggtatgaaattaactccttgccaataacagagaaatattcaaagcgagtgctccgcttaccattgcataataagttgacgcttactcaagttgcaggaatagttgacttaataaaaggatgtatttag

SEQ ID NO: 43436 - protein, 378 aa, Microbulbifer degradans 2-40
MMKTIKFNEPFLAGNELKYLKDVFRQDHFYGNGKYTRLCAEFIRKKLSVENVLITDSCTSALEIAALLMRETGQEQEIILPSYTFSSTASAFARAGFKLVFAEIDPKTMMMDVRDVREKFTQNTAAVVVVHYGGYCAEVNEFRALCDANEVYLVEDAAQAFNCFLNNKALGTIGDFGCFSFHETKNVHAGLSGALIIKDNSFVNRATYIWERGTNRQDVLKGLANKYSWVEIGGSFYPTELQTAFLYAQLEALERNIEERKVIYDEYKIGLAPLKLAGVVYYPEFHVDYKSNYHAFFVVFNSESKADQVREFLRARNVHAYIGYIPLHSSPVGLKMGYEINSLPITEKYSKRVLRLPLHNKLTLTQVAGIVDLIKGCI

SEQ ID NO: 43437 - DNA, 1182 bp, Trichodesmium erythraeum IMS101
  CDS (1)..(1182)
atggctaatgttccccccctagatttaacacaacagtatgaaataatcaaagaacaagtaaatactagagttcaagaggtacttagctctggtcgttatattggcggttctattgttgatgagtttgaacaagaatttgctaaatacatagatgtatctcattgtgtatcctgtaactctggcactgatgctctgtttctagctttacgagctatgaatattgggcttggggatgaagtaattactactcctttcactttttttgctactgctgaagtcattagtgcagtaggagcaactccaatttttattgacattgacccccagacttttaacttagatcttcaaaaacttgagctagcgataactgaaaaaacaaaagctattttgccagtacatttatttggtcaacctttagatatgacacagttaatggcgatcgctcgtgcccacaatttaatagttattgaagactgtgcccaagctacaggagcagaatggcaccagaaaaaagtcgggagttttggtgatgttggttgttttagtttttttcctactaaaaatttaggagcttttggagatgggggagctctgaccacaaataatgcagcgatcgcttctcaagcgcgaatactaaaaaatcatggacagtctgccaaatatttttctcaagacattggtattaacagtcgtctagataccatacaagctgcaattctgcaaataaaattaccattattagatagttggaacgaacaacgtcgtaaattagcaaatcattaccataaattttttagtactataactgctgtagttcctcctcaagagttatctggaagtagatgtgtttggaatcaatacacaattatgcttaaaagtaaacagttagaaactacgacaaaatctcatttttctaattatttgcgtgatttagttcatgataatttacaaaataggggaataggttcagcggtttactatcctacacctttacatttacaacctgtttacaaatctttggtaaactatcaattgccagtagtagaacaagtgtgccatcaggttttgtccttgcctatttttcctgaactttccactccacaacaagagcaagttatatatgctttgaaagattgtttgcaagaactaatgccgaatccaccaagaagtcataaattataa

SEQ ID NO: 43438 - protein, 393 aa, Trichodesmium erythraeum IMS101
MANVPPLDLTQQYEIIKEQVNTRVQEVLSSGRYIGGSIVDEFEQEFAKYIDVSHCVSCNSGTDALFLALRAMNIGLGDEVITTPFTFFATAEVISAVGATPIFIDIDPQTFNLDLQKLELAITEKTKAILPVHLFGQPLDMTQLMAIARAHNLIVIEDCAQATGAEWHQKKVGSFGDVGCFSFFPTKNLGAFGDGGALTTNNAAIASQARILKNHGQSAKYFSQDIGINSRLDTIQAAILQIKLPLLDSWNEQRRKLANHYHKFFSTITAVVPPQELSGSRCVWNQYTIMLKSKQLETTTKSHFSNYLRDLVHDNLQNRGIGSAVYYPTPLHLQPVYKSLVNYQLPVVEQVCHQVLSLPIFPELSTPQQEQVIYALKDCLQELMPNPPRSHKL

SEQ ID NO: 43439 - DNA, 1353 bp, Trichodesmium erythraeum IMS101
  CDS (1)..(1353)
atggaagctgaaaatctcaaagtgcagattttagaattggttaaaaaatattaccaaacagctcatcaaaagtctggttttgaaccaggaaaaagtcgaattaactactcaggaagggtttatgacgatcaagaattggtcaatttagtagattcttctctggatttttggttgaccgcagggccttatggaaacaaatttgagtctaaaatgcgcgattttttcagcagtagagactttttgcttgtcaattctggttcatcggctaatctactaatggtaagcactatttgttcacctgaattaaaatcccaaaaggatactcagttacaacctttagaaccaggtgatgaagttattactccggctgtaacttttcctactactttagcccctatcattcaaaaccgcttaatacctgtttttgtggattgcgaggtgggcacttacaatattaatccccatcttattgaggatgctgttgggcctcggacaaaagccatttttattcctcatactgtcggtaatccttgcaatatggagattattatggatgtagctaaacgtcacaatctatgggtattagaagatagctgtgatgctttaggggcaacttttgatggtactttggtgggtacttttgggcaaatggcttccttgagcttttatccagcgcaccacatgacaatgggtgaaggaggagccgttattgttaatcaagctagtctgaaaaaaacggtactctctttacgggactggggtagaagttgttggtgtcctccagggatatctgatagttgtagcaaaaggtttaattgggaattgggcgaactaccatttgggtacgatcataaatacatttattctaacattggctataacttgaaagttactgatatgcaggcggctattggtattgctcaaaaggagaaggttgaagggttcattgaaaaaaggcgtcataatttttggcgactgtatgaaggcttaaaatctctcgaagagtacctaattttacctaaaattgattctagggctaacccttcaccatttggttttcctattactgtgaaggaaggaataaatcgtcgcgagctagttcaacatttggaagctcatcagattgaaactaggttggtttttggaggtaatatactaaaacaacctggatttatgaatattgaacgtagagttcacggtactttggaagaatcagatataattatgaatcgcacgctttttactggtgtgtttcctggattaactgatgaaatgatagattatgtcattgagcaatttactgttttctttaaaaaagatcctgttaattcatcggttactcttttgtcataa

SEQ ID NO: 43440 - protein, 450 aa, Trichodesmium erythraeum IMS101
MEAENLKVQILELVKKYYQTAHQKSGFEPGKSRINYSGRVYDDQELVNLVDSSLDFWLTAGPYGNKFESKMRDFFSSRDFLLVNSGSSANLLMVSTICSPELKSQKDTQLQPLEPGDEVITPAVTFPTTLAPIIQNRLIPVFVDCEVGTYNINPHLIEDAVGPRTKAIFIPHTVGNPCNMEIIMDVAKRHNLWVLEDSCDALGATFDGTLVGTFGQMASLSFYPAHHMTMGEGGAVIVNQASLKKTVLSLRDWGRSCWCPPGISDSCSKRFNWELGELPFGYDHKYIYSNIGYNLKVTDMQAAIGIAQKEKVEGFIEKRRHNFWRLYEGLKSLEEYLILPKIDSRANPSPFGFPITVKEGINRRELVQHLEAHQIETRLVFGGNILKQPGFMNIERRVHGTLEESDIIMNRTLFTGVFPGLTDEMIDYVIEQFTVFFKKDPVNSSVTLLS

SEQ ID NO: 43441 - DNA, 1134 bp, Trichodesmium erythraeum IMS101
  CDS (1)..(1134)
atgctaaaaaatattcctttcattgacctaaaattacaacatcaaccactagaaagtgagttcaaaaaatcaattcaggaagtattagaaagaggagactttatacttggtcaagcagtggcaaagtttgaatcctcatttgctacaacttgtggagttgaaaatgctattggagttgcttgtggcacagatgctatagcacttggacttcaagcttgtggtgttagtgcaggagatgaggtaattttaccagctaatacatttattgctactttaataggtgtacttcatactggtgcgaccccagtgctagtagactgcgatgaggaaacagcattaattgatttagaaattgctcaaaaagctgtcacaaacaaaactaaggtaatattgccagtacatctttatggtcaaatggtagctcccagtaaattactagactttgctcaagctaataagctcattatatttgaggatgcagctcaggctcatttggctcaaagagaaggatatcgtgctggaagtattggaactgctgctgcatttagcttttatcctagtaaaaatttaggttgttttggggatggaggtatggtcgttactagtgaccaaaaggtagcaagtaaaatgcgaatgcttcgtaattatggtgctcctcgtaaatatgtctatgaggaattaggtactaatagtagattagatactttacaagcagcagtactaaatgttaagcttccttacttgaaaggttggaatagcgatcgcaaccaagcagctcaaaaatacgataccctcctcagtccgatgaaagagaaaggtattattccgatacagaatttgagtggtactgggcatatttatcatttatatgtgattcgaattactgacaagtctccaatagaccgcgatactctgaaagataaattaggagtagcaggaatttctgttggtatccattaccctataccctgtcatctccaaccagcttatcaacacttaggctataaaaaaggagattttcctaacagtgaaactctgagtcaacagattttatctttacctatgtatcctgtaattagtgaagaacaaattaatcttgttgttgagacaattattcaaattatcagtcagtaa

SEQ ID NO: 43442 - protein, 377 aa, Trichodesmium erythraeum IMS101
MLKNIPFIDLKLQHQPLESEFKKSIQEVLERGDFILGQAVAKFESSFATTCGVENAIGVACGTDAIALGLQACGVSAGDEVILPANTFIATLIGVLHTGATPVLVDCDEETALIDLEIAQKAVTNKTKVILPVHLYGQMVAPSKLLDFAQANKLIIFEDAAQAHLAQREGYRAGSIGTAAAFSFYPSKNLGCFGDGGMVVTSDQKVASKMRMLRNYGAPRKYVYEELGTNSRLDTLQAAVLNVKLPYLKGWNSDRNQAAQKYDTLLSPMKEKGIIPIQNLSGTGHIYHLYVIRITDKSPIDRDTLKDKLGVAGISVGIHYPIPCHLQPAYQHLGYKKGDFPNSETLSQQILSLPMYPVISEEQINLVVETIIQIISQ

SEQ ID NO: 43443 - DNA, 1155 bp, Desulfovibrio desulfuricans G20
  CDS (1)..(1155)
atgagcgattccaaccgtcacaacgccccgttgcgcctttcccgttccgtggtgggcagggaggaggccgaggccgtcacccgcatcatcatggaagaaggctatctgggcatgggggccgaggttcagcgccttgaagcggaaattgccgcctatctgggtgtggctgccgccaatgtaagctgcgtgaacaccggcaccgccgcgttgcaccttgccgtgcaggctgccgtgccgcagggcggcgaggtgctggtccagtccgtcacctatgtggcttcttttcaggccatacgcgccgccggagcggttcccgtggcctgcgaggctctgcccgcaagcgtgaccattgatctggacgacgccgcccgccgtctgacgccgcgcaccagagccatcatgccggtgcactatgcaggctatgcgggagatctggatgccgtatacgcctttgcggacagacacgggctgcgcgtcatcgaagacgccgcccatgctttcggcagcagccacagaggacggctcatcgggtcattcggcgatattgtgtgcttcagctttgacggtatcaaaaacatcacctgcggcgaaggcggcgccattgtcagcgcagaccccgccgttaacgccgcggtaaaagacgcccggctgctgggggtcgaacgggacacggaaaaacggttcgccggtcagcgcagctggaattttgatgtgacggcgcaaggctggcggtatcatatgagcaacatcatggccgccatcggcagagtgcagctgcgccgcctgccgcaggagttcgctccggcccgccgcagactgagcgccctgtacagggaactgctgcaggatacccccggggtggccctgctggagaccgatgccgaaggcacggtgccgcacatcatggccgtgcgcatcaccgacggccgccgtgacaccctgcgcggactgctggacggcgaaggcctgaccacaggtctgcattaccgccccaaccacctgcacaccctgttcggaggcgcaagccggtcgctgcccgtcagtgaacggctggaaaaggaactgctcaccctgccgctgcatccggccctttccgaggatgacgtacgcgccgtatgcacgcggctgcgcacattcatgcaggagaaccgctga

SEQ ID NO: 43444 - protein, 384 aa, Desulfovibrio desulfuricans G20
MSDSNRHNAPLRLSRSVVGREEAEAVTRIIMEEGYLGMGAEVQRLEAEIAAYLGVAAANVSCVNTGTAALHLAVQAAVPQGGEVLVQSVTYVASFQAIRAAGAVPVACEALPASVTIDLDDAARRLTPRTRAIMPVHYAGYAGDLDAVYAFADRHGLRVIEDAAHAFGSSHRGRLIGSFGDIVCFSFDGIKNITCGEGGAIVSADPAVNAAVKDARLLGVERDTEKRFAGQRSWNFDVTAQGWRYHMSNIMAAIGRVQLRRLPQEFAPARRRLSALYRELLQDTPGVALLETDAEGTVPHIMAVRITDGRRDTLRGLLDGEGLTTGLHYRPNHLHTLFGGASRSLPVSERLEKELLTLPLHPALSEDDVRAVCTRLRTFMQENR

SEQ ID NO: 43445 - DNA, 1146 bp, Actinobacillus pleuropneumoniae serovar 1 str. 4074
  CDS (1)..(1146)
atgcaaattccttttaataaaccgccgattgtcggtacggaactcggttatatgcaacaagcgatggcaagcgggaaattatccggcgacggcttttatagccggcgttgcgagcggtggctggaaaatcaattcggtacggcaaaagcattgcttacgccgtcttgtaccgctgcattggaaatggcggcgatattaatcgatattcaagccggcgatgaagtgattatgccgagttatacctttgtttcgaccgctaacgcatttgtgttgcgtggagcaaagattgtgtttgtcgatattcgtcccgatacgatgaatattgatgaaacgaaaattgaagcggcgattacaccgaaaaccaaagcgattgtgccggtacattacgccggtatcgcctgtgaaatggatacgattatggcaatagccgaaaaatatcggttgtatgtgatcgaagatgcggcgcaagcggtaatgtcctcttacaaaggtaaagcattaggcactattgggcatttcggctgttatagttttcacgaaactaagaattatagtgccggcggcgaaggcggtgctttattgattaatgatgatcgatttattgctcgtgcggaagtgatccgagaaaaaggcacaaatcgtagtcaattctttcgtggtgaaacggataaatacacttggcgagatctcggatccagttttttaatgtcggaattacaagcggcctatttatatgcacaattggaagtcgcacaacaaatcaagcagacccgtttagccgtttggcaacactattttgaagtcttacgtccgtttgccgaacaaggtcgtcttgagttaccgacttgcccgcccgaatgtgaacaaaacggccatctgttttatctgaaatggcgcaattcggatgaacgcaatgactttatcgaacggctaaaacaacacggaattttagcggtatttcattatgtgccgttacatagcagccctgccggtcagcggttcggctcgtttatcggcgaagaccgttttactacttcggaaagcgaacgcttggtgcgtttaccgctattttataatttacaaccgcaagaatcggataaaattattcgggttatattggaatttctacatcaatgcaatcattga

SEQ ID NO: 43446 - protein, 381 aa, Actinobacillus pleuropneumoniae serovar 1 str. 4074
MQIPFNKPPIVGTELGYMQQAMASGKLSGDGFYSRRCERWLENQFGTAKALLTPSCTAALEMAAILIDIQAGDEVIMPSYTFVSTANAFVLRGAKIVFVDIRPDTMNIDETKIEAAITPKTKAIVPVHYAGIACEMDTIMAIAEKYRLYVIEDAAQAVMSSYKGKALGTIGHFGCYSFHETKNYSAGGEGGALLINDDRFIARAEVIREKGTNRSQFFRGETDKYTWRDLGSSFLMSELQAAYLYAQLEVAQQIKQTRLAVWQHYFEVLRPFAEQGRLELPTCPPECEQNGHLFYLKWRNSDERNDFIERLKQHGILAVFHYVPLHSSPAGQRFGSFIGEDRFTTSESERLVRLPLFYNLQPQESDKIIRVILEFLHQCNH

SEQ ID NO: 43447 - DNA, 1155 bp, Chloroflexus aurantiacus
  CDS (1)..(1155)
atgtcagcaccggatattaccgaggccgagatacaggcagtacagcaggtactgcataccagttatctgagcattggcccacaaatcaaggcgtttgaacaggcaatggccgattatgttggactaccgcacgcggtgggcgtcaattccggtaccagtggattgcatctgtgctgtattgcaaccggtgcccgtgatggcgacctggtcattacaacacccttctcatttatcgcctcggccaatagcattctttacgagcgagcaattccaatcttcgttgatgttgatccggttaccggaaacatcgatccacagcttgtggctgaggctgcatctgatctcatgcgcggtggcactgctgcccggcgctggctgcctcggcgtcacaacacgctcggtatacttagagcgatcatgccggttcacgcctttgggcaacccgccgatatggatccgatcaatgccgtagctgccgaatatggactacacgttatcgaagatgcctgtgaagcgattgggtcaatgtacaaagggcgtatggcgggcaccctcagcgatgccgccgtctttgccttttacccaaataagcagatgacaaccggcgaaggcggaatgattgttacccaccgtgatgattgggccagcctgttccgctcactccgcaaccaggggcgcgatgtctttgatgcctggctcaaccacactcgtctgggctacaactatcgcctcgacgaaatgagtgcagcgttgggagttgtgcagctacagcggatcgaggaacttatcgcccgtcgtgcgcaggtggccgcctggtacaacgaacaactggccgacctcgaactggtcgaacgcccgcaactaagcccacataccacccggatgagctggtttgtgtatgtgatccgtattttgccacccgccgaccgcaatacggttatgcgccggctggcagatgccggtattccgagccgtccgtacttcacaccgatccacctccaacccttctatcgagaacagttcgggtaccaaccgggtgattttccggtcacggagcggcttggtaacctttcgctggcattgcccttctccagcgtgatgcgtgaagagcaggtcactgaagttgttcatcatctgcgtgctgcactgcaatga

SEQ ID NO: 43448 - protein, 384 aa, Chloroflexus aurantiacus
MSAPDITEAEIQAVQQVLHTSYLSIGPQIKAFEQAMADYVGLPHAVGVNSGTSGLHLCCIATGARDGDLVITTPFSFIASANSILYERAIPIFVDVDPVTGNIDPQLVAEAASDLMRGGTAARRWLPRRHNTLGILRAIMPVHAFGQPADMDPINAVAAEYGLHVIEDACEAIGSMYKGRMAGTLSDAAVFAFYPNKQMTTGEGGMIVTHRDDWASLFRSLRNQGRDVFDAWLNHTRLGYNYRLDEMSAALGVVQLQRIEELIARRAQVAAWYNEQLADLELVERPQLSPHTTRMSWFVYVIRILPPADRNTVMRRLADAGIPSRPYFTPIHLQPFYREQFGYQPGDFPVTERLGNLSLALPFSSVMREEQVTEVVHHLRAALQ

SEQ ID NO: 43449 - DNA, 1158 bp, Chloroflexus aurantiacus
  CDS (1)..(1158)
atgacgacaacggcaaagcggcatattccgctcaccaaaccggtgatggggcaggcagaagctgaggcagcccaacgagtgattttatcgggatggattacccagggtcctgaagtcgctgccttcgagcaagagtttgcggcttacaccggtgctgcctacgcggtggcggtatcaaattgtacgaccgcccttcatctcgctttgctggccgtaggcgtgggtccgggcgatgaggttatcacagttagtcattcctacattgccaccgcgaacagtgttcgctactgtggtgctgaaccggtcttcgttgatattgatccggcaacccacaatatggatccggccttcatcgaggctgcaattacgtcacgcacgaaagccattttaaccgtacatcagatggggatgccggccgatctggaacggatcctggcgattgctaatgcgtatcaactgcctgtgatcgaagatgctgcctgcgcgatagggagcgagatttggtggggtgagcgctgggaacgcatagggaagccgcacggcgtgattgcctgcttctcgtttcacccgcgtaaagtcctgagtaccggtgatggtgggatgttgacgaccaacaatcctgagtatgccgagcagtttcgtttactccgccaacacgggatgagcgtcaatgatcgggtgcgtcatctggctaatcaggtaatcttcgaggaatacaatgttgttgggtataactaccgcatgaccgatattcaggctgcggttggccgcgaacagttgcggcgtttacccgaaattatcgctgtacgccgccggttggccgaccagtatgccagcttgttacgttcaattccaggggtgggtataccggtggaaccaccgtatgcacgaaccaactggcaaagctacccaatctatctgccggaaggatgcgatcagcgtactgttatgcaatatatgctcgatcacggcattgccacccggcgcggcatcatgtgtgcgcatcgcgaaaaaccgtattggcggcgggaagggtaccatttaccacaatcggaatatgcccaggatcgtagcatcctgttgcccttctacccgcagatgactgcggatgagcaggagtatgtggttgcgacgctggcagcagcctgtacagcgtaa

SEQ ID NO: 43450 - protein, 385 aa, Chloroflexus aurantiacus
MTTTAKRHIPLTKPVMGQAEAEAAQRVILSGWITQGPEVAAFEQEFAAYTGAAYAVAVSNCTTALHLALLAVGVGPGDEVITVSHSYIATANSVRYCGAEPVFVDIDPATHNMDPAFIEAAITSRTKAILTVHQMGMPADLERILAIANAYQLPVIEDAACAIGSEIWWGERWERIGKPHGVIACFSFHPRKVLSTGDGGMLTTNNPEYAEQFRLLRQHGMSVNDRVRHLANQVIFEEYNVVGYNYRMTDIQAAVGREQLRRLPEIIAVRRRLADQYASLLRSIPGVGIPVEPPYARTNWQSYPIYLPEGCDQRTVMQYMLDHGIATRRGIMCAHREKPYWRREGYHLPQSEYAQDRSILLPFYPQMTADEQEYVVATLAAACTA

SEQ ID NO: 43451 - DNA, 1116 bp, Chloroflexus aurantiacus
  CDS (1)..(1116)
atgatcccgtttgtggatttgaaagcccaatatctctcgatcaaagaagagattgatcgagcggttctggatacgctggccagtactcagtttgtgttaggaaaagaggtcgtcgcatttgaagagttatttgctgcttacacgcagtctcagtatgcgttgggtgtgaattccggtaccagtgcgctgcatctggccttgctggcctgtggtgttggtcctggagacgaggtcattacgacaccacacacctttatcgcgaccgtttcggcgatagactacactggtgcgcgaccagtgtttgtcgatatcgatccggtgacgtttaccgtcaatccggcgctcattgaagcggccatcactccgcgcacaaaagcgattattccggtgcacctctacggtcagccagccgatatggatccgatcatggcaattgcccgcaagcacaatctggtggtgatcgaagacgcagcgcaggctcacggtgcagagtataaagggcgccgggtcgggagtattggtgatgcaggttgttttagcttctatcccggtaagaatttgggggcgtatggcgaaggtggggcagtgaccaccaataaccctgaaattgcccgcactgtgcggatgctccgtgattggggagccgagcggcgttaccaccacgatctcaaaggattcaactatcgaatggaaggtgttcagggtgccatcctgcgggtgaagatggcgtatatcgaacactggacagagctgcggcgagcggcagcggcacgttacgatgcaatgctggccccacttgggatacaaactccggtagcactccctgatcgtcgtcatgtctatcatatctatgctattcgcgaccggcagcgtgatgcgctgcaaacctatcttcacgatcatggggtaagtaccggtatccattatccaatcccggttcacctgcaaaaggcgtttgctgatttgggttatcgagtcggtgatttcccgcaggccgagctggcggctgccgaggtcttgtcgctcccaatgtttcctgagttgactgttgatcaacaacaggttgtggctgaagcattgcagggatggatgcagcaggttgctgccggttgctag

SEQ ID NO: 43452 - protein, 371 aa, Chloroflexus aurantiacus
MIPFVDLKAQYLSIKEEIDRAVLDTLASTQFVLGKEVVAFEELFAAYTQSQYALGVNSGTSALHLALLACGVGPGDEVITTPHTFIATVSAIDYTGARPVFVDIDPVTFTVNPALIEAAITPRTKAIIPVHLYGQPADMDPIMAIARKHNLVVIEDAAQAHGAEYKGRRVGSIGDAGCFSFYPGKNLGAYGEGGAVTTNNPEIARTVRMLRDWGAERRYHHDLKGFNYRMEGVQGAILRVKMAYIEHWTELRRAAAARYDAMLAPLGIQTPVALPDRRHVYHIYAIRDRQRDALQTYLHDHGVSTGIHYPIPVHLQKAFADLGYRVGDFPQAELAAAEVLSLPMFPELTVDQQQVVAEALQGWMQQVAAGC

SEQ ID NO: 43453 - DNA, 1083 bp, Campylobacter lari RM2100
  CDS (1)..(1083)
atgaaaattccttttatagacttaaacgctcaatataatgcttataaaaatgaaatcgatgaggctattagtgaagttttacaaaacacttctttcataggtggtgcaaaattagaagaatttgaaaacaatttagctaaatatgtaggtattaaacacgcaataggttgttcaagcggcacaagtgctttatttttagccttgatggctttgggtgtgagtagagatgatgaggtaatagtgccaagttttacctttatagctacagctgaaatagttgctctaatcggcgctaaacctgtttttgtagatattgattttaaagattataatcttagtttagaaaaaattcaaagcgccatcacgcctaaaactaaggctgttattgctgtgagtatttttgggcttatgcctgatatgtttgctttaaaagaactttgtaaaagtcaaaatattgctttgatagaagatggtgcacaaagttttggagctagtcaaaaaggcataaaatcatgtgctatagttgatatatcttgcacaagctttttcccatctaagcctttaggtgcttatggagatggcggggcgatttttacccaagatgatgaattagcgcaaaaaataaaaatttatttaaatcatggacaagtacaaagatataagcataaatacatcggtattaatggaaggcttgataccatccaagcagctattttgaatgtgaaattacaatacttagatgaagagattaaaaaaagagaagtagtggcaaaaatttatgatgaaaatttgaaaaattgcataattccgcctagaaaagaagggtttagcagtgcttgggctcaatatagcgtgcgtgtaaaaaatagagaaaaaatcatgcaaaaattacaagataataacattccatgtgctgtgcattatcctttggggcttcatttgcaagaagcttttgcttatcttgcttataaaaaaggagatttgccaaatacagaactcttaagtgatgaaattttatctttgcctatgagtgcatttttaaaagaagagcaccaagctagagtgattgaggtttttaaatga

SEQ ID NO: 43454 - protein, 360 aa, Campylobacter lari RM2100
MKIPFIDLNAQYNAYKNEIDEAISEVLQNTSFIGGAKLEEFENNLAKYVGIKHAIGCSSGTSALFLALMALGVSRDDEVIVPSFTFIATAEIVALIGAKPVFVDIDFKDYNLSLEKIQSAITPKTKAVIAVSIFGLMPDMFALKELCKSQNIALIEDGAQSFGASQKGIKSCAIVDISCTSFFPSKPLGAYGDGGAIFTQDDELAQKIKIYLNHGQVQRYKHKYIGINGRLDTIQAAILNVKLQYLDEEIKKREVVAKIYDENLKNCIIPPRKEGFSSAWAQYSVRVKNREKIMQKLQDNNIPCAVHYPLGLHLQEAFAYLAYKKGDLPNTELLSDEILSLPMSAFLKEEHQARVIEVFK

SEQ ID NO: 43455 - DNA, 1131 bp, Campylobacter lari RM2100
  CDS (1)..(1131)
atgataacttattctcatcaaaatatcgacgaaaaagacatacgagtagtttgtgaggctttaaaagatgattttttaaccggtggaaaaaaagttgaagaatttgagcaagctctttgtgaatatgtgggtgtaaaatatgcttgtgtgctaaattcagccacttctgcattgcatcttgcatatttatctttaaatgttaaagataaaattgttttaacaaccccaataacctttgctgcaactgcaaatgctgctttaatggcaggtgctagagttgagttcatagatgtaaaaagcgatgggaatattgatgaaaaaaaacttgctttaagattaagccaagatggctctaatataggggcaatttgcgtggttgattttgcgggaaatagcgtagaaatggatgaaatcttagccctagctaaacaataccatatcccactaattgatgatgcaagtcatgctctaggtgctatttataaagatcaaaaagtaggttctatggcagatttaagcatattttcttttcatccggttaaacctatcacgacctttgaaggtggtgcggttgttagtaatgatgaggaattaatctcaaaaataaagcttttaagaagtcatggcatagtcaaaaaaagactttgggatagtgatatgatcgatttagggtataattatcgcttaagtgatgtagcttgtgctttaggtgtaaatcaacttaaaaaacttgataatatgctagaaaaaagagaacaaataactaaattttacgatagagaatttgaaaaaaatccttattttagcactataaaaatcaaagattataaaaaaagctcaagacatttatatcccattttactttttcctgagttttattgccaaaaagagattatttttgaaaaattattaaatttgggcataggtgtacaagtgcattacaaacctacttatgaatttagttattataaaaacctatatggaaatttattcttagaaaatgcggataatttttacaaagccgagcttagcataccggctcatcaagaaatgagcttaaaagaagcacaatttattaaagatagtttatttaagattttagaagaaactaaaaagggatgttgtgagtaa

SEQ ID NO: 43456 - protein, 376 aa, Campylobacter lari RM2100
MITYSHQNIDEKDIRVVCEALKDDFLTGGKKVEEFEQALCEYVGVKYACVLNSATSALHLAYLSLNVKDKIVLTTPITFAATANAALMAGARVEFIDVKSDGNIDEKKLALRLSQDGSNIGAICVVDFAGNSVEMDEILALAKQYHIPLIDDASHALGAIYKDQKVGSMADLSIFSFHPVKPITTFEGGAVVSNDEELISKIKLLRSHGIVKKRLWDSDMIDLGYNYRLSDVACALGVNQLKKLDNMLEKREQITKFYDREFEKNPYFSTIKIKDYKKSSRHLYPILLFPEFYCQKEIIFEKLLNLGIGVQVHYKPTYEFSYYKNLYGNLFLENADNFYKAELSIPAHQEMSLKEAQFIKDSLFKILEETKKGCCE

SEQ ID NO: 43457 - DNA, 1161 bp, Campylobacter lari RM2100
  CDS (1)..(1161)
atgagattttttttatcagcaccgcatatgagcggaaaagaattagaatacatacacaaagcttttgaaagtaattacatagcacctttgggtgaatttgtaaatgctttagaacaaagtataaaagattacacaaaaagctctaatgcacttgcgctaaatgcagctactgcagccattcatctagctttaagagttttaggtattaaagaaggtgatgtggtattagcttcaagttttacttttatagcttcagttgcaccaatttcttatatgaatgctacgcctgtttttattgattgtgatgaaacttataatttagatgtaaatttattaaaaaaagctatcaaagaaagtcctaaaaagccaaaagctctcattttaacacacctttatggtaatgcttctaaaatggatgagattgttcaaatttgtaaagaaaatgagatttttttaatcgaagatgcagcagaagcgttgggaagcttttataaaaataaagctttaggcacttttggagattttggagtgtattcatttaatggtaataaaatcatcacaacaggtggtggtggaatgcttgtgagcgaaaatcatgctaatcttgaaaaagcaagattttatagcactcaagctagagaaaattgccttcattatgagcataaagaatatggctataattatagaatgagcaatatcttaggtgcaatcggcactgctcaaatggaggttttagatcaaagagtagaaaaaaagcgtcaaatttatgattggtataaagagtttttaagtaaaagttttacctttttagatgagcttgaaaataccaagtcaaatcgctggttaagcactgctttgcttgattttacgccaaataaattaaacacttatgaaaaacattgtatttgtgaaaataaaaatgttcaaattcaagataaaattttaaaaatcatacaagttttaaaagataataaaatcgaaagccgtccactttggaaaccaatgcatttacaagaactttacaaaggatgtgatgcatatttaaatggcaatagtgagtttttctttagcaatggaatttgtcttccaagcgcaactactatgagtaaagctgatgtagaggaagtttctactttaatcttaaacaccttaaaggactaa

SEQ ID NO: 43458 - protein, 386 aa, Campylobacter lari RM2100
MRFFLSAPHMSGKELEYIHKAFESNYIAPLGEFVNALEQSIKDYTKSSNALALNAATAAIHLALRVLGIKEGDVVLASSFTFIASVAPISYMNATPVFIDCDETYNLDVNLLKKAIKESPKKPKALILTHLYGNASKMDEIVQICKENEIFLIEDAAEALGSFYKNKALGTFGDFGVYSFNGNKIITTGGGGMLVSENHANLEKARFYSTQARENCLHYEHKEYGYNYRMSNILGAIGTAQMEVLDQRVEKKRQIYDWYKEFLSKSFTFLDELENTKSNRWLSTALLDFTPNKLNTYEKHCICENKNVQIQDKILKIIQVLKDNKIESRPLWKPMHLQELYKGCDAYLNGNSEFFFSNGICLPSATTMSKADVEEVSTLILNTLKD

SEQ ID NO: 43459 - DNA, 1314 bp, Vibrio anguillarum
  CDS (1)..(1314)
atgtcaaaagaacaattaagaagtcaaattgcagaattagtagcacaatatgcggtcattgaatacgcgcctaagatgtttatcggaggagaaagcgttgttccgccatcgggtaaagttcttggagcaaaagaactacaacttatggtagatgcttctcttgatggatggttaactactggtcgctttaatgatgcttttgaaaaacgcttaggtgagtacctcggtgttccatttgtgttgactaccacttcaggttcctctgctaacctattagcactgacaacgttaacttctccaaaacttggtgatcgtcaattgaaaccgggtgatgaagtgatcactgtagctgcaggttttccaacgacagttaaccctacgatacaaaacggtttaattcccgtatttgtggatgttgatattccaacttatcaaatcaagccagaaatgattgaagctgctgtatctgaaaaaactaaagcaataatggttgcacatacattaggcaatacgtttgaccttaccgaagctcgaagagttgctgataagtacaacctttggttaattgaagactgttgtgatgcactaggttcaacttacaatggcaaaatggttggtaccattggtgatattgctacagtaagtttctatccagctcatcatattacaatgggtgagggcggtgcagtattcacaaaagataaagaactacgtaaacttattgaatctttcagagactggggacgtgattgttattgtgctcctggttgtgacaatacttgtggaaaacgcttcgaccaacaactaggatctttacctcaaggatatgaccataaatatacttattctcatctaggatataatttaaaaattacagatatgcaagctgcttgtggtctggctcaaatggatcgcgttgaagagtttgttcaagcgcgtaaagaaaacttcgcctaccttaaaaatgggttagcttcatgcgaagagttcattatcttaccagaggcgacagaaaattcagaaccatcttggtttggtttccccattacaataaaagatgattctggcattagccgtgtagatttgttgaaatttatggatcagcacaaaataggtacacgcttgttatttgctggtaatttgacacgtcaaccatattttgagcatgtaaaatatagagtagtgggtgaactcactaatactgatttaatcatgaataatacgttttggattggtgtatacccagggttaactctagctcatttagattttgtgcttgaaaaatttgaagagttctttggagtaaatttttaa

SEQ ID NO: 43460 - protein, 437 aa, Vibrio anguillarum
MSKEQLRSQIAELVAQYAVIEYAPKMFIGGESVVPPSGKVLGAKELQLMVDASLDGWLTTGRFNDAFEKRLGEYLGVPFVLTTTSGSSANLLALTTLTSPKLGDRQLKPGDEVITVAAGFPTTVNPTIQNGLIPVFVDVDIPTYQIKPEMIEAAVSEKTKAIMVAHTLGNTFDLTEARRVADKYNLWLIEDCCDALGSTYNGKMVGTIGDIATVSFYPAHHITMGEGGAVFTKDKELRKLIESFRDWGRDCYCAPGCDNTCGKRFDQQLGSLPQGYDHKYTYSHLGYNLKITDMQAACGLAQMDRVEEFVQARKENFAYLKNGLASCEEFIILPEATENSEPSWFGFPITIKDDSGISRVDLLKFMDQHKIGTRLLFAGNLTRQPYFEHVKYRVVGELTNTDLIMNNTFWIGVYPGLTLAHLDFVLEKFEEFFGVNF

SEQ ID NO: 43461 - DNA, 1110 bp, Vibrio anguillarum
  CDS (1)..(1110)
atgataaatgagatgatacttacggctgggccaagtattaccgaaaaagagatcagttatgttaccgatgctgtaaaaaatggatggaataacaattggaataactacctactaaagtttgaaaaatcattggcggattatgttggagttaaacatagtttatcgacatctagtgcaacaggtgcattacatttatctatgcttgcatgtggcattggacctggggatgaggttattgttccggagataagttgggtagcctcggcttccgcagtggcttatgtcggtgcaactcctgttttttgtgatatagatccagtaagttggtgtttggatattgaatcagctgcaagattattaacgcctaaaacaaaggctatccttccggttcatatatatggccatccagccaatatgcctgcaatcatggaatttgcgagagctaataatattttgataatcgaagatgcggctccttctattggtgctgaggttgatggtaagaaaacaggtagctttggtgatgctgctgctttcagttttcaaggagctaaaatactatctacaggcgaggggggcatgttcgtttctaataacgatgaaatatttaatagagttaagtcattgaatgatcatgggcgtgatcctagtcaaccatttgcttctgttgaggttggttataagtataaaatgtctaatttacaagctgcaatgggcttggcccagatagagcgtgtagaggagcttgttaataaaaaacgtgaaattaattccatataccaagagcttctaaaagattgcactgcagtcaaggtaacgaccgagctgcctgattgtaaaagtattcactggatgacatcagtggagctacttggttttgattatgataaacgccagagatttatgggtaaacttagagaaaacttagttgattcacgtccagtattttcaccgttgagttctttacctatgtttgaaccacgagtaaaaaatccggttgctctacgtattggtcaaagtgcaatcaacttaccgagtgggcacaatttaatattagaacaacttgaacatgttgcaacaacgattaaaaaaactcgtatagcaatctag

SEQ ID NO: 43462 - protein, 369 aa, Vibrio anguillarum
MINEMILTAGPSITEKEISYVTDAVKNGWNNNWNNYLLKFEKSLADYVGVKHSLSTSSATGALHLSMLACGIGPGDEVIVPEISWVASASAVAYVGATPVFCDIDPVSWCLDIESAARLLTPKTKAILPVHIYGHPANMPAIMEFARANNILIIEDAAPSIGAEVDGKKTGSFGDAAAFSFQGAKILSTGEGGMFVSNNDEIFNRVKSLNDHGRDPSQPFASVEVGYKYKMSNLQAAMGLAQIERVEELVNKKREINSIYQELLKDCTAVKVTTELPDCKSIHWMTSVELLGFDYDKRQRFMGKLRENLVDSRPVFSPLSSLPMFEPRVKNPVALRIGQSAINLPSGHNLILEQLEHVATTIKKTRIAI

SEQ ID NO: 43463 - DNA, 1116 bp, Vibrio anguillarum
  CDS (1)..(1116)
atgatatcctttttagacttaaagaaacttaatgctcaatacgaacaagagctaaaagatgcatgcactcgagttatagattctggttggtatatacttggtaatgaagtttcagaatttgagaaagagtttgctgcatattgtaatgttgaacactgtttaggtgttgctaacggcttagatgctttgatacttatactacgcgcttacattgaactaggagttatgtctaaaggtgacgaggttattgttccgtcaaacacctatattgcatctatactcgcaatatctgaagcggggttagttccagtacttgttgagccttgcgaagtaactttcaatctagaccctaatttaatcgaactagcagttactactcgaacaaaagcaattctaaccgttcatttatacggacaggtttctggtatggatcaaatccaaaagattgctcgaaaacataatttaaaggtaatagaagattgcgcacaagctcacggagcgttgtatgattcgaaagaaggaatcaagaaggttggttccattggtgatgctgctggttttagtttttatccaggaaaaaatcttggagcacttggagatgctggtgcggttacaactaatgacccagagcttgccagtactatctcggcactccgtaactacggttcacatgaaaaataccgaaatatatttaaggggttgaatagtcgattagatgaaatacaagcggcgatgcttagagtcaaactacgctatttagatgacgaaatatctctacgacgcaaagttgcaagccgttacttaaatgaagtaagaaatcctctaatcaaggtacctttagtcgaagatgataatgcgcatgtatggcacctttttgtggtagtggtcgaggatagagataaattagtcgaacatctgagtgaaaaccaaattcagtcattaatacattacccaattccaccacacaagcaagaggcttatatggagtggaataacagtgcctttccgttatcagagaaaatgcataagcaagttttaagtcttccactaagctctgttttggataaaagtgaaattgacaaagttatagatgtattgaactcttttcttggttaa

SEQ ID NO: 43464 - protein, 371 aa, Vibrio anguillarum
MISFLDLKKLNAQYEQELKDACTRVIDSGWYILGNEVSEFEKEFAAYCNVEHCLGVANGLDALILILRAYIELGVMSKGDEVIVPSNTYIASILAISEAGLVPVLVEPCEVTFNLDPNLIELAVTTRTKAILTVHLYGQVSGMDQIQKIARKHNLKVIEDCAQAHGALYDSKEGIKKVGSIGDAAGFSFYPGKNLGALGDAGAVTTNDPELASTISALRNYGSHEKYRNIFKGLNSRLDEIQAAMLRVKLRYLDDEISLRRKVASRYLNEVRNPLIKVPLVEDDNAHVWHLFVVVVEDRDKLVEHLSENQIQSLIHYPIPPHKQEAYMEWNNSAFPLSEKMHKQVLSLPLSSVLDKSEIDKVIDVLNSFLG

SEQ ID NO: 43465 - DNA, 1158 bp, Salmonella typhimurium
  CDS (1)..(1158)
atggctgaaggaaaaatgatgtcggactttttgcctttctcccgtccggcgatgggcgcggaagagcttgctgccgttaagaccgtactggactcaggttggataacaaccggcccgaaaaatcaggaactggaagcggcgttttgtcggctaactggcaatcaatatgccgttgccgtcagttcagccactgccggtatgcacatcgcgttgatggcgctgggcattggtgaaggcgacgaggtcattacaccgtcaatgacgtgggtttctacgctaaatatgatcgttttactcggcgcgaaccccgtcatggtcgatgtcgatcgcgatacgctgatggtcacgcctgaacatatcgaagccgcgattacgccacaaaccaaagcaattatccccgtccactacgctggcgcgcccgccgatctggacgctatttacgctcttggcgagcgttatggcattccagtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcgggggacgcgcgccacaagcggaagtcctggcgccgggctacaaatataatttgcccgacctcaacgccgctatcgcgcttgcccagttacagaaactggatgcgcttaacgctcgacgcgccgccatcgcagcgcagtaccaccaggcaatggcagacctgccttttcagcctgtgagccttccgtcgtgggagcatattcacgcctggcatttattcattatccgggtcgatgaagcccgctgcggtattacccgggatgctctgatggcatcgctgaagacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgagtcattaccgcccttcatcagatagcaggacaataa

SEQ ID NO: 43466 - protein, 385 aa, Salmonella typhimurium
MAEGKMMSDFLPFSRPAMGAEELAAVKTVLDSGWITTGPKNQELEAAFCRLTGNQYAVAVSSATAGMHIALMALGIGEGDEVITPSMTWVSTLNMIVLLGANPVMVDVDRDTLMVTPEHIEAAITPQTKAIIPVHYAGAPADLDAIYALGERYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDLNAAIALAQLQKLDALNARRAAIAAQYHQAMADLPFQPVSLPSWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 43467 - DNA, 1167 bp, Amycolatopsis mediterranei
  CDS (1)..(1167)
atgaacgcgcgaaaggcaccggaattccctgcgtggccgcagtacgacgacgccgagcggaacggcttggtccgcgcgctcgaacagggtcagtggtggcgcatgggcggggacgaggtgaactccttcgagcgcgagttcgccgcccaccacggcgccgcgcacgcgctggcggtcaccaacggcacgcacgcgctggaactcgccctgcaggtcatgggcgtcggcccgggcaccgaggtcatcgtgccggccttcaccttcatctcctcgtcccaggcggcccagcggctcggcgcggtcaccgtcccggtcgacgtcgacgcggccacctacaacctcgacccggaggccgtcgcggccgccgtcaccccgcgcaccaaggtgatcatgccggtgcacatggccgggctgatggccgacatggacgcgctggcgaagatctccgccgacacgggcgtcccgctgctgcaggacgccgcgcacgcgcacggcgcccgctggcagggcaagcgcgtcggcgagctggacagcatcgccacgttcagcttccagaacggcaagctgatgacggcgggcgagggcggcgcggtcgtcttccccgacggcgagaccgaaaagtacgagaccgccttcctccggcacagctgcggccgtccccgcgacgaccgccgctacttccacaagatcgccggctcgaacatgcggctcaacgagttctccgcgtccgtgctgcgcgcgcagctggcccgcctcgacgagcagatcgccgtgcgcgacgagccgtggaccctgctgtcccggctgctcggcgcgatcgacggcgtcgtgccccagggcggcgacgtgcgcgccgaccgcaactcccactacatggccatgttccgcatccccgggctcaccgaggaacggcgcaacgccctggtcgaccggctcgtcgaggccggcctgcccgccttcgccgcgttccgcgcgatctaccgcaccgacgccttctgggagctcggcgcccccgacgagagcgtggacgcgatcgcccggcgctgcccgaacacggacgcgatcagcagcgactgcgtctggctgcaccaccgggtcctgctggccggcgagccggagctgcacgcgaccgccgaaatcatcgccgacgccgtgggccgggcatga

SEQ ID NO: 43468 - protein, 388 aa, Amycolatopsis mediterranei
MNARKAPEFPAWPQYDDAERNGLVRALEQGQWWRMGGDEVNSFEREFAAHHGAAHALAVTNGTHALELALQVMGVGPGTEVIVPAFTFISSSQAAQRLGAVTVPVDVDAATYNLDPEAVAAAVTPRTKVIMPVHMAGLMADMDALAKISADTGVPLLQDAAHAHGARWQGKRVGELDSIATFSFQNGKLMTAGEGGAVVFPDGETEKYETAFLRHSCGRPRDDRRYFHKIAGSNMRLNEFSASVLRAQLARLDEQIAVRDEPWTLLSRLLGAIDGVVPQGGDVRADRNSHYMAMFRIPGLTEERRNALVDRLVEAGLPAFAAFRAIYRTDAFWELGAPDESVDAIARRCPNTDAISSDCVWLHHRVLLAGEPELHATAEIIADAVGRA

SEQ ID NO: 43469 - DNA, 1104 bp, Brucella melitensis
  CDS (1)..(1104)
atggatataccagtttactctccctatctctgtgggaatttcaaaaagtatgtgaacgaatgccttgatacagggtggatctcgtcgaggggtgaattcatatctcgctttgaagatgcatttgcacaatatgtcgatgttccgtctgcggcttcagttgcaaacggaacggtggcactacatctcgctctagatgctctgggcatcggggcgggcgatgaagtcattgtaccgacctttacctatatcgcttcagttaacactatcttgcaaaccggggcaacaccggtttatgtggactctctcgaaaatacattgcagatagatccagagggggtgcgactggcgattacagagcgcactaaggctgtaatggttgttcatctctatgggcatccatgtgacatggattcgatccgagagatttgtgacgaaaaatcgctactgctcgtcgaagactgtgctgaaggattcggaactaaatggaaaaacagtcacgtcggcacgtttggcgacgtggcgacgtttagtttctttgggaacaagacaattacgaccggtgaaggcgggatggtgctagcgcgcaatcctcaagtcatggaaaaatgccgacatctcaaaagtcaaggtacttcgcctacacgagaatactggcatgatgcgcttgcgtataattacagaatgacaaatattcaagcagcaatcggcctgtcgcaaattgaaatggcagatgaaatactctcccttaaagccaggacagctgcctcttatgccagcaagttagctggattgccgcttcgtatgcacacccctgtgggagacgttaaacattcatattggatgtgctctattgtacttgataactcggaacacagagagccgctgcgccaacatttaagggagaatggtgtagatacacgaccgtttttcccgccagcccatcgtatgcctcacagcgcttccacaggatcttaccctgttgctgatagcttatccgctcgtgggttgaacctgccaagcttcccacacattactgatgtagaaatcagttttgtttgtgatttggtcaggagttatttttctaatcattccaaccacatttag

SEQ ID NO: 43470 - protein, 367 aa, Brucella melitensis
MDIPVYSPYLCGNFKKYVNECLDTGWISSRGEFISRFEDAFAQYVDVPSAASVANGTVALHLALDALGIGAGDEVIVPTFTYIASVNTILQTGATPVYVDSLENTLQIDPEGVRLAITERTKAVMVVHLYGHPCDMDSIREICDEKSLLLVEDCAEGFGTKWKNSHVGTFGDVATFSFFGNKTITTGEGGMVLARNPQVMEKCRHLKSQGTSPTREYWHDALAYNYRMTNIQAAIGLSQIEMADEILSLKARTAASYASKLAGLPLRMHTPVGDVKHSYWMCSIVLDNSEHREPLRQHLRENGVDTRPFFPPAHRMPHSASTGSYPVADSLSARGLNLPSFPHITDVEISFVCDLVRSYFSNHSNHI

SEQ ID NO: 43471 - DNA, 1107 bp, Streptomyces antibioticus
  CDS (1)..(1107)
atggacgttccgttcctggacctccgggccgcctacctggagctcaagcacgacatcgacgccgcgaccggccgcgtcctggactccgggcgctacctcctgggccccgaactcgccgcgttcgagacggagtgggccgcctactgcggggcccggcactgcgtggcggtgggcagcgggtgcgacgccctggaactggcgctgcgcgccatggacatcgggccgggtgacgaggtgatcgtcccggcgcacaccttcgccgcgacctggctcgccgtctcggcgacgggtgcggagcccgtcgcggtggaaccggagcctgcgacgttcaccctggacccggagcgcgtcgaggctgcgatcacctcccgcacccgggtgatcctcccggtgcacctgtacgggcatccggcggacctggcggcgttgtccgaggtcgccgagcggcacggcgtgcggatcctggaggacgccgcccaggcgcacggtgcgcaggcgtacggccggcgggtgggcgcgtggtccaccaccgccttcagcttctacccgggcaagaacctgggcggcttcggtgacggcggcgccgtggtgacggacgacgcggagctggcggagcgggtgcggctgctgcgcaactacgggtcgcgggagaagtaccggcacgaggtccgggccaccaacttccggctggacgagctgcaagcggccgttctgcgggtcaagctcgcccacctggacgcctggaccgagcgccgggccgcggtggcggcgcgctatctcgacgggctcgccggcctggacgggatcgtgctgccgaggccggcgccgtgggcggaccccgtgtggcacctgttcgtgattcgttccgcggaccggtccgcgctgcgggagcggctggcggcagccggcgtcgagacgctgatccactacccggtgccggtgcaccggtcggaggcgtacgccggcagccggcaggccgcccgcgcacagcccgtggcggagcggctcgcccgggaggtgctgagcctgcccataggcccgcacctgtccgacgacgccgtcaaggcggtgatcgaggcggtacggggcgcggtggccgcctgctga

SEQ ID NO: 43472 - protein, 368 aa, Streptomyces antibioticus
MDVPFLDLRAAYLELKHDIDAATGRVLDSGRYLLGPELAAFETEWAAYCGARHCVAVGSGCDALELALRAMDIGPGDEVIVPAHTFAATWLAVSATGAEPVAVEPEPATFTLDPERVEAAITSRTRVILPVHLYGHPADLAALSEVAERHGVRILEDAAQAHGAQAYGRRVGAWSTTAFSFYPGKNLGGFGDGGAVVTDDAELAERVRLLRNYGSREKYRHEVRATNFRLDELQAAVLRVKLAHLDAWTERRAAVAARYLDGLAGLDGIVLPRPAPWADPVWHLFVIRSADRSALRERLAAAGVETLIHYPVPVHRSEAYAGSRQAARAQPVAERLAREVLSLPIGPHLSDDAVKAVIEAVRGAVAAC

SEQ ID NO: 43473 - DNA, 1041 bp, Caulobacter crescentus
  CDS (1)..(1041)
atggacacgacctggatctcgtcggtcggacgcttcatcgttgagttcgaaaaggccttcgccgactactgtggcgtcaagcacgcgatcgcctgcaacaacggtacgaccgccttgcacctggccctggtggcgatggggatcggacccggcgacgaggtgatcgttccgagcctgacctatatcgcctcggccaattcagtcacctattgcggcgcgacgcctgtgctggtcgacaacgatccgcggaccttcaacctggacgccgcgaagttggaggcgctgataacgccgcgcacgaaggcgatcatgcccgtgcacctctacggtcagatttgcgacatggatccgatcctcgaagttgctcgcaggcataacctgctcgtgatcgaggatgcggccgaggcggtgggcgcgacctaccggggcaagaagtcaggctcgctgggcgactgcgccaccttcagcttcttcggcaacaagatcatcaccaccggcgagggcgggatgatcaccaccaatgatgatgacctggcggccaagatgcgcttgctgcgaggccagggcatggatcccaaccgccgctactggtttccgatcgtcggcttcaattaccggatgaccaacatccaggccgcgatcggtctggcgcagctggagcgggtcgacgaacacctggccgcgcgcgaaagggtcgtgggctggtacgagcagaagctggcgcgcctgggcaatcgggtcaccaagccccatgtcgcgctgaccggtcgccacgtgttctggatgtacactgtgcgcctgggcgagggcctttccaccacgcgcgatcaggtgatcaaggatctcgacgcgttgggcattgagagccgtccggtgttccacccgatgcacatcatgccgccctatgcgcatctggccacggatgatctgaagatcgccgaagcctgcggggtcgacggcttgaacctgccgacccacgcggggctgactgaagccgatatcgaccgtgtcatcgcggcgctcgatcaggtgttggtctag

SEQ ID NO: 43474 - protein, 346 aa, Caulobacter crescentus
MDTTWISSVGRFIVEFEKAFADYCGVKHAIACNNGTTALHLALVAMGIGPGDEVIVPSLTYIASANSVTYCGATPVLVDNDPRTFNLDAAKLEALITPRTKAIMPVHLYGQICDMDPILEVARRHNLLVIEDAAEAVGATYRGKKSGSLGDCATFSFFGNKIITTGEGGMITTNDDDLAAKMRLLRGQGMDPNRRYWFPIVGFNYRMTNIQAAIGLAQLERVDEHLAARERVVGWYEQKLARLGNRVTKPHVALTGRHVFWMYTVRLGEGLSTTRDQVIKDLDALGIESRPVFHPMHIMPPYAHLATDDLKIAEACGVDGLNLPTHAGLTEADIDRVIAALDQVLV

SEQ ID NO: 43475 - DNA, 1137 bp, Streptomyces glaucescens
  CDS (1)..(1137)
ttgagctcctccgtggaattaccgaggtggccccagctctccgacgacgatgtcgaggcggccgtcgccgcattgcgcgccaaccgcctggtggggctgggcaatccggtcgtcgagcaattcgaatcggccctcgccgagagccaggccgtcgagcacgcggtcgccgtgtccaccggcactgcggcggtccacctcgccctgcacgccctcgatgtcggtccgggtgacgaggtgatcgtccccgcccacaccttcatcggctcggcgagccccatcgcctacctcggggcccgcccggtcttcgccgacgtcacccccgacacccactgcctggaccccgactcggtgaagtccctgatcaccgagcggaccaaggcgatcgtcgtcgtccacatcaacggcgtggccgcggacatggcgtcgctgtccgcgatcgccacggacgccggcgtcccgctcgtcgaggacatggctcaggcgctgggcaccagcatcggcggccgtccggtgggcggcttcggtgacctggcgtgcgtcagcctgttcgagcagaaggtgatcacctccggcggcgagggcggtgccgtcctgacgaacaaccccggctacgccgagcgcgtccgccggctgcgcagccacggcgagggtcccatcgccgaccgtcccggcctgatctgggcgtacgaggtcggctacaactaccggctgaccgcggtgcaggcggcggtcggcctcagccagcacgggcggctgggcgagatggtggaggcacgccggcgcaacgccgcgtacctgtccgagcggctggccgacgtcgagggcctggagctgccggtcgaaccggagggcaccgtgcacgccttctggaagtacgtggtgcgggcggtgccggccggtggccggccgacggccgccgagatcgccgcgaccctgcgctcgcgcggtgtcccggtcctgctgcgctatccgttcccgctgcacaagcagcccgccttcgccgagcaccagtcggtgtcgctgccggtcgcggagcggctgtcgcaggagctgctggcgcttccgtcgcaccccgcgctcaccgaacggcacctcgatcacgtggcggccgaggtccgcaaggcgttcaccgggtga

SEQ ID NO: 43476 - protein, 378 aa, Streptomyces glaucescens
MSSSVELPRWPQLSDDDVEAAVAALRANRLVGLGNPVVEQFESALAESQAVEHAVAVSTGTAAVHLALHALDVGPGDEVIVPAHTFIGSASPIAYLGARPVFADVTPDTHCLDPDSVKSLITERTKAIVVVHINGVAADMASLSAIATDAGVPLVEDMAQALGTSIGGRPVGGFGDLACVSLFEQKVITSGGEGGAVLTNNPGYAERVRRLRSHGEGPIADRPGLIWAYEVGYNYRLTAVQAAVGLSQHGRLGEMVEARRRNAAYLSERLADVEGLELPVEPEGTVHAFWKYVVRAVPAGGRPTAAEIAATLRSRGVPVLLRYPFPLHKQPAFAEHQSVSLPVAERLSQELLALPSHPALTERHLDHVAAEVRKAFTG
